United States Patent 6,605,709 (NUCLEIC ACID AND AMINO ACID SEQUENCES RELATING TO PROTEUS MIRABILIS FOR DIAGNOSTICS AND THERAPEUTICS) - sequence listing, part 2

SEQ ID NO: 1976 - DNA, 1920 bp, Proteus mirabilis
gtattacagagtcattatctaattatcgtcaaggtcgagattatgaatgtaaaagagatcattcgtcatgaaccatttggaacattactcggttatgcacctggtggtgttgcgatttactcttcagattacagcagtatagataaagaagattatgccgccaatgattcattccgtagttatattggtaatgagtatatggggcataagtggcaatgtgttgaatttgcacgccgttttctctatttacattacggggttgtttttactgatgtgggaatggcctatgagatcttctcgttacgtttcttacgaagaacgattgatgacgatattttacccttgcaagcttttgcaaatggcagcaaacagccaccgacggtaggagcgttgcttatttggcaagaagggggagagtttaaagtcaccggtcatgtggcggttattaccgaagtattagaagataaaatccgtattgcagaacaaaatgtgatccacactaggttaccgcgaggtcaacaatggacacgagagttaccacttaaagtgagtgataatggctattttatcgaagatacctttgataataccaccttgctaggttggatgatccaaacagaacctaatgcctacagtttacctcaacctaaagttgcccctgaattgttagctattcatgaggccaaattagccaacaaggggcaatttgctggaaaatggctagatgaaagcgatccgttagaaaaagcctatgtgctagcacagcacggtcatacgattaatcaagacagctatgaatatttcaccatttcagaaagtgctgagcatgaacttatacgtgctagcaatgaaatgcatttgatgtatctgcatgcaacggaaaaagtgctgaaagacgataatttactgcgtttatttgcgatccctgaagtgttatggccccgtatccgcctatcatggcaaaatagacgtcatcaaatgatcactggacggttagatttttgtatggatgagcgcggtatcaaggtgtatgaatataacgctgattctgcatcttgccatactgaagccggattaattattgaaaaatgggctaaacagggtggcattaaagcaggttataacccgggtgaacgtctattagatgcgttatcagatgcttggaaacacagtgatgcgaagccatttgtacatattcttcaagatgatgataatgaagaagattatcatgctcgctttatgcaacaagcactgactaaagccggttatagcagcaaaattctgcgtggactaaaagagctgcattggaatagtcgtggtcagttaattgatggtgataaacgtattgttgaatgtgtatggaaaacatgggcttgggaaaccgcgttagatcaactaagagaagagagtgaacaacagtcacttattcctattcgtattggtgatccggcgggagaagttcgtttagttgatgttcttttacgccctgaaatcacggtttttgaacctctttggacacttattccaagtaataaagcgatattacctattttgtggcaacttttcccagataatccttatctacttgatactgagttcactttaaccccacgtttgtcgcagagtggttatgcagttaagcctattgctgggcgctgtggtagtaatattggtttagttgatcaccaagaaaatgtattaggtgaaaccagtggtcaatttgaacatcaagaaaatatttatcaagagttatggtgtttaccaaaagtgtctaaccgatatattcaggtttgtacctttacggtagatggacattatggtggttgttgcttacgctctgatccgacattagtgataaaaaaagacagtgatattgagccattaattgtccttgaagataaacactttttagcggattaa

SEQ ID NO: 1977 - DNA, 1503 bp, Proteus mirabilis
caacataagaggatccatcgcatcactatgaaacaaagtctgcaacttcgtcttagtcagcaattggccatgacgccacagctccaacaggctattcgtttgttgcaactttctacgcttgaattacaacaagaaattcaacaagcccttgaatctaacccattgcttgaacaagaagacgatcaagcggatgtaacgcattctgatagctcatcaacacaagagagtgatgatagtacaccagacaatgagcgtgataatgaggtattagataccctagatgcactagagcaaaaggagatgcctgacgatcttcctctcgatacccaatgggaagaaatttacaccgcaggcaccccttcaggcaccagtaatgattatgcggctgatgaattaccactctatcaaggtgaaaccacggcttcactgcaagattacctaacttggcaagctgacctaacaccttttactgatactgatcgtgctatcgcgacaagcattattgatgctgtcgatgaaacaggatatttaacagtttcaacagatgacattcttgccggaatgggtgatgatgagttagagcttgatgagattgaagcggtattaaagcgtattcaacgctttgatcccgtaggtgtcgctgccagagacttaaaagagtgtctgttaattcaattgtcgacatttccaactaatacaccttatttgaaagagactgaacttgttattgagcactatttagcgttattaggtaatcgtgattttcgccaattaatgcgtcacactaagctacgtgaagagacattaaaagtagtgattgagaccattcaatctcttgatccaaaaccgggtttaagtattgatacagaggaatcacagtatgttattcctgatgtactggtaaaaaaatcaggagaacactggcaagttgagttaaatacggatagcattccccgcctacgcataaatgagacttatgcagcgcttgggcaatcagctcaaaacgaaagcgatgggaaatttattcgtgacaatttacaagaggctaaatggctgataaaaagcttagaaagccgtaatgagacattattaaaagtcgctcattgcattgttgacacacagcaggcgtttttcgaattcggtgaagagcatatgaaaccccttgttttggccgatattgcagaacaggttgagatgcacgagtccaccatttctcgcgttacaacgcaaaaatatttgcattgtcctcggggaattttcgaattgaagtattttttctcaagccacgtaaatactgataacggaggtgaagcctcttcaacagcaattcgggctttagtgaagaaactaatcgcagcagaaaacccagcgaaaccactaagtgatagtaaactggcaaatatgctcgccgagcttggtatacaggttgctcgacgaactgttgcgaaatatagagagtcattatccatcccgccttcaaatcaacgtaaagagttggtttga

SEQ ID NO: 1978 - DNA, 1038 bp, Proteus mirabilis
ataagaaagagagtaaaaggccaactgatgcgtaatttgacagcttctattatattggcaatcggtctgacaggctctgcttttgcggatacgacaccggctaagcaaactgagcaacctgcgactacggccacttcttcaaccgcttctacacagggaacggcgactacaacgattgcaccaacagcagaaaatacggcaacgccaacgggggaagcagccaaaacggcaacttctgaaacaccagtggcagaagagaatacatcgacgagtacaggagatgctgcacagacagctctagagccagaaaatgccacgcaaggtgcgacacctgaaatcgtcactggagggggatttgctgaagatctctctgttatgggaatgtatcgcaatgcagatctcgtggtaaaaagtgtcatgatcggtttgctactcgcctctattgtcacttgggcgctgttctttgctaaaggtagctacttattagcattacgtcgtcgtttaagaaatgaaagtgcgcaattagtagaagcgaaatccctcaaagaggcattagcgattagccaaaaatttggcaataaaagtgcgacagccgacttttttaatgatgctgaattagagcgtacttactctcaagagagtcacgttgcatcaggtattaaagagcgtgttgagatgcgcatggagcgtcgtgtcgccgctattattcgtgaattaggacgtggtaatggttatttagcgaccattggggcaatttctccttttatcggtttgtttggtacggtttgggggatcatgaatagttttattggtattgcgcattctcaaactaccaacttagcggtggttgcccccggtatcgcagaagcattattagcaaccgccatcggcttgattgcagctatccctgcggtcattatttacaatatttttgcacgtatgatttccggttatcgtggtgaaattggcgatattgcaacaggtgtagtgaccttagtcagtcgtgacttagatattgaaaacagcaaatcaaggtaa

SEQ ID NO: 1979 - DNA, 1203 bp, Proteus mirabilis
atagtcaggagtcagaatatgtgtagcacttgcggttgtggtgaaggtaatgtcagcattgaaggtgtagcgcctcattcacacgatcaccaccatcactctcacgaccatgatcatcacgaccatggccatcaccatcacggtcatcaccatcatcatgggcatgatcatcatcatgaacacaatgctactccagcgaatactgttcataaatatattgataagtctgagcaaaagcataagcacaattacgaaactcatggtcagcctatcattattcatcatcaccattaccataatagtggcgatgttcatctccatttttatcatgatgcacagcaaaatgaagcccaagtgttccatgagcatcatcatgggcatgacgatcatcatgcacattctcatgaacatactcatagccatgaacatgaacatagccatgatcacgaacatagccatgaacacgaagaacaatttagtccagttattgataatgacaacatgcattatgggcaaggggaagctggtactcatgctcccggaattagccaaaaacgaatgttaaaaattgagatggatgtactggataaaaataatcgaattgccgttcataatcgtgaacattttgcccagcaaaatgtattggcgctgaatttagtttcaagtcccggctccggtaaaacaacgttgctaactcaaacgttaaaacagctaacgcaacgtgtaccttgtgcggtgattgaaggtgatcagcaaacgacgaatgatgctgatcgtattcgtgaaaccggggttgctgctattcaagtcaatacgggtaaaggttgtcaccttgatgcacaaatggtgcatgatgctacccatcaattaggtttaaaagacaacagtattctctttattgaaaatgttggcaatctggtttgccctgccagttttgatctgggtgaaaaacataaagtggctatcctttcggtaacggaaggggaagataaaccattaaaatatccgcatatgtttgccgctgcagatctgatgattatcaataaaattgatttagtgccacatcttaatattgatgtgcaagcgtgcattgaatcagcgcgtcgcgttaatcctaatattgagatcattgcattatctgcgacaactggcgaaggtatggaagagtggttagcttggttggagagccgtttatgtgcttag

SEQ ID NO: 1980 - DNA, 282 bp, Proteus mirabilis
aatatatttgggagttggaacttggctaatatcaaatcagctaagaaacgtgcggttcagtctgaaaagcgtcgtcagcacaacgcaagccgtcgttcaatgatgcgtacttacatcaaaaaagtatacgcagcagttgcttctggtgataaagaagcagcacaaaaagcatttaatgacatgcaaccaattgttgaccgtcaggcaactaaaggcttaattcataagaataaagcagcacgtcataaagctaatctgcaagcacaaatcaaagcaatgtaa

SEQ ID NO: 1981 - DNA, 948 bp, Proteus mirabilis
aaaatgtttggatcttctaacgtgattttgagaaataagcgcttatccagttatcaattagcacgacttcacacttttgaagcaacaggacggcatttatcattcgctttagccgcagaggaattgtccttgacgcctagcgcgattagccatcgtattaatacactagagaaagaattagggataaagctatttaatcgctttcatcggcgtattgaattaaccgaagaaggtgaacgtatttattgggcattgaaaaaaacacttgaagatattaatcaagagattttagatatctataatcaagaaatatctggcgtattaacggtgtattctcgcccttctattgcgcaatgttggcttgtacctcgtatttctgattttactcaacgctatccttctattgaattaaacttacttactggcaatgacgatattaattttcgtggttatggtatcgatctcgctatctatttcgatgataaacacctgaaaaatctctattgtgaagatttaatctcagaatcaattattcctgtttgtagccctgaatatgctgctcgccatgaattagtaggcaatatccatcatcttgctaattgtactttgttacatgatagacaagcttggagtaataactctgattttgatgaatggcgtgcttggagtgaatatatgggattaggattatttccaaataaaagtaatatttgttttgatcgctctgatttagctgttattgctgccgttaatcattccggtgtcgcaatggggcgtaaacgcttaattcaaaaacaactcgcaaataatgaattaatagtcccttttgataattgtgagtttttttgtgcacaacgctattatctggttacccgcgatgaaaagagtaacgctaaagtacagctttttattcaatggctgaaaaaacagatcttacaagggatgtga

SEQ ID NO: 1982 - DNA, 2835 bp, Proteus mirabilis
cggaaacttggaactgagaatcgaatgagtgactataaaaataccctgaacttaccagaaacagggttccctatgcgcggggatttagcaaagcgcgaaccagaaatgttatcacgttggtacaaagaaggtttgtatcaagctattcgtcaagctaaaagtggtaagaaaacatttattttgcatgatggccctccttatgccaacggcaatattcatattggtcactcagtaaacaaaattctcaaagatattattattaaatccaaagggctgtcaggctttgattctccgtacattccaggatgggattgtcacggattacctattgaattaaaagttgaacaaattgtaggtaaaccaggagaaaaagtctctgcagctcaattccgcgaggagtgccgtaaatatgcttatgagcaaatagaggcgcagaaaaaagattttattcgtttaggtgtgctaggagattgggacaaaccttatctcactatggactacaaaacggaagccaatactattcgtgcattagcgcgtattatcgctaatggtcacctattaaaaggggcaaaacctgttcactggtgtacggcttgtggttcatcgctagctgaagcggaagtggaatattacgataaaacctctccttctatcgatgtgcgtttccgtgcagttgattcaaacgctgtagcggctaaatttggtgtcgttactgataaacctatttctttagttatttggactaccacaccatggacattacctgctaaccgtgcaattgcattaaatggcgaatttaattacgcattagtttcatttaatgatgagtgcgtcattttagcggcagacttagttgaacacgttatgaaacgtatcggtgtcacagactgggctgttttaggtgaatgtaaaggtagtgatttagaattattgcgcttcaatcacccatttatgggttttgatgtgccagccattttaggcgatcacgttacattagatgccggtacgggggctgttcataccgcaccgggtcatggtcctgatgactttgttattggtcaaaaatatggtttagaagtggctaatccggttggacctaatggttgttatcttcctaatacgtatccgaccttagatggtgtgtttgtttttaaagctaatgatgtgattgttgagttactaaaagaaaagggtgctctattacatcatgaagcaatgcaacatagttatccttgctgttggcgacataaaacaccggttatcttccgtgccactccacaatggtttatcggtatggataaaaatggattacgtcaacaatccttaaaagagatcaaaggtgttaaatggatccctgattggggccaagcacgtattgagtcaatggtggaaaaccgtcctgactggtgtatttctcgtcagcgtacttggggaacaccaatgtcgctgtttgtgcataaagaaacacaagagcctcatcctcgtactctagagttaatggaagaagtcgctaagcgtgtagaagtgagtggtattcaagcttggtgggacttagatatccgcgaactgctgggtgatgaagctgatgactacatgaaaacacctgacacacttgatgtttggtttgattcaggatcaacacactcaaccgtagttgatgctcgccctgaattccatggcaattcagctgatctctatttagaaggttcagaccaacatcgtggttggtttatgtcttctcttatgatttcaacagcaattaaaggcaaagcgccttatcgtgaagtattaacacacggttttaccgtggatggacaaggccgtaaaatgtcgaaatccattggtaatactgttagccctcaagatgtaatgaacaaactgggtgcggatattttacgtttatgggttgcctccaccgattatacgggtgaaattgcggtttccgatgagatcttaaaacgttctgctgatacttatcgtcgtattcgtaatacagcgcgtttcttcttagcgaacttaaatggttttgatccggctaaacatcaagttaaacctgaagagatggtaatacttgatcgttgggcggtcggtcgtgcgaaagcggcacaggaagatatcctcaaacactatgaaaactacgatttccataatgttattcagcgtcttatgcagttctgctcagtagaaatgggatctttctatctagatatcattaaagacagacaatacactgcgaaaagcgacagtgttgctcgccgtagttgtcaaactgcgctataccatattatcgaagcattagtacgttggatggcaccaattatgtcgttcaccgcggatgagatttgggcacagttaccgggtgagcgtgcgaaatttgttttcactcaagaatggtacacagatttatttggtttagaggcatctgaaaccttaaatgatgagtactgggcggaattattagccgttcgtagtgaagtcaataaggtgttagagcaagctcgtaccgataagcaactacgtggctctttagaagcggcagtaacactgtatgcggataaagccttagcggaaaaactgaatgcattaggaaacgaattgcgttttgttttacttacctctcaagcgaccgttgctgatattcatgatgcgccagaaaacgcgttagcatctgatatggcggggctgaaaattgtcttgagtaaagcgcaaggtgaaaaatgtccacgttgctggcactatgcaactgacattggtcaagtggcggaacacgctgatttatgtggtcgctgtgttactaacgtagccggtaacggtgaagaacgtaagtttgcttaa

SEQ ID NO: 1983 - DNA, 1770 bp, Proteus mirabilis
aacatcactgggtacagtatgctttcctcaatttttgtgcgttttaaaacaggtttatcctatactgcaatactttctgccttgattatgtcaggttgtaccctgacggggcaacaacaacagccactgacacctgctgaaaaagcgcaagtggaaatgaaacaatttcagaaagtcattgatgatgcgaacggacaagcctctttagatgtgatccgtgcctatattggcctagaaccccttatcactgatcctgtattacatcagcaaaatattgatgatacttggttaacactcacgaagcttacacctgaacaacgtcgtagtgtggtaatcaaagctgatgaaaatacattacaaggctggttagatttactcaacacttatgaatataaccaagatgatgcgggtaaattatcccaagcaatacgcgaatggcaaacacgctatccacgcaatccaggagcgctaacattaccgacgctgttattgcgccaatcacaatctgccgtcagtaacagcggaaaaatcgcattattattaccgttaacaggacaagctaaagtgtttggtaatgctattatgcaaggctttaccgatgctaaagaaggtttacctcaagctaacgcagcgccagaagccccccaacaagatagtttagcttccattttagcagaattaggtatttcatctccgaatgcagacacagcaacaacggaaaacgataatacagcggaaggcgctgaaaatagtgatgctacttcagcaaaagaaaccgaagcctttgcgggtaatagccgcgtgcaattagatcctattgtccaaaataatcgccaagtgattatgtatgataccaatagccaacccattgatctgttactgaaacaagtgcaacaagagggtgctgatttaattgtggggccactattaaaacccgaagtgatcaaaactattgaattaaaaagtggtttacctgttttagcactaaatgaagttgataatattcctctggctactacagtgtgtttcttttcactttccccagaagatgaaactcgtaatgcggctcaacacttacgccagcaacaaaaatctaatccacttattatcgttcctgacaataaattcggtcaaagaatggcacaaacttttgcggatgagtggcagcgtagcgggggtggaaccgtcttacaacaaactttcggctctcttgatagtctaaaaagttcaattaatcgtggcgtgggtattcgaatgacaggaacccctgtattgccaacagacaatgcaccactgccattagataccgcttcaatgccaacaacaaacggtgctattgattctgtgtatatcattgccactagcgatgagttaacattgattaaaccaatgattgatatggcaatcagtaccaaaaaacgcccaccgatttatgtcagttcacgcagtaatcaagggggaatggggccagattttcgtatggaaatggacggtatccaatttagtgatattcctcttatgacgggagcaaatttaccgttaatgcaaaaagcatccagtaaatttgcgaacgattactcattaatgcgcctttacgctatgggtattgatgcatggtcattagcaaacaattacaatgaactcaccaaaggaaccttacagttcaatggtgtttctggctctttacgtgtggaagataattgcactatttatcgacaactcccatggatgcaatttaaacaaggtaaaattgaacctgtgggacaataa

SEQ ID NO: 1984 - DNA, 267 bp, Proteus mirabilis
gctgactatggaaataatgtatctaaagattattgctttaagcattcaaaaaatttgtttaagttaaaaaaaacccccgcgggcgggggtgagataagcgcaattaaaagtctcaaatcaactcaggagaaaaatacctttagtgtcgattacgaacaatttggtaacggcgcgttagatactcaattggcacgctccaaatatgaactaaacggcagaatgggaacaataaaaaaatcgtcatacctaggaatatgtgcaatttaa

SEQ ID NO: 1985 - DNA, 1452 bp, Proteus mirabilis
catgggtatggcagcagcattatcaggcgcattaggtcgtacaatgtcaccattagcaggggcagccattgtttgtgctggtcttgccaatatcaaccctatggaaatcgcaaaacgtactgcaccgggtatgattatcggcgtcatcgctgttgcgttattcatgttataagtggagaaatgattatgtcagtttcactagaacaattaattaaatggcgtcgcgaatttcaccaataccctgaaattggctggtctgaatttttaaccactgccaaaatcgtcaaagtgctacgtggcttaggattagaagttaaagtcggccctgaagttattaaccaagactttgcttttggacgccgtcgtcaagtggttgaaaaaggattggcggtagcaagaaaacaccatgttgacgaagcactacttgatgaaatgcaagagcttacgggttgtgtcgctattttcgatagtggcaaaccagggcctactgttgcactgcgttttgatattgactgtgttggggtaacagaaacaacagagactcaacatcgtccacaggtagaaaatttcgcctcttgtcatcctggcgaaatgcatgcttgtggtcatgatggtcatattactattggtttaggggttgctcactggttagtcgacaataaagataaagtgagcggtaaagtaaaaattttattccaacccgcagaagaaggcgttcgtggtgcaagagcaatggcggaaagtggcattgctgatgatgcaaattacttcttaggctcacacttaggctttatcgccaatagtggtgaaatcgttcttaacccaacacattttttatgtaccactaaatatgatttccgttttaaaggtacgccttctcatgcgggggcagagccagagctaggtcgtaacgcattagcaggcgcttgccatgccgcaacacaaatgctggggatctctcgccatggtaaggggatgtctcgtattaatattggggtattaaaagccggtgaaggtcgtaacgtcactcctgccaatgccgaaatgcaaatcgaagtgcgtggtgaaaatgaagagatcaatagctttatggctgccaatgctgtacgtatggcagaaggtgccgcacatagcttccaattagaaatggaaagcgaagtgatgggggaagcggttgatttaaccaatgaccaagaactgattgatgtgatggccaaagtggtgggtaaacacccagaactcactgcgatcccaacccgtccattcggcggaagtgaagatgcaacagtgttagcaaaacgagtacaacgctgtggtggtaaatctctttactttattgttggtgccgatagaactgccggacatcaccaagcaggctttgattttgatgaacaacaactgatgactgcggtaaatctttacacgggttgtttagaagaattactgaaataa

SEQ ID NO: 1986 - DNA, 1050 bp, Proteus mirabilis
aaaaagtgtggtcaggcaaacagagcgcacaagccgccttggataatgcggttaaacggggaaatgaacaactacgccgatttgaacgcactcagtaaggtatttggtattcggcgaacatcaataagtgttcgcctgttattttgtcagatctctggatacagtatggcttcccaatccgtttactttaaacaaaaatggttacctatcgcgctgatcttccctcaattagccattactttaattttctttatttggccggctggacaagcattgttgcaatcttttcagttagaagatgcttttggccttagtcgtgaatttgttggtttagaaaattttcagcgcttatttaatgataattattattttgacagcttaatcaccacgcttatttttagtaccagtgttgtattactttcaatgttatctgcggttattttagcgggtattgctgagcaaatattacggggtaaattgttttaccgcacaatacttatcgctccttatgctattgctcctgttatcgcaggttttctctggttgtttatgctcgatcctaccattggtgtattaagccgagtattaaacaaaatcggtatcaattgggagccggtcttaaatacatctcatgcaatgtggatggtgattttaaccgccacatggaaacagataagctataacttcctgttttttcttgccgcgttacaatctgtgcctaaatcgttgctagaagcagcagccattgatggcagtggtccaattaaacgttttattaccattagtttgccattaatttcgccgacaacttttttcttattggtggtgaattttgcctacgccttttttgacacctttcccatcattcatgccatgactcaaggtggccccggtaatagcacctcaacattagtttataaagtgtataacgatggatttgttggattagatttaggctcatcagcggcacaatcggttattttaatgttgattgttgccatattgaccattattcaatttcgttatgttgagaaaaaggtggcttactaa

SEQ ID NO: 1987 - DNA, 867 bp, Proteus mirabilis
gaaaaaggtggcttactaatggttgaacgtagacctctcttccacgctttttgccatcttattctgattgttggcattctttctgtagcatttccggtatggatcgctgttgttgcgactacccaccaaaataccgaatttgccacaggctcgcctctttggtttggtcaggagggtatcgaggtttttaaaacgctcttttcatcagcgggaacgactcaaaatagtgcaattaccattaatggtatgctattgaactctttagttatggcgttagtgatcactattggtaaattggttatctctattgcctccgcttacgccgtggtgttctttcgttttcctggcagaatgctggctttttggacaatcttctttaccttgatgctccccgtcgaagtgcggatcatgccgacctttgaggtagtgacaaatcttaatatgttgaactcctatgcaggactgaccattccactgattgcgagtgcaacggctacatttttgtttcgccaattttttcttactatcaccccagagctgattgaagcggccaaaattgatggtgcagggccaataaaatttttctttactattttattgcctttatcccgtaccaatattgccgcactttttgttatcacctttatctatggctggaatcaatatctttggccaatgcttatcaccacagatactcagtactacaccattgtcatgggcatcaaacagatggtggccgtatctgatggcgtgattgagtggaacaaaattatggcaaccactttaattgcaatgttgccacctgtctttatcgtcattttgatgcaaagagcctttgttaaaggctttgttgatacggagaaataa

SEQ ID NO: 1988 - DNA, 948 bp, Proteus mirabilis
ggaaggtacggaatgacccgtttacgcacagtatcaaaacaccctgaacaattagaaaccacaccattagttgcggaaagtcatcactacgatgatcctttagcacctcaaaaactggtatttttagaggcggtcaatcaacagcgttgtgtgattaactcaccacagcgcaatagccaactcactaatacaatacctttttttatcgtacttttagttatggctttttatacactgtttggttttattgaaaaccataaatcaaattattttacccttcaatataggtctaactattataatgaaaaatatggtatcgataacttaccaaaagaattatctcgatatttgccatatatgaaagttaaggaaataagtatcggaacatatttaatcgattactatacggataaaatttacaaaaatgataaatttaagatattgatgattatcggctggctaatttttttccccggttttttatggctatttggctatctctctttctttacgcctcctgtgtaccttattgctgataggcaaagaggaatactgtatagctatggcatgggaaaagtacgtttaacccgctataaagaggcgcaatttggttatgcgggcaatatgttggcaattaaactatatggcattaatgaaaaaacaggccaattaaaaacgatcctctatcgccccaatgtgtcccactactccagtttcctaaccagtaccgacagtgaaaaccaccgttttatcacttttcttaatgcctatatgcaacaaggccgagatgctgtttcgcctgttgattaccaagcccgtaagccctttttatcttttggtaaaaacccacttcctgctgattttgagcaacaggtcaaacagattctggcaaagcttgatcaggagaaaaaaaacatgcgtaaaattgataaggaaggcacggaatga

SEQ ID NO: 1989 - DNA, 948 bp, Proteus mirabilis
ggaaggcacggaatgaccaatttacgcacagtatcaaaacacccagagcaattagaaaccacaccattaattgcggaaagtcatcactatgatgaccctttggagcctcaaaaactggtgtttttagaggcagttaatcaacagagttgtgtgattaactcaccacagcgcaatagccaacttactaatacaatacctttttttatcatactgttagttatggccgtttatacactgtatggttttattgaaaaccataaatcaaattattttacccttcaagataactctaactattttaatgaaaaatatggtgttgataacttaccaatagggttatcaaactatttgccatatatgaaagttaaggaaataagtatcggaacatatttaatcgattactatacggataaaatttacagaaatgataagtttaagatattgatgattatcggctggctaatttttttccccggttttttatggctatttggctatctctctttctttacgcctcctgtatatcttattgctgataggcaaagaggaatactgtatagctatggcatggggaaagtgcgtttaatccgctataaagaggcgcaatttggttatgcgggcaatatgttggcaattaaactatatagcattaatgaaaaaacaggccaattaaaaacgatcctctatcgccccaatgtatcccattactccagtttcctaaccagtactgacagtgaaaaccaccgttttatcactttccttaatgcctatatgcaacaaggtcgagatgccgtttcgcctgttgattaccacgcccgtaagccctttttatcttttggcaaaaacccacctccagctgattttgagcaacaggtcgaacagattctggcaaagcttgatcaggagaaaaaaaccatgcgtaaaattgataaggaaggtacagaatga

SEQ ID NO: 1990 - DNA, 468 bp, Proteus mirabilis
cgaattgacggagatagaagcataatgtcggaaaattttcatattttgctcctgaatggtccgaacttaaacctgcttggcactagagagccggaaacttacggacacctaactctgaatgatatagttcaaagtttgtcagcggatgctcaagcattaaatgtgaaactgactcattttcagtcaaatgctgaacatgagctaataaataaaattcatgcggcgcggggaaatgttgattatattcttatcaaccctgcagcatttacgcacaccagtgtagcactgcgtgatgcattattaggggtgaatattccatttattgaaattcacctatccaatgtctacagtcgggaacctttccgtcaccactcttatctttctgatatcgcaactggcgtaatctgtggattaggtgctgaagggtatcgatttgctttacaggcagcggtcaaccgcttgtcttaa

SEQ ID NO: 1991 - DNA, 708 bp, Proteus mirabilis
tcgcaaagcgggttattgtacccccaattaggaaaaatagcagaagaagccaaaagtgataaaaatatccccggcttttatgccctactgccaatgttacctattattatggcagtaagttcatcaagcctatttgttgaaggtattcaccttgatgtcgtcactattgtattaatttcaatggcaatttgtatgctgattgaaacattacgcttacgtgattttaaatcagtgtgtgcaggcttccaacattttctaaagggtatgggttctgcatttagtaatgttgttgggctattagtcgcagcgggtgtttttgctcatggtattaaagtcagtggtgcaatagacagcctgatcgttatggcggaatctgttggtctaccaccatttgccatggcattagtgttcgctatcgtgacattggctgccgcaattattatgggctcaggtaatgcacctttccttgcattcgttgaacttattccacaaattgcccatagcatgggggttaatccaattgcaatgattttacctatgcagcaggcatcacatatgggacgcggcatgtctcctgtggctggcgtgatcattgcggtttccagtggagctaaattgcaaccctttgatgtggtaaaaagaaccgctgttcctcttatggttggttttgttttccactgcgccattattgctatattttattattaa

SEQ ID NO: 1992 - DNA, 402 bp, Proteus mirabilis
ttaaaaataggaaacacaacaatgctacgcaccatgttacaaggcaaacttcatcgcgtaaaagtcacccaagctgatcttcactatgaaggctcttgcgcgattgatcaggattttatggatgccgctggtattcttgaaaatgaagccattgatatttataacgttgataatggtgaacgtttctctacttatgccatttgcgcagaaagagggtctggtattatttctgtcaatggcgcagccgctcgccgtgctgctgtaggtgatcgcttaattatttgctcttatgtgcaaattccagatagcgatgcgcgtagccataaacccaacattgcctattttgaaggcgacaatgaaatgaaacgcattgctaaagccgttcccgttcaagtcgcttaa

SEQ ID NO: 1993 - DNA, 876 bp, Proteus mirabilis
ggaggatcaggcgttatgaaaaaagttaatgtcgcacttttgcagctttgtagcggaaaaaatataaaaaataatctggcgcaaatagagcaacagattaagcaactccccgattcagtcaagcttgtattaacgcctgaaaatgcattacttttctccagcgcaaaagattatcataaacatgctgaaattcaggggaaagggccattacaagatgcgattgctaatatggcgcagcgctataaggtgtggatcttagtgggttcaatgccattgattagccgagattctcctgagcagatcaccagtagtagtttagtttttgatgatgaaggtgtgatccgcgctcgttatgacaaaattcatatgtttgatgtgaacattgatgatgaacaaggcgaatataatgaatcagccatttatcaacgtggtgaacgcttgactgtagtggatacacctgtggggaaattaggtttaacgatttgttatgatttacgttttcccggtcttttccaagcattaagagaaaaaggtgctgaaattatttctgtaccggcagcctttactcgtttaacaggtaaagcgcactgggagccattgttacgcgcgcgggctattgaaaatcagtgtattattttggcaccggctcaagtcggtacccatgatgctcgtcgcacatggggtcatacaatggcagtggatggttgggggaaagtattgaaaaagaaccctgatgcggtcagtgccctaacgctcaatattcgagtcgatagtttagaaggtatgcgtgaacagatacgggttgtgaaacataatcgctttcgcccgaaactgacacacttaataaaaaaagttaaggataaaaaagaattatga

SEQ ID NO: 1994 - DNA, 1005 bp, Proteus mirabilis
atatccgcaggtgactgcaaacagatttacctagtagatgagataaacaaaatgaccaacaaattaacttctttgcgtaaactgactacagttgtagctgatacaggtgacattgcagcaatgaaactgtatcaacctcaagacgcaactaccaacccttctttaattttaaatgcagcccaaattcctgaatatcgtaaattaatcgatgaagcgattgaatgggcgcgttcacaaagcgattctcgcgagcaacaaatcgttgatgcgtgtgataaacttgctgtcaatattggtttagaaatcttaaaactgatcccaggtcgtatttcaacagaagtagacgcacgtctttcttatgatacccaagcctgtatcgtcaaagcgcgtcgtttaattaaactgtataacgaagcgggtattagtaacgatcgtatcctgattaaacttgcttctacatggcagggtattcgtgcagctgagcaattagaaaaagaaggtatcaactgtaacctaactttactgttctcttttgctcaagctcgtgcatgtgcagaagctggtgtatacctgatctctccattcgttggccgtattatggattggtataaagccaatacagataaaaaagagtttgcaccagcagaagatccaggtgttatttctgtaactgaaatttataactactataaagagcatggttataacaccgtcgttatgggagctagcttccgtaatattggtgaaattttagaattagcaggttgtgatcgcctaactatttctcctgcgttattaaaagagttatcagaagcacaaggtgaagtagagcataaactatcctttaatggtgaagttaaatcacgtcctgcgccaatcactgaagctgaattttattggcaacataatgctgatccaatggccgttgataaattatctgatggcattcgtaagtttgcagttgatcaggaaaaattagaaaaaatgattgcagatttattataa

SEQ ID NO: 1995 - DNA, 975 bp, Proteus mirabilis
atggttcaaggagcttatatgtcagtcccttcacaggaaaatatcacactaaccaaagaagacttacgccaactgcatgtttcaagttcactttatcgttggtttttgcgttattttccccatggaggtacttaccgtgctatccataatgaattgataaaacaacgtcaaacacaatggatagaaagcttaattcaatatatttatctgcgtcattttagtcagtcctcttttgccaaacaggaacaagaagtgatagaaaacatcttgtccctgttaggcaatgaaaaacaaaccggtgtgatattacaacgtttaccctatcaccaaccgcaatctagcgacgaaaacattcagttttctaccgaatggcatcaactgattgtcaaaagccaacaatttaacaccgcccttgcattatgtggtcgtgataatattgtcgccttttccggtgatgaaaacagtattgctaacactggttatagtaaccaattaatcaacagcggatttgctggaaagatcagtaatacggcagatcaatgtcgtattggtagcttaggaggacgctctcgtatttgtaatagtggcaacgatgttaaaatttacgcttctggccaaggggcgcatattgccaatagtggaataagaaattttattaatgcgactcaatcccgtacaaaagtcaccaatactggtgatttagcacatattactgttactggcgataacgccattgctatcaacacaggtgataactgcacactctctgtatctggggataacagcgtgtgtatctcaacagggcatcttcagcaattttgcttaggaaaaggcggtagcgctgtgattgcctatcacgatggaaaacgcacccgctttaacgttttctatgaaggtgaaaataatattgaggccggcattcactactacttagatgaaaaacagcgccctgttgcaatggataatattacttaa

SEQ ID NO: 1996 - DNA, 858 bp, Proteus mirabilis
gtacttaaaggcaactggaggtatataatgagtaatcctaaattgatccaactatctgatggcaacactattccacaacttggacttggggtttggcaagcagataatgatcaagttattaaagcggtacatcatgctttagacacaggttatcgtctgattgataccgccgctatttatcataacgaagaaggtgttggtaaggcattaaagcaaagcactattcctcgagacgaattatttattaccaccaaattatggaacaacgatcaatcccatgctcgtggtgcattacttgaaagccttgagcgattacaacttgattatgttgatctctatttaatgcattggccagtgccatctcgcgagctataccttgacgcttggaagcagatgattgtgttacaaaaagagggactggttaaaagtattggggtatgtaattttaaagaagagcaccttgagcgcattattacagaaacgggcgtttcccctgtcattaatcagattgaaattcacccattgatgcaacaagcttcattaagagcttggaataccacccataatattgtgacagaatcatggagtcctttagcacaaggtggtgaaggcgtgtttgatcaaccaattattcagaaactggcagaaaaataccaaaaaacaccggcacaaattgtgttacgttggcatttagatagtggcttggttgttattcctaaatcagttaccccttctcgtattgaagaaaacttccatatctttgatttcaaattagaaaaagaagaagttgctgaaataaaacaactagataaaggaaagcggttggggcctgatcctgatacttttgttgatatctag

SEQ ID NO: 1997 - DNA, 354 bp, Proteus mirabilis
agagaaaaaggggtttgtgtgatcatgcggctcactaataacaaacccagtacggtaagtaagccaacaatggcgctgtggttaattgatgatattgcttttgctttatttgttgaggaagtgacgcaattggatgaagcgtggcgcggtaaatcattcggtagtatgaaaaaaaccagtagtgcacataacgtacaaatgataaatgccccgaaatttatccaaaagaaactcagtaaatcgaggatggccccaccagcaatggctccagctaacgatcctgcattggtagatacttgtaaccatgccaaaagccgagtacgttgtgctatggggatcatggcaataccataa

SEQ ID NO: 1998 - DNA, 1422 bp, Proteus mirabilis
cttctaagagggttccatatgtcttcgttgttaaatacttattaccgagcaaatgaatcttggcagatcgctataacccaagtattacccccttatatcgatccggttattatccgttggttggaaacatcccctgatacccttgttcatttaacacagatatatggttcaccccttaatattgtctggcctcatactgtggagcagaacgttaatgccatggtcgaagtcgccaaaacatttggtatacaaaccaatttgtattatggggttaaagtcaataaatcacagtcattattacaagccgctgttgctgcgggaactggggcggatgtatctagcctatatgaactcaacgatgctattcgtgcgggatgtagaggtacagagttgtgtgctacaggccctgccaaaacaacggcatttttacaggcgttaatagtgcaaggggcacggattgttattgattcacttgaggagatggacgagcttattcaccttgctacaaggtggataagtccatcaggacgtataagtatactgttgcgttttcgtcctgagtctaatcatatcagtcgttttggtatgtcatccgctgagatcatgacagcacttgagaaacttaattatagtgaccaagtaaaggttgatggattccatttccatcttagtggttactcttcggtatctaggatcaaggctttttttgataccttacccttgattagctacgcacgtgctttgggttactccccttatattatcgatattgggggagggttacctgttcagtatgtagacagtcattgttataagaaatggctctctacgcaaacacataaagactatcgtactcgacgaattcctgattctttctatccatatggtggagagataaatgcccaaggctggctcactgagtttctaaccggagtcgatcccacaggtaaaagagtttgtgatgcattaattgaggaaggattaacactttgccttgaacccggaaggagcttggttaatcaaagtgcgatcagtgtatttcgtgtctgtcgagttcgtccatatgatcatgtcggacatgttatttttgtcgaaggaactagttttagcgcatgtgaaacgtggtttaattctgaattcttaagtgatcctctccatatttatcaaaataaccatcagccactttcttctgctggaaatgcttggattgcaggccatagctgtttggacgacgatgttatcaccaatcgtttgatcgcttttgcacacctaccaaagccaggtgatttactgatatttgctaataccgcaggttaccaaatggatttactggaaaatcaatttcatcggcatccgttgcccacaagattaactgcggtcataaactcacatcaaaaacctatatttaccattgataattaa

SEQ ID NO: 1999 - DNA, 1935 bp, Proteus mirabilis
ggtgggagaggtaacgtggttaagcaaaagtggtccttcgtcttggcaattagtacattgtgtttctctgcgtgggcacaagcagattcattaagtgaacaacgaacacgttaccaagaaattaaagcagcttgggatgctaaagatacagcacaagttgaaaaattattaccgacattacaagattatcctctttatccctatcttgaatatcgccaaattaccgacaatcttgatgtggtcgctccggctgtggtgactgaatttgtcgaaaaatatccaactttgccacccgcgaaagcactaccttctttgtttgttaatgagttagcaaaacgtcaagagtggcaaaacttactgacttttagtcctaatcctcctaagcctaaagcagcaaggtgtaactactattatgctaaatgggcgacaggggataaacaaacggcgtgggttggtgcaaaagaagcgtggttaaacggtacttctatgccttcaagctgtgatccgctatttgatgagtggcaaaaagcaggaaatttaagcattgaattagtgttagagcggattaatttagcaataaaaagtggtaatactgggttagcaacttatttagctaagcgattgccgatggattatcaaacgattaacgatgccattgttgaactacaagatcaccctaatctggttgctcgttatgccacacaactttcaccaacagattttacgcgtaatattgtacaagccgcattttcacgttgggcgcgaaaagatgccgatagtgcaagagcacagcttgatagtattgccagagctcaaaaaatgacgacagctgaacgccaattaatgcgtgatacggtcgcttggcaatatatgccatatgccacaccagagcaggctaaatggcgtgatagtgtgatacaagataccgcttcagataccctgcgtgagcgtcgtgtgcgtttagcgttaagccaaaatcagcccgcagaattagctttatggttagaaagattatcacctgaaagtaaaaataaagaggagtggcgttattggcgagcgatggtgttgcaatcgcaaggtaaaaacagtgaagcacaagcgcttttacaagaactaacacaacatcgcggtttttatcctatggtggcggctgaaaagctaggtaaaccttatgttatggtaatagacaaagcgccaagtgtttcacccacaattccacagcaacctgaagtgcaacgagtacgcgaattaatgtattggcaaatggataatttagcgcgtactgagtgggcaaattatgttgccacccagcctgctaccacacaatctcaactagcgcgttatgcttttgagcaacaatgggctgacttagcagtacaagcaacgattactggtaaaatgtggaaccatttagaagagcgtttcccacttgcatggcaaaatgaatttgaacgatatacgaaagataaagcgatagatcgcaattatgcgatggcgatcgctcgccaagaaagtgcatggaacccacaagctcgctcttcagctggggcaacgggtcttatgcaagtgatgccgaaaaccgcagagttcacggtaaaacaagcaggtattaccgggtatgcaagtagtgcgcaactgacagatccggttaaaaatattgaaattggtaccgcttatcttgattctgtttatcagcgttttaatcaaaaccgtattttatctagtgctgcctataacgcaggtcctgcacgggttgaccgttggttatctgatgctaataaccaactagatgctattgcttttattgagagcattcctttcgcagaaacgcgtggttatgtcaaaaatgtactctcatttgcggtgttttatagctattttgccggagagcaacaaccggtattaactcaaactgagtggaatagtcgttattaa

SEQ ID NO: 2000 - DNA, 321 bp, Proteus mirabilis
ttgataggaggaaagaggtcaccaatgtcaaaagtttatcctatttctcaaattattggacataaaattcgccaacagcgccaacacttacgtttatccgctaaagcagtggctgaaagagtcggcgttagccaacagcaattttcacgctatgagaatgggctatgtaaaattgatgttgatatgctcttccttattgctaaagaattaaatgttacaccaaccgcttttcttccttcaccgcttaatgaagatcctatcgcttcttcaagcgctgtcacccaatctaagctattttggagcgcacagagtcaaatttaa

SEQ ID NO: 2001 - DNA, 1044 bp, Proteus mirabilis
catacaggaggtgaagatatgctatttcaagtaggagagatcgctaaaaagacgggattaacagtccgtactctccatcattatgaagagataggtttattgcaaccgactgcaagaaccgatgcaggttatcgactctatgatatgaaaagcatagagcgattaacgcaaattcaaatgctacgtcaaattggcgtcaaactgaaagacatcggtcatattcttaatggtcatagtgcagagatagcttgtttaattgaagagcgcattagccaattaaccacgcaaatgcaacaaattgccaaattgcgttatcagctagagcatgttcaacaacaaatacaaacaggcactccatttacgcaacatgactggttttctttattggagatgatgtctatgtacgataaatattttacttattctgaattagcgcagttacccctctatactgcgcacacattaaaaagccaagcatggcaacagcgtatttcaactgtcaataatttgattaaacaaggtaaatcagccgattcaaatgaagcgatgcaagtttcaagagagtggatgatagctttagagcaagatactgggggaaatcccgacttttttgtccgtttaaataaaatgcatatttctgatgataagtttgcgacggctaccggtattactaaacagatgatagattttgttgctaaaggctttagcgaatatcaattatctgtttttaaacctcatctgactccggaacaatttgccgtagtacatcagcactattttgatgctggcagtgtctggcctgagcttatttctggattatataatgcactcacttgcggagaaaaagcagattcagagcaggtgcaaaacctcgctaagatgtggctaaatatgttcaatcagtttacacagggtgatagtgatattcaggccaagatccgtaccatttatcaaactgatcatgaaatcgctaaaggtacatggatgacacctgagattggtcaatatttatttacggctattagtttgctagtgcaaaaatag

SEQ ID NO: 2002 - DNA, 3783 bp, Proteus mirabilis
cgcgcattgggagagtatctgatgagtaaatttctcgatagattccgctattttaaacagcttggtgatacgttttcacaagatcacgggcaagagttaaatgttaatcgcgactgggaaaatagttatcgtagccgttggcagcatgacaaaatcgtgcgttctacacatggtgttaactgcaccggatcatgtagctggaaaatttatgtcaaaaacggcttagtaacatgggaaacccagcaaacagactatccacgaactcgtcctgatctgcctgatcatgaaccccgtggttgtccgcgtggtgcgagctattcatggtatttgtatagcgctaaccgcgttaaatacccaatggtgcgtaaacgtctgatcaaattatggcgcgaagctaaagcgcaacacgctgatccagtggatgcatgggcatcgattgttaacgctcccgaaaaaacgaaaagttataaacaagcacgtggtcgtggtggttttgttcgctcttcatggtctgaggtgaatgaaattattgctgcctctaacgtctataccgctaaaacttttggcccagatcgtattattggtttctcacctattccggcaatgtcaatggtgtcttacgccgccggtgcccgctatttatctcttattggtggtgcttgcttaagtttttacgattggtattgtgatttaccgcctgcctcaccaatgacttggggggagcaaaccgatgtgccagagtccgctgactggtataactcttcttatctgattgcatgggggtcaaacgtacctcaaacccgtacgccagatgctcacttttttaccgaagttcgttataaaggcaccaaaacggtagcagtaacacctgattatgctgaaattgctaaactgtgtgaccagtggttaaacccaaaacaaggtacagatagcgccatggcaatggcgatgggacacgttattcttaacgaattccacgttaaacgccaaactgaatactttagtaactatgtgcgcacttacactgacatgccaatgttagtgatgttagataagcatgattctggcaagttagttgcgggtcgcatgctgcgtgctgctgatttagtgaacaatctcgatcaggagaaaaatccagaatggaaaaccgttgctattgatgagaaaacacagcaattggtcgctcctcaaggttcaatgggttttcgttgggaaggcgctgccaaatggaatctagagcctaaagacggtaagagtggcgaagaagtcactttacaattgggtcttttagaaaaccatgatgatgtggttgacgttgcatttccttactttggtggcatcaagagtgaatactttgaaggtgttgcccttgatgatgttctcgttcataaactgccagcaaaacgcattactcttgccaatggcgaagaaaaatatgtcactaccgtttatgacttattactggctaattatggtgtcgatcgtggtttaaatgatgaaaactgtgcgacaaactatgatgagatcaaagcctattcacccgcatgggctgaacaagtaacaggggttagccgtcaagatattatccgcattgcacgtgaatttgctgataatgcagaaaaaacacatggtcgttcaatggtgattgtcggtgcgggcattaaccattggtatcacatggatatgacctaccgtggcattatcaatatgcttatcttctgtggttgtattggccaaagtggtggggggtgggctcactatgtgggacaagaaaaactgcgtccacaaacaggttggttgccattagcttttggtctggattggcagcgtccacctcgtcatatgaatagcacgtcatttttctataatcattcaagtcaatggcgctatgaaacggtatcaccgacagaattactatcacctttagcagataaatcacgctttagcggtagcttaattgatatgaatgtgcgttcggagcgtatggggtggttaccgtcagcaccgcaattaaacgttaacccattgtctattaccaagaaagctcaacaagctggcgtcagtgcaacggattataccattaatgctctgaaatcaggtgagatccgttttgcatcagagcaaccggataatccgcaaaacttccctcgtaacttatttatctggcgttctaatttattgggatctgcaggtaaagggcatgaatatttactgaaatatctattagggacggaaaatggattacaaggtaaagatttaggtgaacaaggccaagttaagccacaagaagtggaatggcaagataaaggcggtgagggtaaggtcgatttagtggtgactttagactttcgtatgtcaagtacctgtctgttctccgatatcgtgttaccaaccgccacatggtatgaaaaagatgatatgaatacctcggatatgcatccatttattcatccattaaccgccgcggtagatcccgcttgggagtctaaaaccgattgggaaatttataaaggtattgctaaaaccttctctaaattgtgtgtcggtcatttaggggttgaaaccgatttagtgacacagccaatacaacatgactccgcggctgaaatggcacaaccatttgatgtcaaagattggaaaaaaggtgaatgtgaccttatcccggggaaaactgcaccgcatcttattcctgtggagcgtgattatccaaatacctatgctcgttttacctcacttgggccgttaatggataaattaggtaatggcggtaaagggatcggttggaatacacagacagaagttgatttcctgaaaaaacttaatcgcgttcgtcatgacggtgtggcaaaagggcgcccggcgattgaaaccgcaattgatgcagccgaagttatcctctctttagcacctgaaacgaatggtcaagtggcggtaaaagcgtgggatgcactaagtaaagtaacaggacgcgatcacactcatttagctaaagtaaaagaagatgagaaaattcgtttccgcgatatcgttgctcaacctcgtaaaatcatttcaagtcctacatggtctggtctggaagatgagcatgtctcttataacgcttgttataccaatgttcacgagatgatcccttggcgtactttaagtggccgtcagcagttatatcaagatcatgagtggatgcgtgcttatggcgaaagtttagtggtttatcgtccacctattgatactaaggcaatcgaagccgtgaaaggtaaaaaaccgaacggcttcccagaaaaagcgctgaacttcctgacgcctcaccaaaaatggggtattcactcaacgtatagcgataacttactgatgttaaccctcggtcgtggtggccctgtggtttggctgagtgaagatgatgctaaagagatgggtattagtgataacgattgggttgaagcatacaacagtaatggtgcgttaaccgcaagagcgattgtgagccaacgtattcctgatggcatgatttatatgtatcacgcacaagagcgccaaataaacctaccaggctctgaaataactggaatgcgtggcggtattcataattccgtgacgcgtgtttgccctaaaccgacccatatgattggtggatacgctcagttggcttatagctttaactactatggaactgtgggctctaaccgcgatgaatttgttgtggtacgtaagatgaaacagattgattggcttgatggtgaaggcgatgcttatcaacaaaccctgaatggacaggagaaggcataa

SEQ ID NO: 2003 - DNA, 843 bp, Proteus mirabilis
ataaatatgggacaagttctatttgttgtttggcgagaaagttttgaagctctgctggtggtagggatcatttatgcatggataaaacgctctcctacccctaaacaaggtatgaaatatctctggggaggagtaatagtaggaatactactctctattcttttagctcttagcatttatggggtatttagctccttagaagatatctggcaatctctgtttatggttatgatggaaatcattgcctgcctattaattgttcagatggtctattggatgaacaaacaaggtaaatcactaaaagccaatatcgaaaacgaattgacacaaaaaacgcaacaacaaagtgtctgggggattttactgatcatcgccattgccattgcgagagaaggcagcgaagtggttgttttcctatcaagccatattatggctctcacagcacaaaccgcgttgtctttcttgattgaagtattcattggcctattgatagcgggactaactctatggttatttttgctaacatcaaaaatgatttcttggcgtaaattctttgttattaccggatttttactgcttttcctcgccgtttccttgctattaaaagcagtagaagagatagctaatctacttattgaaatggatattgaattacctgactttttgatttatccactatgggatcttagccatattttggatgattcaagcatttttggtaatttcttagtttcattctttgcttatcgctcacaacccatcggtttaagtgttgttacttttattgtgttttggttggtggtcgcactgttatttaaacaaggggatcgtcatgccaaatag

SEQ ID NO: 2004 - DNA, 246 bp, Proteus mirabilis
agattaatttttacaatatatcaagatataccaaattcattgcgtatcttattcataaaagagaagtgtatcgcctgtatgggattatttttcttaattgaatgttgttgcttttatactttatttaacttttatattttaggaaaacaaaatgaaattaaaaaaactgcatttagttttagggttaggcttatctatcattgcgggctctgcattagcggcagatcaagggcatggtactgttga

SEQ ID NO: 2005 - DNA, 420 bp, Proteus mirabilis
tataaaattttatcaggaataaacatcatgaagaattttgaaaacattgccttattaatcgcacgtattctcatgccaattttatttatcagcgcagggtatggaaaaattgaagcctatgaaggtacgcaacaatatatgcaatcaatgggtgtgccgggagccttattacctttaaccattttattagagttagggggtggattagccatattattcggtttcttaactcgcacaacggctatctttaccagtgtatttacgctgttaaccgcactactgttccacactaactttgcagaaggtgcaaatcagttaatgtttatgaaaaatataactattgcgggtggctatttattactggttatcacaggtccgggtaaatggagcttagatcgcctatttaagaaaaattggtaa

SEQ ID NO: 2006 - DNA, 786 bp, Proteus mirabilis
ggggattttatgcgctttataaagctattacctgctattttagctgttattttagcgggttgtgtgacacaagcacctgaagttaaacaaccattaaaaccgcaagcaaaattagttgaaggcgtatcttgtactttacctgatgcacctactgccaattatgactatattgcgacaaatgatcgttatggtcaaaatagtaaagcatcaacagattactttaaattagccattaattactcaccggctttttgtgattataaaaaaaataatattaagcgtttaaataacgataacgaaaaagagcgtgctaaacgcgaattcgataaatttgaaatccagtgtttctcagataataaatttggctggattgttcatgggctatgggctgaaacctgcgatggtaaatcatgggatgaatgccgtgactggaaagacatacgcaagcatcctcgtttatgtaaaggggatttaccaccattagaatactcagcgattaaaccttacttatgttcatcaccgggtatcgatttattgcaaggtgaatgggaaaaacatggcgtttgtgcctttgatacgccagaagcattctttggtcagcaacaagcgttatttgacgcattagtgttaccagaaggccgcccttcaaatagtgaattgattaagttcttaaaagaaaataatccatcattgaaggataaagaaattcaaattaatcgagatgaattctatatttgttatagcaaagatttcgaagtgattgattgtccgaaacgtgaatattga

SEQ ID NO: 2007 - DNA, 489 bp, Proteus mirabilis
gtcgcctttatgcacaagcaggtagaaatattcaccgatggttcatgtttaggcaacccaggtcctggtggttatggtgcaattttacgctaccaacagcatgaaaaaacccttagtgaaggtttttttatgaccaccaataaccgcatggaactccttgctgctatcgtagcattagaagcgttaaaattcccttgtaaaattacactgactacggatagccagtatgtcagacagggaattaccaagtggatacatagttggaaaaaacgccaatggcgtaaagcagataaaagccctgtgctgaatgttgatttatggaagcgtcttgataaagccattgagcgtcatgaaattgaatggcattgggttaaaggtcatgcaggccatgacgaaaatgaacgttgtgatgaactggccaaagcggccgcgcaatctcccacaaaagaagatactggctatctagaaagtcaacaagataaaacctga

SEQ ID NO: 2008 - DNA, 1194 bp, Proteus mirabilis
ttggttttctttgccaacttgtttgggggatcgcagatgatcccaaatgagaaattgagagtaacactatgtggagccggtcgtacagggcatcttgcggcaattttatttagcttaaatcctgcgattgacgtcactctttacagcagtcgctcagaaactgtgacagcatataaagaaaatgatcatcaacttcaggcggtgatgcctgatggtcaagttattaaaaccggttcggttaggatgacagaagccattgatgaggcgtgctctaaggcagatatcatcattattacgacaccaagtcatgtacgtgaaagtttacttcaacgtatggcgccaatactgccgaaacataaaaacatctttgtgggcgccattcccggttttgctggctttgactggctggctgaaaaaacgttaggcgatgcacccaatattgttatatggggaatgaaagatgttccccatattgcatttgatctgcaaccgggaaaaagtgtcagaatggggggcggaaaatcacaactctatgtagctgtgcatggaagagaaaaaccgcaatatgccaatcttcttctcaattacctcaaacaactttatgactcacctattacgctactgaccgattatctagaaattaccctaacgccaggaaatcctattatgcacagctctgttatctatggccttatcggtccatggggacagtggcacaataggccttttgagagcattccatgttggtggaacgattgccccgagttgggtgcctattttcttgcccgctgtgatagggagaatcaagcgttatgtaataaagcagaaattgtattggggattaatctcagttccgtgcaaccattacagcaggaaatagtagccgcatatgcggactcaattgctgatccgcgaacattacttagtgtgttacgaacgaataaggcctatcagggtattcctttacctcttatttctacagcacaatcccatggttatatttttgacaaacaacatcgggtttttcaggaagacattgcctatggactagcccttcttgttgctcttggggaacgtcttcgagtgccaacaccctatataagagaaatatatgattggtgttgtggttatatgggaggaagtttgcctcaccctcagatcccaatggattggccaataataagggtgaaatag

SEQ ID NO: 2009 - DNA, 765 bp, Proteus mirabilis
ggtaactttatggagcttatcagaattcccgctttatccgataactacatttggctattaagtaatgaaaatagtgaatgtgtgattgtcgatccttcccaagccaaaccggttatagatactatctcacaacgttcattaacacctgtcgctattttgttaactcatcaccacgaagatcatgtcggtggtgttgctgggttggttagtaaatatcctaacattgaggtttttggtccacaagaaacacaaactaaaggcgctaataaaattattcatgatcaagaacacattattattgattctttttcttttttagtcatcggaacaccaggccatacattaggtcatgtcgcctactatagcgaaccttatttattttgcggtgacacgctattttccggcggttgcggacgtttatttgaaggtagtgcacaacaaatgtttagctcattacaaaagttaatggcattacctgataacaccttaatttgttgtgcccatgagtatacattagctaatttgacctttgcgcaccatattatgccaaaaaatcctgatattaccgattatttaaaccaagttactgaaatgcgccatcatttgcaaccaacagtgccaataacactgaaaaatgaaaagaatattaatctttttctaaaatctgacgatattgatttacaaagaattttaggtataacttctaatacttatgctccaataaagacatttacaaaattaagagaattaaaagacaacttttag

SEQ ID NO: 2010 - DNA, 234 bp, Proteus mirabilis
tcaatatttatgtgttacacagagaactttaatactctattgtggacaatttcacgtacaatcgagtattataaaacgctcaatctaacacataatattggtgaattaataggttatacaaaaaatgatatctatgcagagcggataaaaaaagcaaatattatctttctctgcctcgtcgcacaatatttagatagtttaaactgctttcaagacgaattcagaccaaagtga

SEQ ID NO: 2011 - DNA, 939 bp, Proteus mirabilis
gctttgtttattttaacccatgttcattttgaacttgcctgtggtatatctaagacaatggaatacaaacacatactttcttctaaccaaatatccttaaaaacgttttacatcgaaaacccgatgatcgcgatggtatatggtgcaaaaggtgagatttgtattaatgggcaaactatcacagtcaccactaatctcacgttgattattcctaaatatagtcaagtttcttgtgatgtgacaaattttttcccgaccaaaccgattgaattacataccttagtactgtctgaaactgaattacaatctgtgttctctttacttaaaccattaataaaatcaggggcgccgattactcgtcatcttcctgattatcatctatcaacacctgaggtggttaaaactaattttacgttacttcagcaatgtctaccgcttgaacatggcaccccctctcaagagaccctgtttatgcaacagagcctcttttttattttgctggcggtttatcacgaaggggtcgatattcttaatatttttcgttttaattatgatgagccaaaaaatcaggcgattactcatctaataacacaagatccgcaacgtaaatggcatttagaggatgtagcaaaaacgctctatactacgccatcaacattacgtcgccatttaagtaaagagggcgtttcgttttgccaattactgttggatgtcagaatggggatcgcattaaattacctcaccttttctaactattctgtgtttcaaattagtcatcgctgtggttttggtagtaatgcttatttttgtgacgcatttaaacgtaaatatggtatgacaccatcgcaatttcgcacccaatctcgccaagcaaacgatccgaatgcaatagcaacaatggcgtcacaaaatgacgagtcaataaaaaaagtattttaa

SEQ ID NO: 2012 - DNA, 951 bp, Proteus mirabilis
tttccacttatgacttatgcattggagttaaccgagttaacgaaaacttaccataatggtgtcaaagcgcttaaaggaattaatttaaccgtagaagcgggggatttttatgcgctattaggccctaatggtgcaggaaaatcgaccaccatagggattatcagctctttggtgaataagagtagtggtaaagtcaaagtatttggctatgacactgataccgatatggttaatgctaaaagacaactcggattagtgccacaagaattcaatttcaacccttttgaaaccgtattacaaattgtccttaatcaggctggctactatggtgtaccacgaaaagtggcattagagcgtgcaaaaacgtatttaacccaattagatttatgggagaaaaaagatgatagagcacgttttttatctgggggaatgaaacggcgtttaatgattgcgcgtgcattaatgcatgagcctaaattgctgatcctcgatgagccaacggcgggagtagatattgaattacgtcgttcaatgtggacgtttttacaacatttaaatgcacagggtaccactattatattaaccacacattatcttgaagaagcagaaatgctgtgtcggaatattggcattattcagcgtggtgaactggttgaaaacaccagtatgaaaggtttattaagtaaattagagtctgaaacctttattttagacttagcagcaaaaagtccgttacctgaattacaaaattaccaatatcgtttagtcgatacatcaacactagaagttgatgtgaaaagagagcaaggattgaatggggtttttgctcagctcaatgcacaaggtattcaggttttaagtatgcgtaataaagctaaccgccttgaagagttatttgtgcatttagttaatgaagatcatacagaaacagaaaaaggagagagggaatga

SEQ ID NO: 2013 - DNA, 216 bp, Proteus mirabilis
gagaaacttatgtttggtaatttagggcaagctggaaaatatctaggacaagccgctcgtatgttaataggtattcctgattatgataactatgtgcagcacatgaaggacaaccatcctgataaaccagtgatgacctataacgagtttttccgtgaacgtcaggaagcccgttatggtggcggtgatggtaaaggtggtttccgctgttgctaa

SEQ ID NO: 2014 - DNA, 3144 bp, Proteus mirabilis
tacattattatgtctcgattttttattaatcggccaatactttcgtgggtgatggctattgttattatgattgcaggaggattgtcgttaataaaacttcctgtgagtcaatatcctgaaattgcagctccagcgataatgatcaccgcagtttatcccggtgcatcggctgaaacagtgcaagacacggttgttcaagttattgagcaagagcttagcggattagatggcttccgttatttaagttcaaatagtaatacggatggtagctttgaagttatcgccacttttgaacaaggtacggatagtgatattgcgttgatgcaggtacaaaataaactgcaattagcaactcctaagttaccccttgaagtacaacgacaagggatgagggtagtgaaattccagattaactttatgcaagtggttgcccttgtagatgaatctggaaaattagatgcctttgatttaggtaattaccttgcctcacatatgaaagatcctatttctcgtattgatggtatgggggatattctgttattgggatcaccacgcgctatgcgtatttggcttgatccggataaactgactaattatcacctgatgccgcaagatattgccgcggctatccaagatgagaatgtacaggtgtctgccgggcagttagcgggcttaccggcattaaaaggtgttgagttaaacgcaaccattaccagtgcatcacgtatggtatcagtagatgaattcaaccatattctattaaaagtgaatcttgatggctcacaagttctgttacaagatgtagcgaaagtcgaagtaggggcagataatttctctatttcaagcttatacaatggtaaaccgtctgcgggtatggctatgcgcttagcgcccggagctaacctacttgatgtgtctaaaaaagtaaaagaggttgtggaagctcagtcgcagtttttccctcaaggtgtaaaagcccttttcccttatgacacaacgccttctgtaaaatcgtccattagctctgtggtaagaacgattgtcgaagcttccatcttagtgttcttggttatgttcctgttcctacaaaatattcgggcaaccttggtgccaacattggctataccggttgttttattaggaacttttggtgtattagccgcattaggtttaactctcaacgtattaacgatgtatgccatggtgctcgcaatcggcttgctggtggatgatgccatcgttgtggttgaaaacgttgaacggatcatgcatgaacaggcgatttcggtaaaagaagcgaccattctctcgatgacgcaaattcaaggggcgttagtggggattggtcttgttttatcagcggtctttgtgccaatggcattttttggtggatcggctgggattatttatcgccagtttgcagcgactattgttgtcgcgatggcattatcagtgcttattgcattaacatttacacccgcattatgcgcgtccatattgaaaaagccacaacctaaggtgaagaaacgtcgtggattcttctggctgtttaaccgtttctttgatagaggaactaactattacgagaagggggtacgcaatatcttgtaccgtcgaggccgttatatgtttattttcctcattattaccgttggaacagggtggttatttacgcaattacctaaagccttcttaccaaatgaagaccaaggggttgtgatgattgaagttcgtatgccagcaaatagtaccgctgagcgtatggaacaaaccatggcagaatttagggattatttactgaccgaagaaaaacatctggttaaaacagtatttactgttaatggctttaactttgcaggtcgtggtcaaaatgcgggtatggcatttgttaacttggctgattggtcagagcgtaaaggaaaaggagaagatgttttctcattagtggcacgagcacagcaacactttaactctatccgtgatggtatggttattgcgttcccaccacctgctattatggagatggggaatgcgatgggatttgatttctacttacaagataatgcgggtttaggccatactgaattggttaaagctcgtgataaattcctcgaattagcagcacaaagtccagtattaactaatgttcgcccgaacggtaaaaacgatgaacctcaattacgtgttgtgattgataaagagcgtgcaagagcattacaactgcgtttatctgatattaacgatacattatctgccgcatggggatcgatgtatgtaaatgattttattgatgaaggtcgtgttaaacgtgtttatctacaaggggaagcctcagcgcgtatgttgccaaccgatctggataaatggcatgttcgtaatcagcgcggtgaaatgatcccattcaatgcctttgcaacaacacaatggtatatggggccaccgaaattagaacgttttaatgggctatcagcgattgagatcttaggtgaaccagcgccaggttacagtacgggtgacgcgatgctggcaattgcagatattatgaaacaattgccatctgaaatcagcctaagctacagcggtctgtcttatgaagaaattcaaacacaagaccaagcacctgcattatatgtgatgacaattctgtttgttttcttaagcttagcggcactctatgaaagttggtcagtacctttctctgtcgctttagtggtgccatttggtattttaggggctgttatcgcaacactgttacgaggtttatcctcagatgtctatttccaaataggtttgatgaccaccattggcctatcagcgaaaaatgccatcttaattgttgagtttgctaaacatctttatgagaaggatggtaaaccattaatcgatgcggcagcagaagcggcaagaatgagactacgccctatcattatgacctcactcgcctttacttttggggtattacctatggcacttgcttcaggcgcagggcaaggtagtcagcactctgtcgcaacaggggtaattggcggtatgctcgcatccactttcttggctattttctttgtaccactgttctatgtctttgtggttaaactattttcacgaaaaaaagcacatatgagtattgaggaaatagataagtaa

SEQ ID NO: 2015 - DNA, 1113 bp, Proteus mirabilis
gagtctattatgttaaaagttattcaatccccagcgaagtatatccaagggcctgatgcgttatatcatattgggaaatatacaaaacctttgggtgagagagcattgattatcgctgataagtttgtcatggatctggctggcagcatcgtcaaagacagcatgacacagtatgaagtcaatggacactttgaacagtttcacggtgaatgtacacataaagagattgaccgcttagttgagatagccaaacaacaagccgctcttgttatcattggtgttgggggaggaaaaacccttgataccgccaaagccgtcgcctataaatgccagttacctgtggtgatctctccgactatcgcatcaaccgatgctcctactagcgcactttctgttatttatacagaattaggcgcatttgatagctatcttttctacccgaaaaatcctgatatcgttgttatggataccaatgtaattgcctcagcaccaccacgtttattagtggcagggatgggagatgccttagcgacctattttgaagcaagagcctgtagtcgagcacaaaagcaaacaatggctggaggtaaaaccacccttgcagcactggcattagcagagctttgttatcacaccctacttgaagatggctataaagccaaactggctgtcagccgtagtgtgtgtactactgcggttgaaaatattatcgaagcaaatacctttttaagcggtattggttttgaaagtgccggattagccgccgcacatgcaatacataatggtttcactgcattagaagagtgccatgcaatgtatcacggtgaaaaagtcgcctttggtactctagttcaactagtgctagaaaatagcccgttagaagagatcgaagaagtactcgatttctgtgttcaagttggcttacctgttaccttagaagaattaggcgtacatgctacaggtgatgaattaaatgaaaaaatcatggctgtcgcagaattaagctgtgcagaaggtgaaacaatttacaatatgccatttgatgttgattccgataaagtgtttgcggcgattatggcagcagaccaattagggcgtgagtggttatattaa

SEQ ID NO: 2016 - DNA, 555 bp, Proteus mirabilis
acacctattatgagatccctaatgaatcgaaaaatccgtaatacactaattatcagtacgttattctcaataagtgtcccagttatggcacttaaagatgatacacaacaacctattgttgttaattccgagaaacagtcacttaatttagaaaaaaacattaccactttcacacaaaatgttgtggtaaaacaaggctctattgatataagagctgataaagtagtggttacacgtcctggtggcgattctaaaaaaatcgtgattgaagcttttggtaaccctgtgacattctatcagttacaagatgatggtaaaccaatcaaaggtcgtggtgataaaatgacctatgagatggacaaagagctggtgaccttaacaggtaaagcttatcttgaacaattagacagtaatatcaccggtgataaaatcacttatctcgtaccgacacaacaaatggaagcatttagcggtaagggaaaacaagtcaccaccgttttactcccttctcagttacaagagaaaggtcccggtgttaacaacaaaggtaagtaa

SEQ ID NO: 2017 - DNA, 771 bp, Proteus mirabilis
ttatacattatgataagaaaatcaattttattgtttattacaacaacatgcactttacctgcacaggctaattatctcggtggatttgctaatatcagtatcaattatcttgactggacgacacataccacccataaaacaggccaaacttcccataaagatgattttgcttatttagaacttgaagggggagcccacttttcatggggtgagttttatggcttttttgacttagaaaatccttttaataatcgacaaacacagcccggcgataatcagcgctataccgtcaaaggaactagtcgtatttatttagctgacagtggattaaacctttatggccatgtatatggtacttggtcactgcccggaaaagaatatggcggtaatttccatgaggttaatacactttatggtattgggtataacacacaattagcagatatctggtttaaaccttttatagctttacattatgtcgatcaaacttattattcaggaaataatggctatgtggttggttgggttgccggttacgattttaacctggtaaatcaaaaatttagcatcacaaattggcatgagatggagtttgatcgtaataaacgttatggcaatggcggaaaaaatggctttaatggagctgtcgctatttggtggcaccccacggcttccattactacaggcattcaataccgctatgcttataaaaagttaggagaaaactttttacaagatggtgtgatctatagcttaaaatataacttctga

SEQ ID NO: 2018 - DNA, 333 bp, Proteus mirabilis
ttggacattatagtatccattttatgtttagagctaataatgaaactctcattacttaccgatattgatgttagtcgagcttttgctactcatttacgaaaacgacgagaaaaagaaaaatggtctcgggaacatcttgccgagcgcagtaccgtccctgcatcaacaattaaaaaatttgagttacaaggcaaaatttcattacgacaactactgttactttggcagtgtcttgatgatttaaataacctttatgccgttgttgaccctaaaaaagccaataagcctcgtataccaagaaccattgaagaggtattacaagatgaattttaa

SEQ ID NO: 2019 - DNA, 420 bp, Proteus mirabilis
gagctaattatgtcattaaaaattactaccgccccgacgacgaatgaaatcaacgaaatttatgaaggcttattaacacataaccttcagtatattcagatggagcaatatacgcccttagccgtttttaaagaggaaaatggtaaaaaaataggtgggatcactggtgatatattaggtaattggctacgtattcgttatctatgggttgataaggcctatcgtggtaacaatattggtacagaattactgcaagcaatggaaaatacagctaaaaagaaaggtgccaaatatgctgaggtggatacttttagctttcaagccctgcctttttatcaaaagcagggatttgaagtttttggcaccttagaaaattatccgattagtgacaaaaaatattatttaaacaaagtattataa

SEQ ID NO: 2020 - DNA, 408 bp, Proteus mirabilis
atacaaattattgttatattcactattaaacgcaagcctgagtttttattaccaaaattcaaccaacatgctgaacaattagctatttctacaattacactcgctgagctcatttttggtgctgaaaaaagtgtaaatccagccaaaaacttagctacggttaacgactttgtttctcgactgactgttttatcttacgatgacttagcagcttttcattatggagacattagagcaacactagaaaaacagggaaaacacgttggtgataaccacttacatatagcagcacatactagaagtaaggggctaatagtcgttaccaataatactcgagaatttgaaagagttgatggtttaagaattgaggattggaccgttattaactcagacccccaaactgattga

SEQ ID NO: 2021 - DNA, 1455 bp, Proteus mirabilis
aaaagaattatgagtttagctgttgtcagcgaaagtctgttggaagcgaacaacctgagtttagatgatttagcatcgacactagagcagcttgcacagcgtcaaattgattatggtgatctttattttcaatcaagctaccacgaagcatggatattagatgatcagataattaaagatggctcttacaatattgaccaaggggttggcgttagagcgatttatggtgaaaaaacaggttttgcttatgcagaccaattaacactcaacgcacttaaccaaagtgctcatgctgcgcgtagtattgtgcaagcacaaggcaatgggcagatccatacactgggtgctattcaacatactccgttatacaacctaaatgatccattacaaagtttgtctcgtgaagaaaaaatagcactattacatgacgttgatcgtgtggcacgggctgaagataaacgtgttaaacaagtcaatgcctcattaacgggagtgtatgagcatgtgttagttgctgcaacggatggtactttagcggcggatgtgcgtcctcttgtacgtctttcagtaagcgtactggtcgaagatgacggtaaacgtgaacgtggttcgagtggtggcggtggtcgttttggttatgattattttctgactaaagaaaatggcgaaacccatgcagcgacttatgcccgtgaagcggtacgcatggcattagttaatttatcggctattgctgcaccggcaggtacaatgcctgtggttttaggcgccggatggcccggtgttttattacatgaagctgttggacatggtttagaaggtgattttaatcgtcgtcaaacatcggtattctctgggcgtattggcgataaggtaacttctgagttatgtactatcgtggatgatggttcaattgaaggccgacgaggctccgtggcgattgatgatgaaggcgtaccaggtcaatacaacgtattaatcgaaaatggcatcttaaaaggctatatgcaagataagatgaatgcgcgtttaatgggggtaaaaccgacgggcaatgggcgtcgtgaatcctatgcacatttgccaatgccacgtatgaccaacacctatatgcttgcgggtaaatcttctcctgaagagatcatcgccagtgtcgatcgcggtatttatgcgccaaactttggtggtgggcaagttgatattacctccggtaagtttgttttctcaacttcagaagcctatttaattgaaaagggtaaaattactaaaccaattaaaggcgcaaccttgataggttcaggtattgaagcgatgcaacaagtttctatggtgggtaatgatctcgcattagataaaggtgtcggggtgtgtggcaaagaggggcaaagcttaccagtaggggttgggcaaccgacactgaaattggataagttaaccgttggtggtactgcttaa

SEQ ID NO: 2022 - DNA, 768 bp, Proteus mirabilis
aaacggattatgagcactccaatcacacgacaaattgtactagataccgaaacaaccggtatgaacaaactgggcgttcactatgaaggccataatatcattgaaattggtgccgttgaggttatcaatcgtcgcttaactgggcgaaatttccatgtttatataaaaccagaaagattggttgatcctgaagcttttgaagttcacgggatcagtgacgaatttttagaggattgtccttcatttgcagaaatagcggatgagtttttagcgtatattcgtggtgcagaattaattatccataacgcctcgtttgatatcggctttatggattatgagtttcagaagcttaaccgtgatattcctctcacagaaactttttgccaaataaccgatagccttgctatggcaagggagttatttcctggcaaacgcaataatctagatgcgttatgtgacagatatttaattgataactccaaacgaacactgcacggcgcattattagatgccgagatcctcgctgatgtttacttagctatgaccggtgggcaaaccgcattagctttttcaatggaaggtgaaccgaacgaagagcaaaaaggggatgatatacaacgtattgtacgaccagtgcgtggattaagagtaataaaagcctctgcagaagagttagttgcgcacgaagctcggttagatttagtggtgaaaaaaggaggccactgtttatggcgtccagctcctgcttcgaatgatgaaactgcctaa

SEQ ID NO: 2023 - DNA, 774 bp, Proteus mirabilis
aatttagttattttagtaatagaaaggtataatattctgggcattgatatttctgaaaataaaactattagttttaacgctcatcatgaacgaagagtaattacttccattaataaaaatccaaaaattagtataataggtaaaaaaaataaaataacaatatatagtatttatcaacgaactaaatttggtgattatgaacgagatggtaatcctctaatatattcattaaaaggtatttttaactatacaataacaatcaatgaactatataaattcaaaccttcttttttagctatattaaataaaataagagataaaatagtaaatcaaaatattatatttatcgctatgccttcatctagtacagttccatacctattggctagaaggatttctcgtcatttcaagtcaacactctataatgagatatttataaaatgtacagtagaagaagttataaatcgttatgctaacagcacagtaaataaaaaagaaaatcatataaaattactaaacagaacgttatctgaattacaatctttacctcccaatacgattttcaaaatgaagcacatccctaataaaattaggcattatttttctccttggaaaatagatccaaactttaatattagaaaattaaataattacaatattattttaattgatgatttgctttcaacaggaacaacattaaatatggcaactatcgaactaaataatttaggatttacctgttctactgcaatatgtcttctaagtaatctttga

SEQ ID NO: 2024 - DNA, 549 bp, Proteus mirabilis
tttatggttatggaacagtggtttagcccaagcaaggcagtgttggtttttattctggcaacatttactggaggcctgagttctactgctgttgctaacttacctgcaggagcagtaataagagcgacccccgggattgtttatatcaatattactggaaacgtcatcgctccacctccttgcttaatcaatgacggcaagatgatcgaggtgaattttggtgaagtaatgagtacgcgtattaatgatagcaattataagcaacctatcgaatataccgcgacttgccaaaaaagaccgactaacgccatgaaagtctatataacaggtaatgcaacagggttcgatagtaatgccctacaaactaatattacgggattaggggtacgcattctttatcaaggtaaattattaggattaggctcagcggttaaatttacctatcccaatttgcctaaactagaagcgatccctgtgcgtgataatagagaaacactagttggtggagattttgttgccaatgccacacttcatgtagattatcagtaa

SEQ ID NO: 2025 - DNA, 1647 bp, Proteus mirabilis
gttcaggttatgattacagttttagattatttattagtaagattaaaagagttagaaattaaaactatttttggtgttcccagcgattataatttaccttttattggtgttgttgataatgataaagatattcaatgggtaggcgcatgtaatgaattaaatgcatcatatgcttgtgaaggatatgcacggatcaaaggtttttctgctctgtgtacaacctatggagtgggggagttaagtgcgataaatggtgttgctggcgcatttgcagagcagattcccattattcatattgttggcgcgccttctcagtcaaagcaagagaaaggaaaaacattacatcattgtttagcgacgggtaggtttgatgcctttgaaaaaatgtatcgtcatatttcaaaaacaacggctgtattaacatatcacaatgcgacggaagaaattgatagagtattagaaacattgtggcgttatcgatatccggtttatttattaataccagaggatgtcggcgtgatgaaagttaataaaccaaagttaccattacaattaacattacctcaaagtaatcccgatgatttaaataaagttattactcttcttgaaaataaaattaagcaatcaaaatcaccatgtattattattggcgaacaagtatcacgttaccaattaagaaaacaagttgagaatttattagaaaaaactaatctgccgttttttactgtatggggaagtaaaggggttgttgatgaagggcgtcaacagtatggtggaatattatttggtgaattatctaatccacaaggtttagattatattataaattctgatttaattattagtcttggggtgagttgggatgaagttaatacagcgggatttaccttcgacgttcccacacaaaattgctatcaattttatgatacttatagcttaatagaggaagagaagatttatggcgtttctttactcgatatgcctaacgccttattagcccttgactatatttatccccacaacatagcgttactaccgcaaaaaatagtaccgcctgattggcaaggactgataaaaatagattctattcctcttctgttagataaagtccttgatgataattcggttattcttgctgaagcaggtaatgcttttttatgtgctgttaatcatatattttctggtaacagtcaattagtggtcagtaatatttgggcatccattggttatactttacccgccgcattaggtgttactcttgcattagaaaaccaaggacgtgcctttgttgttattggtgatggtgcatttcagatgactgcacaagagctttctactttattacgcttaaaactcaatcccgttatttttattgttaataatcaaggttacgcatttgaaaagatcttttacgggcctaaagatacctttaatgatatccaaaactggaattactcacagttacctgagctatttaattgtgatgcttatagcgtgaaagtggatagtctagaagcgttagaaaccgtattacctttattaaaagtgcatcaagataaactgtgccttgttgaacttgatatggataaacatgactattcggagccaatcagtgaatttattgcgttgcttaatcagtataaatga

SEQ ID NO: 2026 - DNA, 231 bp, Proteus mirabilis
acaggatctatctgttcctttggcagacgcgctttatgtggcgcaggtctaaacagacttaacatattagcctccgatggcttttattttaatatgttgatattaaacaatgacaaaacgaacaacaaagtaatcaaaaaattttctttaacgaacgtaatagtaaacttgttgaagcaaatttactgtgaagtaatactcagttgtcgaataatttttcaagatgtgtaa

SEQ ID NO: 2027 - DNA, 588 bp, Proteus mirabilis
ggagttactatgaaattgcttccgattaccgcagtactttgttccgcgctattgctacaaggctgtattggtgccgctgtggtgggtactgctgccgttgcaggcaaaaccgcaaccgatcctcgttcattaggacaacaagttgatgatggcacattggaagcccgagtttctggtgctctaaataaaaaccaacagatcaagaacagtaatgcgcgcattgtcgctaccgcttatcaaggaaatgtgttgttaactggacaaagtccagatatgtcggttgcagagacagctaaacaagttgctagcaaagtggaaggagtaaacaatgtttataatgaagttcgccaaggtgagcctgtgacattaggcactgcttcttcagatacatggttaaccactaaagtacgttcacaaattttagctagcgatgccgtcaaatcatcttccgtaaaagtgatcaccgaaaatggcgaagtattcttattagggatattaacccgtcaagaaggggctgcagccgctaaaattgccagtgaaaccaaaggtgttgttaaagtaacaacggcatttacctatctaaactaa

SEQ ID NO: 2028 - DNA, 1461 bp, Proteus mirabilis
ccattgactatgaagtttattattaaattattccccgaaatcacgatcaaaagccaatctgttcgtatacgttttatcaaaattctgaccagtaatattcgcaatgtattaagtacattaggtgatgatatcacggttgttcgccactgggacaacattgtggttgtcagtaaagacgaaagtaaaagcgaagcggtgtgtgatgcgctaactcgtatcccaggtattcatcactttttacaagttgaagagcatagctataccgatttacataatatttttgaacagacctttgctgcctttggtcatttagttgaaaacaaaacgttttgcgtaagagctaaacgccgtggtaaacacagttttacttctaatgaagtagagcgttatgtgggtggtggttttaaccaacacgttgaaagtgcaaaagtaaaattaactcgtccggatgtgaccattaatctagaaattgaagatgataagctgatcctagttaatgctcgctatgaaggtattggtggtttccctattggtacacaagaagatgtattatcacttatctctggtggttatgattctggtgtatcaagttatatgttgatgcgccgcggtagtcgtgttcattactgcttttttaatcttggtggttcagcccacgaaattggcgttaaacaagttgcacattatctttggaaccgctttggacgctctcataaagtacattttgttgccgttgattttgaacccgttgtggcagaaattttagagaaaattgatgatggccagatgggggttgttctgaaacgtatgatggtgcgtgcggcatctcgtgttgctgaacgttatggcgtacaagctattgtaacaggtgaagcattagggcaggtttctagccaaacattaaccaatctacgtttaattgataatgcgacggataccttaattctgcgtcctcttatcacacacgataaagaaaatatcattaatatcgctcgccaaattggtacggaagattttgctcgtactatgccagagttttgtggtgttatctccaagaatcctacagtaaaagcggttaaagccaaaatcgaagctgaagaagaaaaatttgatttttctattctcgatagtgttgttgaaaatgctaagaatatggatattcgccgtattgctgaagagacggtacagcaagtaacagaagttgaaatggtctctgagtttgcaacgaatgacgttgtactggatatccgctctccagaagaacaagaaaactcacctctaaaattagagggtgtagatgttaaagaattaccattttataaattaagtacacaatttggtgatttagataacagcaaaacttatttgctctattgtgagcgaggtatgatgagtcgtttacaagcactgtatttacgtgaacaaggctttaataacgtaaaggtgtatcgtaagaagtaa

SEQ ID NO: 2029 - DNA, 1338 bp, Proteus mirabilis
catacttatattacaaaacatggggtaaaaaaagtgaatgaaatatatgaaatagcctattcagcggcagcaaatagattatgtttgtttacaggaaccggtttttctaaagcactaacgaataacaaagctcttggctggcaatctttacttgaaaaagcctgtgataaattagatggtttaaataaagtcaaaaaatcactttttcccgaagatggaaaaaatccattaagcttagaagaagcggctcaagttatttatattgaatatcaaaaaaaaggagaaaatttacatgaaaagatagcagaaataataaaagaaattcatttatcaaaagataataagcatgtaaagaatttcttagataataattcaataagaataataacaacaaattatgataaacttatcgaagaaatgatcccaataaaaaaatgtcaatctcttgcacctggtttaccaataccaaaagcatcttccagtacaaaaatttatcatgttcatggttctattgattcgcctagtaatatggtagttacttctgatgattattttaaatttataaactataactcttatttttctaagaaaataagctccatgatttatgaaaatacaatcgttatattaggctattctcttggagacactaatcttaaagcaattattaatgagtacaaaaatttctcacgagaaaatgttattggttcctctatgtttttagtatcgagaaagaaagtagaatcttatttaaaagagtattattttcattgttatggcattagagtcattgataatttagatattcatgacttttttgataaattaaattcaaaaattcaagatgtacaaaaaagagtagaagattcgttagagaatatcgaaaaagtactgagtggaaaacacagcttttctaaaagttttctcaaggttgaaaataatttttatgaaataattatgtccttagctgcatttggtgttcttgtgacagatgccaaggcaatgaatatgatagaaaaaataatacaggaaaaaataaaactaacgagcgaaaatagtgcatgggaacaatatgttcatttagcaaattggctaatttatcttgcaacaattatcgaaataaaagatacatccttagaaaaaatatatcttaaagcggtatttcattcgatgaatcatatgagtaaagactattctataggatattcttggcacgcctataaagcatgggaaagtaagtggttttcgcttattgtatcaaatagagtcatgctaaaaaactatgtaagcaaaaacattaataaccaagatgctgttaacttagtgaaaaatctataa

SEQ ID NO: 2030 - DNA, 321 bp, Proteus mirabilis
gttgtgtatatatttcacacaacctatttggtatcctataaaaactgctatatggcagtttttataggagctattactatgatccagtatggcaaagtatttatgagcaatagaacacaaaatgttcgattacccgctgagactcgatttccggatgatgtaaaagaagtttttgttcgcgtcaaaggcaaagagagaataatcacacctatacaaaatgcatgggatagctttttcttatcagaaaagtctgtaacagatgatttcttatctgaaaggcctgatcaagccacaagtgaaagaggatcctttgatgattaa

SEQ ID NO: 2031 - DNA, 1188 bp, Proteus mirabilis
gttaacaatatgacagcaattattagacaatttttaagattagaggcatcaggcggtattcttctgattgttgctgctattatcgcattaataatggcgaatacacctcttagtgctttgtataatgagtttttatctatcccaataatgattaaatttggggcattagagctagataagccgttgatcttatgggttaacgatgcactcatggccatctttttcttagtggtaggattagaagtcaaacgggagctaaaagaaggttcattagcgcaacgtgatcgcgctatttttcctgcaattgcagcagtaggaggaatgttagcacctgctttgatttatctattttttaatcatggcgatgcgattggtcaacaaggatgggctattccggcagcaacagatattgcttttgctctaggtgtaatggcgttactagggcgtcgcgttcctgtggaattgaaagtctttttattagcgctagccattattgatgatcttggtgtcattgtgattattgctctcttttactctaagagtgtggcattagtcccgttattattggcagcgctaatcaccatcatgttgtttattcttaattggcgtaaagtgagtaatacagcagtttacttagtcctaggctttattttgtgggtgtgtattttgaaatcaggtatacatgccacaatagcgggagtgattgttggattcctgatcccattaagagataaagagggggcttcaccgtcggaagagttagagcatgttttacacccgtgggttgcctacttaatattaccgctatttgcttttagtaatgcgggggtttctttaaatggcgttacccttgatggcatgttatcgaccttacccgttggtattgcattagggcttttcttaggtaagccgattgggatttttctctttagttgggtttcggtaaaactagggattgcaaaattgccagatgcgattaatcttaagcaaatatttgccgtttctgttttatgtggtatcggttttactatgtctatctttatcgcaggtcttgcgtttgaaggtgctatagaagcctataatacatactctaaactgggtattttagttggctcaaccatggctgctgttgtgggatatttattgcttaactctgttttaccgaagttgaagcagaagcaaaaatag

SEQ ID NO: 2032 - DNA, 1434 bp, Proteus mirabilis
gcaataaatatttttgataacaatatcaagagactcatattcatgttgactaaaaaaagaaaattactacttagcgcattagcgatgagtgttggtttatcactctctactctcccggcaaccagtatggctgccctgccttcggtaatgccatctggagaacaactacctagcttggctccgatgctagaaaaagtcttgcccgctgtggtcagtgtgcatgtttctggaactcgagtgcaaagccagcaggttccagaagagtttaaatttttctttggtccaaattttccttcacaacaacaaagcatccgcccttttgaaggcttaggttcaggggtgattattgatgctgaaaaaggttatgtattaaccaataatcacgttgttgatggagccgataaaattcaactccaaattaatgatggccgtgaatttgacgccaaattaattggtagcgatccacaaacagatatcgccctgctacaaattgagaaacccaataacttaaccgccattaaaatgactgactcggataaattacgtgttggtgactttgcggttgctgtgggtaatccatttggtttaggtcaaaccgcgacttccggtattatttcagccttaggtcgtagtggtttaaatctggaagggttagaaaactttattcaaactgatgcatcaattaaccgtggtaactctggtggtgctttagttaatctcaatggtgaacttatcggtattaataccgcaattttagcaccaggtggtggcaatattggtattggtttcgcgatcccaagtaatatggcgcgtgatctcagccaacaactgattacacatggtgaagtgaaacgcggtattttaggtattcgcggtactgaaatgaatgctgatttagcgaaatcctttaaaattgatgcccaacgcggtgcttttgtcagtgaagtattggcggactcttccgcagctaaagccggtatcaaaccaggtgatgtccttatttctattgatggtaaacgcattaatagctttgctgaattaagagcaaaagttggtacaacaccaccaggtaaagagatcctgattggtttgatccgccaaggaaaaccaatggatgtcaaagttacactagagaaacaatcagcagatgcaacgcgagcggataacttctctcccgcacttcaaggggcaacgctcagtaactatgttaacaaacaagttaaagcggttgctgtagattctgtggagaaaggctcagcggcagcagcatcggggttacaaaaaggcgaccttattattggtatcaacaatatgccaattggctccttaggtgacttacgtaaaaccatcgatgctaaaccaccggttcttgcattaaacattaaacgtggcaacgaagaaatttatcttctgttacgtaacagctcgcgttaa

SEQ ID NO: 2033 - DNA, 726 bp, Proteus mirabilis
gtagcaaatatgcaaaccccgcacattctgattgttgaagatgaagtagttactcgtaataccctgaaaagcatattcgaagctgaagggtatatcgtacacgaagccactgatggcaacgagatgcataatattctgtccgaccatgatatcaatctggtcattatggatattaatcttcctggtaaaaatggtcttctattagcccgtgaattacgtgaacaggtaagtgttgcattaatgttcctaacaggtcgtgataatgaagttgataaaatcttaggccttgaaattggtgccgatgattacatcactaaaccatttaatcctcgtgaattaactatccgtgctcgtaacttattgtcacgcactatgaatttagcgaatggcacagaagagcgtcgtttagttgaaagctataaatttaatggttgggagctagatattaatagtcgctctcttattagccctacaggtgaacagtataaattacctcgtagtgagtttcgtgcgatgttacatttctgcgaaaacccaggaaaaatccaaactcgtgcagaattactgaaaaaaatgacgggtcgtgaattaaaacctcatgatcgtactgtagacgttaccattcgtcgtattcgtaaacactttgaatcaacccctgatacacctgagattatcgccactatccatggtgaaggttatcgtttctgtggtgatttagacgagtga

SEQ ID NO: 2034 - DNA, 738 bp, Proteus mirabilis
ggagaaaatatgatgatctctttgaaagttatttctctgttattggattatcccagcgaagatctctgggaacatcgtaatgagatcattgatgcattgcaggaagctgacgagcttcctgtcacgcaagtcgcaaaattaatggcgtttattcgtgaactcacgcaacaagatctgctggatgcacaagcgaattacagtgagatttttgatcgaggtagagcgagatcgctattgttatttgaacatgtacatggtgaatcgcgtgatcgtggtcaggcaatggttgatctgcttaatcagtatcaacaagcagggatcaccttaagtagtcgtgaattgcctgattacttacctacttaccttgagtatttaacgctattgcctaccgatgaaagtattgaagggcttaataatattgcccctattttggcattgctgagtgagcgtttaaaacagcgaggcagtgattatcacgctctttttgatgtattgctttgtctctcacaaagtgagttagacgcttcacaactggcggctcaagtagaaaaagagcctgtagatgatacgccggctgcattagatgccgtatgggaagaagagcaagtgacgtttctaggtgaaagtgcgcaatgtggtagtaacaatattagccagcatcagcgacgttttgcgcaagaaacgcctgttcaatatctcaatgtcggtaattcgctagatatgggagcacaaaaatga

SEQ ID NO: 2035 - DNA, 336 bp, Proteus mirabilis
tgggtgaatattatgatgatgaattttgattttgcgaatatagatgtaaatgcttctgtaggtaaaaagatccaaaaaaaacgtaaagagctgggttataccggtatgcagctggctaaaaaaattggtgtcagccagcaacagttttctcgctatgaacgaggtatgaacaaaatagatctcagacatttagtgttgttagctctctatttgaatacacccatttattggttttttgaggattgttacgtaaaaaagccttcattaaataataaaggaatagataaacgtaattatgttattgctcaagcaacacctgatgcttttcattattga

SEQ ID NO: 2036 - DNA, 2250 bp, Proteus mirabilis
ggagagaatatggttgcagttagaagtgctcacttaacacctgcaggggagtttgccgttgataaatgggttaatagcttgaatttaactcatgcgaatgcggggagtgaaatcatgcaaacctgggaatactgtcatcgtactgttctgggccgtgaagatgcgcaactgttgctatggcgcggtgttgagatggttgaacttctttcgacactcagtatggataaagatagcatgagggcagcacttctcttcccacttgctgaagaagatcttattaaccaggaagttatcactgaacattttggtgaggcgatatggaatttagtgcgtggcgtaatggagatggatgctattcgccagcttaaagcgacacataccaacgaaactagctcagtacaagtcgataatgtacgccgtatgttattgtctatggtggaagattttcgttgtgtagttatcaaactcgcagagcggattgcccatttacgtgaagtgaaagatgccactgaggatgaacgagtcttagcggcaaaagagtgttttaatatctatgcaccattagccaatcgattggggattggacaattaaaatgggagcttgaagatttctgtttccgttatcttcatcctgatgaatataagcaaattgcaaatttactgcatgaacgccgtattgatcgcgaacagtatattgataatttcgtcagtacggtgcgtggttatatgcagcaagagaatattgaagtcgatatctacggacgtcccaagcacatctatagtatttggcgaaaaatgaagaaaaaaaatctcgcctttgatgagctatttgatgttcgtgcggtacgtattgttgtcgaacgcctacaagattgttatgccgctttaggtattgtacatactcattttcgtcatttacccgatgaatttgatgattatgttgccaatccaaaaccaaatggttaccaatctattcatacggtagtacttggccctgaaggtaaaaccgttgagatccaaatacgtactcgtcagatgcatgaagatgctgaattaggtgttgcagcgcattggaaatataaagaaggtgctactggtgcaacaaccaaaggcgggacgggaagttatgaaaatcgtattgcgtggttacgtaaattaattgcatggcaagaagagatggctgattctggtgaaatgctagatgaagtacgtagtcaagtatttgatgatcgcgtctatgtctttacgccaaaaggggatgtgattgatttacctgcaggctcgacaccattagattttgcttatcatattcatagtgatgttggtcatcgctgtattggtgctaaaatcggcgggcgcatcgttccatttagctatcagctacaaatgggtgatcaaattgaaattattactcaaaaacaccctaatccaagtcgagactggctaaaccctaatcttggttatgtgacaaccagtcgtggtagagcgaagatccacaattggttccgtaaacaagatcgcgataaaaatattattgcaggccgccaaatcttagataatgaattagcgccgcttgatatcaatatgaaagaagcagaaaagctgctgattgctcgttataacgtccatagtcttgatgaagtgctggcaggtataggcgttggtgatatccgtatcaatcaattagtcaatttcttacaaagtaagctgaataaagccacagcggaagatgaagacaaagaggcgttacgctcattagaaaataaaacggctacaccaaaaacaaccacgtcaggtggtggcagtattgtggtcgagggtgtcgggaacttaatgcatcatatcgcacgttgttgccaacctattccaggcgataatatcgttggatttattaccaaaggacgtggtatttcaattcaccgtgcagattgtgatcaattagctgagttactttctcacgcaccagagcgtattgtcgatgcggtgtggggtgagaattactcaagtggttattcattagtggtgcgggttgtggctaatgatcgcagtggtttattacgcgatatcaccactattttagctaatgaaaaagtgaatgtgctgggagttagtagccgcagtgatgtgaagcaacaaatagcgaccattgatatgaatattgagatttataatcttcaagtattagggcgtattttagcgaaactcaatcaattacctgatgtcatagaagccaaacgcttttctcattaa

SEQ ID NO: 2037 - DNA, 633 bp, Proteus mirabilis
gagacagatatgtcatttaacgacacccaggaacaattcgcacctaatatggctttggtgccgatggttatagagcagacttcacgaggtgagcgctcttacgatatttattcacgtttattaaaagaacgtatcattttcctgactggccaagttgaagatcatatggccaatctcattgttgctcagatgttgtttttagaagctgagaacccagaaaaagatattaacctgtacattaattcaccgggtggtgtgatcactgcaggtatgtcgatttatgacacaatgcaatatatcaaagcggatgttagcactatttgtatgggacaagcttgttcaatgggtgcatttttattatctgcaggtgcaaaaggtaaacgtatttgtctacctaactcacgtgtcatgatccaccaacctttaggtggataccaaggccaagcgacagatattcaaatccacgctcaagaaattttgaaagtgaaatcgcgtatgaatgagttaatggctcaacatacggggaaatctattgaagaaatagaaagagatactgagcgtgatcgtttcttatccgctaacgaagcgttagaatatggtttagttgataaagtttatacacaacgcagctag

SEQ ID NO: 2038 - DNA, 651 bp, Proteus mirabilis
ggagcagatatgcaaattaaaagttattttaaaaacacgccattatcgctaaaaagcattaataatgagagttataaatttaatacaaaattgaaatcagctatattaagttgttataatacaatatcctcttttataaaaccattttttcataaaacttcaaataattcagaatttaaagttcatatttctaatattgaaaatatgaaaaagaatgaaaatatacaatcagataataaagtaataaacacgcctcactcaatgaaagatgataatgataaatttggagatttatctaaagtacacaaaaagtttaaagttgatgaaataataaatttaatcattaatgatattatctctgttttagaagaaaaacctacattagagaaaggaaaaattatacaatttgaggatgagttacattctcactctaaaagtattttatcatctactaatggcttgtctttaactgagattaaaaataaatttttagcatcaatcatcgatagcatattaacttcagacgaaaaaataaaatctgaatttgggaatattaataattataaatattttttatcaaatagtataaatgagacggttagtcgttcactggctaaagataaaaatcttgtaaaaaatggcgataaataa

SEQ ID NO: 2039 - DNA, 1023 bp, Proteus mirabilis
acctgctgtatggcggtaaacgcatcaagaaactgtctatttaaggagcacgttgtggcacaggattatactgttgaacaattaaaccatggtcgtaaagtcattgactttatgcgttgggacaacgtcgcctttactatttcgtttctgcttttggtagcatccatcgctatcatttccgtgaaaggatttaactggggattagattttactggaggaacggttattgagatcaatctcagtcaaccggccgatctagataaaatgcgtgatagcttggcagccgccggctataaagatcctctgttacaaaactttggtagcagccgcgatattatggtgcgtatgcctcctgttgaaggacaggctggtcaagaattaggtaagaaagtcatcgatattatcaatgttgaaattgataatgatgcaacagtcaaacgtattgaatttgttgggccaagtgtcgggagtgaattggctcaaacaggggcaatggcgttactttctgcacttatctgtattctgatctatgttggattccgttttgagtggcgtctagcattaggggctgttatttcacttgcccatgacgtggtgatcactttgggtattttatcactcttccaaattgaggttgatttaaccattgtcgcgtcattgatgtctgttatcggttattccttgaacgatagtatcgtggtatcagatcgtattcgtgagaatttccgtaaaattcgtcgtggtacctcttatgagatcatgaacgtttcactaacacagacattaagccgtaccatcatgacatcagcaacaacattattagttgtgttgatgctctatatctttggtggttcaatgcttaaaggcttctctttagtgatgttaatcggtgtttcattcggtactgtttcatctatttatgtggcttctgcattagcactgaaaatgggcatgaaacgcgaacacctgattgttcaaaaagtggaaaaagagggtgcagatcagacaacactcttaccttaa

SEQ ID NO: 2040 - DNA, 912 bp, Proteus mirabilis
gggagatgtatggatcaaaccaacatcatacgtgatttactcgcttggcttgacaataatctggatcagccactatccctcgataatgtcgcaactaaagcgggttactctaagtggcacctacaacgcatgtttaaagaagtaacagggcaggcgattggttcttatattcgttcgaggcgtctatctcgcgcggctgtggcattgcgtttaacaagtcgtcctatcttagatatcgctttacaatatcgttttgattctcaacaaacatttactcgcgcctttaaaaagcagtttgatagaactccagccctatatcgccgttctgatgagtggtgtgctgtaggtatttgtcctccaataaaattagatcctcagccttttcctaaatgggaatatgtgcaattaccggagataaaattgattggtattgaacaaacttgtagccatacactagaacaatgggccaatgcttgttccgatatgcgtcagacattttggcaaaattatattactaaggtaaacactatccctcatgaggtttatggcttgcaccatacgcaacacagtgatgagcatgaagatgaacagcgcgttatctacaccaccgccgttgagcctgcttatgcgagttttgtagaagatgatactgctgatgaagtcatattagaggctggcgattatattcgctttgacttcgagggagaggcaaaacgaggcgccatgcaggagtttttattcttaatttatggtgtttgcttgccaaccatggggcttactcgccgtaaaggacatgatattgaaaagtattatcttaaagaagtgcactatgacaatgtgatgaccgccgagccacaagatcatattaagcgttttgagtattatattcccattaaacgcgaattggcctaa

SEQ ID NO: 2041 - DNA, 504 bp, Proteus mirabilis
ggtgaaggtattgtaatgcgtacacttgtcttaggtattggtaatttattactaagcgatgaaggcattggtgttcgtatcgtagaagcgctcgaagagcgcttctctttaccggagaacgtcgatgttattgatggtggcacatcaggcatggaaattttgcaagatattgctgcaagagatttattgattgttgctgatgcagtaagaagccagcacgagccgggcagtatctttgtattacatgatgatgatgtacctgcattatttacccagaaaatttcaccgcatcaactcgggctatcggatgtattaatggctttacgtatgactgatgaatttcctcgcaaactgattttagtgggtattgaacctgcttcattagcgccaagtatgtcattgtcagatattggtcagcaatcgatggaaatagcacttgaacaagtggttaatattttgcgtgaacatgggatcaccgtaacccctaaagaggtaacagcatga

SEQ ID NO: 2042 - DNA, 330 bp, Proteus mirabilis
tattatatcttgttttatcttcaatgtgatggcattgtcaagggtgctaaattctgtctaattttttcatttgcttataaaggattggaatgggcatttaaggatcaatatcatttagccgattttttgggaaatgtgacggttgatatggcaaaaacagctttggctgctgctggagcttgggctgtaggcacagtattattatcaagcgctgtggtaggaggcagtgtagtagctgttgggttaattgtctttcttgtaggggttggtatcacgatgactttagattatatagataagcaatatggcttaagtgaaaaagtcatttaa

SEQ ID NO: 2043 - DNA, 186 bp, Proteus mirabilis
gatgctttcatgttgtctatttcagttatagaacaacgcgctattctatcaaatgactactttagtttcacgtcttatcaccagagaatactcggtttaatccccttttctgtggtaaaaaagaaaagcgcatcctttaaagatgcgctttatttcttaatcgattcgttttctgtttatccataa

SEQ ID NO: 2044 - DNA, 1479 bp, Proteus mirabilis
ggagatttcatgacagcagagctattagtgaatgtgactccctctgaaacccgagtggcctatatcagcgggggcatactacaagagatccacgttgaaagagaagccaaacgaggtcttgtcggaaacatctacaaaggtcgggtaagtcgtgtattacctgggatgcaagctgcatttattgacattgggcttgagaaagccgcttttttacatgcttctgatattatgcctcacacggaatgtatcgcgggtgaagagcagaaaaaatttaatgttcgtgatattgcgcaacttgtacatcaaggtcaggacttgattgtacaagtggtgaaagatcctctaggtacaaaaggggcacgtcttacaacagatatcacattaccatcacgttacttggtgtttatgccgggggcttctcatgtgggtgtttcacaacgtattgaaagtgaagaagaacgtgagcgcttaaaacgcttggtagaagagtattgtgatgaaaatggcgggtttattattcgcaccgccgctgaaggtgtcggcgaacatgaaataaaacaagatgctgcttttttaaagcgcctatggaataaaatcattgagcgtaaaaaaagaaataaaacgcgcattcaaatttatggtgagctcgctttagcacaacgtattttacgtgattttgcaggggctgaattagatagcattcgggttgactctaaattaacttatcatcaattacaggagtttattggtgaatatattcctgaattaaccgctaaacttgaattacaccaaggtaatcaacctattttcgatctctacggggttgaaagtgaaattcagcgcgcgttagagcgaaaggtcgagttaaaatcaggaggctatctgattatcgaccaaaccgaagcaatgacaacgattgatatcaatacgggcgcttttgttggtcatcgtaatttagaagagacgatttttaataccaatgttgaggcgagtcaggcgatagcgcggcaactgagattacgtaatttaggcggcattatcattattgattttattgatatgagtaatgaagatcatcgccgtagagtattagcttccttagaacaagcattgagcaaagatcgcgtgaaaacgaccatcaatggtttttcacaattaggtttggttgagatgacacgtaaacgaacccgtgaaagtctcgagcatgtactttgtgatgactgtcctacttgccaaggccgtggtacagtaaaatcagttgaaacggtatgttatgaaatattacgagaaattgttcgtgttcataaaaccatagacgcagatcgctttttggtttatgccgcccccgctgttgtggaagcactaaaaggtgatgaatcacatgctttagccgaagtggaaatttttgttgggaagcaagtcaaagtgcaaactgagctactctatagtcaggagcagtttgatgtggtgatgatgtaa

SEQ ID NO: 2045 - DNA, 1140 bp, Proteus mirabilis
gtcacgctcatacaggtagagtgtaaaactctgcctgttccaaatataggatcttattacatgtctaaagtttttgatttcgtaaaaccgggtgtcatcactggtgatgatgtacaaaaagtatttgcagtagcaaaagaaaataattttgctctgcctgcagttaactgcgtaggtacagactcaattaatgctgtattagaagcagctgcgaaagtgcgttctcctgttattgttcaattctctaatggtggtgctgcatttatcgcaggtaaaggtcttaaagctgaagcgccacaacaagcagctatcctaggtgctatttctggtgctcaccatgtacaccaaatggcagaatactatggtgttcctgttattttacacactgaccactgtgcgaaaaaactgttaccttggattgatggtctgttagatgcaggtgaaaaacactatgcgaaaacaggtaaaccactattctcttctcatatgattgacttatcagaagagtcattagaagaaaatattgaaatctgttctaaatatttagcgcgtatggctaaaatcgatatgactttagaaatcgaattaggctgtactggtggtgaagaagatggcgttgataacacaggtatggatagctctgcgctatatacccaacctgaagacgttgcttacgcttatgaaaaactaaatgctatcagcccacgtttcactatcgctgcatcatttggtaatgttcacggcgtttataaaccaggtaacgttcaattaacaccaaaaattcttcgtaactcacaagactatgtgtcagagaaatacaatctgccacacaatagcttaaactttgttttccacggtggttctggttcatctgcagaagaaatcaaagaagctgtaagctacggtgttgtgaaaatgaatatcgatactgatactcaatgggcaacttgggacggtatcttacagttctacaaaaagaacgaaggctatttacaaagccaattaggtaatccagaaggcgctgataaacctaacaagaaatactatgatccacgtaactggttacgtcatggtcaaacatcaatggttgttcgtttagagcaagcatttaaagagctaaatgcgattgatgttctgtaa

SEQ ID NO: 2046 - DNA, 192 bp, Proteus mirabilis
aacatcatcatagtaattctattattacgttttcttaaggttttttctttaaaacaacgtatcctaaactggaaaacaaaagtgaatgtcttttttcaaatattcttgctcaatgaagcgcttgtagggtatttaagtgaaaaaattttctgtctagtttttattgattttgttagagtgttgctgttttaa

SEQ ID NO: 2047 - DNA, 984 bp, Proteus mirabilis
gaggtcatcatgaaagcattattagtcgaacaacacagcgataaacttagcgccggcgtccaacatatcgatgaatcacaacttcctattcatgaggtcattgttgatgtccactactcgaccctaaactacaaagatggcttagccataacaggtaaaggaaaaattctacgccaatttccgatggttcccggtatcgatttttcaggggtggttcaccatacagaagatccccgctttcatattggacaacatgtgttactaaccggttggggggtaggtgaaaaccactggggcggtttagcacaaaaagcgggcgttaaaggtgattggttaacggcggtgcctgaaggactgtcgttaaaaaatgccatgatcattggcacagctggttttactgccatgctttgtgtgatggcgttagaacaaggtggcataacacccgatagtggtgagattttggttacaggtgccagcggtggtgtcggtagcaccgcaattagtttattaaccgcacttggctatcaggttaccgctctcagtggcagagccagcaatcacgattatttacgtaaactgggggccgagcatattatcacccgtgaagcatttgaggctgcgggtaaagcgttagataaacagcgttgggcaggcgctattgataccgtaggtggacaaatccttgccaatatcttgtcacaaacacattacaatggcaccgttgccgcctgtggattagcaggaggatatacgttacctactacagtcatgccatttattttacgcaatgttcgtctgcaaggtatcgattccgtctattatccagcagaaaaacgcgctcaagtatggcaacgtttactacagctattgcctgatacattttatcagcaaacagtaaccgaaattacactcaatgaggtgccacgctatgctcagatgataatggataatcaagtaacaggtagaaccttagttaagttgtaa

SEQ ID NO: 2048 - DNA, 759 bp, Proteus mirabilis
atggttgtcatgatggcgatatcaacgaataaggagagaaagatgaaaatagccgctcatagaggattttctggaaaggcacctgaaaacacattagctgcatttaaaatggcaattgattttgggtgtgaatggattgaaaccgatgtgcaattaacggcagatcatgtacctgtactgatccatgacaagacggttaatcgttgcacgaatggacaaggtgcggtgcgctttcatagtttggatgatttacaccgtcttgatgcaggcagttggtttagttcactttatcaaggggaaaaaattcccacactaagacaaggtttgcagttgataaagcgctcaggcactaagctcaatatcgaacttaaaacatggcctgatgatgatgtagagcgcttatgtttagcggtatctgaaatgataaaaagcgcagatatccctaacgaacaaatcctgttttcctctttcgatactcatgcattaatggtgatgaaacgttatctgcccgccattcgtcgaggacagctatgggatgatattcctgataatgcactagaaactttacaagctatagaggggtttagcgtgcattgtaattatcaatatttaacgcagcaacaagcggctatgttgaaacaagcaggctatgaaatttattgctatacccccaatgatcctaaagaagtgaaagattttgaagcatggggagtcgatatgttgatcactgatgtcccagatatttatcaacagaattaa

SEQ ID NO: 2049 - DNA, 696 bp, Proteus mirabilis
ttttgcgtcatttatcaccgctatctgagggtgataagccaattgttagaagatttttctcatcacgctcaagtgataataatttggcggggtgataatggtaagatcgcacaattaccaacgattagaagggaccccttctatcagatagagggtctaaaattacactttgccccaccggattttattcaagttaatgatgaaataaatcataagatggttgttcaagcgatagcatggctcgatttatcgccaacggatcgcgtactagacttgttttgtggcatgggtaacttcacattacttatggcaaagcgtgttgataaagtcgttggggtcgaaggtgttcctgcactggtggcgatggcgaaaaaaaatgctgaacttaatcaattagataatgttcagttttggcatgctgatttatccgccgatttttctgctatgccttgggcacaggaaggatttaataaagttctgctagatcccgcaagagcgggagctgcacaagtgatgtcacatattgtgacgttatccgcagaaaaaattgtgtatgtttcctgtaatccgaccacgttagccagagatagtaagatattattagattccggatatcagctaacccagttaagaatgttggatatgtttccacaaacagggcatctggaatcaatggcattgtttattcgcaaataa

SEQ ID NO: 2050 - DNA, 579 bp, Proteus mirabilis
cgaatttccatatcagaaaatgcttctggtacggttttaaaaggtaagcgctcacccaatacttttaagaaaagaggcccgcccactaatgaggctaataatccaacagcaagaccggcaacgatcaccgttcccatatcggcccctaactcattagtgacaaaaagcgctgcagggtgtggaggaacaatacaatgcacggccattaatgcagtacataaagggatggcgagttttaataatgaggtgtttgtttttttagcaatagagaatgctaatggaataagtagcactacccctacttcaacaaacagggtaataccacaaatcagtcccaccaataccataataacatccggtgataaccaacggcatttttgtaaggtgataccgatgcgctctgccgcccccgatatttccatcattttaccgagaatagtacccaaaccaataatggcggctaaaaatcccagcgttcccccaatcccattttcaattgcactgaccatttctaatgggttcattttcattgccataccgacaaaaaaactggcaagtagtagtgctaaaaatggatga

SEQ ID NO: 2051 - DNA, 372 bp, Proteus mirabilis
tcacttcccattttgaaaaaatttgagagtattattatgtcattaccttcttgtcctaaatgcaactcagagtatacctatgaagatggggcaatgtatgtctgccctgaatgtgcccacgaatggaacgatgctgagccaacaactgatagcgatgagctgattgttaaagatgcccatggtaatttattagccgatggggattcagtgacagtcattaaagatctaaaagtaaaaggtagctcaacgccactcaaaattggtacaaaagttaaagggatacgtttagtggaaggcgatcataatattgattgtaaaattgatggctttggacaaatgaaattaaaatctgaatttgtgaagaaaagctaa

SEQ ID NO: 2052 - DNA, 705 bp, Proteus mirabilis
tcactacccataaagatcctatcgaaaagggagcaaatcataatgaataatatgggagcagtcgcagacaaagcgactattttattaattgatgatcacccgatgttacgcaatggtgtgaaacaacttttaagtcttgatacaacattaactgtcgttggtgaagctggcgatggtattcaaggggtaaaattagctgaagagttagatcctgatttaatcctactcgatctcaatatgccgggtatgaatggttttgaaacactcgatcaattgcgattacgatcgctatctgggcggatcgttgtgtttagtgtatcaaactacagtgatgatctgatcaccgccttaaaacgaggagcggatggctatctcttaaaagacatggagccagaagagctattagccgctttaaagcaagcagccgcagggaaaatggtggttagcccaacattaacccccattttagcgcagtcgctacgagaagatcgttctgaaggtgagcgggatatagaccaactcaccccacgagagcgcgatattttaaagctgatagcacaagggctatccaataagatgatcgcacgtaaactcgatattactgaaagtacggttaaagtacatgtcaaacatctactcaaaaagatgaaattaaaatctcgtgttgaagtcgcggtttgggttcatcaacaacgtgtggattaa

SEQ ID NO: 2053 - DNA, 1284 bp, Proteus mirabilis
gggatcaccatggtgatgcaacttatagccgtagccgttattatcgtaacggtctatttgctaataaaaaaatatgaaacccgtatggtattgatcggtgccggcttattgttatgtattttaagtctgacaccgctcgatgctttcactgcatttagtgatcgcatggtttcatcatcattaattcaagctatctgttcaagtatgggttttgcctacgtgatgaaatacaccaagtgcgatatgcacttagtccatgttttatcaaaagtcctgactcgtcttggtttctttcttattccagcaaccgtgatcgtcacttattttattaatattgcgatcccatcagcagccggatgtgcagcggccgttggtgcaacacttattccgttattaatcgcggcacgtattcaccccgcaatcgcaggtggtgcggtgttatgtggtactatcggttccatgttaagccctggtatgtcacataacgcttttgtggcgaatatggccaatatggaagtcgtcgatttaatcgctcgccatagcccatatagtttaatggcaggagcaatagcagcagtttcactcgctgttgtcgctttagtgaaaaaagagtttaaagtctcttctgtagccacagatgtcgccaactcatcttctcaagcaacaccagaagcagtacgccctaattatttatatgcaactgcgccttttatcccattaattctattaatactgcctttcttcgaaacatttagtacttttaaactatctgtgccagcagcaatgttaattggtgccatttatgcactgatcatcacattaaccaatccggctcaaattactaaagagttctttaaagggatgggtaatgcttatggggatgtgctggggatcattatcgcagcagccgtatttgcagccggtctaaaagcatcaggtctgattgatgcctttatcaacttcttaactcactcacctgaatttgcccgttggggtggtacattagggccattcttaatggggattattactggctctggtgatgctgcagcatttgctttcaacgaaaccgtcacaccacacgctgcacaatttggttatgaaattcctgacatgggtatggcagcagcattatcaggcgcattaggtcgtacaatgtcaccattagcaggggcagccattgtttgtgctggtcttgccaatatcaaccctatggaaatcgcaaaacgtactgcaccgggtatgattatcggcgtcatcgctgttgcgttattcatgttataa

SEQ ID NO: 2054 - DNA, 333 bp, Proteus mirabilis
ataagcgtcttttggagcaatatcgcgatgagcaaacaaaatagacgcaccctagcattagcaagacgcaaaaagctgttgttggatgaaattcaacaacagcgcactcaattagcgcaagaggggcaaacatggttagaggtcaccgcgccttatgataaagcatggaatatcttaacctcgttaaaacctatcttgttaataggggcaagcgtggtatctctttatagcattaagcaccctaaaaaactggttcgttggggacgacgggcgataggcgctgttggtttaatacgcacattacagaagtctgtcaaaaaaaccgctgactaa

SEQ ID NO: 2055 - DNA, 588 bp, Proteus mirabilis
aatatagtctttttcaatgagtcatgtatacaaattattctaccagttaacaaaagtttgctttatcctagacaaaatcattctttcttctttttatggaataaatttaatatgtttaatttcaaaaagatactcgcactttctatcttgcttcctatgtcaataatggtgaaagctgaagaaattggttatgtcgatacggtttttaagttttttggtgccaatcataaaattgtcattgaagcttttgatgatcctgaagtcaaaaatgtcacttgctatttaagccgtgctaaaacagggggcatttccggtagtttagggcttgctgaagataccgccgatgcggctatttcttgccaacaagtagggccaatcgaattaagcgaaaaagtcttaaaaggtaaaaatcgtggtgatgttgtttttcaaaaaagaacgtcactagtctttaaaaagctacaagtggtgcgtttttacgataaaaaccgccatgcactgatatatcttacttactctgataaggttatcgatggctcaccgaaaaatgccattagtgcagtacccatcatgccatggaaagagtaa

SEQ ID NO: 2056 - DNA, 1290 bp, Proteus mirabilis
tttacatacattcatgtatgtttgtactatacatcgcaatcattcatcaacttaattattttttatcccgggaaacaacttttgaatagaggttttcttatgcgaaaaaacagaggggttttgcctctggctctgttagtgctttcaggcagcttggttattgctggatgtggcgacaaaaatcagtctgctggaggtccacctcctgctcctgctgtaggtgttgttacattagatgcgaaaccactgactatcacaacagacttacctggtcgtacatctgcttatcgtatcgcagaggttcgtcctcaggttggcggcatcatcttaaaacgcaattacaccgaaggtagttatgtagaagcaggaacatctttataccaaatcgatcctgctatttttcaagctacattaaacagtgctcaagctgatttagcaaaagcgaaagcgaatgctgaaattgctcgtctgactgtagagcgctataaacctctactcggcaccaattatgtcagtaaacaagattttgataccgcaacatctcagtacgctcaagctgttgctgcagtaaaagcagctgaagctacagtgactaatgcaaaaattaatcttgaatataccaaagtcaccgcaccaatttctggccgttcaggtaaatcaacggtaacagaaggcgcattagttgcgcctggtcagcaagtggctttaacaactgttcagcaaatcgatccgatttatgtcgatgtgacacaatcgagtgaagattatctgaaattaaaaaatgaaattgaaagtggcattattcgtcaagagcaaggcaaacctgttgttcacttaaccttaactaatggtcaatcctacgctcaaaaaggtcacttagaattttctgatgtgaccgttgatgaatccacaggctctatcactatgcgtgcaatcgtacctaatcctaaaggtgaattactgccaggtatgtttgttcgtacaaaattagaaaatggtattcgtcaaaatgctattttgatcccacaacaagctgttattcgtactcctcgtggtgaagcaacaaccatggtcgttaataaagacaatgtggttgaagtgcgtactattgaagtatcacaagcagttggtaataagtggctagtgaatagtggtgttcaggttggtgaccgcgttatcgtttcggggctacaaaaagcaaaacctgaaatgaaggttacgccacaagaagaaaatttagatgcaacagcatcaactgaaaaatctgaaccagcgaaggatcctcaataa

SEQ ID NO: 2057 - DNA, 192 bp, Proteus mirabilis
cttattcacattttatgcttaaaaatatattttgctgtttatattaaaaatataacgctaaatctttgtgaaacaatgcgaagttatcgtgtttcgtctccatgtttgcccaatagcttctatgagaattttttattaattattgagttaagtaatattatccattgcaacagggcgctgtttttcatctaa

SEQ ID NO: 2058 - DNA, 567 bp, Proteus mirabilis
ggattaaacatgaactctcgttatgtgcgtgctctcacgttgttatcattaattcccacttctgtcttcgctcttgagtatcccgtaggtcaaccaatcattaaaaatggcatggaaattcaaggtgtctatctacaacctatcacgatggacacagaggaaggccatcatgcaatgaagcacctacctgctgataaagctgatatccatttagaagcagatattcatgctgttgaagataatccgaatggttttgctgaaggtgattggatcccttatctcactgttgaatataccgtgactaaattagatgcaccggagaaaaaacagcagggaacttttatggccatggtcgccagtgatggtcctcattatggtgaaaacctaaaattagatggcaacggccaatataacgttacctataaaatttacccgccttcttacaataaagatgtcgtttttggtcgtcatatcgacaaagagacgggggtagccgcttggttcgagccttttgaagtgtcatgggattttaactatagcggtactggtcgtaaaggcagttactaa

SEQ ID NO: 2059 - DNA, 1344 bp, Proteus mirabilis
ttttcgaacatgaagacaaaagtgattttgttctctatattgctattggcgggttgccagcaatctaagagcataaaacccgatttgtctgcgataacacccacatctttagggacttcaacttcttaccaaccacaatatgatataaaaaccaatttgtggggttatgtagtaagtgaattaaaaatggatatccctgacaatgaaaggatttcgcagcaagaaacttattttttaaataatccaaaacatatacaaaccgttgcattacgtgcagagccttatatgtattggattattgaggaaatagaaaaacgtaatctaccgatggagcttgcactggttccggtggtggaaagcgcgtttaatcctcatgtcacctcttcagctaaagcggcgggcttatggcaatttgtccctgtcacagctaattattatggtctagcacaaaatcaatggtatgacggtcgccgtgatgttgtcgcttctactaatgcagccttagatttgcttgagcgcctttacattatgtttgatagcgactggcctttagcattagccgcttacaatgcgggcgaaggtcgtgttatgcaagcgataaaagctaatgagagcaaaaacctacctaccgattactggtcactttcattacccaaagagaccatgaattatgtgcctaaaattctcgccttaagtaaagttatccgtgacaatgaagccgatatcaccttcccgaaaagtaactatcgcgataaatcattagccgcaattgatattggcgaacagataacattaagcaaagttgctgaacttagccaattacctattacaaccgtaaaagactataacccaggctataagcgcgggatcaccgcaccaaatggccctcatgttattttacttcctcgtaataaacttgcgcagttccaaaatgcgtttgctgacgaagcgattttaaagaccatccgtttagcggtcgctaaagccaatcagtcgattaaacaagaaggtatttataaagtccgctccggtgattctttttatgctattgctcgacgttataatatgagcgtaaaagagctacaacgactcaatggattaagtgcaaagagcaccctattagttgggcaaacattaaaaattcataatgcaggtagtgtgaacaatcgtccaacaagcaaaccaaccggcgcttcaccaagttactataaagttcgtcaaggtgactcttattacagtattgctcgtcgtcacaatattaatcttaagcaattaatgagctggaatgctgatatcaagatgttaaaaccgggaacgcaattaacgctttacttaaaaaaatag

SEQ ID NO: 2060 - DNA, 1296 bp, Proteus mirabilis
gagtctgacatgagcaagtctgaaacgctttataatctcgcacaacaagtgatacctggtggcgtcaattcaccggttagagcatttaacggtgttggtggcacaccgctttttattgaacgtgctaatggtgcgtatatttatgatgccgatggacgtgcttatcttgactatgtcggttcatggggaccgatggtattaggccacaatcaccccgctattcgccacgctgtaactgatgcggtgcaaaaaggcctaagctttggtgctcctacggctgctgaagtggaaatggcaaatttagtcactgagttagtgccttcgatggatatggttcgtatggtgaactcaggtacagaagccaccatgagtgccattcgtcttgctcgtggctacacgggtcgtgacaaaatcattaaatttgaaggctgttaccatggacatgcagactgcttattagtcaaagcaggctctggtgcattgacgatgggacaaccaaactctccaggcgttcctgctgattttgttaaacacactttaacttgtacttacaacgatttaaattcagtacgtcaagcatttgaaaattatccggaagaaattgcctgtattattgttgaacccgttgccggtaatatgaactgtgttccacctaaagccgattttctaccgggattacgtgcattatgtgatgaatttggtgcattactgattattgatgaagtaatgacaggttttcgtgtcgcattaggcggtgcacaagcttattacgatgttgatcctgacttgacctgtttaggtaaaattataggtggtggcatgcctgtaggcgccttcggcggacataaagaagtgatgtctcaattagcccctatcggtcctgtctaccaagcgggaacattatcgggtaaccccattgcgatggcggcgggtctagcttgtttgcaagaagtttcacaaccgggagttcaccaaacactggatgaacttaccactatgttagcggatggcttacttgaaaaagcacaacaagcaggtatccctatggtagtgaaccatgtaggcggtatgtttggtttattctttaccgatgccaaagaagtgacctgctatcaagacgtaatgaactgcgatgtcgaacgctttaaacagttcttccacttaatgttagaaaaacgtatttacctcgctccgtcggcttttgaagcaggctttatgtctatcgctcatagcaaagaagatattcaacgtactatcgatgcggctgaatatgcctttagcaaaatgaaagcgtaa

SEQ ID NO: 2061 - DNA, 846 bp, Proteus mirabilis
ttaactgacataaataactcaatttacacgcaacacgccatggagtttattatcatgaagccggttacgctatctacgctcaatcgctataaacaagaaaagaaaaagtttgccactatcacggcttatgatgctagctttgctcgtctatttgccaatgaaggtattcctgccatgttaattggtgattcactcggtatgacactacaaggtcatgacagcacattacctgtcaccgttgagcaaattgcctatcatacccgttgtgtaagagctggcgcccctaacgctttcttaattgctgatatgccttttatgtcttattccactccagagcaagcctgtcttaacgcagctattttaatgcaagcgggagcgaatatggtcaaaattgaaggaggaagctggcttattcctacagtcaaaatgctcactgaacgcgcagtgcctgtttgtattcacctaggcttaacccctcaatctgttaatgtgtttggtggctataaagtacaaggtcgagaagaagctgctgcagagcaacttaagcaagatgctatggcgcttgaagccgcaggagcacaactagctgtattagaatgcgtccccgtttccgtagcaaaaactattaccggatcactcaatattcccgttatcggcattggtgccggcaatgtcactgatggacaaattcttgtgatgcatgatttattaggtctaacacctaatgcccctaaattttctaaaaatttcttacaagaagctggctccttacccgaggctgtcagactgtatgttcaacaagttgaacaaaaactgttccctcaagaacaacactcatttaactga

SEQ ID NO: 2062 - DNA, 351 bp, Proteus mirabilis
ggtatagacatgcatgaaatcacgctttgccagagcgcatttgagataattgactcacaagctaaattaaataatgcgcaaaaagtaaaaagcgtttggatggagatcagcgcactatcttgtgttgaagtctctgcacttgagttttgctttgatattgtttgtcgagatactatcgcacaaggttgccagctacatattgaggttatcccagctaaagcatggtgttgggattgccatcaagtggtgactgtttcgacttttaatgcaggttgtcctgcttgtggtagtcaaaatttgcgggttgagaatgacgatgcaatgcgcataaaacaaatagagatcgaatag

SEQ ID NO: 2063 - DNA, 336 bp, Proteus mirabilis
gatcattgcattatctgcgacaactggcgaaggtatggaagagtggttagcttggttggagagccgtttatgtgcttaggtgttcctgccaagatagttgaggtgggcgatgacgtccaccaactcgcttatgctgaagtcagtggcgtaaaacgtgccgtcaatatctctatggtttgtgagggtgacccgtcagagttattagataagtgggtgcttattcatgttggatttgccatgagtattcttgatgaacaagaagctcaagatactctggatgcattacaacatgtatatggtgttacccttgaagaggctgatgatgcaatacgttga

SEQ ID NO: 2064 - DNA, 252 bp, Proteus mirabilis
tactgttgcatgatgataaaaacattatcaatgatcattcttgttgcaacagggattatcagtaatgcaattaccacccaaaatagggcaacagaattacgtggattagtttgtaattcaaaacgtgaaagtgtctctagcggtaacacatggcgcacttgtgttagggttttatggagcatttttatcattagaaaaagagaggcgaagccgatgaaaaaaagtaaacagccttctctcaaccctagatga

SEQ ID NO: 2065 - DNA, 252 bp, Proteus mirabilis
ggaaatcgcatgaacgagaaaaaaaccatagtgccagattatcgtcttgatatggtcggtgagccttgtccttatcctgcggtggcaacattagaagcgatgccgtcactgaaaaaaggtgagatccttgaagtggtaagcgattgtcctcagtctattaataatattcccttagatgcgaaaaactacggttataccgtattagatattcagcaagatgggccgacaatacgctatttaattcaaaaatag

SEQ ID NO: 2066 - DNA, 1461 bp, Proteus mirabilis
gagatgagcatgacaatgcaaactgaggttatcgtgccactggttggctatctcttattggtcttcctattatccgcatacgcatatcgtaaacgtgaaaaaggacaatttcttaacgagtattttcttggtaaccgctctatgggtggatttgtccttgcaatgaccatcacggcaacctatgtcagtgctagctcttttattgggggaccaggcgcggcttacaaatacggcattggttgggtacttctttcgatgatccagctccccgctatttggctctccctcggggtactaggtaaaaaatttgctattttggcgcgtcgttataacgccgtcaccctaaatgatatgctctatgctcgctaccaaagtcgctttttagtctggtttgccagcttaagtctactggtagcttttgttggtgccatgaccgtacaatttattggtggtgctcgcttattagaaaccgcggcgggtattccctatgaatttggtttgctgatatttggtatctcaatcgcattatatacagcgattggcggatttagagccagtgtattaaatgatgccttacaaggccttgtgatgttattgggcacctttattttgctttttgccattatctacaaggcgggtggtttagatattgcaatacaaaaactaaatgctatcgatcctgcccttacctctcctcatggtgctgacggcattttaactggcccctttatggcgtcattttgggtattggtctgttttggggttatcggccttccccatactgcagtgcgctgtatctcttataaagacagcaaagccatgcacagagggatcatcatcggcaccatcgtgatggcgttattaatgtttggtatgcactttgcgggcgcattaggtcgggcaatcattcctgatctcaccgtgccagatcaagttattccaaccttaatggttgatgtattaccgccttttgctgccggtatatttttagcggcaccgatggcagccatcatgtcaacgattaacgcacaactgctacaatcatcagcgacattggtcaaagatctctatctcaatctcgcgcctcatgccataaacaatgaaaaacgcattgcgcgtttatctagcctatctactttgattttagggatcttattgctatttgctgcatggaacccgccatcaatgataatttggctcaatttacttgcctttggtggactacaagcggttttcttatggcctctagtacttggcctttactggaacaaagcaaaccgttatggcgcgattgcgggcatgataaccggtgccacactctatgctacactggcaacatttaatatccagattgctggatttcatcctattattcctgcgctgttattgagcttagtggcctttcttgtcgcaaataggtttggagaacaaaccttgcctcaatctgctccattacagtga

SEQ ID NO: 2067 - DNA, 240 bp, Proteus mirabilis
actcacttaataaccataacattaaaaagtggtaaaaatatgaacaacaacaacgacgaactcaataatgctctatatcgagtcgctttagtgttagataaagggcttgaatcaacaagagaactagcagctggttatgtagaaacaatgggattggggtttgatagatctgttaggaatctatcgtatttttttgatggctatgaagatgtctatgaaaatataaaatataaaatataa

SEQ ID NO: 2068 - DNA, 894 bp, Proteus mirabilis
aagagattaattatgccttggatacaattaagactaaatgccacctcagaaaacgccgaagccattggtgatgagttggttgaaagtggcgcggtatcagtaacctttcaagatagccacgatacccctatttttgagccattaccgggagaaactcgcctctggggtgataccgatgttattggcttatatgatgcagaaaccgatatgagtatcatcgtggctatgttagaaaacacggcggtgctgggtaaaggatttgtacataaaatcgaacagttagaagataaagattgggagcgcgaatggatggataacttccaccctatgcgctttggcgaacgtttatggatttgcccaagctggcgtgaagtgcctgatcctaacgctgtaaatgtcatgctcgatccaggtctggcatttggtactggtactcacccaaccacctctttatgtctacaatggctcgatggtttagatctcgcaggtaaaaccgttatcgactttggttgtggctctggtattttagccattgcagcattaaaactgggggctgcgaaagcgataggtatcgatatcgacccacaagctatccaagcaagtcgcgacaatgcgcaacgtaacggtgtcgctgatgcactgacgctataccttgctaaagaccaaccagacaatctcagtgccgatgtagtggtcgccaatatcttagctggcccattacgtgaattagcacctattatcagcacactgccacgtcaagggggtcatttaggtctttccggtattcttgccacacaagctgacagtgttgcacaagcttatcaagaacaatttactttagatcctgtggctgaaaaagaagagtggtgtcgtattaccggagtgaaaaaataa

SEQ ID NO: 2069 - DNA, 975 bp, Proteus mirabilis
ggtaagttaatgttgagtatggaaaaaattaagcaaccctattggccagcattaaaattgatattaagttcacttattgtttttagtttctatttgaaacaaagccatacccctgacttttcattactgattaatatatttgatttaacattaattcctatgtttgtttttattatcgggtttattactaaaaatgggacatggaaaagttggcgtgataatttattggctgccttagtgatttatgcgactttccaaactattgatatgatccctctttattattcagggcaatttgaccttaatacttaccttctttttcctcaaaatggtgtgtggttttttcttgctacacctatttggcaagcttttttcctattgttaccttcatacatcagacatcataaaccaatattattctctcttctgcttgtcagtattttgctatcgttgttaactaaaggctatgaaactaaactatccactttcttggctataatacaatattttccattttttattatcgcttatttagtagaccaacaaactattgctaaattgagaagtcaatcttctgtggttattgctttaataagtttattatcaatatttatactttattatcaatctaatatcaattatattattctaacaaaattagaagggagtctattttttgcaaaattaattatatatattatctctttattgataagttttattttaagcgcagggattatttaccttgcaccaaccactcaaaaatacgcttctcttgccaataatgcgttaggtgtttatctaattcatccaattatttgttttatccttttacaaggcataatcttttttcagttatctcttacattaccgatggtttttgcactcatcattatcacgattagcctagcactattattggcatcaattaagcttattcattggtttattagcccaacttttaatatccgatag

SEQ ID NO: 2070 - DNA, 231 bp, Proteus mirabilis
ctatatataatcagcggttcagatttcccattgattacattttcatcaatgaccactttctctgcattttcaaatgaaggaagatcgtacattgtatcaagtaatgcagcttctacaatggaacgtaaaccacgcgcccctgtcttacgcgacatagcttttttagcaatcgcggttaacgcatctttacggaactctaaatctacaccttctaatttaaacaatgcttga

SEQ ID NO: 2071 - DNA, 438 bp, Proteus mirabilis
ttttcaataatgaaaacttttacagctaaaccagaaaccgtaaaacgcgactggtatgttgttgatgcagacggcaaaactttaggtcgtttagcaactgaaatcgcacgccgtttacgcggtaaacataaagcggaatacactccgcacgttgatactggtgactacatcatcgttttaaacgctgagaaagtagcggtaactggtcataaacgtactgacaaagtttactaccgtcatactggtcacgtaggtggtatcaagcaagcgactttcgaagagatgatcgcccgtagtcctgagcgtgtaatcgaaatcgcggtaaaaggcatgctgccaaaagggcctctgggtcgtgctatgtaccgtaaactgaaagtttacgcaggcgctgagcacaaccacgcggcacaacaaccgcaagttctggacatttaa

SEQ ID NO: 2072 - DNA, 669 bp, Proteus mirabilis
cagaagataatgcagaaaaaaacatcaccacagatcctttgccaaaaaatcgctgatattattcgccaaaaaattactatcggcgaattacctccaggagagaggctttcagaagctactttaagcgagcagcttgaaatatctcgtaatacattaagagaagtatttcgtatattaacccaagaaggcctattaacctataaacctaatcgtggtgtgtttgtttctgtaccagatatggcatcaattatggatatttatcgcgtaagaaggctgattgaatgtgatgctttacgacatgcctatccaatgcacccagccatttcccgcatgcaagataacgttaatcaagcaaaaatgtttcaacaacaaaaagattggaatagcgttggaacctgtaatatgcatttccataccgctatcgtcgagctttctgatagccctaggttatttaaacaatatcaacttattttagcagaattacgattagcctttggtttactcaatgatccccagttattacatgctccttatattgagaagaatgagcatattttaacgctattgatgaatgggaaagcgcaagaagcggcaatcgaaatggaaagttatttagaaatatccgagcgaaccgtattagccgctttttctcgccacaacatctgttaa

SEQ ID NO: 2073 - DNA, 1203 bp, Proteus mirabilis
ggggagataatgaaacatacattgttaaaaacgactgcaattgctatggcattaagtgtgggagttgtgcaagcgactgaatataaagcgagtaccgcagaacatccaatcaaaatagttaatttagatgctcttgaaaatcaagtaaaagaaaatatggataaaggcgctttcggttatattcgtggtggtgctgaagacgaaaataacttgcgttctaatacaaatgcatttaataaaaaatatattatgcctcgtgcattacaagggattgaattttccgatctgaatttaaaaacagaatttttaggtattaaattagatacgcctattattcaggcaccgatggcagcccaagggcttgctcatcaacaaggcgaagttgccacagcaaaaggtatggcgaaagcgggctctattttctcattaagtacttatggtaataaaaccattaaagaagtcgcgcaagcacaaccgggttatccgttcttttttcagctatatatgagtaaaaacgacgcgtttaatcagtatattttatcgcaagcaaaacagtatggcgcgaaaggtattattttaacggttgattctcctgtggggggatatcgtgaagatgatattaaaaatagttttcaattcccattaggttttgccaatttggaagcattcgccaaaatcagtgatgataaatcaaaaacaggtaaaggttcgggtattagtgagatctatgctcaagctaaacaagcatttactcctgcggatattcaatatgtgaaaaagatgtcaggtttaccagtcattgtgaaaggtattgaatcacctgaagatgccgatactgcaattaaagcgggtgctgatgcgatttgggtgtctaatcatggtggtcgtcagttagatagtgcaccagcaaccattgatgtattgccagccattgccaaagtcgtgaacaaacgtgttcctatcgttttcgatagtggtgttcgtcgtggctcacatgtctttaaagcgctagcgagtggtgcagatgttgttgctgtggggcgtccaattctttatggattaaatttaggcggtgctgaaggtgtgaattcagttatcgagcaattaaataaagagttaagaattaatatgatgttaggtggtgcaagaaacgtcaaagaaattcaagcaacacacctgtatacagatgctgactttaaataa

SEQ ID NO: 2074 - DNA, 201 bp, Proteus mirabilis
ataggtgtaataggcgaattttgtgatagtcccgtacttgacaaaactggtgtcacagcagttacatttgttgtgataaaaaagctcaatagtaccaatattgatacaagactatttttattaatctgctgtttcataaatatacctattaatttccttggtctgtttctatcaccttacattcacgactatcgcagctaa

SEQ ID NO: 2075 - DNA, 198 bp, Proteus mirabilis
ggtttcgtaatcttgatgccaaagcgccaagaacagctctcttacgatttccatataaaaggcttcctaaaactgagtcattcgggggtaaatacaaaaacattctctcttgttatctatttacccgtaatacatatcatagggtttatttttcattgtttaaaacagcaacactctaacaaaatcaataaaaactag

SEQ ID NO: 2076 - DNA, 540 bp, Proteus mirabilis
tcattatcaatatgtcttttattcttgtgtgatcttaacaagtttggcattgtgttttgccatcaaaacgctactttccacattaaaacagcaacgacaaaccatcgactaacaggacatttgatgaaactaaccattgaaaaactgccgcagctttcagcacaagataaaatagatttagggaaaatttggcaagatagtgagtaccaaatggcactcactgcaccaatcaccacagagcatgctctttttgtcgcccgttttaacgggcgattactagcggcttgtcgtataaaataccaagcaaaaacagcgcttatcagtgattttatggtaagagaagtgactcgtcgtcgtggtgttgggcattacttactaacacaatgccttgaaaaaaatccaaccattacacattggcaagctttattgaaaacagggcaaatcaacgatcctgtagcacaggcttttttagcgcatcatcattttactacttcattacaggctgatacttatgattatttatgcaatgataaagcataa

SEQ ID NO: 2077 - DNA, 726 bp, Proteus mirabilis
aaaatatcaatattcaggagtattctgatgaaaaaaacggtcgttgtctttagtggtggacaagattcgacaacctgcctaatccaagcactagagcagtatgatgaagttcattgtattacatttaattatggacaacgtcataaagaagaaattgaggtagcacaaagagtcagtcaattattaggtgcaaccgcacataaagttttggatgtcagtttactcaatgaactcgctatcagcagcttaacacgtgacaatattcctgtgcctgattttaaacagagtgaacaaagcgatattcctagtacctttgtacctggtagaaatattttatttcttacattagcctccatttatgcttatcagattggtgctgaaagcgttattaccggcgtatgtgaaactgatttctcaggttatccagattgtcgcgatgagtttgttaaggctctaaatcatgcggtaaatttaggtattgctcgtgatattcagtttatcactccgttgatgtggttagataaagcgcaaacttgggcactcgctgactattacggtaagttagattttgtacgccacaacaccttaacttgttataacggtattcaaggtgatggttgtggtcaatgtgcagcttgccatttaagagagcgtggacttcatggctatttacaagacaaaaatgccgtcatggacgccatgaaaaataaagttggccttaaataa

SEQ ID NO: 2078 - DNA, 381 bp, Proteus mirabilis
ataatgtcaattcttgatgaatgggcggagcgccacattgaaaaggcgttgaaaaatggtgaactctcttctttgccaggagaaggtaaacccttggtattagatgataacagtcatgttcctgagtctttgcgggctagttatcatttgcttaagaatgccggctttttgcccccagaaatgcaagatagaaaagatgcattatctttagccgaaatattaagttcactttcagaaactggcatcaaagatgaacagttacaaaaaaaactcactttactcgaattaaaattacaacaggcaggaatggacacacagtttctacatacggactatgcaacccaattaacagaaaagttagcaacacataaacacaaataa

SEQ ID NO: 2079 - DNA, 498 bp, Proteus mirabilis
atagtgacaatcaatccttatcgtagccgtgggcgttggattatttggctctcgtttctaatagctttggtgttacaaattatgccttggcctgagcaactagaagtttatcgccctatttggccagtgttgtttctgatttattggataacgtcattacctcatcgtattagcgttggaacagcatttgttcttgggatgagcatggatttagtgcaagggacaacattaggcgtaaatgcgttggcttatactctagtaagttatgttatcgcctttaaatatcaattattttgtaacttagcgttatggcaacaggcattagtggtaatgttagcgattggtgtggttgatcttactgtattttgggcagaatttttgctttctcccgtgacttttcacccacaagtattctggaatagtccagtcagtggtattctttggccatggctttattttttgcttcgcaaagtccgtcaccagttttcagttcattaa

SEQ ID NO: 2080 - DNA, 1242 bp, Proteus mirabilis
gggatagcaatgcggattattcacacctcagattggcatttaggacaatatttttttacaaaaactcgcgcccaagagcaccaacaatttctcgattggctattagcgcaaatccgtgaacaacaagttgatgcagttattgttgcaggggatatctttgatactggctccccccccagttatgcccgagagctttataatcgatttgtcgtcgcaataagagatactcagtgccaactgattattttagggggtaatcatgattctgtggcaacgctaaatgaatctaaatcactgttagcgtgtttaaataccaccgtcattgctaatgttcacactgaaaccccacaagcccctattattctttatcaaaaaaatcacacacctggagcattactttgtgcaatcccctatttacgccctagagatatgataaatagcaaaagtgggcaatcgggagcagacaaacagggcgctttaaaagaagcgatcgcagattattatcaacgccaatatcaagccgcgctcgacttacgaaaacaactcaatgttaacatccctatcattgccacagggcatctgacaacgataggcgccagtgttagcgattcggtacgtgaaatttatatcggcacattagaagcctttaacgcaaccctatttcctccatttgactatatcgcccttggtcatattcatcgtccacagcgcgtcaataaatcgggtcatattcgctacagtggttcacctattccattaagttttgatgaaagtgcacaacagaaaagtgtttgtcttatcgattttgagcaagataaattagcggaaatgacactattacccatccctgagtttcagctattacgcactctttcaggctcgttacaagaaattgccacacaactcgaaaagttagcaacacaatataatgaaatggataccacgatttggctagatattgaagtttcaactcaagattatctcagtgatattcaaaaccgtattcaagagctaactcaatcgccactctttgaagtgatcgtattaagaagagcgagaaaacaacatcaagcactgatgcaaaatgagaaagaaaccctaactgaactgactgtatatgatgtatttgaaaggcgcttagctcaacaccagtttgaaaccgaggaagacaaaacacggttaaccacactctttaagcaagcggttgaaatggcagagcaagaggataacaacgcacgatga

SEQ ID NO: 2081 - DNA, 432 bp, Proteus mirabilis
attatggcaatgaatcttggtaatgattcaggtgaagataatgaattgcatgatattaacgtcacaccttttattgatgtgatgttagtactgctgattatcttcatggtagcagcccccttagcgacggttgatattaaagtcaatttacctgcttcgagtgctaagcctcaacctcggccagaaaaacctgtttatttgacgattaaatcagataaacagatttttatcggtgaagagatggtaactcatgagacgatggccagtgtcttggattctatgacgcagtcgaataaagaaacgactatctttttccaagccgataaaacggtcgattatgaaactttaatgggggcaatggactcattaaggaaggcgggatacctcaaagtagggctagtggggatggaaaccgtatcatcgggtaactaa

SEQ ID NO: 2082 - DNA, 351 bp, Proteus mirabilis
aatcttcaaataatattttgctcgtttatggaatatccacttgtaccagcacaaatatggttccatgaaatagactcatatcgtagtaatattttttcatgggagacgatagagtatccgttagatgattctggtgaagattgtgtaaaatccacaatagttgcattactcaatttaatttcaaaatatttttctaaaataccaaattggtttatcctgaaaaagtcaaaattagcatctaataattcattattagatatggcaacgcctaataacggggatgacttatcaattggtttaatgaataaaactggatggtggactgaattttgcatcctgcttattgtgtaa

SEQ ID NO: 2083 - DNA, 405 bp, Proteus mirabilis
ttaagtcaaataacaaatcttgtgaaatcatcacatataggaatgtcaccactaatgaaaaaaatgttcgctttgttctgcactattattctttcttttgccacgcttttttcttctagtgcaaaagcactcacttatactcaagcagaagacttagctgatttaaccgcggtatacctgtttttaaataatgattgtggttatgagcagatctcaaaacaaaaaatagaacgagcgctgattattttttcacaatctcagcagtgggatgtctctaattattcaatgctcccaatgagcaagcttaatgaagatagttatcaggatttaaaaaatatacaaattgctcataacaaaaaatgtcaactactagcccaaaaatcacttagcttactaaactattaa

SEQ ID NO: 2084 - DNA, 990 bp, Proteus mirabilis
aggagacaaataatggaacctattgcagtaacaatattgactggctttttaggatcgggaaaaacaacgcttttacgccatatgctcaatgaggagcatggctataaaattgcggtgattgaaaatgaatttggtgaagtgcctatcgatgatgaaattattggtgatagagcaacacaaataaaaacactcaccaatggctgtatttgttgtagtaaatcgaatgagcttgaagatactttgctcgatctctgcgatagtcttgatcgtggtgacattgtgtttgatcgcttagtgattgagtgtacagggatggctgatccgggacctatcacacaaacatttttttctcatgaagtgatctgccaacgctatttattagatggcattattacactggttgatacaatccatgctcagcaacagttagatcaatttgctattgctcaatctcaaattggttatgcggatcgcattctattaactaaaacagatattcaacctgcgagccaacaattacttgctcgtttaagacgtattaatgctagagcgcctacctatacggtgatcaatgggaacattgatttagcactattgtttaacgtaaaaggctttatgttgaatgatactttagagatcaagcaacccctgtttcgttttcagccagaaaaacaagatgatattcagtctattgtactaaattttgattatcccgttgagttacaagcagtctctgatgttatggagtctttgttattgagctttgccgataacttattacgttataaggggatcttaaatattaaagatagtcctaaccggttgttattccaaggagtgcaacgattatatagcgctgattgggatagaccttggcaagagaatgaaactcgtcaaagcaccttagtctttattggtattcatctgccagaagaagaaataaaagccagtttcgatgcgttaatgcataacactaaagaatatgagtaa

SEQ ID NO: 2085 - DNA, 282 bp, Proteus mirabilis
aaagcgcaaatgacccaatatcgacgcgtagcgataaaaaaccgtttaggcatgcatgcaaggcctgccatgaaattgtttgatttggtcaatacatttcaatcaacggtgacgttacgtaaccatgagggcgttgaagcgcaagcagatagtgtgattgcgatgttgatgttagattccgaacaaggcagtcacatcgatatagaagccagtggctgtgatgaaaaagaagcgattgatgcgattattgcattatttgaatcagggtttgatgaagattaa

SEQ ID NO: 2086 - DNA, 1926 bp, Proteus mirabilis
atgggtaaaattattggtattgacctgggtacaactaactcttgtgttgctgtaatggacggtaagaatgcccgggttattgaaaacggtgaaggcgatcgtaccactccttcgattgttgcatatgcacaagatggtgaaattctagttggtcaaccggcaaaacgtcaggctgtgactaacccacaaaatacattatttgccatcaaacgtttaatcggtcgtcgtttcgaagacgcggaagtacaacgtgatgtttctatcatgccttacaaaattattaaagctgataatggtgatgcatgggttgaagcacgtaacgaaaaaatggctccaccacaagtttctgctgaagtattgaaaaaaatgaaaaaaacagcggaagattacttaggtgaaccagttacagaagctgttattacagttcctgcttactttaatgatgcgcaacgtcaagcaactaaagatgcgggtcgtatcgcgggtttagatgttaaacgtattattaacgaaccaacagctgcggcattggcttatggtttagatcgtgaagtgggtaaccgcactatcgctgtttatgacttaggtggtggtacattcgatatctctatcatcgaaattgatgaagttgatggcgaaaaaacctatgaagttctgtcaaccaatggtgatactcacttaggtggtgaagacttcgatagccgtttaattaactacttagttgatgagtttaagaaagaacaaggtattgacctgcgtaatgatccattggcaatgcaacgtctgaaagaagctgcagaaaaagcaaaaattgaattatcttcagctcaacaaacagatgtgaacttaccttatgttactgctgatgcgacagggcctaaacacttaaatatcaaagtgactcgtgcaaaactggaatctttagttgaagacttagtaaaacgttcaatggatccagtaaaagttgcattagaagatgcgggcttgaaagttagtgaagtaaacgacgttattctggttggtggtcaaactcgtatgcctatggtacaaaaaactgtggctgagttcttcggtaaagaaccacgtaaagacgttaacccagatgaagctgttgctatgggtgctgctgttcaaggtggtgtattagctggtgatgttaaagatgttctgttacttgacgtgactccactgtctttaggtattgaaactatgggtggcgtgatgacttcgctgattgcgaagaataccactatcccaactaaacatagccaagtattctctaccgctgaagataatcaatcagctgtaactattcacgtattacaaggtgagcgtaaacgtgcgagtgataacaaatcactgggtcaatttaacttagatggtattcaacctgcaccacgtggtatgccacaaattgaagtgacttttgatatcgatgctgatggtatcttgcatgtatctgcaaaagataaaaacagtggtcgtgaacaaaatatcaccattaaagcttcttcaggtttaaatgaagaagaaatccaaaaaatggtacgtgatgcagaagctaatgcagaagcagaccgtaaatttgaagagttagtgcaaacacgtaaccaagcagatcaattagttcacggtacacgtaaacaaattgaagaagcgggtgacaaattagcggctaacgataaagaagctatcgaaaaagcgttaagcgaattagaaattgcttctaaaggtgaagataaagctgctattgaagcaaaactgcaagcgttagttgaagcttcaaaacctctgttagaaattgcacaacaacaagctcaagcgggtgcaggtaatactgccgatgcaactgatgcaggtgcgaagaaagatgacgatgttgtcgatgcagagtttgaagaagtagacggcaaagataaaaaataa

SEQ ID NO: 2087 - DNA, 234 bp, Proteus mirabilis
accgccaaaatcattccgcttattgtttcaatatctaaaagatctctcagagtcagcttaacgactgatgctcctgaaaacgcagtgctaaatcatgataccactgcggttttcaggataccttgtaatacttatgggctttcagctagctctacttggcttttttatgttcacaatgaaagcgaaataggtctttaccgagcgtctcttgcgcttcttgcattatctcaataa

SEQ ID NO: 2088 - DNA, 537 bp, Proteus mirabilis
gaaaacaaaatgaaattaaaaaaactgcatttagttttagggttaggcttatctatcattgcgggctctgcattagcggcagatcaagggcatggtactgttgaattctatggttcaattattgatgctccttgttctatcgatcctgattcaggtgctcaacgtattccattaggtcaagtgtcatctagcgcactgaaagacggtggccgtagtgcatcaaaaatgtttaaaatcaaattattacagtgttctactgagacatataaaacagtcaaaacaacctttaccggtgctgaagctcctgatgttttagagggggctttaggtattgaagggatcgccaaaaatgcagctgttgttatcaccaatgcaggtggtgaacaaatcaaattaggtcaagcaagtgccgcccaaacattgaatgacggtaacaatgacttaaattttgccgcttatttacaaggatcttcctcaaaagctgctattcctggtgattttacagcaatagccacttttgctttatcttatcaataa

SEQ ID NO: 2089 - DNA, 954 bp, Proteus mirabilis
atgttaaaaattcaccatggagatcaggatttcattatggaacttacctttttaggcactaatgcaggcgtaccttctaaagatcgcaacgtcaccagtatggtgcttgatttacaaaataaacaaaaaagtctgtggatgttcgattgtggagaggcgacccagcatcagatcttacatagccatgtaaagctatcacgcattaataagatttttattacccatttacatggtgatcatatttttggtttacccggactactctgtagccgttcaatggggggcacagaaaacccgttaaccatttatgggcctacaggcattaaggcatttatagaaacagcccttacattaagccaatcttatctcacttaccctttagatattattgaaatagaacaagatggttttctttttgaagaagaaggtatacgtgtaagttgtggcgcattatcacatcctgtcccctgctttggttatcgtctagaagaagacaataaaccaggtaaactcaatgctgacaagctagaggcagagaatatccctagaggcccttggtataaattattaaaacaagggaaaaccgttacactacctgatggacggatcatagatggaaaagattatctaagcacagagatcaaaggccgttgtattgtgatttttggcgatacacaaccaacgcctaatgcagttaaactcgctgagaatgccgatgttattgtccatgaagcaacctttaaacatgacatggctgataaagccaatagtcgtggacattcaagtaccatacaggcagctgagttagccaaaaaggcgaatgctaagcgactaatcattacccatatcagtagtcgctattcacctaaagaaacccccgaactattagcggaatgtcatactatatttgacaatacacaaatcgccagtgattttgagacattcaaactttaa

SEQ ID NO: 2090 - DNA, 684 bp, Proteus mirabilis
ggagcaaaaataatgcgtgtttctcgccgtaaatttgtagcaggtataggttctgtgatctttttcagtgcgccactggggagtgccttagcggcagccacagataaaaaaccgatacgctatgccatgatccatgacgaaacacgctgtaatggctgtaatatttgtgccacagcgtgccgtcgattaaataaagtaccaaccggaatggcgcgaatggatattgcacacattccattaagcttaaaagaagataacgataagtaccatttttttagacactcatgtcagcagtgtgaagatgctccttgtatctcggtttgtcctacgggcgcatcttggcgcgatgaaagcaatggtattgttcgcgttaataaagagaaatgtattggctgtagttattgcatatcagcctgtccttaccaagttcgttatcttaatcccgtaacacatgttgctgataaatgtgacttttgtcttgagtctcgattacaaaaagggttcccaccgatttgtgtcagcgcttgcccacaaaacgccctactctttggtagagaagatagcccacaaattcagcaatggctaaaaacacatgactactatctctatcaacttgatggagtaggaaaaccgcatctttatcgacgtgttggacctcatgtacaagggggagataacgtatga

SEQ ID NO: 2091 - DNA, 276 bp, Proteus mirabilis
tgcgaaaaaatggttaatacaatgaatgcccaatttgatgatgcgacaaaaacattagataccttaggactacgttgtcctgagcctgttatgttagtgcgtaaaaccataagaaatatggctcagggggaaacactgttggtgattgctgatgatccggcgacagtgcgtgatattcccggtttttgtcgttttatggaacatgacctattacagcaagagacgcaagcaacaccttatcgttatttgatccgcaaaaaagagggtcagctgtaa

SEQ ID NO: 2092 - DNA, 1479 bp, Proteus mirabilis
ttaacagaaatgacgaaggtgaggcgaaatatctcacgacaccataaaaaagggatagtatcatggcagataactgtttttttcttattaattcggaattttattgtgacctcatttgctgatcttcatgcacttcctgctgagcaacttactaatcttaatgagcttggctatttaacgatgactcccgtccaagaagcgtctttacctgctattcttgccgggaaagatgttcgagcccaagcaaaaaccggaagtggcaaaacagcagcttttggcttaggtttattgcaacgtattgatgcaaaacaatttaatactcaatcattagtattatgtccaacacgagaattagctgaccaagtcgctaatgagttacgtcgactggctcgttttctgcctaacattaaaattctgactctgtgtggtggtgtgccttttagcattcaacgggattcattaattcatgctgctcatattattgtcgcgactccggggcgtttgttagatcatttaaacaagcagactgtcacacttgctgatgtaaaaacattggtacttgatgaagcagatagaatgctggatatgggattttttgatgatattagcgacatcatttctcaaatgtcgacacaacgtcaaactttgctcttttctgcaacttggccggatgaaatcgctaaaattagtcgaaaaattcaacaagatcctgtcactattgagattaattcaccggatgaattgccagcggttgaacaacaattttatgagatctcccgttatggcaaattgggattattacaaaagcttttgagtcatcatcaacctaattcttgtgtggtattttgtaataccaaaagagattgccaagatgtgtatgaagctttgaccgaaagcaaccaaagtgtccttgcgttacatggcgatatggagcaaaaagagcgcgaccaaacattgatccgttttgctaatggtagctgtcgagtgttagtcgccacagatgtcgctgcgcgaggcttagatatcaaagcgctagaaatggtgattaattatgaattatcacacgatccggaagttcatatacatcgaattggacgaacagccagagcgggagaaagtggtttagcgattagtttttgcgcaccagaagagatccctcgcgccaatgctctggaagaaatgttgaatataaaactggattggcaatcagccccttcaggtttatcaatcacaccattggttgcgacaatggcaacactatgtattgatggcggtaaaaaagcaaaaatgcgtccaggggacatccttggtgcattaactggagatttagggtttagtggagaagatattggtaagataaatatccatccaactcatgcctatgtagcggtaaaacagtccattgctaaacaggtatggaaaagccttcaacaaggtaaaattaaaggtaaatcagtaaaagtcagactgtttagataa

SEQ ID NO: 2093 - DNA, 588 bp, Proteus mirabilis
cgacacagaatgaataaattaaaatcctggtttaccctgattttagccattattgctcttgggctgattggctggaactatactaacaatactgagcttgatgatggaaagattgttgaagatggtcaacccacctaccaatctaaatcatcaatatcctttgtttatgaaccaacaggtatactgggatataaactagttgctgatgatgtcaaaaactatgctcagcaaaagtttacatggtttactaatcctgtcttaacgacttattcgccgacaggagatgcaacatggacagtgcgtgcaaataaagccaaactgacaaacagtaaaatgctctatctttatggcgacgttcaaattgatagtttaactgatgactcccaacttcagcggatcagcacagaaaatgctatcgcagatctggatacacaagatgtttcctctgatgatgaagtgactattatcggcgtcggactgaaatcagtcggcttaaaaatgcgaggcaatctgcgtgaaaaacgtgcagagctgattgaacaggtgaacacctattatgagatccctaatgaatcgaaaaatccgtaa

SEQ ID NO: 2094 - DNA, 1305 bp, Proteus mirabilis
gacaacagaattttattaaataaaatacaaaaaacacaacggagtctaatcatgaacattgttgatcggtttatttcttacaccaaggtgaatactacaacaaatagagaaaatggcgcagcggggattatgccttcatcggaaggtcagcgagtcctcgctttacaattagtcgaagagttaaaggcgttaggtgttgaagatatcaaaattcgcgatactgccattgttaccgcgacactaccttctaaccttgattatgaggttcctaccgtggctttctttggtcacttagataccagtgcagaacaaactaatgatactaaagcacaaattttaccttataaaggtggcgacctttgcttaaacaaagaacttgagatttttttacgtcaaagtgaattccctgaattagaaaactatattggtgacgatatcatcgtaacagatggtactagcttattaggcgctgacgacaaagcggctatcgcctctattatggatatgttgcaatattttaaacaacatccagaagtgaaacacggtacagttaaaattggttttgtacccgatgaagagcaaggtttacgtggtgcaaaagcctttgatgtaacagaattcggcgcagactttgcttataccttagattgttgtggtattggtgaacttgtatatgaaaattggaatgccggtgatgttgaaataacctttatcggaacctcagcacaccctatgtcagcaaaaggtaaattaaaaaactcactgttaatggcacataaatttattgcgatgttaccaggcggtgaagcaccggaatataccgaaggtcgtgaaggttattattgggttaaacaactggcgggtaatagcgcacgtaccgtattaaaaatggatgtgcgtgatttcacagaagcaggctacgcccatcgtatggcatttttaaaacaactttcagagcaatgtgaagcgttatggggtgaagggactgttgtttgtaagcaagccgatcgttatgcaaatgtctttaatagtctacaaggtgaaaatcgatatcctatcgatattgctattgatgcttataaagccaatggtattacccctcgtccaatccctatgcggggtggctatgatggagcagcattatcgcaaaaaggattaccttgccctaatatttttaccggagcgcacaatttccactctatttatgaataccttcctgttaaatcgctttatgctgccagcgatgtattgaaatctgtcgttaagatcaccgcagagcgctttgcccccggagctaaagcatga

SEQ ID NO: 2095 - DNA, 939 bp, Proteus mirabilis
ggatatggaataatgagtaatccatttacgatatctaactttcctgaacaactagagacctcccctttaatagatgaaagccatcactatgatgaccctttaccgccaaaagatctcgtatttttacaaagtatcaacaaccaagaatgtaagattaaatcatcacaagttaatggtcgattcacgaatactgtcccgatgtttttggtattaatagtaatgatgttttataccctatttaattttattgaaggacatattattacaaaatatactttagaagataatattaaagaaattgaaaattatagtacctattatacagggaacgatcgcgttgtacttagggatataaataaatataaacctttctttggaaaggaaaagataagttggtgggaatatatcaaagcatataattcaggtaaattttttgtaggtagtgaagatgacaaatattttgtcctcgcatggttagttttatttcccagtggattatatatcttaagctcccttgctttctttgtgccaatgacctatttggtggctgatagaaaacgacagatcttatattcttatgtagatggcattgtgatggcaacccgttatgaagatgctcaattcggttatgccggtaaaatgttagcatttaaattattctatatacattctgaaactggtgagctaggaatacatatatatcgtcccaatgtctctcattacacaggttttttattaagtagtgatactgaagatcaccgctttattacttttcttaatgcctatatgcaacaagggcgtgatgcagtctgcacaagtgactattatgcacgagcaccactattctgctttgcgaaaaaccctcttcctgctgattttgagcaacaggtcgaacagattctggcaaagcttgatcaggagaaaaaacggcatgcgtaa

SEQ ID NO: 2096 - DNA, 1218 bp, Proteus mirabilis
gtattcttgatgaacaagaagctcaagatactctggatgcattacaacatgtatatggtgttacccttgaagaggctgatgatgcaatacgttgatgaatttcgtgatcccgaattagccaaagcattattagctcaaatacgtgaaactatttcacaatggccccatcccatcactcgcccattacagattatggaagtgtgtggcggacatacgcatgccatttttaaatttggtctcgaccgcttattaccacaagagattgagtttgttcatggtcccggttgccctgtatgtgtgttacctatggggcgcattgatgcttgcttagaaattgcagcccgtccagaagtcattttctgtactttcggtgatgcgatgcgggtgcccggtcgtcatggttcaatgcttgatgctcgtcgtcgcggtagtgatatccgtattgtttactcaccgcttgattcattaaaaattgcgcaagataaccctgataaacaagtggtattttttggcttaggttttgaaactaccatgccaagtacggcgatgacgctgcaacaagcgaaattacgtggactgaaaaatttttcgctattttgtcagcacattactatcgtaccgactttacgttgcttattagagcaagaagatgtacgtattgatggttttattgcccccggtcatgtcagtatggtgattggctgcacgccttatcaacctttatgtgatgaatttgaaaaaccctttgtggtgacaggttttgaaccgttggatttattacaagctatactgatggtagtaaaacagcttaaagcaaaagctgagaatgcagattatgttttaagtattgaaaatcaatatagtcgtattgtccctaatgaaggcaataaacttgcgcaaaaagcattgaaagatgtttttatgctaaaagagagcagtgaatggcgtggacttggggagatccctatgtctggtattcaactaacacccgcttacgctgagtttgacgctgaacgacgttttacaccagcaccacaacaagtggctgataatccacaatcacgctgtggcgatgtattaaccggacgatgcaaaccttctgattgcccattatttggtaaaagttgtacaccagaaacggcattaggtgccttaatggtgtcatcagaaggtgcatgtgcggcttattatcagtatcgccgtgaaggtaatatatga

SEQ ID NO: 2097 - DNA, 213 bp, Proteus mirabilis
cgtcaattgataagggtattaaccttatcaccttcctccccgctgaaagtactttacaaccctaaggccttcttcatacacgcggcatggctgcatcaggcttgcgcccattgtgcaatattccccactgctgcctcccgtaagagtctgggccgtgtctcagtcccagtgtggctgatcatcctctcagaccaactagagattcgcgcctaa

SEQ ID NO: 2098 - DNA, 765 bp, Proteus mirabilis
ttaaagatgatggcatctaaacatttatttatggtaactaccaccttattaactggaatggtgtttacgtcgcaagttggtgcgacaatcgctttagatcgtacacgtattatttttaatggtgctgataaatcagtaagtctgagtataagtaatcaaaacaaagaattaccttatttagctcaaggttggctagagaacgagcaaggagaaaaaatagaaacacctcttattgtattacctcctattcagcgtattgaacctgggaataagagccaagtgaaagtgcaatcattacctgatattgcacaactacctcaagatagagagagtgttttttattttaatttacgtgagatccctccacgtagtgataaacccaacgtattacaaattgcactacaaacgcggataaaattgttctatcgaccaaaatctatttatgccacccaaactgatttaagtaatccatggcaggaaaaaattaccttaacaaagcagggggagagttatgttgtgcataatcccacaccctattatatcactattgttgatggtctaacggatctgaaagggaaaagcttagaaggatttacccctatcatggtagcgcctcgagggcaggaaaaactcaatttaacggtttctacgctgggggcttctccggtattaagttacatcaatgattacggtggtcgtccaagattgaaatttagctgcgatagtcgtgaatgtaaggtgatagaaacagaccaaggaaattaa

SEQ ID NO: 2099 - DNA, 765 bp, Proteus mirabilis
ttaaagatgatgttattaaaacgctcatgcattgttgcaaccactttgttaatgggaatggcatttactcatcaagctgttgctgccattgcgctagatcgaactcgtgtcatttttaatggtgccgaaaaatcgattagtttaaatgtcagcaatcaaaataaggacttaccttatcttgctcaaggctggatggaaaatgaaaacggcgaacgtattgaaagcccactgattgttttacccccgatccaacgtattgaaccgggtgataaaagtcagattaaggtgcaatcattacctgatatagccaaattaccacaagatagagaaagtgttttctattttaacctacgtgaaattccaccacgtagtaataagcctaatgtactgcaaattgcattacaaacgcggatcaaattattttatcgtcctgcatcaatctatgcctcgcaaacggatttaaccaatccttggcaagagcagatcactttaactaaaaaaggtgatcgcttcgaagtgaataatccaacgccttactatgtgacattagtcgatggattaaccagtttgaaaggaaaaagcttggatggctttgaaccattaatgatcgcacctaaaagtagcggcacgataaatctgagtgcttccatgtttggtgcttcaccggtattgagctacatcaatgattatggcggtcgccctcagatgaaattcacctgtagtggcaatcaatgcaaagtaacagaaacggcagctggaaactaa

SEQ ID NO: 2100 - DNA, 549 bp, Proteus mirabilis
agggtatcgatttgctttacaggcagcggtcaaccgcttgtcttaataaaaaacatcaaaagagtacggaatcaactcatggatattcgtaaaattaaaaaactgatcgagctagtcgaagagtctggcatttctgaactggaaatttctgaaggtgaagagtcagtacgcatcagtcgcaactctggcgttcagggtcaaatggctcctcagcaatattttgcggcaccagcagcacctcaacctgcattagcagctgctgtggcacctgtagcaccagaaacaccagcggctacagcaacgcaagaaattagcggccatgttgttcgctcaccaatggtaggtaccttctatcgttcaccaagcccagaagcaaaagtctttgttgaagtgggtcagcaagtcaatgttggcgatacactgtgtatcgttgaagcaatgaaaatgatgaaccaaatcgaatctgataaagcgggcgttgttaaatctatcctttgccaagatggcgatactattgagtttgacgatccactctttgtcatcgaataa

SEQ ID NO: 2101 - DNA, 270 bp, Proteus mirabilis
aggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataa

SEQ ID NO: 2102 - DNA, 3735 bp, Proteus mirabilis
caacgcacgatgaaaatcttaagtctgcgctttaaaaacattaactcactcaaaggcgaatggaaaattaattttgatcaagagccttttgttagcaatggactatttgccattacaggcccgacaggtgcgggtaaaaccacgctcttagatgcaattagtttagccttatatcacagaacgccacgcttagataaagtaacccaatctcaaaatgaattaatgactcgtcacactgcagaatgtttagctgaagtggaatttgaagttaaaggggttgcctatcgggcattttgggaacaacgtcgtgcgaattataaagaagagggaaacttacaagccccacaggctgagttagcaaaaattaatcgtttaggcggtgaagataaagttttagccaataaaattagccaagtaaaagaaaaaataatctcgatcaccggattagatttcgatcgcttcactaaatccatgttgttatcacaagggcaatttgctgcatttctcaacgctgatgataaatctcgtgcagagctacttgaagagcttactggtacagatatctatcgccatatttcacaaacaatttttaaacattggcgcgaagaagagcaggctttaaacacgctaaaacaacaagctcaaatgatggcattattggatgcaacaacacgccaagagctattaacacaacaagccaatattcaagcacaagtaacaaggttacaaaaagagcaacaggaataccaagttgctaagcaatggcaagaaaaagcgctagaaattcagcagcaacaacaatcagcccaagcgggactcaatgaggctcaacaggcattaattattgctcaacccgatattcaacgcttagaaaaaaatgagccagcagaaaaaattcgccctctttatgatgaaaaaaatcgtcgtcttacagagcaaaactatttagcaacacaattaacaagcttaaaaacagaaaaacaggctattgaacaacaaagcctacctatcaataaaaaattggcagactttcatgaacaattaaaaacgcatcatgagaaaaaacagcacactttacagttaattcgtgagaaggtactgcctttagataatcaattggggctgttacaacaagaaattagtactaataaccaacacaagcataaattagaaaaaatatgcgctgaatatctgcaacattctcagttagccgagaaaaaattaatcaccacacaacaacaagttaatcaattaaataacgacttaacacaacacgcctatcacgcacaacttgcagaaaatctacccttatggcaacactattttcagcaatataatgaaatatcaagccaatatcttgccaaccaaaaacgagaaacagtagagcaggaaaaagtcataagtttggaaaaagcattacaacaagccacccaaacattagccacccagcaagagcaacttaatttacagcaacagcaactacaatcttatcaaacacaattggacgcacgtcaaaaggcagacaaacccgatgaaataaaaccgcgattacaacaaattaatctgcaaaaaaatgcattggcaaaaattataaatttacacactcaattacaacgtaatggcaaagagcagcaacattatcaaactacattgagtgaaaatcagcaaaaaatagcaactctaacccaaacgattgcagaaaatgatctggcactaaaagagaaagcacaacatcttaaagatttaaatgacaactatcttttactacaaaaagtcgccgaatatgagcaagagcgtgcacgtttactgaaagataaaccttgccctctatgtggctcaacacagcatccttatgtagaaacctatcatgacatcaaaccagatgagacaaagctacgtttagaagcattacaacagcaggtgcattcactcaccatcaccttagccgaacagcgaacccaacgggtaaactatggctcacaaaatagcaccttgagtgacaatatcgctcagttaacccaagagaatagcgtactgacccaacagtggcagacgttagcacaagcacaccatttaccgttagttgatgatgcaaataacttactgacattagaacaatcattaaatcagcaagagcttattctcacagaaaaacttgacaattatcagcaattagaagcccaaacacatcaaaagaatacgtattttctcaatgcaaaagagcaatttaatcaacaacaacaatcggttaagcaacagcaaaatgatttagattatttgcaaaaaacaatcaaaacctatcagcaacaaagcgagcacttgcaccaacagcaacaacaattagcacaacatattcagtcagcgattgaaaaacaaggctatacactccctgaatttgagcagttcacgccatggttggcggctcgtcaacaagagcaccagcaatatcaaagtcagttaaaagagcttcagctattacaacaaagcctacgtgaacagcaagtgacgcaaaatgaaaaaaaacgttatttagcagaaaaacaggctgaacttgaggcactattagcaaaattaagccaacaacaacaccaacaaacacaatggcaggatcaacgacaagccttatttggttcacaatctgtagagcaggtacgcagtgaacttgataaacatagccaatttttacaaacccagattgagcaatatactcaagaaaaaaaccaactagaaaaccgacttaatcaattaattggccaatatcaagagaatgaaaaagccctacaacgagcaataacacaagcacaacaagccactgaacactatcaacacgcgttaaaagagagtctttttgccgatgaaaatgactttttagcctctctattatcggtagaggaaagaacacgtctacaagagcagcaaaaacagcgacttgataaacttttacaagaaaaaacgcgccttgagactcaagaaaaagcctatcaacaacatttattacaacaaccattactctcaacccaatgtactgctgaacaatgtaatatccatttagacgacttagcaaagcaacacaaagcgttgcaagaaacactatttagtctgcaaatacaattacgccaagatgatgaaaaacggatagagcaacaaacactattagtgcaaatagccaaacagcaagcgcattatgatgattggagctatttaaatgagttagttggctctgcatctggtgataaatttagtcgctttgcccaaggattaaccctcgaccatcttatctatctggctaatcgtcgcttagaaaaactacatggccgttactttttacaacgcaaaacgacaggtagccttgaattacagattgccgatacatggcaagcagatgctctacgcgatacacgtacactttctggtggagagagttttttagtcagcttatcccttgccttagcgttatctgatttagtcagtaataagacgcaaattgagtcactctttttagatgaaggctttggcaccctcgatcctgatacactagatattgctttagatgccttagatagccttaatgcttctggcaaaattattggtgtgatcagtcatgttgaagcgatgaaagagcgtattccggtacaaataaaagtgaaaaaagcggggggtttaggaataagtcagctagcacctgagtttagatatggtaataagagcaatgaaaatcaatcagttaaagactag

SEQ ID NO: 2103 - DNA, 711 bp, Proteus mirabilis
atacagcagatggtactagtgagaaagttaaagaaactattaattattctaattgctttatggttagggatagttgtcctgttttcttttttaccggtgcctttttctgctgtaatgctacaaagacaaatttcttcgtggagtaagtttgatttttcttatgtatcccattctacatgggttaatgaaaatgaaatatctccgcagatctatttagcggtaatagcctctgaagatcaaaattttccaaaacattggggatttgatttcgatgcgattgaaaaagttttccaaaacagcctgcaaagctcaaaaacgatacgaggtgcctctactatttcacaacaaacggtcaaaaacttatttttgtgggatgggcgtagttggataagaaaaggacttgaagccggaatgacgccagtggtggagctgatttggtctaaaaaacgtattttaaccgtttatctgaatatcgtagagtttggtgacggtatttttggggttgagcaggcttctcagcactattttcgcaagccggctaaacaactcaccgcccatgaggcggctttattagccgctgttttacctaatccacatattcttcatgttaataagccttccgcgtatttgctaaaacgacagcagtggatcttaaatcaaatgcgattaatgggaggaacttcgtttttaagcaaaaatgcgttgttataa

SEQ ID NO: 2104 - DNA, 1017 bp, Proteus mirabilis
cgttacaagatgtcacatttgatattgaagtcgtcagtattgatccacaggaggaaacaacaaatgcaaatattgctggctaacccacgaggcttttgtgcgggtgttgaccgagctatcagcattgttgaacgtgcattagaaatctatggcgcgccaatttatgtacgccacgaagtggttcataatcgatatgtagtcaatgatttacgcgaacgtggtgctatttttattgaagaaatctccgaagtgccggataacgctattttgatcttctcagcacacggtgtttctcaagctattcgccaagaggcacgctctcgtaatttaacgatgctttttgatgccacttgtcctttagtgaccaaagtacatatggaagtcgcaagggcgagccgtaaaggtaaagaggccattttaattggtcatgccggacacccagaagttgaagggacgatggggcaatacagtaacccagaagggggaatgtatttggttgaatcgccagatgatgtatggaaactaaaagtgaaagatgaagataatctttgctttatgacacaaaccacattatccgtcgatgatacttccgaagtgattgatgccttaaataaacgattccctaaaatcatcgggccccgtaaagatgatatctgctatgcgacaaccaatcgtcaagaagctgctcgagagcttgcagagcgtgccgatgtcgtgtttgttgttggctctaaaaactcatctaactcaaatcgattagcagagcttgcacaacgtgcaggcaaaccctcttatttaatcgatagtgctgaagatattgatgaaatatgggtaagccatgccaatattgttggggtgacagcaggagcatcagcaccagatattttagttcaacaagtcttagcacgattaaaagcctttggtgcagaagaagtgattgagctatctggcagagaagaaaacattgtttttgaagtgccaaaagagttacgtcttgactataaagtagtcgaataa

SEQ ID NO: 2105 - DNA, 1314 bp, Proteus mirabilis
ggtaacaagatgcaagtttctgttgaaacgactcaaggcctagggcgtcgtgtcacaatcaccgtaccagccgctgatatccaaaaagctgtagacagcgaactgaaaaaagctgctaaaactgttcgcattgatggtttccgtaaaggacacgtaccaatgtctatggttaaacaacgttacggtatgtctgttctgaatgatgttctgggtgatctgatgcagcgtaatttcatcaacgctatcatcgaaaacaaagttaacccagtaggtgcacctgattacaaaccagagcaatacaaagaaggtgaagactttgtatactctgtagaattcgaagttttcccagaaatcgaactgaaagatctggaaagcattgaagtggtaaaacctatcgtgacagttaaagacgaagacgttgataacatgttagaaactctgcgtaaacaacaagccgagtggaaagataaagaaggtgaagttgcggcagaagatcgtgtaactgttgattttaatggttctattgacggtgaagaatttgaaggcggaaaagctgaagatttcgtactagcaatgggccaaggccgtatgatcccaggttttgaagaaggtcttatcggtcataaagcaggtgaagaattcactatcgatgtgactttcccagaagattaccacgctgaaaacctaaaaggtaaaaaagcacaatttgctatcaacctgaaaaaagtggaagagcgtgaactgccagaattaactgaagagttcatcaaacgcttcggtattgcagatggttcagttgatggtttacgtgccgaagtacgtaaaaacatggaacgtgagctgaaaaatgcgatccgtacacgtgttaaatcacaagttatcgatggcttagtgaaagctaacgaagttgacgtacctgcagctgcggtagatagcgaaattgaagttctgcaacgtcaagcagcacaacgtttcggtggtgatgaaaaacaagctctgcaattaccacgtgaattgttcgaagaacaagcaaaacgtcgtgttatcagtggattactgctaggtgaagtgatcaatagtaatgaactgaaagcaaaagacgagcgtgtgaaagcgttgatcgacgaaatggcttcagcttatgaagatccatcagaagttgttgagttctacaataagaacgaacaactgatgaataacatccgtaatttagcattagaagagcaagcggtagaaaaaatcttagcaactgctaaagtaacggaaaaagaaactaacttcactgaactaatgaacgaagttcagatgggttaa

SEQ ID NO: 2106 - DNA, 975 bp, Proteus mirabilis
gagtttgagatgagtacaaaatcaataccagcgtcaaaacgatggttctctaaggcttggttattagaacaaaaatcactcattgccttattgttgcttattgtcgtggtttcaacactcagcccgaatttttttaccttaaataatatttttaacattctacaacaaacctctgttaacgcaattatggctgtaggtatgacattagtcattttaacctctggtatcgatttatcggtaggttcattactcgctttaaccggtgctgttgctgcttctatggtaggggctgatgttaatgcgttagtggctgttgtcggtgctttagcattaggagccgctattggtggcgttacaggtgtcattatcgctaaaggtaaagtgcaggcatttattgccacattagtgatgatgctgttattgcgtggtgtcacgcgtgtttatactgatggcagtccaataaatacaggatttagcgataatgccgacctgtttagctggtttggtattggacgcccctttgggatccccacccctatttggctgatgatgattgtctttttaagcgcgtggtatgtattgcatcacacacgcttgggtcgctatatctatgcccttggaggaaacgaagcagcaacccgtttatctggtattagtgtcgataaaatcaaaattattgtttatgcgctttgcggtttattagcggcccttgccagtgtcattgaagttgctcgtctttcttccgcccaaccaatggctggcaatggttatgaactggatgctatcgccgctgtcgtcttaggtggtaccagtcttgctggcggtaaaggacgcataatgggcacacttattggtgcgttaattttaggctttctcaataatgcactcaatttattaggcatatcatccaattatcaaatgatagtcaaagctgttgtcatcttacttgccgtgctggttgataacaaaaaataa

SEQ ID NO: 2107 - DNA, 231 bp, Proteus mirabilis
accgcagagatggaaatcgctggcggtgcaatcgttggatattgtgcaacaggcagtttgatgagtgccaaaagaccagcaagcatggtaattatggcaattacccacgcaaatattggtctgtctataaaaaacttaggcatagatcatcgactccttattgaggatccttcgctggttcagatttttcagttgatgctgttgcatctaaattttcttcttgtggcgtaa

SEQ ID NO: 2108 - DNA, 627 bp, Proteus mirabilis
gataaagagatgcaagaatataatcaaccactgcgtattggtgttggtggccctgttggttcaggaaaaacagcactattagaagttctttgtaaagctatgcgcgatagttaccaaatcgccgttgttaccaatgatatatatacacaagaagatgcaaaaattttaactcgtgcgcaggctcttgatgcggatcggatcattggtgttgaaacaggaggatgtcctcatacggctattcgtgaagatgcttcaatgaatttggctgccgtagaagagttggcgatgcgccataaaaacttagatattgtttttgtcgaaagtggcggagataacttaagtgcgacctttagccctgaattggctgatcttactatttatgttattgatgttgcagaaggtgagaagatccctcgcaagggggggccggggatcacacattctgatctgctggtgatcaataagatcgatcttgcgccttatgtgggagcgtcattagaagtgatggaagcagatacagccaaaatgcgtcctgtgaaaccttatgtttttactaacttaaaagagaaagtaggtttagagacgattatcgattttattattgataaaggtatgttgagacgttaa

SEQ ID NO: 2109 - DNA, 513 bp, Proteus mirabilis
agcatggagattaaggatatgtctccgcgccgtccgcatttattgcgtgcgcattatgattggatccttgaaaacgagttaaccccccacttagtggtagatgttaatgtcgtgggtgttcaagtccctatggaatatgcgcacgatggtcaaatcgtactaaatatttctccttttgcggtaagtcatcttgaattgatgccgcatcaggtactatttagtgcaagctttggtggtgtacctcgtaaagtgcgcgtacctatggcggctgtaatagcaatatatgcgcgagaaaatggtgcgggtatgatgtttgagccagagccagcctatgaggaaggttatacaccatcattggtggatgatgagcagcaagacggcagttcagcttcggccactgaaggattgtctttagtgaaagatgagacacaggttgaaaacccatcttctccagatgatgatcctgaacctcctcgcccaacaggtcgcccatcattgcgtgtagtgaaataa

SEQ ID NO: 2110 - DNA, 729 bp, Proteus mirabilis
gtaaaggagatcatgatgaataaacagaatgcatcagcctctataccacctgatattgcccatgatgctgatattactttagaacaaccggatatttctcttcgtcgttggctattgccgttatcagagagaggtattgggcatggtactcacaccttaacggatactacagaagaacaaattgaagatatcgcgcaattatcggctgaacaacacctagccaatgcaatccgtcaatgttcaaaagaaggtgaactattagctatttccacgctgtatgatgcgccttattcactctctgaagaagaggtaatgcaattaagagtcgcgttgaacgaggacgctttcgttgatattacttatttaacacataatggtgaagattatttctattctgacactgttatgtcagataactatgcacaattacagcttctcaatagatataccgatatttgtactgccattgcaggtttagttcgctttgaatgcgaaacctaccctcgtccattgaagcaaagcatgttgatgtcggagcctttttattacaccgctgcagaaatagacgatgcattgacgctgatgaaaactcaccctgattttcaagatattcagcaaatattcgcctctaacaatgccccttacctatttagtagcaccctaatgagttatggcaaggcgagagggttaacagaatggctggaggtagaacaatatgaaaatccttaa

SEQ ID NO: 2111 - DNA, 639 bp, Proteus mirabilis
cctctctggatcatgacggtatttttgtgtcaccgtcatgaggatattattgtgatcactctttaccttgcatcgagttcccccagaaggcgagagcttctgtcactgttggatgttcaatttagcaccattacaccggcaattgatgaaatttggcaacaaggtgaagcaccggaagattatgttatccgtttggcgagagagaaatctcaagagggggtacgtcaagcgacaaatgactatccggtattaggctctgatactatcgtggttcaagcaggtcgtattctggaaaaaccacgagataaagcgcatgcagcacaaatgctaagtaatctttcaggtgcaacccaccaagtgatgacggcgattgctatttcagataaaacccgaacaataagccaattagttgtcacggatgtgacttttagaaagatgacagaaagtgaaattagtgcgtatattgaaacgggagagccaatggataaagctggcgcttacggtattcagggaaaaggaggccgttttgtacaacggattgagggtagctatcatgctgttgtcggcttaccgcttgttgaaaccgaagcattgatagctcaatttttgtctctagcgaatgataaggagatttcatga

SEQ ID NO: 2112 - DNA, 1089 bp, Proteus mirabilis
agtagacggatttttccgtcccggcttgcaggattatcctttcgtatgtttaaaaaatttcgtggcatgttttccaacgatctgtctattgacttgggtaccgccaataccctgatttatgtcaaaggacaaggtattgttctcgatgaaccttctgtagttgcgatccgccaagatcgcgcaggtacatcaaaaagtgttgcagccgtcgggcatgaagccaaacagatgctagggcgtacacctgggaatatcgcagctattcgtccaatgaaagacggtgttatcgctgatttttatgtaaccgaaaaaatgcttcaacacttcataaaacaggttcataacaacagctttatgcgtccaagccctcgtgtattagtgtgtgtacctgttggtgcgacacaagttgagcgtagggctatccgcgagtcggcacttagtgcgggtgctcgtgaggtctttttaattgaagaacctatgtctgctgcaattggtgcaggtttaccagtatctgaagcgacgggttcaatggtcgttgatattggtggtgggactacagaagttgcggttatctcattaaatggtgtggtttattcctcttctgtacgtattgggggagaccgttttgatgaagctatcattaactatgtacgtcgtaactacggttcgttgatcggtgaagcaaccgctgaacgtattaagcatgatattggctcggcttatccttcagacgaattaaatgagattgaagtacgtggacgtaatttagcggaaggggtaccacgtagctttactttaaattccaatgagatcctcgaagctttacaagagccattaacaggtattgtaagtgctgtgatggttgccttagaacagtgtccgccagagcttgcttctgatatttcagaacgaggtatggtcttaacgggtggtggggcactgttacgtaacttagaccgtttattaatggaagaaacaggtattcctgttattgtggctgaagatccgcttacctgtgtggctcgtggtggtggtaaagcattagaaatgatcgatatgcacggtggcgatctatttagcgaagattaa

SEQ ID NO: 2113 - DNA, 294 bp, Proteus mirabilis
attatggggatgaaaagcgtgaataaaactcaactgatcgacaaaattgctgcgaatgcagatatcactaaagcggcagcgggtcgtgttgtagatgcaatggtagcttcaatcactgaatctttacaaaaaggtgatgacgttgcattagtgggcttcggtacatttaccgtacgtgatcgcgcagcacgtactggccgtaatccacaaacaggtaaagaaattcaaattgctgcggccaaagtgcctgcattccgtgcgggtaaaggtctaaaagacgcagtaaatcaataa

SEQ ID NO: 2114 - DNA, 3468 bp, Proteus mirabilis
gaggcagtttttcaatattcattgaacaagttgctcaatatgcgtggatctaacgtttttattcgattaaatcattttatttcgacaatatttattgtctctatcctctttgttttgttaggaaatatactttttacctcggctaaagcagaaacagtcagcaataatttacccaccaaagaaagtattcaaaaccagcttaatttattaaataaacgtagtgacttaagtgccgaagataaactcactattggtgatctagagcaggcattgctacttcttgataatattcaacaactagagaaaaaagcagacgactataataagacagtagagcaattaccagaaaagctacgcagtattcaaaatcaattaagtcaattaaaacagaaaatagcgaacaaagaagttgatgactaccgtcaatctttagagagtctaccgcttgcaactttagagtcgcaattagaagaggttttacaatccttagcgaaagcacaggaagatttagccaattacagtaatgagcttattgttttacaaacgcaaccagaaagggcgcaatctgtcttatttaataactcagaaagattgcaacaaatacgaattgcattaaataaaagcagtgcagataaagctcaaatgcgatcttcttctgtgcaacttttacaattagaacaatattatttgcaacaacaaaacagttttcaaaaacgaacactgcaatctaatgtacagctacaaagcttattgcaattacagcgtgattatagttcagcctatattgacctctctcaagagcatgctcaactactgcaagagatcttaagtgataaacgtttagacagttcagaagaggttgctaaagaggcgcagacggcagagctgagtaatcaggcgattaaaaataacgctttttatttagctcaagctgatattaataaaaaactcagcgataagctgattattactacacaaaataataatgagttaaatcgccatagtttaatggtcaaaaatcgcctagatagagctatccaatcagagcgcaatcttaaagagcaaattgatgtattgaaagggagtctgttgctctctcgtattctgtttgaagagcaaattgaactacctgatgatatctttatcaataagttaccggataaaattgctgacttacgtttagaacagtttgaaatcaataaacaaagagatcagatttttcagccgaatctctatatcgaccaattaatgcaagagtaccaagccacacatccggaaattactgataaaaatgagctaaaagagctacataatgcattattacaactgattgatgcgcgacgagatctactggataagctcaataatcaactgggtagccaaatttctgaatctattaatttacagatggatcagcaacagctacgtagtgtggtgagttcattagaaaacaccttagcgcaacaaatattctgggtaagcagtaataaaccgattaacctcagttggttctcaacctttccagatcaggcagtggctgaatttcaaagttttaaactcaactggtcaaatgaaaatctgttgaccggggctaaaaaatcatatcctgtactgattgcgctaattttgttcagtagcatactggtttggcaacgtaaaaaatttgataagcagtttgataaattaagtgctgatattaataagcttaataaagatacgcagttacatactccattagctttagggattgttttcttaaaaacattacccctttcttgtattgtgttagcgataggatattggcttattaatagctttaatgtgcaacaagagtttatctggtcttttacttggcagtttgcggtattttggctgatgtttgagtggtcttatcgtttaatgtcggataatggagtggccgttaatcactttaagatccccctagagcgagtacaacaaaatcgtaaacgtttattacgtttatcgcttcccatgttgccaattattttactttccgcttatggtattaataacccattattgttagtgggtgatgtgattggtcaattagtgacaattatttcactcttttttattagtctgtgtgcattacctttttgtcgtgaaatgtggcaagaaaagggtaatcatgttgtgagaacggtggttatcaccttattaactttctcgcctttacttttaatggggttagttatttttggttattattacaccgcactacgtttagccaatcgttggattgatagtttatatctacttatgttgtggtttattgcttaccacgcgagtttacgcggccttactgttgctgcaagacgactggcgtatcgtcgagcgctagagcgccgacaagcgatgcttaaagagaaaaaagagggggacgataacactctcgagccaatccaagagccaccgatggatatggagcagataaaccaacaatcattaagattaaccacaatgatcttatttattatctttgcttccagtttttatggtatttggtctgactttattacaatctttacttacttagatggtattacgctttggcattataatttgcctacagagttaggtaatgtggttaaagcagtgacggttgctgacttactcctctcttttgccattatggctatctcttggtttatgataagaaacctaccgggtttactcgaagttcttattctttcaagaattaagttacagcaaggcgcttcttatgccattacgactattctgacctatattattattgcgataggtacaattgtttcgctggggatattaggcgtagcatgggaaaaactacaatggttggcggcagccttaacggttggtttagggtttggtttacaagaaatattcgctaactttgtttcagggataattatcttatttgaaagaccggtcagaattggtgatacggtgacaattggctcttattctggaacagtgagtcgtattcgtatccgagcaaccacggtaacggactttgatcgcaaagaggttattatcccgaataaagcctttgtgactgaacgactgatcaactggacattatctgatactgtcacacgtattatcattcaagtcggtgttgcttatggttctgatctggataaagtgaaaaccattttaatgaaagcagcaaaagataatcccaaagtgatgactgagccagagcctgtggtgctgtttaccgaatttggggctagcacgttaaatcatgaattacgtttttatgttagaacgcttggggatagaaatactgctatcgacgaagtcaaccgcgctattgataaactttgcaatgaaaatgatatcaatatcgcgtttaaccaattagaagtgtatctgcataataaacaaggggaagaagtgcaagaaataaaaaaaggccctcttgatggttcaacacctgaagcgaatacgccatttaattaa

SEQ ID NO: 2115 - DNA, 1380 bp, Proteus mirabilis
gctccatacttcattaacggaagaataatgatgctaataaaaaaactttttacacttttttccgtaggactcctaagcttgccagcttcagcggttacactgtctgatctctattttttagcgattaaacatgatcccacatttaatgctgcggtaaaagagcaagtagcaggtaaagagtatgaaaatatcgggttatcacaattgctacccaatatttctgtcaattacaaaaataatcctcgcaactggcaacgtaaggcttatccaataaatatatttcaggataaaataacaacagttgagtatcaaaactatcaaagctattctgtcaacgcgattattagtcaaccactatttgactacaccgcatttagtgaatacaaagcttctatcattaaaacattattagcagacagtcattatcaaaataaattttcagaattaattattcgacttattgataattatattcaagttgcttatacacaagataaattattgctaaatcaagcacagcaagaaatctatcaaaaacaactagcttcaagtcaacgcctatttgagttaggagaaggaaccaaaacagatattgctgaaatagagactcgtttatatttaacccagtcacaatataccgatcttcaattagaaattgaaaaggctaaaaacaaactcagtgctatgatcggttcacaattgcctactcatgagcacatcgcaaagctaactgatacaaagtttgttcttcaatcactggctcccgatgactattccacatgggaaaaaaatgccatacaaaataacttaaagatacaatctgctcgtcatgaaatggcgatagctaaacaagagattgagaagaatagaggtgaatttttcccaacagtacaattttatgcggcttactctagtagtaattctgatagtaataataccattaaccagaaataccaatctgctaacgtgggtttttatgtcagtatgcctttatttaatgggggtaaaacaacggcatcaatgcgtcagtcgacagcaaaatatcagatgagtgcatttgaaagggatgctattattcaaaatattatgcaggaattaagatatcaatatcaaatttgctcaacgagccatattaaattgatggcttttgagcaagccgttagttccgctaagttacaattaaatgcaacacgaaaaagctatattggtggtcagcgaacgatggttgatgtgcttaatgcggaagagcttttatatagagcgcagcaagatttaatcaaagccaaatatgattatattcaagcttgggcattattacatcaatataccaatacactagacattgaaaaaataaaaattattgaaaactattttcagtag

SEQ ID NO: 2116 - DNA, 663 bp, Proteus mirabilis
ttgattaacttggaggttttcatggctgtcgctgccaacaaacgttcggtaatgactttgttttccggtccgactgatattttcagccatcaggtcagaattgtccttgcggagaaaggtgtcagtgttgaaattgaacaggttgaagctggtaatcttccacaagatcttatcgatcttaacccgtaccagagtgtgccgactttggtcgatcgtgaactgactttatatgattcacgtattattatggaatatcttgatgaacgcttccctcatcctcctttgatgccagtgtatcctgttgctcgtggtagtagccgtttaatgatgcatcgcattgaacaagattggtactctttaatgaatgttattgaaaagggtaacgatcaacaagctaatgcagcacgtaaacaactcgccgaagagctattggcggtatctccggtatttaaagaatacccttattttatgagtgaagagtttagcttagtggattgctacctagctcctctcttatggcgtttacctgtattaggcgtggatttaagcggtgcaggtgcgaaagatgtacaaatttatatgcaacgtgtttttgagcgggattctttccttgcgtcattaaccgaagcagagcgcgaaatgcgtttaccttcaagaggataa

SEQ ID NO: 2117 - DNA, 1263 bp, Proteus mirabilis
acaaataactttgggatggtaaaggatagaagcatggcagtggcaagcgaaacagcaaaagaaccaacggtactttctcgtcgtaaattgttatgtattgccggaatggggtggactttcgatgcaatggatgtggggcttctcgcctttttattaacggcgttaaaagaagattggggattaacagcagcgcaattaggttggattggcagtattaattctatcggtatggcagtaggcgcttttgtctttggcattatggccgatagaaaaggtcgtaaaccggtatttatcttaacgttgctgctatttagccttggttgcggtttaactgcattagcaagctccttaatggtggtattaattttacgcttttttattggtatgggattaggtggagaattacctgttgcttccacattggtgagtgaaagtgttaaagcccatgagcgtggtcgtattgttgttttattagagagtttttgggcggtagggtggttaattgccgcgttaatagcgtattttattattcctgattatggctggcgtatggctatgttattgagcgcactacccgcagtttatgcactctatttgcgttcaaagttaccagaacccagttccacacagtcattattacaaaatcgtttatctcttcgccaatcaatggcattgatttggtcacctcaatatcgccgttcaacactgatgttgtgggtattatggttttgtgtggtgttctcttattatggcatttttttatggctaccgagtgtcgcaatgttaaaaggctttagtttaattaaaagctttcaatatgtgttgatcatgacactcgctcagttaccgggctattttaccgcagcatggtttattgaacgttatggtcgtaagtttgtgttaatcacctatttagcaggcaccgcgattagcgcttactattttagcgtagccgattccacaaccacactattagtgtttggtatgttgttatcattttttaatttaggtgcgtggggggcattatatgcctataccccagaacaatatcctgatggtatacgagctacaggcgctggaacggcgacggcaataggccgtattggcggaatattagggccactgatggtaggctatttagtgcaatatcaatttgacataagcactatttttcttatttttagcctttccattgtgatagcgatactagcggttatgttattaggtaaagaaaccaaaaatagaccacttaattctatttaa

SEQ ID NO: 2118 - DNA, 876 bp, Proteus mirabilis
ttgggtaacttaggtgtcagcgtgatgcaattaatcgcgcctttggttgtcagtgtgggcgtttttgctatgtttagtggccccggtgtcgttcaacctgatggctcacgtttatggctagagaatgcggcgtggatttgggtacctttcttgcttatctttacctttgcggcttggtttggcatgaatgatctggctgctaataaagcttctttaagtcaacagctacctgttttaaaacgtggtcatctttggttactcagtatcctctatctgtgctcttttggttcttttatcggcttttctgccgggtttgcaatgttatcgaaaacccagttccccgatattgtcattttacattatgccttctttggtcctttacttggagcattagctcgccctgtgggaggtgcgctatctgataaatttggtggcattaaagtgacgcttatcaactttatcattatggctattttctcagtgctcctgttcttaaccctaccggaaaatggtgctggtggatcgtttattgctttctatggcgtgtttatggtgctgtttttaactgcagggctaggcagtggttcaacattccaaatgattgccgtggtatttagaaaaatcactattgatcgcatgaaggcacaaggggcttcagatgaagctgcgcaaaaagaagccgtaacagaaagtgcagctgcattgggttttatctctgcaatcggtgcgattggtggcttctttattcctaaagcctttggtacatcccttgcgatgacgggttcacctgctggggcaatgaaaatcttcgttctgttctatatcgcctgcgttctgatcacttggttggtctatggacgtaaacacaataaataa

SEQ ID NO: 2119 - DNA, 216 bp, Proteus mirabilis
atatcttttgttggtcttaaagaagcgtctattttcactttatttattattatgaatatcaaaatagcttcatttaaagcaaaagagagtaggagaaataactttctcctacccaactatgacttaaacaataaaatcagtttcgtaattaacaaaacctacgatatcaattttaaaatcaggattataattatagccataagcattaatggctaa

SEQ ID NO: 2120 - DNA, 1248 bp, Proteus mirabilis
acaaactttgtctatacaatagacaaatttgatgtttatcagggaattactatgacagccttaccacgaaaaaatatgtggcagattgtccttactatcattttagtaggaataaatttacgcccttttttaaccgggcctggccctgttattgacaatattattgcttcaacaggcatgagctatagccaagtctcattactcacgttattacccatgattttaatgggagtcggtgctttggttgtgccctttttacaaccttatattcaagctcgtagagggctacaagttgcgatgcttatcttattattagcatcgttttctcgtgcctatgtttctgatggtgatcagttacttattactgctctattttgtggtttaagtgtcgcttatatccaagcggttttccctggcatcatcaaagcgtggtttggacagaaaactcccattatgatggggctctactcagccatgctaatgggaggaggtgcattaggtgctcagttatcccctgttcttacggcatctgatggcaattggcagcaggctcttgcttggtttgcgttacccgcaagcgtcgcattagttgctattacgctatcaattaaaaagaatatttccgaaaccaataaactgccacttaatacattgatttggcgaccaagaacagccttattaattgttggatttggctttgttaatgccggctacgcttcgatggtggcatggttagctcccttctatcaatcattaggtatgccaagtgcacaaagtggctcattagttgctattttgtcactttttcaagcatcagcagcattaattattccatttcttgctgccaaaaatcatgatcgccgtttttggctacttttaacactgacaagccaacttattggatttttagcgctgatgacaatgccaatgagcgccccttatctatggagtatctttttaggctgtgggttgggtggttgtttctcaatgatgatgattgccgcattagatcatgttcctcatccattacacgcaggagcactatcagccttgatgcaaggtggcggatttattattgcctcttttgggccgctgatcgcagtatggctacaacaagatgatggtagttttacctatgcttgggcttttcatgctgtcttagtgatattaactatgggattatttgcacggttaaatcctcataattataataaggcctatcctactagccatatattgacagattag

SEQ ID NO: 2121 - DNA, 1335 bp, Proteus mirabilis
gcaattcctgtgtggttacttgctgttttgtcattttgtttccttggaaaaaatattttaaaaaataataccaaaactatttacatcaatcaaaatatcgctattatctattttgtttccatggaaacaaaactaagaggcaatataatgaaattatcaatccgtagtctgttttaccttgtttgctttagcgctttattaggctctctagcacaaaatatttatactcctgtgctgccattgatccagcagcaatttaataccacattatcactggttaaccttacggtatcagctttcacttttgctatggctgttatgcagttatgttatggttcattgattgacaaatggggcagaaaacctattttgctcagtgggttaacgatttcaattatcggcgcacttatttgtatatgggctaattctattaacctattaatttttggacgagtgatccaagccataggtatcgctgccatccctgttgtcgcagcaactattttaggagatctctatcaagggaatgagcgtgctaaagcaatgggaagttaccaaatgttgctagcattagcaccagcgagtggtcctttattaggcggctatttagcacaacattatcactaccaaagtatttttgttttcttaagtatggtgggacttgttttgctgattgcccatctattttatttacctgaaactcgcccagaacaaaaacagtccgttaaaagcttatctgctatgcgacaagtgctcgccgccccagagggtaaatctgtttttgtgataagttttatggtgttttataactacttctgcctattagtatttttacctttaattgcttttcacctttatcacttaaatagcagtgaaattggtgggctttatgttcctatgtccattgcactggtgttaggcagttacctttaccgtaaggtttgtcatttgtttagcgctgaatatggtgtgatcataacttcatgtataaaccttgccatgttgtcgttatttgccctattttggcaaatctcattaccaataatgttaatattaacggtgttatatggtctctctttaggattaactatgcctacacacacgaccttaataaccagccactttagttcagtaagagcaacggcaatgggtatttataattttatccgctactgtggtatggctgcagggcctatggtcgcaagctattttgtcaccgataatcattatcaatatgtcttttattcttgtgtgatcttaacaagtttggcattgtgttttgccatcaaaacgctactttccacattaaaacagcaacgacaaaccatcgactaa

SEQ ID NO: 2122 - DNA, 1866 bp, Proteus mirabilis
attaataatgtcagtgaattgaattctagacaattattccaattttcacttgaacaatggagaagcgcagtgcaaacctttaatgccgatatagcgataatcggagccgggggcgcaggcttacgagcagcaattgctgcagcggaagcaaatcctcaactgaaaattgctctgatctcaaaagtttaccctatgcgtagccacactgtggcagcagaaggcggatcagcagcagtgactcaggctcacgactcctacgactttcacttcaatgataccgtttctggcggtgactggttgtgtgagcaggatgtcgttgattacttcgttgagcattgtccaacagagatgactcaactagaactctggggctgtccttggagccgtaaagaagacgggtcagtcaacgtccgacgttttggtgggatgaaaatcgaacggacttggttcgccgccgataaaaccggcttccacatgttacacaccctgttccaaacctctttaaaataccctcaaattcaacgtttcgatgaacatttcgttctcgatatccttgttgatgaaggccacgctcgtggtgttgttgctattaatatgatggaagggacgaaagttcaaattcgtgctaatgctgtcattatggcaacaggtggcgcaggtcgcgtttatcgctttaatactaatggcggtatcgttacaggtgatggtatggggatagccttacgtcatggcgtgccactgcgtgatatggaatttgtgcaatatcacccaactggtttaccgggctcaggtattctgatgaccgaaggttgccgtggtgaagggggtattctggtcaataaagatggttaccgttatctacaagattatggcctaggaccagaaacaccattaggtaaacccgaaaataaatatatggaattaggtcctcgcgataaagtttctcaagcattctggcatgagtggcgcgcgggtcgtaccattaaaactcaccgtggtgatgttgtgcatcttgatttacgtcatctgggtgcgaaaaaacttcatgaacgtttaccattcatttgtgaactggcaaaagcgtatgtgggtgttgatccagttaatgaacctattccagttcgtccaactgcacactacaccatgggtggtatcgagactaatcagcgcacagaaacacgtattaaaggtctgtttgcggtgggtgagtgttcatctgtcggcttacatggcgctaaccgtttaggttctaactcactggctgaacttgtagtatttggtcgtcttgctggggaagaagccgttcgtcgtgcccaagaagcaacccctgctaacgcatcagcattagatgcacaaactcgtgacatcgaagacaatttgaaaaaactgatgaaccaaaaaggttctgaaaattgggctcagatccgcgatgaaatgggtgaagccatggaagaaggttgcggtatctatcgtacacctgaattaatgcaaaaaaccattgataaactgactgaactaaaagaacgttttaaacacgtagaaattaaagataccagtagcgtctttaatactgatttactgtataaaattgagcttggctttggtttagatgtcgctgaatgtatggcgcattctgcattcaatcgtaaagagtctcgtggtgcacaccaacgtcttgacgaaggttgtactgagcgtgatgacgtgaacttccttaaacacactctggcattctataacccagaaggtgcaccgcgtttagaatatagcgatgtgaagatcaccaaatctgctcctgctaaacgtgtctatggtggtgaagcgactgcacaagacaagcagaataaggagaaagcgaatggctga

SEQ ID NO: 2123 - DNA, 204 bp, Proteus mirabilis
tgccaaaatgtatgcaccacttttgcgcataactcttttttatgcgctattttggggcatatctattttttatttccccactcaaatgtcaacaaaatgttaaaaatgagatcttgttggcacttttatcatcgtatatttaaatctatttgcttatttattcatctattattattaattgttcaacaatctaatatctattga

SEQ ID NO: 2124 - DNA, 456 bp, Proteus mirabilis
ccgcatgatgtccgaccatgcttagccaaccttcgtgctcctccgttactctttaggaggagaccgccccagtcaaactacccaccagacacggtccccgacccagtttatgggcctaggttagaacatcaaacgttaaagggtggtatttcaaggttggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaggagcttcgcttacgctaa

SEQ ID NO: 2125 - DNA, 720 bp, Proteus mirabilis
agctatttcgtgttggcctactgtcagcgcaaatggtgggaaactgaatttacaggcagtcacatcatgatgagaaaaattgaagaactgttagccaacaataaacaatggtcaagttctgttacagaagaaaacccgcaattttttaaagagctgagtaaaggccaaaaacctcatttcttatggattggttgttcagacagccgcgtccccgctgaaaaattaattaatgccgcccctggtgatttatttgtacaccgcaatgtggcaaaccttgtgatccacaccgacttaaactgtctttctgttattcaatatgccgttgatgtcctacaagttgagcatattattgtttgtggtcattatggctgtggtggtattgaagctgctattgaagggactgaactgggcttaattaataactggttactgcatatccgtgatatctggtataaacatagctccatgttaggtgaactcgcaccacaagatagattaaatttactctgtgaacttaacgtgatagaacaagtttataaccttggtcactcaactattatgcaagccgcatggaaacgtggacaaaaagtgatgatccacggttgggtttacggtttaaacaatggtgaattacacgatttagatatcacctcagacagtcgtgaaaaactagaactctcttatcgccaagctattgcaaaattaagccatccacgttga

SEQ ID NO: 2126 - DNA, 1599 bp, Proteus mirabilis
aggcgatgcttatcaacaaaccctgaatggacaggagaaggcataatgaaaattcgttcacaagtcggtatggtactgaacctcgacaaatgtatcggttgccatacctgttcagtaacctgtaaaaatgtttggaccagtcgtgaaggtgtggaatacgcttggtttaataatgttgaaactaaaccgggtacagggtatccgcaaaattgggaagatcaagagaagtggaaaggcggctggatcaaaaatattaaaggtaagttagtaccaagaatgggtaaccgtgttgggctattatcaaagatttttgccaacccagatgtgccagcattagatgattattatgagccatttgattatgactatgagcatttaaaaaatgcaccagaaggctcattacccaccgcacgtcctcgttcgttgataaccggtcagcgtatgaccaagatcgaaaaaggcccaaactgggaagatgatttagggggcgaatttagcaaacgtgctgcggataaaaacttcgccaatatgcaaaaagagatgtatgggcagtttgaaaatacatttatgatgtatttacctcgtttatgtgaacactgcttaaatcctgcttgtgtcgcgacctgtccaagtggtgcgatttataaacgtgctgaggatggtattgtgcttatcgatcaagataagtgtcgtggttggcgcatgtgtttaacagggtgtccatacaaaaaaatctactttaactggaaaagcggtaagtcagaaaaatgtattttctgttatccgcgcatcgaatcaggtcaaccaaccctatgctcagaaacctgtgttggacgtattcgttatcttggtgtgatgctgtatgacgcagataaaatttcacaagccgccagtgctgataatgaaaaagacttataccaaagtcaattagatatctttttagatcccttcgatcctgaagttattaaagctgcagaagagcaaggtattccattaagtgtgattgatgcagcccaacgttcgccggtttataaaatggcggtggattggaagctggcattaccattacaccctgaatatcgtactttacctatggtgtggtatgtgccacctctgtcacctatccaatctgcggctgatgcaggagtgttgccacatacgggggtattaccggatgtagaaagtttacgtattcctgtccaatatttggctaacttgctgaccgcaggcgatacagcgccagtgttattagcattaaaaagaatgttggcaatgcgccattataaacgcgcagaaacggtagaaggtaaaaccgatttgacagcattagagcaagtgggattaaccgaagcacaggcacaagagatgtatcgctatttggcgattgccaattatgaagatcgctttgttattccttctagccatcgtgagttagcaagagaagcttttcctgagcgtaacggctgtggttttagttttggtgatggttgtcatggcagcgagagtaaatttaatctgtttaatagccatcgtattgatgccatcgatatcacttccaaaacccctcaagatgagcgccgttctgaggagaaaatatga

SEQ ID NO: 2127 - DNA, 474 bp, Proteus mirabilis
cctatgaacgtaatcaaaggtgttgtcgcggcgccaaacgcacgtgtagcgattgcaattgcccgttttaataattttattaatgatagcttgttagaaggtgccgttgatgcacttgagcgtatcggacaagtttcctcagaaaatattaccgtcgtttgggttcctggcgcttatgagttgccattaactgtaaaagcattagcagaaagcgacaaatatgatgccgttatcgcgttaggcactgttatccgtggtggaaccgcacattttgaatacgttgctggcgaatgcagctctggcctttctcatgttgcaatgcaaagtgagatccctgtgacttttggtgtattaaccactgaaagcattgagcaggcaattgaacgagctggtactaaagcgggcaataaaggtgctgaagctgcaatgacagcacttgaaatgatcaatgtacttaaagccattaaaggctaa

SEQ ID NO: 2128 - DNA, 1014 bp, Proteus mirabilis
actgcacgctttgttttctgttggagtttttcgttcatgagtgaaatcgcggattggcagccaagcgcctcaatcgccaacttactgaaaaaggcgaaaattgtcagtaatattaggcgttttttcgctgatcgtggtgttttagaagttgaaacaccgatgatgagtcaggctaccgttaccgatattcatctatgcccatttgaaacccaatttgtggggcctggtgcttctcaagggctaaagttatatttaatgaccagtcctgaataccatatgaagcgtctattagcggcgaacagtgggccaatttatcaaatggggcgttgcttccgtaacgaggaagccggtagatatcataatccggaatttacgatgcttgaatggtatcgaccttgttttgatatgtaccggttgatgaatgaagtcgatgatttattacaagaagtgcttgattgtgaagcgtctgaatcgctctcatatcaacaagcctttttgcgctatctcgatatcgaccctttatctgcagataaagaaaagttacgtgaggttgcggcaaaacttgatttatcaaatattgctgacacagaagaaaatagagatacgctactgcaattactttttgtgtcaggtgtagagcctcatattggtcttgaaaaaccaacctttatctatcattttcctgcttcacaagcttcccttgctgaaattagctcagaagatcatcgtgttgcagagcgatttgaggtctattttaaaggtgttgagttagcaaatggttttcgtgaattaacggatgctaaagagcaacgtcttcgttttgaacgagataatcgtcaacgtgttgccatgggattacctgaacagcctattgatgagcgttttttagctgcgcttgaagctggattacctgaatgttcaggggttgctttaggcgttgatcgcctgattatgctcgcactcggtgttgagcgtattagtgatgtgattgccttccctgtttatagagcataa

SEQ ID NO: 2129 - DNA, 1005 bp, Proteus mirabilis
gtcaagggcgtatggtgggaggacaaaatggctaaaggaaaacactcccgtaaggcaatgccaacaccaaaagcgaaaacaaaagcattacgtggtggacgccgtgagcagtggcgttatgcatggcgtaataccatggccgactttttacgccaacccctctcttctttcttaacggtgatggtagtagcgatttcattaacactacctagtatctgttacattgtctggaaaaatgtatcaacagccgcagagcagtggtatcccactccgcaactgacggtctatcttgataaatctctagatgacagcttagcgcaggcaacgataaaaaatatcgaggcattagataaagtcgaagaggttaattatctttctcgtcaagattcattagtggagtttcgctcatggtctggatttagtagcgcattagatatgctagaagaaaatccattacccgctgtcgcgattgtgactcctgttatggatcctaatgacgagcaattaatggttaatttgcgtgatgcagtggcaaatattgccggtgttgacgaagtgagaatggacgatagctggtttactcggttatctactttaacctcattagttggacaaatcgcaatggtgatcggtagcttaatgattgtggcactgctattggttattggtaatagtgttcgtcttaatattttcagtcgtcgtgataccattaatgtgatgaaattaattggtgctactgatggctttatcatgcgtccctttttaaattggggtttagtactcggctttatcggggctatttttgcgattattttctctgcattattggtatggaagttatctgatgtcgttacgcaagcggcgaccgtatttggaacaactttctcaatatctggattaggttttgatgaatcggttattttgatcctcgtttcgatgaccattggctggtttgctgcttggttgaccaccatgcaacatttacgtcaattcacaccagaatag

SEQ ID NO: 2130 - DNA, 219 bp, Proteus mirabilis
tctattttagtattttattgtttttatactttttatctaaaaaaagacaaattgcattttttaatttctctctttggtaaagaatataactattatttatgtaatacctctataaattgtttttataaataccctcgggaaaaaggaggatcactgatacaaaataatgcaaaggcaagatacaaggtgaaaaatcgtgttttggctacaattttctga

SEQ ID NO: 2131 - DNA, 366 bp, Proteus mirabilis
gtgcttggcttgctcggactcactctcagcaagaagcttgggcaaggtgatgtctcagaaattttgcttcctactaatggcaaaaatagtagtgtcgatttagtgttattaatgatgcagttaggtaaacgcaatattaatagtgtatgggttgaaagtggcgcacattttgctggcgcactattagagcttggtcttgttgatgagcttatcatttatattgctccgaaaattttaggcaatgatgctcgaggtttattatccatttcaccactgtcgtcattatctgaagcccctgaatttacaatagattctcttcaacaaatcggtcctgatatccgcgtttgtttaaaacctcgttattaa

SEQ ID NO: 2132 - DNA, 7158 bp, Proteus mirabilis
ttacttaaagttcagtttctgatatctaaaaaaactataaatacgaaaatctcatcattatttgttacgatgagtttaaaaatgacgacgttaaataatgtaccttccccacgccccagttctattacgagaaaagtcgcttggcttaatatttttatacaattagcatttcctattgtgacaaccatgcctacgcagacttttgccaatgagaataactttaaaaaacataatattagcgatataaaccaacaaaatacttatcaagtcaaagcgggtgataccccagaatctatcgcaaaaaaatttaatataaaattatttaaattgattgaagctaatccacaacatgtatcgttaacgggtgagctaaaaataaatgatggaactattcttaatattcctaatgaatatttattaaaaaaaaagtggctcaataatcaagatgaggcaatcccctcaacagagggcgaagagctcgctaaaattattgttgataattcatttttactcaataaagatatcgatgtaacacaatatgcaattagccaaatctccagtaaatccaatcagaaaatagaacaatggcttaatcaatttgggcatgcgcgagtttcactttcagcagataaaaatctcaccttaaaaaatagctcagcggaattgttaattccattatatgaacaaaaagaaaagctgatctttgctcaaactaactatcatcgcaaagatcttcgtagccaatttaattatggtattggttatcgctattttactgaaaaatttatggtcggcattaatggcttttatgatcatgatttaacgcatcatcataatcgtttgggaattggcgccgaaatttggcgagactatttcaaattaagttctaaccattatcaccgtctatcaagttggcgagcctctaataatatcttagattatagtgaacgccctgcgaatggttgggacattcgaacagaaggctattttccagcttatccacaattaggcactaaattaatctttgaacaatactacggtaaagaagttggtctatttggcaaagataaacgggacaaaaatccacatacctacacattagggattaattatactccgataccattagtcacattaaatgccgagcgtcgtattggcttacatgatcgtgctgataataacttgaatatcaacttgtcctaccgcataggagaatcactcgcttcacaacttaatcctgataatgtcaaagcaatacgtacattagcaggaagtcgttatgactttgttaatcgtaataacgatatgattttagaatataaaaaggaaactttagttttcctttctatggttgattcaataaatggttatgctaaagaggagcgcgatttacaagttcaagtaaaaacaaaatatccgttagccaatattgaatggtccgcaagtaagttaaatgcccaaggcgggcaaataaaacatcatggtggaactcactacaccgtgattttgcctcaatatcaaattggtgcaattgagaaaaatagctatatcattagtgctgttgccattgatacccatggcaatcgttcagcgcctgttcaaacaacggttattgtagataaatcgttaatcaatacgcgtaatagcctattttcacctaaacagagccaactattcgctaacggtgaagcaacccaaaagttaatattatccatcgttgataatgataatttacccgttgatattgatagtaaagaaattactttacagcaacagtctgatacagaaaaaggcaatagccgtatttctactttctctcgtttagctgctgggaaatatcaattaacggttacagcaggaagcataccggaaaaattaaccctaacccccgtattccgtgataataccttcaactcagcaaccgtgacacttattgccgataatcaaactgcccatattgcaaaaggcaacctaacggttacaaaagataacgcgccagccgacggtaaaagtcaaaataaaatcaaagtacgagtcactgatagcaaccacaatccattggctcattatccagtcaactttactgccagtaatggtgctaatgtcattagctcaagaaaaacggatgaacaaggtgagattattgcttcagtgactaatactcaagtagggagttcgcagattggtgtacaagtaaaagggataacctattcgactgaagtccattttagtgtggataatgatagcgcctatattccacaacaaaacttcacgatcacaccaccactttctctagccgatggtaaaacagaaaaaaacatttcattacaagttgttgataagcaaaataatccgatacccgctactcatgtgacattatcggcagataaccaagcacaattaaaacaaaccatattaaccacagacgagcaaggtaaggcgaccaccactatgataagtaaagtcgccggtacggtcaccgtgagggccaaaataaacgacaagatgactcacgcgacaacccaatttatcgccaaccaagctaagggggttattgtctccataaccccatcctctacaactcatgtcgcagatggtcaaaccccggtcatccttactgcattagtacaagatcagttcggtgagccgctccctcatgcacaaattagctgggaaactgagcacgataaaagtattgttaaaattgaacataccacaatgactaatgagcaagggatcaccaccaacaagttaaccagtacacaagcactcagtgtgcgggtaactgcgcgtataaataacaatgcctttactgctgagccaattacttttattgctaatgggcaacaagctttgattagtgaattattggttaataaaaatcagattgttgcagataagcaagatcccgcagaacttactgcaatagtaacagataaactgggtaatcaacttcctgatactattgttaattggcaagggagtgctggtactcaatttgctcagcaacaaactaagaccgatgctcaaggtatcgccaaaaatacgctaacaacatcacaatcaggtatcacaaccatcaccgcgcgattaaataatggtcaacatgcacaaactaacttagttgccgttgcagatctcaaaagtgccactctcacattaacgacattaaataataagcaatctgccatagcagataaccaagatagcattaccgtagtagcaaacttaactgatgcttatcataacccattgaaaaatatccctgtctattggcaatcaagtattaatcatattgatgaaactactactcaaacagatgaaaaaggcagaacgcaagttgtcatttcaggaaccaaagcacagccaacaacaattaccgcctatttatcaaataaagagaaaaaaagcattcaggtaacctttgttgcgggggcgccagtgcaacaaaatagttatttgacgattgaaccacaatctatcattgccgatggtaatgcctttgctgtgggtaaaatagacctgcgtgataaatttgataatccggtaataggtcgtagtaacgatattgcgttaattggggataacagcaccatccaattcagtaaaatcacagaaacggctaacggcaattatcaagctcatattagaggtacaaaagcgggactcagtcaaattaccgccactattgatagtattacggtaacgcaatctttaggatttttaacagataataaaacagtcaagatccactccgttaaggttatggcaccttataccgtaacagcgaatggtaaagacaaagtcattattcaagcacaaatcaccgataaacataacaatccagtatcaaaaggcgttactgtcggttggataagtgatctcggtaagcttgcagcaccattaagcatgaccaataagcaaggaatagctgaaattaccctctcaagtactcaggcaggaaaagcgaaagtaacggcagtgctcaataaccaacaatctgtcaatgctgatcacattgtcacctttacggaaggtgatatttcggcctctctttctactgttgccatattccctgacactattgtcgcaggggcaaataaagcgaccgtaacaataaccttaaaggataaagaaggtaatttattgcccaacttagccaataaaatcaccttaacgccgcagactaatttacaaacaacgattacgccctttaaagagaaacaaaaaggcatttatcaagcccaagtgagcgcattaaaaaccggaaaaacctcgttatcggctcacgttgctccattagcaataaaacaatccgtttctttaacggtgctccctaataacacaacagcaaaggtgaaaaactttactattagcaatatgcaaccacatgctggggagtctattacttataaagcctatttagttgataaccatgataatcctgtcggtatgggtgtacctgtcgcttggtcaacgaatgaaggtagtcaactcgaaacaccattaacttttacagatgataatggtgtagcaatagttggattatctcgacgctctgtcggtgttgccaaagtcagcgcaatattagaaacaggtacttatatagcagatgatgttcactttttaacgggtcacattgatgaaacgatgtcagaactgtcgttgaacccgagtcaaatcattgctaatggcaaagataaggcattattgacatttgttattaaagataaaaatggaaatatcatccccaaccaacaagtaagcggattttctaaaaatccaaccatcaaatttagtcaagcacaacaaatatcactgggacgctatgagattgaaataacaggaactcaatcgggcacagcacagattggtgttatggtaaatggcacccatttcaaaaaacaaaaaatattacaacttaatgccgatgtgacgacatggaaaatacgcgctgttgaggttgatagaacaaccataaccgcaggagataaaggtgttaactaccaagcaactgtcgttgatgccaataataatgtattacctaatgttattgtgtcatggaaattactcggatcagcagatgattatcattacagcacttatactaatgataaggggatagcaacgaatcgagtgactagtcatgtcgcgggacgcttgaagatgagcgcttatcttgattctaataattataaatcaacacaagatattactgtaataccggctgaaatagatattcataaatcaacctttaatagtcatcgtcgttctataaatgctgataataaagatagtacgttattaagcgtaaaattaatggataaatacgataatactattgatggtaagaatgttgagattaaaactatcagtggtaagcctaattttagtgacaatccattaaagtcagtgggcaatggtgaatatcaaacaaatgttacagcaaatacgatgtccgatattatcttaaccgctcaagctgaaacaataactatcgcagagccattgacgattaaagtggctatccctaaatctgaaattacctttgagaaacctatccaacaggaaatctacaaatcaactgtgattgatgcgttaagttataaaggtgtaccacaaaatatgcaggtaatatggtcaagctctgatcctactgttgcttccattgatacaacaagtgggcaaatctccatgaaaaaggctggtactacaattattaccttacaaaccttaggtaatgagcaatatccatcagctaaaaatagctatcctttagtgatagaaaaagcgccaccaaaactgaaagtaacctctcctcacaccatacaatcgatctggaatgatggcattacccatcaaataacagcggaatttgataatccagaggttaaaaatacccccattcatttctctagtagcgataccttggtagccaccattgatagtaaaggtaacttaaccgccattaaaccaggaaaaacaaaaatagtaatacaaagtgatgctacagataaattcctagctgatagccaaactgtagactatcagcaagaaaaagctgcactaagttattattttaaaaagaattatattgtattaacaactgattctgctgcagataaattattgatggctcaaagccctacgccagatgtccccgttgaagcgaatgcaacttggtatagtagtcaacctaacatagttgaaatcaccccagatgggattatcaaaaaccttaatattgggcaaacaacattaacacttgaggtgaaaaataataattattttcaagatcatgagcaaagctataacgtcattatacaagcatcgcctcgcatcacaattaactcatttgagtttctatctgcgggagagagcaaatcaaatacacatttggatgatttaacttggcaacctttatacacttcagacgatcagtttattgttaaatggtcttcatcagacacacctaaagcgattaacttcgagttatttgatgaaaacggcacttctatcgccttagaagaaagacaaaactatgcacctaaacataatatacatgacccggtaaaaattcaggtaccgaaacaatatctaaccagtccaaaacaattaacactagaagtcacaacctttgatagtaataatcagccttacgtcgatcctaaaaaatataaaattaatattgactattttcctgccaataatgcatataaaataatctctcttgattataattctaaatttatctatacaaactcaggaaagagtgcttcagcttgtcaaaatggttggtcaaccgctacaacacatcttattttaacgccaagattagtatttaaaggtgagccgaaaaagttactttatcccatttctattactacggaattatatgatgtaacattaaattcatcggataaactcatcggacatattaataagaaattaacttatccagataagattatatttagcgagcgttctaaaaaaatagctgaaatatcgccaacatcatcacactacgcattagacgaagaatgtagaattaatgattctggtcatggtacgttaaaagcaaatataaccataggtaacagatccagttatcttaaaaaagaatttcattggaatggccaaataggggtatatttttaa

SEQ ID NO: 2133 - DNA, 798 bp, Proteus mirabilis
atgctgctggtcactcaactccttattggttctgctataggtttagttatcaccacaacgggagtggggggtggtgttatcttattacctgtgcttatctatttatttggaatgaatgcattagcagcagtggcgaccgctaatttattatcgatgttaatgaaaatttcctcttcttatattcattttcgtttaggaaatattccattaaaaccagcattattgattttagggatcatgtttccggccacatttttagccagctatggggtaacctggttgggatcacaacctcaatattatgagcaggttgaattaggcattaatatcctgatgattgtggcgattatcttttcaatgttcctttttttacaacgaatattcaaaaaatccacatcatcacatccgttatcatcattggcacctagctcatcaattcctctgaattctctttttgttcccggtatgagtgccggatttgtcttaggggcaacgggggttggtggaggattggttgtcttacccgtgcttatgcgttttgcacaaatgaatattaaggaagcgatcggtagttctatatttattactacaattttgtcaggtggctctgctattgcttatagtgctggtggctataccgatgtgcatacggccatcattctttgtttaggatcacttatttcgattcctttagcgcgctatttactggtgtatttatctgagcgcttttttcaatatttaactctgttatttattctgatcagcatcattatgatgagttggaaactaataaattaa

SEQ ID NO: 2134 - DNA, 327 bp, Proteus mirabilis
aatatcatggtgaaatatcgtcgtgcaaatattgatgtcaatgcactggtaggtaagcgcatacaaaaaaggcgtaaagagttaggttacacaggtagccaattggcggcaaaactaggggttagccaacaacaattctcacgctatgagcgggggttaaacaaaatagatcttacttatctagtgctattagctaagttcttaaacacacccatttactggttttttgaggactgtattacttcaacgtcggtcaaaagtggcaaaccgctaagtcgacgaagcaatcttttagccaaaaaagcactagacgcatttctgtattaa

SEQ ID NO: 2135 - DNA, 228 bp, Proteus mirabilis
tcaggaatggtttcaatgctgtctttaataaattgcagttgttgcgcgttagcagtcataatcagtgccataataaaaaacgaaacgatagaatctatgcaatatgccgttaaaatgcaacagaaagccagtgaacaactcttttttgttgctttaagtcaattcatgtttttagcaaaacaggtacaaagcccaaatgaaaaaaacagatccattgagtttgtttaa

SEQ ID NO: 2136 - DNA, 189 bp, Proteus mirabilis
aaggtggtggtttttcccgcaccgttagggccaagtaagccaacaatctcaccggagttaacattgaggctcacatcaccgacaacggtgcgccctttgtatgcttttgctaaattttcagcttttaacagcgccataaagtgttacttacctttgttgttaacaccgggacctttctcttgtaactga

SEQ ID NO: 2137 - DNA, 285 bp, Proteus mirabilis
ctcggtcaggtccggaaggaagcagccatggcaggtgtcgtgtgtgccgggatgtcgctggcaaggccccacccaatttctgcattgcaatcccgctattttttatccagttactttcttcatcgtaatcgtatcgttgaacgtttgcatctaaacatatttctatttacatattgtttaattaatagtttttttaactatatttactctcaatatgggtttggtgaattaataagaaacagaatgcctttcacctattatcgcctacgcgttatagatgaataa

SEQ ID NO: 2138 - DNA, 201 bp, Proteus mirabilis
agactaaaggttcatatcgcatctatgtttacatatctttgtactttaccaagcaaaccgcaaattcatctattaaaaatagtactcaattcatctaggttaagtgtagaacattattatgccaaagataggggtttgataaaatggcaaggttgccataataatgcaacccgccataataaaaagggaaaaagggactaa

SEQ ID NO: 2139 - DNA, 933 bp, Proteus mirabilis
tgggtttgggtttatcaggacgcgaatagcatacagtggaatgatattcatcactgggaaattaaggggagctacctcatggtgctgatgatagtcagcggacgctctggttcaggtaagtcagtcgctttgcgtgcgcttgaggacatgggattttattgtgttgataacttacctgtcgatctgttaccggagcttgcgaaaacactggctgagcgtgatgctgccgctgccgcagtcagtattgacgtacgtaatatgccagaatcaccggagattttcgaaaaggcgctggaaagtttacccgcggaatattctccacaactgttatttttagatgctgatagaaatacgctgatccgccgttatagtgatactcgacgcctacaccctctttcaacgaaaaacctctcgctagaaatggcgattgatacagagagtgatctgctcgaacctttacgatcacgggctgatctgattattgatacctcagagatgtcagtgcatgaattagccgaaatgctacgtacacgcttactcggtaaacgtgaacgcgaattgaccatggtatttgagtctttcggttttaaacatggtattcctatcgatgctgattatgtctttgatgtacgatttttacctaatccccactgggatcccaaattacgcccaatgacggggttagatcgtccagtcgcagccttcctcgatcgccataccgaagtgcataactttatttatcaaacaagaagttatctagaactttggctaccgatgttagagacgaataatcgtagttacctaactgttgctattggttgtactggcggcaaacatcgttctgtttacgtggctgaacaactggctgactatttccgctctagagggaaaaacgtacaatcacgccatagaacacttgaaaagcgcaaatga

SEQ ID NO: 2140 - DNA, 246 bp, Proteus mirabilis
aaaataagggtatatatgaacattaaagtcggcgatgagtttttggtttatatggcattgggtgaagagagctatatgaaggaatattatcgtgtgttggagttagatagcgcattatcacaagtgaccggtaaattgctaagaaggacgacggcagatgataaaaatattgggttagggcgttgtgaattagaaggtgggattgaacaatttgcgttagaagatatttatctaatagagaagtga

SEQ ID NO: 2141 - DNA, 276 bp, Proteus mirabilis
acacaaagggtccatccctacctttgtattcattacgcactttgctctttttttatgtttttttactcatggggtgccaataagctggaactgtatttattacatataggctctcatgaaaatttttattgctccctttattatttgtcgtgggcaaaaaaaagcccacagaggctgtgggcaaggaatgaaaataaaaagagggtatttggatcagatgtctatattaaagtctattatttgaagattttaaaacgagcgtcatcttcaatataa

SEQ ID NO: 2142 - DNA, 417 bp, Proteus mirabilis
ggcggtttatttataagagataacatcaggaaatcatggatgattattcctaaaagtacttatctagtcggacaatattatgagagaaaagcgttaaattacttgcgccaacaagggttaaagttaattgagcgtaatgtccgatatccctgtggagaaattgatcttattatgcagggtaatagaacatggatatttgttgaagtccgctttcggcgtagtgcacaatttggtgatgcaatcagctcagtgacctacagtaaacggcgccgcttatggtacgccgccaattgttggttagctcaacgccaacaaagtatcgagacggttaactgtcgctttgatatttgtgcatttgatcaacgccagttaatatggctaaaaaacattctcgatcatacggaatttattcgttaa

SEQ ID NO: 2143 - DNA, 2589 bp, Proteus mirabilis
atacaattattaccaccaccaccggaattttatattgcggggcgggctgtcgcatataaaaaacaaaaaacgaaaaagcccgcattgagaaatgcgggcttttttttggcgaaaaatcaggagagctgtatgcgagtgttaaaatttgggggaacttcagttgccaatgcagaaagggtgctgaatgttgctgatatcgctgagaaaaaacgagagcagggacaagtcgctctggtattatcagcacctgccaagataacgaattacttggtggcaatgattgaaaaaacggcagaaggagaagaacctctcactcaagtacgagaagcagagcaaatcttcgctaatctattgcaaggtttacgagaaaatcaacctggttttgattaccaaggtttaaaagacaaagttgagcgtgagtttgctgagattaaacatatcctgcatggtatctccctattagggcaatgtcctgatagcatcaatgctgcgatgatttgtcgtggtgaaaagctttcgattgccattatggagtcggtgttacaagctagaggatataacgttaccgtcattgatccggttaaaaatctccttgctcaaggtcattatctcgaatcgacagtggatattcctgaatcaactcgccgtatttccgcccttaatattccgaaagatcatatgatcttgatggcaggtttcactgccggtaatgaaaaaaatgagcttgtggttctcggtcgtaatggctcagattattcagccgccgtattagccgcgtgtttacgtgcacaatgttgtgaaatttggacggatgttgatggtgtttacacctgtgatccacgcctcgtcccagatgcacacctattaaaaggcatgtcctatcaagaggcgatggaactttcttactttggtgccaaagtccttcatccacgcactattgcacctattgctcaatttcaaatcccttgtttaattaaaaatacgggcaatccagaagcaccgggtacgttaataggtgatggtcaaaaagatgacagcacgccggtaaaagggatcactaacctgaataatatggcaatgatcaatgtatcagggccaggtatgaagggaatggtgggtatggcggctcgtgtcttttccgtgatgtcgcgagcaggaatatcggtagtattaattactcaatcttcatctgaatacagtattagtttttgtgtaccgcaaaaagagctaattagagcacaaaaagcactgtcagaagagttctatctagagttaaaagatggcgtacttgatccgttagatattatgaacaatgttgctatcatctcggttgttggtgatggtatgcgcacccttaaagggatctcagcccgtttcttctctgctttaactcgaggcaatattaatattgttgctattgctcaaggctcttctgaacgttctatctctgcagttattgccaatgatgcagcgacgaatgcggtgcgtttatgtcaccaaatgctctttaacactaaccaaatcgtagaagtctttattgtcggtgtcggtggtgttggcagcgcgctaatcgagcagatccatcgtcaacaagcatggttaaaaaacaaacatatcgacctacgtgtttgtgggattgccaattcacgtgcgatgctaaccaatatgcaaggtatcgatttagataattggcaacaagcgctacaagcagctaaagagccttttagctttagtcagcttattcgcttagaaaaagaataccacttcctcaatcctgtgattgttgattgcacttcaaacgaaatgattgcacagcaatacgccaatttcttacaaaatggctttaatgttgttacgcctaataagaaagccaatacgatgtcgatggattactatcatcaaattcgccaatcagcggaagcatcacgtcgtaaattcttatatgacactaatgttggtgcgggtttacctgttattgaaaacttacagaacttgcttaatgctggcgatgagttggtgcaatttaatggtattctttctggctcactctcttatatttttggtcagctagatgaaggaaaaagcttgtctgaagcgacactttctgcgaaagaaaaaggctttacagagccagatccaagagatgatctctcgggaatggatgttgcacgtaaactgcttattctcgctcgtgaagcgggctatcaattagagttgagtgatattgatgtagagcctgttttacctagctcatttgatagtacaggtgatgtcgagagtttcttaaaccgcttacctcaagtagatgttgagtttgatgctaaagtcgaagaagcccaaaagtcagcgaaggtattacgttatgtggggctcatcaatgaggggaaatgccaagttaaaataatggccgttgatgctaacgatcctctctttaaagtaaaaaatggtgaaaatgcgctagccttctacactcgctactatcaaccaattcctttagttttacgtggatatggtgcaggaaatgatgtcactgctgctggggtatttgcagatgtattacgtacactatcatggaaattaggagtttaa

SEQ ID NO: 2144 - DNA, 519 bp, Proteus mirabilis
atggagctatttatgggcaaacgtctattccctgttcttattgttgtggctgttttattttttgttctgtataaaggattagtacctgaaacgcagataccagcaacagcgcctcctacatcaacaacatctacatcgtcaaagagttcaatcagtcagcctgagtctcaacgtcctttagcaattgatgaaaagacacaagccaataaagtggctgattatttgcaacaacacgctcgcttacctgatttttatatcagcaaaaaagaggctcgagctaaaggttggaatgcgaaagcgggcaatttatgtgacgttttaccaggacgggcgattggtggtgatcgctttatgaaccgtgaaaaacagttacctgaagaagcagggcgtcaatggtttgaagcagatgtcaattatcaatgtggacatcgtggtagcgatcgcctgctatattctaatgatggattaatttatttaaccaccgatcattaccgtaccatgcaaagagttgcaccttaa

SEQ ID NO: 2145 - DNA, 627 bp, Proteus mirabilis
acgcttatatttatcaaggagataagcatgtctaacgcattcacagaattaatgaaaaaacgtagaacaatttatcatttaggtaatcaactgcctattagcgaagacagagttgctacgatcatcaaagaagcggttaaagaaagccctagcgcatttaactcacaaacttctcgtgttgttgttttatttggtgaacaacaccagaaattatggaatatcgttaaagatactctgaaaaaattagtccctgcggatgcatttagcgcaacagaagccaaaattaatagctttgctgccggtgcaggctccatcctttattttgaagatactgatatcgttaaagggcttcaagagcagttcccactgtatgctgaaaactttcctgtttggtcagagcaagccagtggtatggctcaactttctgtctggactgcccttgcggctgaaaatgtaggggcatcactgcaacactacaatccaattattgatgatgaagttcacgcaacttgggatattcctcgccattggaaattaagagcacaaatggtctttggctctatcgaacaagaagcaagtgagaaaaattatattgaagatgacgctcgttttaaaatcttcaaataa

SEQ ID NO: 2146 - DNA, 1083 bp, Proteus mirabilis
agaaacatattgccgcagcactattacattgtaaaagatatgtcgatgcaggacaggagaaatgcactaatgacgagtaagtcgggaaatcaacctcacacagatgaggcgcctgcaacgcttttggcagatacccatgatcaattaagccagcaatctattgatgaacaagctgcgctttggttcacccgtcaacatagtcagcaaatgagttcacagcaacgacaagcctttaaacagtgggtagcagataaagataatcaacaagcttatcaagctatcgcggaaatttggcatagttgtgaagccttaccacgccctactattgtgcctatagaaaaaaggaaatcttcactctggcgcccctttattcacactacagccgcactctgtttagttgctgtgttatatcttccttatagtcatttacctgccctgttaatggataatatgaccttagccaccagcaattttcctaaagagatgaccctcgcagatggctctaaagtttttttaaatagaaatacacaggtacgcgtctcgtatgtccaaacccaaagacgcctttggttagataaaggtgaggcttattttaaagtaaaacccaatccttatcggccattttatgtccatgctgatgagcgattaattaaagttgtcggtactgaatttgaagtgagtcgttatcaaaataatcaaattagtgtcgccgtacatgagggcattgttgaagttaaagccacagaaaaatcccctgcgacttacctatatgctggctctcaagcaattagccaatcaactgataatcaatttgtcatttcctcagtcaatgctgattctgtaggaagctggcgttttgggcaactccatttctttgaacaaccacttggtgacgtgatcactaaattaaaaccttatctggatatcaacgttcatatctcatcagccgatgtagcaaaaataaaggtatcaggtgtagcaaatattaatgacgcgaaaagctttattactgcacttccgctacttttaccggttaatgttatttttactgataaaaataatgtgttaattatcaataagtaa

SEQ ID NO: 2147 - DNA, 225 bp, Proteus mirabilis
gagcagatattaatgaatgataaaaataagctagcagccgcattattagctatttttcttggtgggctaggaatacataaattctatcttcgtaaagtaggaatggggattttatatctcattttttgctggacggggatacccgctattatcggttttattgaaggaatttattatctgtgtatttcagaccaaacctttaatgacaaatataaccgaaactaa

SEQ ID NO: 2148 - DNA, 1725 bp, Proteus mirabilis
aaaatagtattaataaaaataagaatagtatacatccttattttttataatacacaaacaaccatatatcctcatcaacaagaagttatttccgatattcttaatgaaattgcctatataacacaagcaaagtttgttgcatctaatccagaattcgatgccgatataaaatttggtttttacgatgattttcatattagtcatggttcaatagaattttcatataccaccagaggttttgcaacctatcctagcaggtattcaacccctataaaaaagataaatattgatgaacaataccaatactctggaactatatttttaaatttatcatcacaccaatattataagataatacatcaaaatgatcttgataattatataaaaacagaaggtaatattggtgatgctttcaattttaaagataatggtactgttctgataataaaaaaaaccaatactctaattgaaacactaaaaaataataaatatcagccaggtacatatcattataaagttgttttgcatgaagttggtcatgcactcgggctaagccatagttggcaatacttagaatataaagataaaaatcatgtattagcttcattgaaatattctgttatgggttatgatataccaacctcagagcatgctgattttggtggtctttatcccatgacctttatgctgctagatatattattattgcaacaactctatggcgaaaatatgaccacacgccttgaaaataatatctatggatttcattctaataccggacgtgtcgcttactccttaaaaagcatagaagataaattagtaagttgtatttgggattcggggggaattgatacattagacttttccctatataccgttaatcaagttattaacctaaatgaaggtagcttttcagatattggcgggttacggagtaatatctctattgcctacaaaacgattattgaaaatgctattggtggatcaggtcatgatactatcataggaaatagtgctaataatgaacttataggtggtgatggtaatgatactatcaagggtggtttgggtaatgatcacctctatggtggtatgggtaatgatattctctatggtgatataggcaatgattatctctatggaggtataggtgatgatattctccatggtggtatgggtaatgatattctccatggtagtatgggtaatgattacctctatggaaataaaggtaatgataaactctttggtggtgatggagatgatacccttgttgattattatggaaataatacattcattggcggtaaaggcaatgatctattattttcgatatcaaaagcaggacgaaatgaacttcaaggtggtgaagggaatgatatattttattgtggattaggtactaatctattatatggtgaacaaggaaatgatacttttaacttcttatgctataaaggcgctaaaagttataatttaatttttgattttaatacgaatgaagacaaaattatttttgttgatcaaaattataaaaaaatcgatatatcaaaaatgaaacgagtagaacaattatcaggaaatgaaaatgaaatagttttacataatgatattcatacaaataaaaccacaataactatttcaacagccaataacgaccatcattcgactatctttataaaacttgagggtatattaagttacaatgatcttttagatatataa

SEQ ID NO: 2149 - DNA, 549 bp, Proteus mirabilis
atttttccttttttctttcctttaacgaaacgtttcgatcaccttcacaatataaataaatccaacttgttttcctattttcatttcctactatgtagaacagcgaaacgtttcgctgaggaggcaaagatgaaaaaaggtgtattacttaatagttcaatttctagcgtaattgcacgtttaggacatactgacaaaataacgattgcagatgctggattacccataccctcctctgttgagcgtatcgatcttgctttaactcaggggatccctgactttatgtcagtgttacaaacgatcacccatgaaatgcaagtcgaagccgttatgcttgccatagaaattaaaaatataaacccacttctttttagtgagataacccgttatttgcatttattagaacaacaacaaaaaaaacctatcgagatcatttatgtcactcatgaagaatttaaaacacaacttccagataataaagcggtgataagaacaggtgaatgctctccttatgccaatatcgtgctgttttctggtgtgactttctga

SEQ ID NO: 2150 - DNA, 660 bp, Proteus mirabilis
ggcaggcaattaattttacttatcccgattttcctgtattggaagcggtgcctgtgcgtgatttttctactcttcttgtgggaggagacttttctaccacagcgacattgcgcatggaatatcagtgaggagataacgggaatgtttaataaacagaggatattctttttcataacgttactttcatcattttcattaatggctgatgagacggcaaataaggcgacaatcactaacagcgaaaataatttgagattatttggcacactatttattccccctccttgtgtgatccaaaacaatgacatgattgatgttaattttggtcaccaactgggaacgagtcgcatcgatggcattaattatacaaagaccgtcaattacacgttgcagtgtgaagaaaatgcaaaaggttgggcattaggtttatccattatcggctctgcaagccaatttgatgcggctgctttacaaaccaatataacggatttagccgtacatctcacgatagatagtgagccatttattttaaataaacggtttgttattacctctgataaaccgccgattattttagctgtgcctgtaaaaaaatcaggaagtaccttaacaaaaggtgcatttgaggcaacagcaacgctacttgctgaatatcaatag

SEQ ID NO: 2151 - DNA, 486 bp, Proteus mirabilis
atgaaaaaatttactcagattattgatcaacaaaaagcgcttgaactaacctctacagaaaagccaaagttaaccctttgtcttaccatggatgagcgcaccaaaagtcgcttaaaagtggctttaagtgacgggcaagaagccgggctatttttgcctcgaggcaccgtacttaaagagggggatattctgctgtcagaagagggcgatgttgtcaccattgaagcggctaaagagcaagtatcaacggtttatagtgacgatccattattgcttgctcgtgtttgttatcacttaggtaaccgacatgtaccattgcaaatagaagcgggttggtgtcgttattttcacgatcatgtattagatgatatggctcgcggcttaggggctacggtggtggttggcttagaaaaataccaacctgagccgggggcttatggtgggtcatccggtggtcatcaccaccaccatgatcaccaccattaa

SEQ ID NO: 2152 - DNA, 1377 bp, Proteus mirabilis
ctgcatttttcttacattggcaatatcagagaggatgttatgttaggtaaaaatttggcatcaataaataagacctatgatttttggcgtaaaaatttaatgttgtcgatgatcattggctatgccacgttttacctgactcgtaaaagcgtcaattttgtgatgcccgttatgcaaacggaactgcatctagataaaggtgatattggctggatagccagcctgttttatctcacttatggtctatcaaaatttctctctggtattttccatgaccaatacggctaccgttggtttatgggcgcaggtctggtaatgacaggggtgatgaatattatttttgcctactgtttatcctttcctgccttgcttttagtctgggcacttaatggtttctttcaaggatggggttggcccccttgtgcaaggttactcacccattggtattcacgtaatgaacgcggtttctggtggggattatggaatatctccatcaatcttggcgggatgagtattccccttttaaccgcttggttggcaacccattttagttggcaaatagccttagttattcccggcctaataggcattgttatggggttatggctttgtatgcaactaaaaggaacaccagcagaagaagggttacccacagtaggtgtatggcggcgcgatatttttgaattacgtcaagagcaagtatcgcctccgacccctatgttaaccattttgaaagaaagcatcttatttaaccgaatgatctggttactaggtttttcttatattttaatttatctcatccgtatggcgataaatgattggggaaatatttggttatcagaaacccatggcgctaacttgttaagtgctaatgccattctttctctttttgagatgggtggattgttaggcgcgttatgttcaggctggggctcggatttattattccgtggccaacgagcaccaatgatattgctgttttcactcgggctttttatcgcagtaacagcactttggctaatgccaattcatcattatgcattgcttgcagcctgttttttcagtatcggtttttttgtgtttggaccacagatgttaatcggacttgctgccacagaatattgtcataaaaacgcagcaggtacggtaacaggctacttgggattgtatgcctatttaggggctgcaatagcaggttggccattaagtcaggtcatggcgcattatggttggactgggatgtttgtattattaaccagtgctgcggccttaatgggactactactaatgccattgctgatcgctgatgtcagtaaacgtgagcatttagttggcccactttcattttccgatgacgacacatttaaaaggttctga

SEQ ID NO: 2153 - DNA, 924 bp, Proteus mirabilis
aagagattttcaatgaaaatagaattagccaaaagccttgaattaaatagaaatattacagcagaagaagctgataatttattttcaaaaaaaataataacatcaaaatatctttttgaatgtactgaacctgattgtcatgcccaagtaacttgtgccaatcttgataaaccaaaccgattacgaaaaagagttcctcattttaaatttgtttctgaacatagtgatacatgtaaaatagggatcaatgaagaaaatgaatttcgtagaataaaaaaaatgaaagaagatccagaggctcttccttttattctcgatgatattgttgagcttgatctctcaacaccttataaaactaaatttcatgatatcccttcatcaaaagaggaagatggcatcaacaaacgcttaaaaacaaaaaatattgatggcgaaaatagtaataaaacacgtcattcaaaaaagcgtttatcaggactcgttaatgattttatcgataaaaaaaatttctttctcaatattgcagaaggaaagatccatttaagagatttcttcatttatattaatgataaaaaagatctaagcgaatatgtagatgaacctcgaatatacttcggtaaagcttgggttaagcgtatagataattattaccttgtccgttttgataaaaaaatgaaaaaaggtgacttaatttgcaagccaacattttttatttctgaacgtcttgtaaataaatcagagtataaaagaacctctcggcaagaattagataaaatagcactatcaacaccgccaaaacctctttatttatttatatttagtgaattaccacctgtaaaaatgaataatggtgattttatcaatttcaaattagatgacttaacatacttatattacaaaacatggggtaaaaaaagtgaatga

SEQ ID NO: 2154 - DNA, 1296 bp, Proteus mirabilis
gtaatgaaattatataatttaaaagataaccaagaacaagtcagctttgctcaagcggttaaacaaggtttaggaaaacagcaaggactcttttttcccaaagacttgccttcattttctcaagcagaaattgatgcgctattaaaattagactttgcaacacgcagtagccgtattttaagtgcttttatcggtgatgaaattcctgctgatgtgttagcaaaacgtgtaaatacggcatttgcttttcctgcgccagtgacacaagtagaagaggatattagttgccttgaactcttccacggaccgacgctggcttttaaagactttggtggccgttttatggctcaaatgttatcagaagtcgcgggtgaccagcctgttacaattttaacggcgacatccggtgatacaggagcagcggtcgctcatgctttctacaagttagataatgtccaagtcgtgatcctctatccacaaggaaaaatcagcccattacaagaaaagctattttgcacattaggggagaatattcatactgttgctattcaagatgactttgatgcttgccaagcattagtcaaacaggcatttgatgatgaatatttaaagaacaccatgcatttaaactcggctaactcgattaatattagccgcctactggcacaaatctgctattactttgaagcggttgcacaaattccagctgaaaaacgtcaacaattagtcatttctgtaccaagtggtaattttggtgatctcactgcaggattactggctaaatctatgggattgcctgttaagcgttttattgcggcgaccaatgtgaatgataccgttcctcgctatttagatagtggtaaatgggaaccacatcggacaatagcaacactttcaaatgcgatggatgttagccagcctaataattggcctcgtattgaagagttatatcgtcgcaaaggttggctgttatcggatctttcgcatggggctgtgagcgatgaaacgacggaagaaactgtacgtgaactggcacaaaaaggctatatttcagagcctcatgcggcggttgcttatcgtctattacgtgatgagctacaagaaggagaatatggggtatttttaggtacagctcatccggcgaaatttaaagaaaatgtcgagcgtattttaggtgatacattacctttaccaaaagaattagctgagcgtgctgataaaaaattactatcgcatcttttaccggcagatttttctcaattaagagcatttttgttagaacgagcacctaaataa

SEQ ID NO: 2155 - DNA, 1155 bp, Proteus mirabilis
catatcctttcaaaagcgaaactgtgctattctcatgacacttacgacgctatcctcttattcaaacataaatacaggatttttatgttaagcaagctactgcgatctaccttgattggtgttttaacagctgccattcttttggttgcggtaccttctatccgccctatctttattgaacacctgattaatggtgattttcttaatgccccatttagctataacaaagccgtgcgccgtgcggcacctgcggtagttaatgtctacagcagcacaatgggaagcttttctcaagaagggcgcgagctgacctcgctaggtgcgggggtgattatggatccgcgaggctatattcttaccaatcagcacgttattaataatgcagatcaaattattgtggctttacaaaatggtgatctctatgaagggttattgattggctcagatcccttaaccgatcttgcagtgttaaaagttgatgcagaaaaattacccaccatccccatcaatagtaagcgtatttctcatgtgggtgatgttgttttagccattggtaacccatttaatattgggcaaacgatcacacaaggtattattagtgccacaggacgtgtcggcttaagcccaacacgttaccaaaacttccttcaaaccgatgcgtcaattaatgaaggaaattcagggggggcactgattaatactgaaggtgagttagtgggtattaataccatgacctttgattcaggcacctacaatggctatcgccccagtgcggaaggacttggctttgctattccaacacaattagccgtaaaaattatgaataagcttatccgtgatgggcgagttattcgtggttttattggtattaccgcgaaagaactacctaaaattcgctcttcaaataccgatattaaacagatccaaggattacgtatcttccgcattacgcccaatagtcctgctgataaagcgggaatgaaaattggcgatatcattttaagtatcgaccatgctccggccaaatcagctatggagatgatggactatattgcagaaacacgtcctggtaccgttttaccggtaaccttattacgtgatggtaatgaaataaatgttgatgtcacaatttcagaatatcagccagagtcatag

SEQ ID NO: 2156 - DNA, 201 bp, Proteus mirabilis
cagaatatttcaatgaagctaatacatgatttttatctttatattctaagtattgccaactatggcttagcccgagtgcatgaccaacttcatgcaaaacaactttataatgatatgtacctggctgatatttattattttttagtgtttcaattagagtattggttttttttattatcagaacagtaccattatctttaa

SEQ ID NO: 2157 - DNA, 522 bp, Proteus mirabilis
gactcggtttccctacggctcccctatgcggttaaccttgctacagaatataagtcgctgacccattatacaaaaggtacgcagtcaccccatcctcaaatgtcccgcttgcctttgcgttcaatcttgcccgattttttaacttccgttgctcgtgtacttctaggtacactgcgcgacggcttgaaaaaatcgaccaaccttgttagcaaattcggcgctattttcggtgatgttcttgcatcactcagtgcgaggcacttgagtgatggggctcctactgcttgtacgtacacggtttcaggttctttttcactcccctcgccggggttcttttcgcctttccctcacggtactggttcactatcggtcaatcaggagtatttagccttggaggatggtccccccatattcagacaggataacacgtgtcccgccctactcgtcgagttcacaataacagcatcttcagatacggggctatcaccctttactgccggactttccagaccgttctcctga

SEQ ID NO: 2158 - DNA, 1725 bp, Proteus mirabilis
cacggcccttcggttgcaggtctgcagcgttcggtcggtaatggtgctatgagcaactcaatcgttgagattgaggataccaaatgtctatttgtcttcggttataatgccgcagactcgcatcctattgtcgctcgccgtattgtgaaggcgaaagaaaagggtgccaaaattattgtatgtgatccacgctatatcgaaacagctcgcttggctgatttacacttagcattgaaaaatggttctaatattgcactgctaaatgctattgccaatgtgatcatagaggaaaaattatacgataaatcctttattgaaaatcataccgagcaatttgatgagtattgccaattagtcgcaagttacacccctgagtcggtagaaaaaacaacggggttaagtgcacaaattatccgtgaagcagcgcgtatgtatgccaaagcggaaacggcgacaatcttgtggggaatgggggtaacacagttctatcaaggggttgaaaccgttcgttcactcactagcttagcattattaaccggtaatcttggtaagaaatatgttggggtaggtcctgttcgtggtcaaaataacgtacagggtgcttgcgatatgggagcactacctaatacgctaccaggctatcagtatgttactgatgcgaaagcgcgtgaaaaatttgccaaagcttggggcattgaatcgatgcctgaagaagtaggctatgcgcttagtgaagtacctcataatatcgaccatggtttaattaaagcacactatgtgatgggggaagatccactacaaactgagccagatttagccactattcgtagaacttttgaaaaactcgatttactgatagtacaagatatctttatgaccaaaacagcatcgattgctgatgttgttttccctgccacatcatggggtgaacatgaaggggtgtacacatcagcagaccgtggattccagcgtttctataaagcggtagagcctgttggtgatgttaaaacagactggcaaataatcagcttaatggcaacagcaatgggttatccaatgcattacaacaacaccaaagaaatttgggatgagttgcgtgagttatgcccgatttattatggtgcaacttacgaaaaaatggctgatttggcgtatattcaatggccttgcccaacagaagatagcccaggtacacaatatctttatgaaggcggtaagttcgatactcctaatggtaaaggtcaattctatacttgtgaatgggcgccacctattgatcaactctctgatgagttcccaatggtattggcaacggttcgtgaagttggacattactcttgtcgttcaatgacaggtaactgtaaagcattagctgcattggctgatgaacccggttatgttcaattaaacactgaagatgccaaacagttaggaattaaagatcaagagttggtttggatacgctctcgacaaggtaaggttattactcgtgctgcggtcagtgatagaccaaataaaggtgcggtatatatgacttaccaatggtggattggggcttgtaacgaactagttgcagaaaacttaagtccaataaccaaaacacctgagtataaatattgtgcggtttgtgttgagtcaattaaagatcaagctcaagcggagcactatgtaaaaacagaatataacaatattaaacgtcgtttaagagaagccgctgaaggctaa

SEQ ID NO: 2159 - DNA, 357 bp, Proteus mirabilis
cagataacttctttttttgattgttatgttataaggactgagatgatccgtgatgatattgagaataagctgatttcacgcttttctccccattttttgcaagtcattaacgaaagccatcgtcataatgtacctgcaggctcggagagccattttaaagtcgttattgtgagtgacttatttaatgataaacgcagtgtgtcacgtcatcgtgatgtttatcaaacgttatctcatgaattagataatggcgttcatgctttagctctgcacacttttaccttgagcgagtgggatgaacaacaagataaagcattacactctccaggatgtcgtggtggaagccaacaagattaa

SEQ ID NO: 2160 - DNA, 795 bp, Proteus mirabilis
tcattcgcttcacacgactatttgaaaataacgataaataataaatctatgatgacaattaacaacagcaacaatcttacgggcaatgagccggctaatgatgaaacctatatgcgtcgagcgatagagttagctgcattaggacgttttacaacatcacctaacccaaatgtgggatgcgtgattgtgaaagaagggaagattataggtgaaggttatcaccatcatgcaggtggtccacatgccgaagtgaatgcattaaatatggcgggtgaaaatgccaaaggtgctactgtctatgttacgcttgagccatgtagccactttggtaaaacgcctccttgtgctgatgctttaatcaacgccggggtaaaacgtgttgttgctgcaatgcaagatcccaatcctcaagtggcaggacgtggtttacataaattagtcgctgcaggtattgatgtttctcatggcgtattaatgcaagaagctgaaaaattgaatatcggcttttttaaacgtatgagaacagggtttccttatatccaattaaaactggccgcctctttagacggtaaaacggcattagcatcaggggaaagtcaatggataacctctaaagcttcgcgacaagatgtgcaaaactttcgcgcgcaagctagtgctattttaacaacgagtgccactgttttagccgatgatcctgcaatgaatgtgcgttgggaagcattatccgatgagataaaagcgatttatccactagagtcattacggccagcctattcgcattattaccgatag

SEQ ID NO: 2161 - DNA, 615 bp, Proteus mirabilis
atgagccattcaattaggaataatccaatcctaaatgaattaattattttagatgtcttcatcctttatatttcaggaaacaaaaagatgaaattaaataaattagctttagttcttggtttaggtttatctgttgttgcgggttctgctttagctgcagatcaaggtcatggtactgttaaatttgttggttcaatcattgatgctccttgctcaattactcctgatactgaaaatcaaacagttccactaggtcaaatttctactgctgcattaaaagatggtggccgtagtaattctcgtgactttaaaatctctttagaaaattgtactacagagacttacaaaactgttcaaacaactttcactggctctgaagcaactgaagttttagaaggttctttaggcattgaaggtatcgctaaaaatgcagctgttgttatcaccgatgcgggtggtaaacaaatcaaattaggcaccccaagtgctgctcaaaacctgcgtgatggtaacaatgatctgaactttgctgcttatttacaaggttctgcatctgaagctgctgttccaggtgactttactgcaatcgcaactttcgcactgacttatcagtaa

SEQ ID NO: 2162 - DNA, 222 bp, Proteus mirabilis
tataaaaattcggagtccaaaataatggcttttaaatataaaataacaataatcatatttttgctatcttttattttttttgtagtgtatgagttttttattcccgttaaagtcatggaggtacataaagatacgtataccacctctattctggttgaggattttccgataactgattatggaaaaataatatggtggaaaaaacaatcaagatgtttttag

SEQ ID NO: 2163 - DNA, 507 bp, Proteus mirabilis
tataaaaattcggagtccaaaataatggcttttaaatataaaataacaataatcatatttttgctatcttttattttttttgtagtgtatgagttttttattcccgttaaagttatgggagtacataaagatacgtataccacctctattctggttgaggattttccgataactgattatggaaaaataatatggtggaaaaataatcaagatgttttagataaaaagtataatttatttaaagctaaagatagctccttctatatttatatatggaattatggtgatggatatttagaagaaggaaaatacgatcgattatgttttactgaaattaaaagtaacaaaaaatgtatagaaaaagataaagtgatgtcaataatgtattctttaaatgaagaggaaattaggatcggtaattctgcatatattaaagataaaaatggttcttttataaagaaagacaaggatgctaatacaactatcacagtagtccctaatgcataa

SEQ ID NO: 2164 - DNA, 1050 bp, Proteus mirabilis
atgaggtcgactttcatgaatgaacctatttcattgcaatcatttaatacatttggtttgaaagccaatgctcgtcatatagaaacggcaaagaatacagatgaactctgtcggtactggcaaaatgctcaagaccaaaaactgcctattcttattttaggcggagggagtaatgttttattcattgaagattttaacggtacggtgattagaaactgtatttctggcattgaaattacagaagatgagcaacaatggcatattcatgttggggcaggtgaaaattggcataaccttataaagagcttaattgaaaagcatatttatgggttagaaaatctcgctttaatccctggtaatgttgggtctgctcccatacaaaatattggtgcttatggtaaagaattaaaagacgtttgcgcctatgttgatattgttgagttaagcactggtaaagtcacgcgtttaacaaatgaagagtgccaatttggctatcgcgacagtatttttaaacatcactatcagcaaggttatgcaattattgcggttggtttagtgctgaataaacattgggaacctattttgacctatggtgatttagctaaattatcaccagaaacagtcacaccacagatagtattcgaatctgtatgcggtatgaggacaagtaaattgccggatcctgctcttacaggtaatgcgggtagtttttttaaaaatcctattgttgatataaaacttgcacaacgcttaaaaagtaaatatccattttgccctcaatatgtacaacataatggtgtaaaacttgctgcaggctggcttattgatcaatgtggtttgaaaggttatcagagcggtggcgctgctgtgcatacaaaacaggcattggtattaattaataaagaaggcaaggcaagtgggcacgatattgttaatttagcaagttatattcgccaaaaggtatttgaacgttttggagtgcaattagagccggaagtgcgttttattggacggcatggagagattaatgcggtggatgctatttcatga

SEQ ID NO: 2165 - DNA, 1173 bp, Proteus mirabilis
aagaattatttttacgcttttattctacgcttatttttattttttatgactattttttgtactttttttacaaatttattcagttcgcgtcaaaaaaagcagaaaaaaagtaaaaaatctctacgcctctgccacatcactcgttatgatgctgtttattttttatcggatacgggtgttttaaacagcctgtccaacctgcgaatactaggcagatgttggcttatgaataacaaagaacgctttacaaccccttatttagaatttgatagaaagcagtgggctacgttaaggaattcggtccccttaacattaacagaaacagaaattgccgaccttaaaggcattaatgaagaaatctcaattgatgatgtcattgaaatttatcttccattatcaaggttgttaaatttctatatcagttcaaatttacgtcgtcaggctgtcttagaacagtttctaggcacaaataacgccaaaattccttatatcattggtatagcgggtagcgtagcggtgggtaaaagtacgactgcccgtttacttcaagctttgctaactcgttggcctgaacatcggaaagtggatttgattaccactgatggatttttattacctaatgcggaattaaaaaaacgcggaataatgaagaaaaaagggtttcctgaatcctatgatatgcatagtcttgtctcttttgtctctgatattaaatcgggcaaaaagcaagtgactgcacctgtctattctcatttagtgtatgacattattccagacaaaaaacaggtcattgagcaacccgatattttgatccttgaaggactcaatgtattacagagtaatcaagactaccctcatgatccacataatgtttttgtatcagattatgtcgacttttccatttatgttgatgcagatgaagcattattgaaacactggtatatcagccgatttttaaaattccgtgaaggggcatttaccgatcccgaatcctatttcaataattattccaaactgagtcgcgaagaatctattgagatcgcgtcttccatttggcaagaaattaatggcttaaacctaaagcaaaatattttaccaacccgtgaaagagccagtttgattatgactaagggtgataaccattcggttaaaagcgttaggttacgtaaataa

SEQ ID NO: 2166 - DNA, 216 bp, Proteus mirabilis
aaagatacctatattattctaggtatgatgattattaagaataaagaaaaacaaatgcaaaaaagccaacccattgggttggctttctcgtcttatttaatgcttagcagttccctactctcacatggggagaccccacactaccatcggcgctacggcgtttcacttctgagttcggcatgggatcaggtgggaccaccgcgctatggccgctaa

SEQ ID NO: 2167 - DNA, 222 bp, Proteus mirabilis
ttttttaggaaaaaaacgaccaaaatgacagcaaaaaaatcaaagaaaatccaacgcaatattctctctgcaatcctagatttatcactaaacagtaaaattcacctaaaagaattatttttacgcttttattctacgcttatttttattttttatgactattttttgtactttttttacaaatttattcagttcgcgtcaaaaaaagcagaaaaaaagtaa

SEQ ID NO: 2168 - DNA, 981 bp, Proteus mirabilis
tgcggtggatgctatttcatgaaagagacatcaactcctctattactcatcaatatccttgctgatggagagatccattcaggagaacaattaggcgaaagtttggggatgacacgggcagggattaataagcatatcaagacattgcgtagctggggtatcgacattcatacagtggcaggtcagggttatcagctagatgcaccgatgaacctgctaaacagtgaacgtgtcaatcgtggcattcaaggtgcaccagctcgtgtgataccggttattgattcaactaaccagtatatgatacagcgtattagtgaattaacctccggtgatgtttgtattgctgaatatcaatctgcagggcgtggacgcagagggcggcaatggatctctccttttggccgtaatctatatctcagtatgtattggaaattggatcaaggacctgctgccgcaatcgggctaagtttagttgttggtgtgatccttgctgaagttttacagcaatttggtgcgaatggtgtcaaagttaaatggccaaacgatctttacttaaatgataaaaaattatctgggatcttggttgaattaacgggaaaaacaggtgatgttgcgcatattgttactggcattggtattaatatcgccatgagtaacaatcaaaaagatgcaataaaccaacaatggattaatttagagcaggtagggataaaaatagataggaatcagttggcttgtgaaatcaccaatgcgctaagaaaagcatttgtacaatttgaaaaacaggggttatctgcttttattgaacgttggaaaagtttagataattttattgataggcgtgttaaattaattattggtgacaaagagatctttggtatcgctaaaggtattaatgagcaaggggcgttacttttagaacaaaataataaaatagtaccctatattggtggtgagatctcgctacgaagtgcaccataa

SEQ ID NO: 2169 - DNA, 273 bp, Proteus mirabilis
aaacacttaagtaaggaattaatggtggtgggagaaggattcgaaccttcgaagtctgtgacggcagatttacagtctgctccctttggccgcttgggtatcccaccaaatctaaattttaaatggtgccggcaccaagagtcgaactcgggacctactgattacaagtcagttgctctaccaactgagctatgccggctaagtggtgcgcattctaggaggactttcgccatgatgcaacaaaaaaattgcgatatttgttcttttgcttag

SEQ ID NO: 2170 - DNA, 471 bp, Proteus mirabilis; identical to SEQ ID NO: 1406

SEQ ID NO: 2171 - DNA, 522 bp, Proteus mirabilis
gactcggtttccctacggctcccctatacggttaaccttgctacagaatataagtcgctgacccattatacaaaaggtacgcagtcaccccatcctcaaatgtcccgcttgcctttgcgttcaatcttgcccgattttttaacttccgttgctcgtgtacttctaggtacactgcgcgacggcttgaaaaaatcgaccaaccttgttagcaaattcggcgctattttcggtgatgttcttgcatcactcagtgcgaggcacttgagtgatggggctcctactgcttgtacgtacacggtttcaggttctttttcactcccctcgccggggttcttttcgcctttccctcacggtactggttcactatcggtcaatcaggagtatttagccttggaggatggtccccccatattcagacaggataacacgtgtcccgccctactcgtcgagttcacaataacagcatcttcagatacggggctatcaccctttactgccggactttccagaccgttctcctga

SEQ ID NO: 2172 - DNA, 1155 bp, Proteus mirabilis
gttccgtttttaatggttaaaacatcttttatttatgggctggcctttgccagcctatttatttcacacacagcgaatgcccaactctttcctgatagacaacaaatcgaccaatggttaaatcaactaggagggagcaataattttgatcgcagtaaaaccatcgactggggcgttttacccgggcctttctatacccctgaattagagttggggcttgggatcgccgttgttgggctttatcaagcagatagtcgtcccgacagtaaaatttcatcactgtcattaagtggctttggttcatcaaccggggcttttggtatgacttttagtaactatacttaccttgctgatgatacatggcgcttttaccttactggggcattaaataatgtgccgaccaacttttggggacaaggctatcatgaaggacgagttaaaaagaactttgcacaatatcgttcacaagagctacatttaacgccgacattgctacgtcaaattaccaaaaacacctatattggcttaggttgggattacgctaacttacaagcagcagcacctgatgatgagtttaaagcctatatgagcaaacgtcatttgccattacgctctaccagttcaggattaagtgtgcgctttacctacgacagtcgcgattttttgcctaacgctcgccaaggccaagcctttgatattagctatactcattattcatcggataccggtagtaataaccgttttaatgcaacccaaatgcagtacaactattattatccattaaccgaagatgcggtactcgcctttgatagctatgctcgctttacctcaggagatgtaccatggacgcaactgtctaaattaagcaacggccatcagatgcgtggctattatgaagggcgttatcaagataatcatgttttttctagtcagatagagtatcggcaaaaactcaattggcgtcatggtattgcattatgggccggaggtggcacattgagtaatcaagcacgtgatctcggtaaaggacattggctacccagtgttggtattggttatcgttttgaatttaaaccacgcatgaatgtacgcctcgattttggtgtcggtaaagagagcacgggattttatttccaagtgggtgaggcattttga

SEQ ID NO: 2173 - DNA, 1932 bp, Proteus mirabilis
acagtattctcaaacagtgaaccgcagattaaaacaatgactcaatcaagttataatgcaaaggatattgaggttcttaatggtctagagcctgtacgtcggcgtcctggtatgtataccgataccactagaccgaaccatttggcacaggaagtgatagataatagcgtggacgaggcgcttgcggggcatgcaaccaaggtcgaagttatcttatatgcagaccaatctattgaggttatcgacaatgggcgaggaatgccggttgatatccatccagaactgaaagtctctgctattgagctgatccttgcccatcttcatgccggaggaaaattctccaataaaaactaccaatactctggtggcttgcatggtgtcgggatctcagtggttaatgcgttatcaaagcgtattgaagtcaccgtgcgccgagaaggcaaaatatatcaaattgcttttgagaacggtgataaagttgaagagctacatcaaataggtacgtgtgctaaacgagatacaggaaccagtgttcatttctggccggatagcacttactttgatattcctcgtttctcatcaaaaagcttatctcatgtattaaaagccaaagcggtgttgtgcccaggcgtcaatgtctcttttaccgataaagtcaataatacccaagaaacgtggtgttacgctgatggtttaacagactatttaagtgaagctgtcgctgaatttgttcgcctacctgaagagccatttacagggaaatttgaaggtgataacgaagccgttgaatggtcaatgctttggttgccggaaggaggcgatttactcacagaaagttatgtgaacctcattccaaccgtacaaggaggtacacacgttaatggtttgcgccaaggtgtattagatgccatgcgcgagttttgtgaattccataatttattgccaagaggcattaaattaaccgcagatgatacatgggagcgttgtgcttatgtgttatcagtaaaaatgcaagatcctcaatttgcaggacaaaccaaagagcgtctatcgtcacgtcaaaccagtgcctttgttgctagtgcagtaaaaaatgcatttagtttatggttaaaccaaaacgttcaagtcggtgaattactcgcagaaatggctattagcagtgcgcaacgacgtatgcgtgcggctaaaaaagtggtgagaaaaaaactgacttcggggcctgcattgccgggtaaattagcagattgtacttcgcaagatttacgttataccgaactcttcttagttgaaggggactctgcggggggctctgctaaacaagctcgcgatcgtgaatatcaagcgattatgcctctacgtggtaaaattcttaatacttgggaagtctcttctgatgaagtattagcgtcacaagaagtgcatgatatttctgtggcgatcgggatggatcctgatagtgatgatttaagccaattacgttacggaaaaatttgtatccttgcggatgcggactccgatggtttacatatcgccactttgctttgtgctttatttgttcgtcatttcccggcattagtaaagcaaggtcatgtctatatggctatgccacctctttatcgtatcgatttaggtaaagaagtgagttatgcccttgatgaagcagaaaagaacgctattttgcaacgccttagccgtaaaaaaggtaagccaaatgtgcaacgctttaaaggcttaggtgagatgaatccactgcaattacgtgagacaacgcttgatcctaatacacgtcgtttagtgcaattggtgattgatgatgaaaattatcaagaaacgttgggcatgatggatatgttacttgccaaaaaacgttctgaagatcgccgtaactggttgcaagaaaaaggcgacgaagttgacatcgaagtgtaa

SEQ ID NO: 2174 - DNA, 327 bp, Proteus mirabilis
acaatgacctcagaacaacacattttagcaagactgttattaattgaagaagagatgaaaaacatagggttatggcaattggatgcgcctaatgatgaggcttttgcaagctcagagcctttttgtattgatacaatggaggcgcatgaatggttgcaatgggttctgatccctcgtttatcttctcttattgacagtggtatggcattgccgacggcttttgctatcgcaccttattatgaagaagcatttaaggacgatgagacgcgtgattatgtggatttactcaatcaccttcgtgaacttgatgcgttatttaagcaataa

SEQ ID NO: 2175 - DNA, 822 bp, Proteus mirabilis
atcaatcgattagtaaaatatttaacgcattgttatttcgcaaatggtagtctattcacaataatgaataaaaggcagattacccctatattctatcagttaagactgttctcattctggtttactatttgcttacgcaaactttactctttagtatcagtaaaaatattctcttgtatagataaaaaagttgaaaacataatgcgaaaattacctttactttttctttccttacttggcttaggcgtttctctgagctcacacgcagaaactcgttatgtttccgatgaattatccacctatgttcacagtggccctggtaatcaataccgtattgttggctcattaagttcaggggcaacagttacggtactttctcgtaatgccgctacaggttatgtgcaaatcaaagacgataaagatcggacagtttggttaccagaaaatcaattaagtacacaaccgagtatgcgcactcgcattccggctatggaaaaagagatccaaaccctacgcgataaattagcgaatatcgaccaaagctggaaccagcgcacaattgacatgcaaaataaagtgtcaaacagcgatgaaattatcaatggtttgaaaaaagaaaatgagcagatgagaacaaaattagcggttgctgagaaaaaactcgattttgctaatcaacaattagatgataggcagcgtgatatcatcctacagtggtttatgtatggtggtggtgttgccggtgctggtcttattttgggtttaatattgccacatattattcctcgtcgccgtaagcgtaatgaccgttggatgaattaa

SEQ ID NO: 2176 - DNA, 759 bp, Proteus mirabilis
gtgaacttatccagtgacgattcatccgcatcaaaaccaaagcatgttgccatcattatggatggcaacggacgttgggcaaaaaaacaagggaaactccgagttacgggccatcgcgcgggaattaaagcagttcgagatgcggttagcttttccgtcaaacataaaattgaatcactaacgttatatgcatttagcagcgaaaactggaatcgccctgaacaagaggtgagttctttgatggagttgtttgtttttgcattagataatgaagtgaaaagcctacacaaacacaatgtcagattaacaattatcggtgatatcagccgctttagtcgtcgtttacaagatagaataaaaaactctgttgcactgactgcaaataataccggactcaatttaaatattgctgccaattacggtggacgatgggatattacacaaagtgtacaacaattagcgagttccctcgcaaaaggggagttagctatcgaagatattaatgaaaatgcgatatcctcacacttgtgtttacatgatcaatcgcctgtagatcttgtgatccgtacaggtggagaacatcgtataagtaatttccttatctggcaaattgcttatgctgagttatattttacacaggttttatggcctgattttgatgaacaagtttttcagaatgcacttgatgcttttgctaaacgggaaagacgtttcggtggtactacatcggaaacagatactgtaaatctgggaggataa

SEQ ID NO: 2177 - DNA, 594 bp, Proteus mirabilis
gcgcaaatatctaaaaggagtaatgctgtgagcaaggggatttctgcgatttttttagatcgcgatggaacgattaatatcgatcatggttatgtatctgaaattgataactttgaatttatcgaaggtgtgattgaagcaatggctgaattaaaagccatgggatatgctttagtactagtgactaatcagtcaggtattggtcgagggtattatagtgaagatcagtttttacatttaactgaatggatggattggtctttagctgatcgaggcgtcgatttagacggcatttattattgcccacatcatccagatgcaattatagaagaatacaaaaaagaatgtgactgtcgtaaacctgcaacaggtatgtttatggatgcgaaagcacaattaaacatcgatatggcatcttcttatatggtgggagataaaaaagaagatatgttggcagcaaaagcggctggcgttgggcataaaattctcgttcgcacaggaaaagcgattacagaagaggccgaaacttgtgcagattttgttctagatagcttagccgacttgccaaaatggcttaaaagccacaaaaaatag

SEQ ID NO: 2178 - DNA, 1248 bp, Proteus mirabilis
atcatgggatcttttgattatatcaaacaggcaataaaaaagaatggctataccttacagcaagttgccgatgaaagtcagatgacaaagggctatcttagccagcttattaataacaaaatcaaaagccccagtgcacaaaaaatgtccgcattacaccaatttttgggattagaatatccattacaacagaaaaccattggggtgatttttggtaaattctatcctcttcatactgggcatatttatttaattcaacgagcttgtagtcaagtggatgaattgcatgtcattttatgtcatgacgaacctcgtgataaagagctatttatcaatagtgcgatgtcacaacagccgacggtaagtgataggttgcgctggttattacaaacgtttaagtatcagaaaaatattcgtattcatgagtttaacgaacatggtatagagcctcaacctcatggttgggaaatgtggagtgagggtatcaaagcttttctacaagaaaaacaaatcgcgccggattttatctataccagtgaacgagaggacgctagtcaatatgaagcatttttaggtattgaaacggtactggtcgatcctgagcgctcatttatgaatattagcggtagtcaaatccgtcaagcgccatttaaatattgggaatatattcctaccgaagtaaaaccttttttcgtgcgtacagtggctatattaggtggtgaatcgagtggcaaatcgaccttagtaaataagcttgccaatatttttaatacaaccagtgcgtgggaatatggtcgtgattatgtcttctctcatttaggaggagacgaaatggcattgcagtactctgattatgataaaatcgctttaggtcatgcccaatatattgattttgcagttaaatatgctaataaagtcgcatttatcgatacagattttgtaacaacacaggctttttgtttacgctatgaaggaaaagaacatccttttgtacaggcattgattgatgaatatcgttttgatttagttattctgctagagaacaatacgccatgggttgccgatggtttacgtagtttagggagtgataaagagcgccgtcgttttcaaacattgttgatagagatgttagataaaaacaatattgaatatatcaaagtagatccttctgattatgatgagcgttttcttcgttgtgtcgaattagtcagggaattgttgatgatgcaatcaaagcatatcgaataa

SEQ ID NO: 2179 - DNA, 1359 bp, Proteus mirabilis
atgaatatgtcatcgcgcaaaatgcggaaaacacataatgggaaacttatgaaaaattggaaaacgctggttatcggcttaatgatcacggttggtgcagccaccagcacaaccacttttgcagcacaagaactcaaccgcgtatcggctatcgtcaataacggtgtcgttctggaaagcgacgtcaatagaatgttacaaacggtacaaatgaatgccaaaaatgccgggcaagaaatgcctgatgagcaagttttgcgccaacaaatcttagagcgcttggtgatggataacatcatcttgcaaatggctcaacagatgcaaattgatattcctgaagctgccgttgagtcaaccattcaagggattgccgcagaaaacaacctgacactagagcagttaaaaaaacgtcttgctgccgatgggattgcctataacgattatcgtcaagatattcgtaaagagatgatgttagcagaagtgcgtaataacgaagttcgtcgtcgtattacgattttgccacaagaagtggactcattagctaaacaaattgaaagccaagcaagccaaagtattgatcttaatcttagccatatcttaattccattatcagaaaatccatcacctgcagaaattgaaaaagcacagcaagtggtgaaccgtattaagaaccagctaaaaaacggtgctgatttcggaaaattagctgccacttattctgccgatccacaagcacttaatggtggtaatatgggatgggcatcaattgatgagttaccgacaatctttgctaaacagcttgctaatgcacaaaaaggtgaaattgtcgggccactgcaatcaggtgttggtctacatattattaaagtcaatgatatacgtggtgcttcaaaaaccgtttctgtgactgaagtaaaagcacgccatatcttactaaaaagctcgcctatcatgaatgatgagcaggcttatgccaaactacagaaaatttccgccgatattcgtagcggtaaaatcagttttgcggatgcggctaaagagtattctgaagatcccggttcagcattacgtggcggtgagttaggatggtcaatgcctgatatttatgatccagctttccgtgacgcgttgatgcgtttaaacaaaaatgaattaagccaacctgtgcgctctaattttggctggcacttaattgaacttgaagatacgcgtagcgttgataaaacagatgcagcgaataaagaacaagcttaccgcttactgtttaaccgcaagtttaatgaagaagtgcaaaactggatgcaagagttgcgtgcaggcgcttatgtgaaaataatgaacgagaataatgcaaactaa

SEQ ID NO: 2180 - DNA, 267 bp, Proteus mirabilis
gggaatatgtcaacaaatacagaatatcaaccaattaattgtgatgattatgaatatttggagttagcttgccaacgaggcttaacactccatattgaattacataatggtgagcaaattgatggtgtcgcagatgatctctttttaagtaaaaaagttgaatatctgaaagtaaaaacatctgagggtgcaaaagatttacgactggatattattgccagtttttctcatcccgaacttggcactatcataatcaaatctgaataa

SEQ ID NO: 2181 - DNA, 183 bp, Proteus mirabilis
tatttttttttctacctcttaaaaaagataacatttagtcactccacaattattttattttcaaatgtatttgataatccaccaaaatcatcaatatattgccaactaacctgtttaattgatttatctatagctaaattgagtgacgaaaatggcgcaaccataggtgcatttgctgattga

SEQ ID NO: 2182 - DNA, 795 bp, Proteus mirabilis
gcaataaggtcaatgatgctagatattatttatcaagatgaatatcttgtggcggtgaataaaccggcgggatggcttgttcaccgcagttggcttgataggcatgaaaccgtgtttgtgatgcagacattaagagatcaaattggtcagcatgtttttcctgttcatcgtttagatagacccacatccggagtgctattaatggcgctctcttccgaggttgcaagaacactttcagtctgttttgaacaacatcaaatggagaaagtgtatcatgcggttgtgcgtggctatgttgaagagccaatgataattgatagcccacttgttgaagagcatgacaaaatcgctgacaaatttgcctctcacccccctaaaattcaacactgtattacgcattgtgtgccacttgcaaaagtggaaaaagaagtggcgatagggcgctatccaacatcacgttttagcttattggaattacgtcctgaaacggggcgtaaacatcaattgcgccgtcatatgtctcatattcgtcaccctattattggggatacagcccatggcgatttacgacaaaatcgtggggtcgtaaatcattttcaatcacatcgtttgatgttacacgcaagtcagctaaacttaattcatccgatcactcaacagccacttaacttaacagcgaagtgggatctgccatggcaacatctgattaatcagtttggctggcgtggtctaaagcccgaattagagcaattcggtgaggatttagctcaccattttgtactttctgatatttga

SEQ ID NO: 2183 - DNA, 219 bp, Proteus mirabilis; identical to SEQ ID NO: 887

SEQ ID NO: 2184 - DNA, 1272 bp, Proteus mirabilis
gtgacatatccgtggtctacggaaaatgacacaggagagagaattatgaaacgtgtacatatcatggtattagattcctttggtatcggtgctgctggtgatgcggagaaattcggtgaccaaggcgcagacactttaggacatatcgcacaagcatttgcagaaggtaaagcggataaagatggtcgtaaaggtcctcttcacctacctaatctttgccgtttaggtttaggtaaagcggctgaagaatcaacaggtaaattccctgttggtttagacaaagatgcggaaattattggtgcttatggctacgcgagtgagatctcttctggtaaagatacaccgtcaggccactgggaaatcgcgggtgtcccagtattatttgattggggatactttaaagatttgaaaaactctttccctcaagagttgctagacaacattgttaaacgtgccaatttgccgggttatttaggtaactgtcacgcttctggtacggttattctggatgaactgggtgaagagcatatgaaaactgggaaacctattttctatacttctgctgactccgttttccaaattgcttgtcatgaagagaccttcggtttagataaattatatgagctatgtgaaattgctcgtgatgaactaaacaaaggtgattacaacatcggtcgtgtcattgctcgtccatttattggcgacaaaccaggtaatttctcacgtacaggtaatcgtcatgatttagctgttgagccaccagcaccaactatgttgaaaaaactggttgatgaaaaacaaggccacgttgtctctatcggtaaaattgctgatatctatgcaaatgtaggtattactaagaaagtgaaagcaacaggtattgatgctctgtttgatgcaacgattgaagagatgaaattagcaggtgataatactatcgttttcactaactttgttgatttcgactcatcttatggtcaccgtcgtgatgttgtcggttatggtgaagcactcgaattattcgaccgtcgcttacctgagctgatggaattagtgaaagaagatgatattttgatcctaaccgcagaccatggttgtgacccaacttggcaaggttcagatcacacccgtgaacacattccggttctggtttatgggccaaaagttaaaccaggttcattaggtcaccgtgaaacttttgctgatatcggacaaactgttgtgaaatacttcggtttatcaccagtagaatacggtaaagcaatgttttaa

SEQ ID NO: 2185 - DNA, 696 bp, Proteus mirabilis
tttggtgatccactctcatcgatattcatcacgatattggctgcgttctccaataactcactgactggcttaggaatatgtgttcccattaacaacataagcgcaatcaaaatgatcatcggtagtgtggttaacagacctaattcacctttggcaaccacatccggttttggaccaaataccgttttagctaccatacgaactaatccacctaatactacggttaataacaataataatagaattgttaatcccatatgcttagctgctaagcctgcaacaacaatcataaattcactgataaagacattaaatggtggcatgccccctaatgccaaagcaccgccagcaaataatgcagcacttaatggcattactttaaacatacctttcacgacatttagatcccgtgtaccgtatttcagtaacacgttaccagagccgcagaacagcaatgcttttgctaagctgtggtttaacgtgtggaataaagccgccaaaatcccaatcgggccaccaatacccagagccactgcaattaaccccatgttttccacactggagtacgctaataagcgtttcatatcgcgctggatcagaataaagaacgcggcgatagcaacagagaggaagccaaagattaacaataggttacgagtgaattcagtgcctattgctgcatcaataataatgtag

SEQ ID NO: 2186 - DNA, 1314 bp, Proteus mirabilis
tttgtgatgtttatatcactaaacattaaatcattacaacacattaataatgttttattagatttcgatttttccaataggaatttaatttgtataactggccggaatggaatagggaaaacatctatagtaaaatcattatgcttattaaaagatataagtgtcttaaataagacatcttcaattttcagtataaataaagaaactaatataacaatatctataaataaaaacaattatcattattattgtaataacggagaaattgattcaaaagatattattgatgaaagttttttaaatgttgaactccctattccttatggaaaacgtttctctaattttcctgttttaggtaatattgataaagaattaagagagagttatattaagggagagtttaataaaaatatagaaataatttattttttgagccaaatctatataggagagagattctcatcactcaaagaggtaataataagaggtaataagtattattttcttcctcttgatggatatagatatattagagaggattattttagctctggagagtactttgtaataaatctatataagacagtaacttctgattgtaaattaattgttgtagatgaaattgatatttctcttgatgcctctgctcaagttagattaatacaagccctcaataatttgtgtgataaatataagaaaaaaataatatttacaacacattctcttcctattatgagagtgttatatcaacaggttggtgagtctatattttatttagagaatattaattccaggctaattatgagagaagtctcatatagttatattgtgggtgagctttttggttttaaagattatgataaatatattctaacagaagatataatgttggaaatttatttaaaaagattaatttctaaaattgatacaaataaatcagtaaagattatttatataggtggtgcttcaaatgttatagattttatgagaagaaataagcgggaaaactttatttgtgaaagtaaacatatgatttcttttttagatggtgactctcgaggtaaagtatctggagataatatcttatatagtccatttttagatatagaagatgagttttttagaaaatatactgaagaaaataatagatttaatttaccttcaatcggggttgataattgtaaaagtaaatattactgtaaaacagtaattaaagatattggttacgaagctttttttaatatcctcgatattgattttgaagataaaatagaacaaacaatagccgaactaagagaatttattaacaaatga

SEQ ID NO: 2187 - DNA, 711 bp, Proteus mirabilis
tgcttggtgttcttgctctgggtattctggcaagttttgtattcccagaaaaaaagaataaataaggtaaataatgataaccgatattcttgggaaattagaatatcgcaacataaattgaagaggttgaagatgagcgtttctctttctaaaggtggtaatgtttctttaagcaaagcagccccaacgatgaaaaacgtcctagtcggacttggttgggatgcccgttctacagatggtcaagattttgacttagatgcatctgcatttctgttagccgctaatggaaaagtacgtagcgatgccgatttcattttttataacaacttaagatctgccgacggctctgttgttcacactggtgataaccgaacaggtgaaggtgatggtgatgatgaagcactaaaaatcaaactagataccatccccagtgatgtcgaaaaaattatctttgtagtgactatccatgaagcgcaagcgcgtcgtcaaagctttggtcaggtatctggtgcgtttattcgtttagttaatgatgacaaccaaattgaagttgctcgttatgatttaacggaagatgcatcaacggaaacggcgatgttatttggtgagttatatcgtcataacggtgagtggaaattccgtgctgtaggccaaggatatgcagggggcttaggctcagtatgtgcgcaatatggtattaacgcctcttaa

SEQ ID NO: 2188 - DNA, 1488 bp, Proteus mirabilis
aacataaaccccaaaattctttatttttttgcgtgcaaggaaaaagctatgtctctacgttatcaacgttctgcgttatctgtagtcgtcgcaacactctttacaagcgtgagtttctcttcttttgcagcccccgtcactgccgatactattttggcgcaagatcgcgcagcaaaaggtaatattacggaatttggtggtgctcgtcgtataacctcagatcaaactgaagcattaaaagcagcacttaataatcatcaagctaaaaatgtgatcctatttatcggtgatgggatgggggattctgagataacggtagcacgtaactatgccgaaggggctggtggcttctttaaagggattgatgcgttaccgatgaccggccaatatactcattattctttagatagaaaaacacaaaaacctaattatgtaacagattcggccgcatcagcaacagcatgggcttcaggggttaaaacctataatggggcattagggattgatgtgtttggtaaagatcaccaaacgattttggaattagcaaaagcgaatggtaaagcgacggggaatgtcactacctctgaaattcaagatgcaacaccggctgcgctattttcacatgttaccgggcgtaagtgttatgggcctgtagaaacgttagcaaaatgctcaacgaatgcgctagaaaatggcggtagaggttcaatctctgagcaattgttagtgactcgtgcagatattacactgggaggaggcgcgaaaagttttgctcaaacagcaacggccggtgaatataaagggaaaacgctcgagcaacaagcaatagagcgtggctatcaaattgtgaaagatgctaaatcgttagaggcgattacgctagcaaatcaagataaacctgtgttaggtctatttcatgacggtaatatggccgtcgcttgggaagggccaaaagccacttatcaaggtaatttaaagaatcctcctttagagtgtaaaccgaattcaaaattagacccgaatgcaccaacattagcgcaaatgaccaaaaaagcgattgatttgctgaaaacgaatgaaaatggtttcttcttacaagtcgaaagcgcctccattgataaacaagatcataatgctaatccttgtggtcaaattggtgaaacggtggcattagatgaagcggtacaaattggtttagatttcgctaaacaaaatggtgatacgcttattatagtgaccgcagatcacgctcactctagtcaaattattgaagctgatgtgaaatcaagcggcttaacacaagcattgattaccaaagatggcgctgtcatggtggtgaattatggtaactcagaaacggattcacaagagcatacaggcgcgcaattacgcgttgccgcttatggtccacatgctgctaatgtcgtagggttaacagaccaaacagatcttttctttactatgcgcgatgcgatgggattgaaataa

SEQ ID NO: 2189 - DNA, 198 bp, Proteus mirabilis
ttttttctacctctatttacaaaaaatcacccttttatttttacccttgtcgattttttactcatcaagtctttctttttagactatctcattgaaataaaagattattatttaatttattttttctgctctatattgaacacaaattgcgcatacagtcacacaaaggctagacctcgcctcaaatggcacgtataa

SEQ ID NO: 2190 - DNA, 774 bp, Proteus mirabilis
ggcttatcgttaatcaaagaaggaaaagttatgatttcatttagcaacaaagtaggcattatcaccgggggtaatagtggtatcggtttagctagcgctgagaaatttttatcactaggggcatcggttgttattactggaagtcattcaggtcgtggggaaaaagcacaaaactatttgcaagataaagggttttccgcagaatttgttcaaatggatgccgccaatgagcaagataatcaacaactggttaagtatgtagtaaaacattatggcaaagtggattttttatttgctaatgcgggtgttttaaccgataccgttgccgataaattacattacgatcaatggaaaaaagtgcttgatgttaatcttaatggactatttcttattaaccgcgcggttattcaacattggttagaaactaaaaccacaggcgctattgttaactgtagttcaatctgctcttttgtcggccagcatgcatttcctgcttattgctcctctaaagggggcattaaattactcacacaaacgttagcgcttgattatgccagtcaaggtattcgtgttaatgctgtttgtccaggctatattgatactcctttattagaggggcgtgaattagacaaacaaaaactcgtcgctttacaccctattggtcggttaggtacacctgaagaggtggctaatgttgttgcctttttagcaagtgatgccgcctcgtttgtcacaggggcttcttatctcgttgatggtggttttacggcataa

SEQ ID NO: 2191 - DNA, 801 bp, Proteus mirabilis
gaaacatcgttggagagttttatgacagatttaaccgctgcagcgcgccttgcgctgtctttgatggatttaaccaccttaaatgatgacgacactgatgaaaaagtgacaaaactatgtcatcaggcgaaaagcccagaaggtaatacagccgcaatctgtatctacccacgctttattccactggctcgtaaagtattacgtgaacagggaacaccagaaattcgtattgcaaccgtaactaacttccctcatggtaatgatgatttagatatcgcattagctgaaactaatgcagcattagcttatggtgctgatgaggttgatgttgtttttccttaccgcgcattaatggcaggtaatgaacaaatcggttttgatatcgttaaagcatgtaaagacgcttgcgctaaagcgggtgctttactgaaagttattattgaaacgggtgagttgaaagatcctgcgctcattcgtaaagcatctgaaatctcaattaaagcaggtgctgattttatcaaaacatccacaggtaaagtgcctgttaatgcaacactggaaagcgctgaattaatgcttcaagtgatccacgatatgggtgttggcaaagaagttggttttaaaccagcgggtggggtacgtacagctgaagaagctgcgcaataccttgcattagcaaaccgtattatgggcgataactgggttgatgctcgccatttccgttttggtgcatcaagtctgttaggtaatttattagccacactcggtcatggcgaacaaaaatcgtctagtggttattaa

SEQ ID NO: 2192 - DNA, 222 bp, Proteus mirabilis
gcaatagctttagtatctgaacatggaacagacagttttttcagttcttctactgcgcccacaacggctttatcgataccgcgtttcagatccatagggttcatgccagcggcaactgcttttaagccttcggcgataattgcttgtgctaacactgttgcagttgtagtaccgtcacctgccgcatcattagctttagaagcaacttctttcaccatctga

SEQ ID NO: 2193 - DNA, 666 bp, Proteus mirabilis
ggtttttttaccatgaatcagacgctactttccgaatttggctctccattagagcgtgttgagcgtgcgcttgaagcccttcgtgccggtaaaggtgtgatggtgcttgatgatgagaaccgtgaaaatgaaggcgatatggtatttgtcgcagaaaccatgaccacagaacaaatggcgatgtctattcgtcatggcagtggtattgtgtgtgtctgtattaccgaagagcgccgtcaacaactcgatttacctatgatggtagaaaataacaccagtcattttcataccgcatttacggtaactattgaagcggcccaaggggtgactacgggagtttcagcagcagaccgtttaacgacagtacgtgcagctgctgctgataatgcaaaaccaagtgatttaaatcgtccaggtcacgtattcccattacgagcacaacctggtggtgtattaacacgtggtggacatactgaagcttctattgatttagcaacgttagcgggttttaaacctgttgccgtgttatgtgaattaaccaatgacgatggcaccatggccagagcgccagaagttgtcacttttgctaaacagcatgatatgccagtgttaacgattgaagatttagtggcttatcgtcttcgcgaggagaagaaagcgggctga

SEQ ID NO: 2194 - DNA, 1098 bp, Proteus mirabilis
aaaatggttacttggcgaaaatcgttgcttttggggatattagcgcttgccttaacaggctgccatcgtccaacagatcaggggcaacagtataaagatggtaagcttaaacaagatcttattgaagttaactcgccaaatacgcaaggcaagcccattaatggctcagattaccttgaacaaattaaccaaataaatcaaacatcttcacgtctatacaatagtaatcaagatacttatcaagcagtggaaaattggttacgctcaggggcagatacgcgtcaattacgtcaatttaatatcgcagcctttcaaatggaaggggaagataattatgggaatgtaaaatttaccggatattatacccctgttttagaagcacgtttaacgccacaaggtgactttaaatatccgctctaccgcatgccagccaaagtgcgtggtaaattgccttcacgagcggctatctataacggtgctttaagtcccactttaattgccgcttatagtaactccatcatggataactttatgatggaagtgcaaggcagtggctatgtcgattatggtgatggtaaacctttaaccttctttggttatgctgggaaaaatggtcatccctaccgcagtattggtaaagtgctgattgataatggtgaagttgaaaaagaagcgatgtcaatgttggcaattagagagtgggctgataagcatagtgaacaagaagtcagaaaattattagaacagaacccctctttcgttttctttaaacctgaaccttttacgccagtaagaggggcaagtgctattccgctgattgctaaagcgtcagtggcttctgatagaagtattatccccgcaggaaccgtattattagcggaaatccctattttagataataccggtaagtttactggacaataccaaatgcgtttaatggttgctttggatgtggggggagccattaaaggacatcatttcgatatttatcatggtattggtaaagaagccggacaaatggcgggtttttataatcattatggacgtgtatgggtattaaaaaaatcgcaacccaccttactgaaccccatacagtaa

SEQ ID NO: 2195 - DNA, 273 bp, Proteus mirabilis
agagaaaataccatgcgtgttttaacaatttactgtcctgaatgtggtgaaaaagcgatgataaagaaaagtaatcgcaagcataaagagttaacagatctttattgtgcctgccgtgatccgctttgtgggcatacctttgtgctaaatcttacctttagtcatactctaagtcccagcgccaaaaaacaagatgcccttttattagcaatgataaaaaatctctcgccacagcaacgagaaaaagccttaaccttgttacaagagatataa

SEQ ID NO: 2196 - DNA, 504 bp, Proteus mirabilis
cctaaaagtacactatcaaacatcaatactattaaggaatatttcgtgataacgacacagggaacaataaaggagcaacagggtgtcatcggtctgatggctgcagtaggttttatggtgataagtttatcgttactgacaagttttgcttatcattatcgtcaatgtcaattaatggtgatgcaagagttacaagcaaagcagacctttttattcgctggatctgcgttgtcatggggaatgaccttaacatgggatttatcgccttctcgtctttaccaatggcaatgtcgtacttttactgctgagcctaatatgaaaagctgtttctctttgagaggaaagacaagcgctttactactcggagaggctaaaagtcatagcggagataagatatctcattatcaatggattaatctggtgggtaaggaaaaactgcatattgaagcccaaccgaatggttggctagactactgtccactagttaaagaaggctgtatttga

SEQ ID NO: 2197 - DNA, 795 bp, Proteus mirabilis
atgatcatcactgcagcaaaacaactcacaattggctataaaacaacacccttgatccaaaacctctcttttcatattaaacaagggcaaattgtctgtttattaggcgcaaatggctgtggtaaaaccacgttgatgcgtaccttacttggtttgttacccagtcttgcaggccatattatcattgaaggcaaagaaataagtaagtggtcaccaactgatttagccaaagtgattgcctatgttcctcaagcaacccacctccctttttcttttaaagtgattgatatggtgattatggggcgtggagcacatatctcttttttctcgatgcctagctcacaagataaagcaatggcaatggaaaccttagaaatgctctctctttcgcatcttgctcaccgcacttttgatacgttaagtggtggtgaaaaacagttggtattgattgcacgggctttggtgcaacaacctaaattactgattatggatgaacctgctgccagccttgattttggtaaccaaatcaagctaattaaccaaattaagacactaaaagccttgggtataagtgtgtttatgtctacacatcatccacaacatgccgctttactcgcagatgaggtgattttactcacccctcatcgccacgttttacaagataaacctgagcttttgctcacccccgaacatttagctcagctttataatgtgaaacccactgatattcaggcgcacttttacgcctaccctgataataacaatccatataggcaagaatatgaacaccattga

SEQ ID NO: 2198 - DNA, 1029 bp, Proteus mirabilis
ctggagaacactatgtttaacttaaattatttcaaagcagactcatcaacatttattattaaatcggtcaacgggaaagtgcgccaacaaggtaaaggcttaagtttttggtataattcggcgacaacatctattgcagcactgccgttaaatgcacaagaagccccttttatctttaactttcaaactgctgattttcaggcactacgtattcaaggacaaatatcattccaagtcacatcacctgaaaaagctgctgaagtcctcaactttaatttaagtaagaatggcaaatcttacgccagtgaagatcccctaaagctcaacgatcgcgtggtgcgtattgctcaaaccctgatccaagccaagatccaaagcacccctttacgagaagcactacaacttagccaatccttggttactttagtgatgaaacaacttactgaacacccttcattagaggccttaggtattactattttagatgtttctattgcggccatctcaccctctcccgaaacgcttaaagcattagaagctgaggcgcgggaatccttactcaaagaggctgatgatgcaatttatgcacgtcgtaaattctcagtagagcaagagcgcaccattaaagaagctgaattagaaacagacttatctatacagcgtaaacgacaagaaattgaagaagctcgtttagaaaatgaacgtaccctattacgtgaacaagccgaaatagaaaaagagcgtcttgaagccaaagtcaatgccgaagcaaaacgtaaagaattagtcgcgttaagtgcggaaaatcaacgcatacaatctgatgctgatgcttatgcaattgaagcaactatgcgagcttaccgtgagttgcccgttgaaaatctcaaagcaatggctctagcaaaaatggactcacaacagttaatggcaatggcatttgaaactttagcgcttaattcaggaaaaattggtgaattaaatatcactcctgatttatttagccaatttatgaaaaaaagaggataa

SEQ ID NO: 2199 - DNA, 732 bp, Proteus mirabilis
aggttcagcactattaattactcaatgaatagctaccaaataacatctatagggcatattatcagcccttataaagagaaatttgccgttcctcgccaacctggattagtccaggatggcgtaggccagctaatactacacacaccttataatcatcctgatgcagtaaggggcttagaacaatttagccatctttggttattatttatttttcatcaaacagcgcaacaaggctggcatccattagtgcgcccaccaagattaggggggaatagcaaactcggggttttcgccactcgctcaacttttcgccctaatgctatcggcatgtcattagtcgagctaaaagatatcattattgaaaagcaatcggtgatcttgcaactaggcagtctagatcttattgatggaacccccattattgatatcaagccgtaccttccctatgctgaatctattgctggtgcaacagcaggctttgcccaatatgctcctcatgaagagatggagattcttttttctgaagatgccacacagcagttacaatattactctcatcaatatcctcatcttatgcgatttatcactcaagtattgcaacaagatccgcgtcctgcttataaaaaaagcgaacaaagtgatagagtatatgccgtgcatttactggattttaatattcgttggcaagtcaatgggcagcaaacacttgttcttagtatagaaccgcgctaa

SEQ ID NO: 2200 - DNA, 1668 bp, Proteus mirabilis
caacagttaacttatttcttttctgtctctttcaaacagattgagactgatgataagtcgtatctaaaaaatcggagaatatttatgtctattcggtttagttggcgaaaatcgtttattgctttatcctgcttagccgcacttagtgttcctgttactacttcagcacaaaccttaaaattagccattggtgaagagccgacagaaggttttgatcccatgttagggtggagccatggtagctacttactgctacacagcccattattaaagcaaaatgcggatctgacttggtatagcaatatgctcagtgattatcagcctagtgcagagggcacaacatggaagctgacgttaaaaccagatttgaaattttctgatggttcccctttaaccgcaaaagatgttgcctttacctataacaatgctgcggcaagtggcggtaaagtggatatgggaaactttctttctgcaactgcagatgatgatttacatgtcactattgctttaaaagcgcctcaaagtacttttgttaatgtattaggctcgctaggcattgtttcagctgataaatatgatgaaaaaacctatgcacaaaagccgattggtgccggtccttatcgtatggtcagttttcaaccgggtcagcaactcatcgttgaggcaaacccttattatgcgggtaagaaaaatgatttcgaaaagcttatctttgtttttcttgatgaagatgccgcttttgctgccgctcaaagtggacaactaggggttgttcgtattcctcctgccaccgcagccattgctaaaaatttgcctaatgtaaaattgtgggaaagagccagtgttgaaaatcgtggtatcgtctttcctatggtgaaatcaggtgagaaaaatgcacaagggtatgatatcggtaatgatatcactgcagatatcgccatccgtaaagcgattaactatgcccttaaccgccaattactggcagagcaagtattagatggatatgcagttcctgcttataccggcgtaaaaggattaccttgggatcaaaccgaggccgcatttaaagatggtgatattgaaaaagccaaacaaattcttgatgatgcgggttggaaactcaataaaaatggcattcgagaaaaagacggtttagaagcgaaattgacactctggtacaccagtggtgatgcaactcgtcgtgatttagcagaatcaattcgtgcgttagtgcaacctcttggcattcaaatggatcttaagtcaggaagctgggataccgtagagcgttatatgcactcaaacccgactttgtttggttggggaagtcttgatccgatggagctctatcatcactatagtatgaatgccgcaggtgtgggttactataatcctgggtattataaaaatcctgccgttgaaaaacatttacaagcagcattagatgcaccgacatggcaacaagcggtaccacattggcaagcggtagagtgggatggtaaaaatggcgtcggtatcaaaggtgatgctgcttgggcttggttaatgaatattcagcatacttacttaaccgatccttgtgttgatttaggcactggcgctccggaaattcacggttcatggtcattattaaatagcgtagatacttggaagtggacttgtcagtaa

SEQ ID NO: 2201 - DNA, 1149 bp, Proteus mirabilis
atgaccctaacacctggcggaaatatatccgtacctgatcaaacgttaatggtgcgtattcactcaggctcacctgttgatgtatctgcatttaggctttatgcctcaggaaaagtgaacggtgatgctgatatggtgttttatggtcaaaccaccaatgatgaccgtactattatttatgcaacagcaggtaatagcacgtcgtttacggttgacttaactcgcttacgtcctgatgtcgatagaattgcttttacagctacttgtgaggggcaacaaaccattgctcatctacaacatttgtctattcaagttgatgctaacaataatgtcgttgcgaacggccatgttgatatcaatggacgcactgaagcggcattaattttaggtgagctataccgtcgcaatggaagctggaaatttcggtttattgcacaaggatttaacggtggattaaaaccattggcggaatattttggtgttgatattgctgatcctgaaccagcaccagcaccagcaccagcaccgagctcagtgaagttaagcaaggtttcgctaactaaagagaaacctgcaattagcttaactaaaaaggatgatttcggcaaaatccgcattaacctcgattggcatcgagaaagtaaaagcggtggttccgggttattaggtggattatttggtggtaacaaaggtattgatttagatattggcgcctttgttgaactacaagatggttataagtcagtgatccaagccttaggaaatggattcggtgattttaatcgcatgccttatgttgagttacaaggtgatgatcgcactggtgatgtagcgggtggcgagtggatttttatcaatggacgtgaatggaaaaatatcaagcaagtgcttatttttacttttatttatgaaggggttcctaactggagtaaaacagatggtgtggtcactattcatgttcccgagcaaccacctatcgaaacacgtttaacggatggtaataatggtcgagctatgtgtgccattgcacgacttattaatgaaaacggatcaatcaaagttgaacgtctcaatgaattttttaaaggccatcgcgatatggataatgcctacggatggggatttcgctggactgctggatctaagtga

SEQ ID NO: 2202 - DNA, 1317 bp, Proteus mirabilis
gtttattcaacacaaaatcaggggtatgtcatgagaataaaaataatctttagcctcatactattatttagttggctgtttatcactccagcaaaaagtgatgagcagccattggttatactgacgacactttcagatacacccatgcgaccacttaccgaagcttttagtgctcgttatcctgaaactaaggtacaagtggtttatcggcgtgttgcgatcgctacacggatgatgaagcagtatcctacgcaacctgttgatatagtgatgtcctcttcggctaatttttttcatcatttagatagagaaggactactcgcgcgcttaccgattaactatgaaacaccaaaatggctaactcgtcatagtgatatcttaaatgacaaaataaccacggtgggttattcaggtattgggatcatgagtaacagacaatacttgcaaaagttaggtattccggcacctaaaagttggattgatttaagtgatccgatttaccaagggcacttaactatgacgacaccagccaactctggcacgatgcaactgatggttgaaaatgtgctgcaagaatatggttgggagcgcggatggcaaattttactagaaaccagtggtaacctttcttcgatatcggcacgtagttcacgagtgagtgacgctattgccagaggtattgtgggggcggggcctattattgataattacgcttttaaccaccaaaaacgctttgattttgttgattttagttattttgataaatcaattattttacctgcttatgtcgctattgtggctgaaagcagtaaaagagatactgcggccaaatttatcgcctttcttttatcggatgaaggacaagagattatctataaaagtgatatggcgaagatccccctcagcaaagaaattttacgtaataatgatgagcttgctaataatactgagtttattttaaacagtaatgaagcttatcgccgtagcgaagtggtcaatgttctttttgatcaaatgatcacccataattttccattaatgcgccaagtttggaatgagatccacgaggcagaaaaacaacaaaatcgatcaccagaacggatcgcagcaaccaatcaagcccgaaaaatagccagttcagtactaattagcgaaaaagaagctaattcaccgacattacaagccttatttatgaaagaagccgatcagcgggaatattcagatcaagcgttagccgtattgtaccaatggcgtacattagaagcggaaaaacttgaacaagcattagttttattgaaagaaactaaatctccctaa

SEQ ID NO: 2203 - DNA, 960 bp, Proteus mirabilis
ggtttaccaacagccaaaataggggtttcacaacagaatatgtctaaacgtttacctccactaaatgcccttagagtttttgattcggcagcacgtcatttaagttttactaaagcggctgaagaattattcgtgactcaagcagcggttagccatcaaattaaaacattagaagaatttcttggactaaaattatttagaagacgcaatcgttctttgttactgaccgaagaaggtcaaagttattatcttgatatcaaagaaattttctcttcaattaatgaagcgacaagaaaattacttgcgcgaagcgcgaaaggggctttaacagtgagcttgtcgccgagttttgctattcagtggttagtaccgaggttatcagggtttaatcaggcttatccggggattgatgttcgtattcaggcggttgatcgcgaagaagataagcttgctgatgatgtggatgtggctattttttatggccgcgggaactggactggattgcgtactgatcgtctttacgccgaatatttaattccagtttgtgctccttctttgctgacaggtgaaaaaccactaaaaaccccgtccgatctgatttatcatacactgttacatgatacatcgcgtcgtgattggcaagcttatgttcgtcaattggagatccaaaaccagattaatgtgcaacaagggcctatctttagccatagctctatggtgatacaggctgcagtacatggacaaggtgttgcattagttaataatgttatggctcgcagtgaaattgaatcaggtcgattagttaggccttttcaagatgtgcttgtcagtaaaaatgccttttatttagtttgccaagatagtcaggctgaattaggaaaaattgctgctttccgtcaatggattttatctcaagcggcaaatgaacaggaaaaattaggattactggcaacttcttaa

SEQ ID NO: 2204 - DNA, 1059 bp, Proteus mirabilis
tataaaacaacactacagtgtgaacctatggctatccacagacgacaatttctgagttatttagcgacgcttgcagcattatcagcactgccacgttgtgcaagagcggcaatcacttcacgtatcgccgctcaatttggtgtgcttcctacaccagaaaatattcatcgcgttattagcgcaggccccccaaccgaccaactgttgttggctttagtaccagaaaaattattaggtttctcctcgcttaatctaggaaaaagtagcttatttgctgacaagttgcgtaaattgccccatttaggccgtctgtctggccgtggtagtacactctccttagaaacattaatggcgctagagccagatatcattattgatagtggtaatgttgatgaaacctatcgttcattagctaaacgtgttagtgcgcaaacagatgtaccttatgtgttaattgacggcagcttaaaagacagcccaactcagttacgccaaacgggggctttattaggtgtggcagaaaaagcagaaacattagcacttattgcagagcagtatcttagtgatgcgaccttgtttgcttctactctaaaaataagacctcggttttaccttgcacgtggtgcgaaaggcctacaaactggctcaacaggatctattcatactgaagctattgaactattagggttcgaaaatgtcgctgatattgctggttttactggccttactgatgtttcccctgaacaactccttatgtggaaccctgaagttatcatcacacaagatgaaaatgcctatcagcaaatcaggcaagactctatatggaaaaatatccaagctgttaaaaataataaagtgttattatttaaaggcttaccatttggctggttagatggccctcctggtatcaaccgtttaatgggaatgcgtcgcttacagagccattttgaccatcgaatagcagaacaagccacgcaagatctgcaaaattactttgcttgtttttaccatacatcgttaagtgctgagcaatgccagctgttgatgaggtcttcatga

SEQ ID NO: 2205 - DNA, 921 bp, Proteus mirabilis
aatgagcaaacgccatggctattgattaacaatagccatgattatttctgctatctaggttgttatcgcattatgcaaaattcattatcagactcctatctgcaacgcttttctggtattggccgtctttatggacaacaagcgctgtattatttttctcaggcacatatttgtgttgtcggcattggtggcgttggtagctgggctgcagaagccttagctcgcagtgggatcggcgctattacgttaattgatatggatgatgtgtgtgtcaccaataccaatcgacaaattcatgcgctaaaagagcatgtcggccagcctaaatgtgaagtgatgaagcagcgaattttgcaaattaatcctgaatgcaaagttacttgtattgatgattttgttacggttgataatgtggcagaaatgatgcaaaactcatttgattatgtgattgatgctattgatagtgttagaccaaaggccgcattattagcttactgtcgtcgctataaaattcctgttatcaccactggtggcgcaggcggacagattgatccaactcaaatccaagtcgtcgatttagcgaaaaccattcaagatccattagccgctaaattacgtgagcgtttaaaatctgattttaatgttgtgaaaaatagcaaaggtaaattaggcatagattgtgttttttcaaccgagcaattagtctaccctcaaggagatggtacggtgtgtgcggccaaaagtactgccgatggtgtcaagcgtatggactgctcagcgggttttggcgcggtgacaatggtaaccgcttcctttggttttattgccgtttctcatgtattaaagaagatgttagctaaggcgcaacgtactcgtcatacttcaagttgtagcgttgttgaccgcattcattcgcactag

SEQ ID NO: 2206 - DNA, 723 bp, Proteus mirabilis
ctctgtgaaacattggagttcaccatgctacaaaaaatatctgccaataaaattgcattaataaaaagaatgcaacttagtactcctacattagtcgatattctcgatagtttaggaaaaaccattgtattaaatagtcaattaaaaagtattaacctagaaaacttttattctgttggacaagcttatactgtgcaatggaaattaattagaaaacaaaaatctattttaaataaacaaccttctacgtgggaacaagttagttcttttttagtccctgaaataacagatgcaaaaggattattctatatagccggaggacatgaactaataacagaagcagcacttgcaggtggcatgagttgtacttattttgaaaaattaggctttgaaggagttattttagggggagcggtacgagacaagaaagatctcaccaatctaaccattccagtcattgccaccaatcttactcctacagatacacaaggcgcttattttgtcagtgagacaggcactcaatgcaccattgaacatgccacaatctgtagtggtgatttagtgatatccgaccctaatggcaccgtgattatccctttttcactcgttgataatgttctggaagaagcgattaagatagatagcattgaaaataacatgctagaaaaaatcaaacatgggcaacgtttaccagaacttatcaatataacgggacgtatataa

SEQ ID NO: 2207 - DNA, 2361 bp, Proteus mirabilis
gaaattatgacaattcacacagagcaaggctttattcttacccgccattggagtgacaccccacaaggtatcgctgtctcctattggttggcgacagaaaatggaccgcgtaaagtcacggttgcaaagcagtatgctattggttttgttgcccaacaaaatgaaagtatattacgctcagtggttggtcataatcgcgatattgatattcgtcctctggcgttaaaagactttgaaagacaacctgttttgggggtttattgtaaacaataccgccaacttacccagcttgaacagcaattaaaacagtataatattcgcctatatgaagccgatatccgcccacatgaacgctatatgatggagcgttttatcaccgcgcctgtatggtttcgttatcaaaatagtcatactgtcacgctaaaacctgccagtgattatcgtcctacattacgtaccgtctctttagatattgaaaccagtgagtttggtgagctttattctattggattagccggttgcggtgataacgttgtttttatgcttagtgacaccctcccagaagttcaagaaagccaacaacctgaaggctatcgtctgtgctatgtaagtagtcgattacaactccttgaaaaactaaatgcttggatacaagagtacgatcctgatgcaattattggttggaatcttattcaatttgatttgcgtatcttgcatacccatgctcagcgttacgggatcaatttattattaggacgacaaaataccccattagagtggcgtgaacatggctttaaagcggggcacttttttgcctcagcacaagggcgtttaattattgatggtattgatgctttaaaaatggcgacatggaattttccctcttttagcctagagtcagttgctcaaacactgttaggggaagggaaagcgattgatacaccttatgccagaatggacgaaatcaatcgccgttttaaagaagataagcccgccttagcgtattataactggcaagattgtgtcttggttaatcgtatctttgataccacacacttaatggaattcttattagaaagagccagtgtaacaggactggcagcagatagaagtggtggctctgtcgcagcatttactcacctctatttaccctcaatgcatcgtcttggttatgttgcccccaatcagggtgaaaaacccgaagagcatagccctggtggttttgtcatggactcaacaccgggtctctatgactcagtggtggtactggactataaaagcctatatccctctattattcgcacctttttaatcgatccggtgggaatgattgaaggtatgcatcaccctgatagcacacatgccgttcccggttttcgtcaagcgtggttttcacgagaaaaacactgtttacccaccattgtttcacaaatctggcatgaacgagataatgctaaacgtcataacaacgccccgctctctcaagcattgaaaattattatgaatgctttttatggtgtattaggctcagtaggctgtcgtttttttgatcctcgcttggcttcatcaattactttacgtggtcatgaaataatgaaaaagacccgtgaattaattgagtcaaaaggctatcaagtgatttatggtgatactgattctacttttgtttggcttaaagccgctcataacgaagtacaagcagagcagatcggccgtcaattagcgcaagatgttaatcaatggtggaaaagctatctgactgaaacttaccagcttgatagccaattagagcttgagtacgaaacccattatcgccgattcttgatgcccactattcgaggcatggaaaccggaagtaaaaaacgttatgcagggctaagtcatgataaaatggtgtttaaaggattggaaacagtcagaacagactggacaccactggcgcaagcgtttcaaaaagagctttatacacgcatctttaatcagcaaccttatcaacagtttattcgtgattatgttgctgatacgctattaggaaaatatgatgataggctggtttatcgaaaaagattgcgacgaaaattatcagactaccagcaccatatcccccctcacgtcaaagcagctcgattagcggatgactataatcagttacaaaataggccgcaacaatatcagcaaggcggttggattagttatataattactcacttggggccagagccgttagagcatatcacttcgacacctgactatgaacactacattaataagcaattaatgccgatagcagatgctattttgccatttctacaagatgatttttctaccttgttaaatgggcaaatgacgctctctttttaa

SEQ ID NO: 2208 - DNA, 777 bp, Proteus mirabilis
ttagctatgactaaccctgttattttagccgatcttgacgataccttatttcaaactcgtcgcaaaatggtggatgagttagcgcttgcaccctataaaactggtgcgttggatagaagtttagcgccacgtagctttatgactcaagagcaagctatgctggttgattggatgctagaacatgctgatttaattccagtcacagcacgtggaacggaagaaatgagccgtgtcactattccttttcattcatgggctattaccacacacggtgctgttatcttaaccccagaaaaagtcgcagatgaacaatggcaacaccatatcacacaaagcttaacaccttataagcaacctttacttaggttacagcaatctattacccaattaatggctgaacgtaatattgatggttgggcgagaattaactatgaatatgatgatttacccatttatttagtgatgaagcataacgatagcgctcgattagatgagctatatgctatcggtgatgagatagaaaaaatattctcaaccaaaggtttttatattcatcgtaacagtaacaatattgcttggttacctgagccaattgaaaaaggtaaagccgtcacttatttgcttaataaattaaaagcagaacgtggcgtttttcctgtgattggtttcggcgatagcctaagtgatcatcgctttatgaaattatgcaattggtatgctattccccgccaaagccaattcgcgaatgcgatcaacacaaaaatttttggagaataa

SEQ ID NO: 2209 - DNA, 390 bp, Proteus mirabilis
agcccacagacaagccccaaagaaagcgtcgttttattggtatataaaaaaccgccccccattagcccatcggtaggaaagccggcaaataaccaagccacaccttcgttatcttttaggttaaaacgatctttaatgacactttcaggcagttcgatgatctcttttacgcccacggcaacattttcagctgcaactcgttttgtcatgcctaactgttcagccaaaagtgagttcacaccatcagccaaaatcaccgctttggcttctaatacatcaccatctgcttctacaccgacaattttaccgtcacgctcaactaacttatcaacacgaatgcccgtgatacactgggcgcctgcatcttcggcttgcgccattagccattga

SEQ ID NO: 2210 - DNA, 831 bp, Proteus mirabilis
aggaattttgcgcgacttatgatttacgatcccaataagcctttatttagactgctatttgtctcaatcgtattagtggggctggttatttatggcttatctgtttctcatactgatattgtgatggattttttagctagaaaccaagcgccatctactcagtactggtttggcacggataatttaggccgttcactgtggttacgctgttttcaaggtatgttaagtagcttaaatatcggtgtcactagtgccgttgtcagtggtgctattgctttgatatttgctgggatctcctccattaatcgccattgtgatttattggtcagaggggtggttgatgccttgttagcattacctcatttactgttgttgatcttgatctgttttactttaggtgggggacagcaaggtgttatctgggctgttgcattaacccattggcccaaattagccctaattttacgtggtgaaattcaacgtattcgtgaagcagattatgtgatgctatctcgccgtattggcaatacaccttttgagtgtgtgaaaaaacactatatcccaatgttattaccgcaatggattgtaggaacgttgcttatgtttccacatgcggtattgcatagtgctgcgttgagctttttaggttttgggcaagcagcgcatgagccttctcttggattgctattagcggatgccttacgttatttaagtaccggtgcttggtggatggtgttttttcccggattaattttaatgtgcttggtattgatatttgatcaatttgctaaagccatgcagcaactatggttaagaggggcaggatgttaa

SEQ ID NO: 2211 - DNA, 456 bp, Proteus mirabilis
tggttttatttggtattatcaacctgttatttccaatttatcggcaacaacgaaaagaatggaaagcgatttgtgtcgctagtccgtttggttcaccgtttaatcaactgccatattcaaaacgtattcgtagacgtagtggttattcaggctctggtggttattcgagttcgtcttattcatcaagttcatcaagttcatccagctcttctagttcttctagttcttctagcggtggcggcggtggttcgagtggtggtgggggtgcttcagggagttggtagaggaatatgtcgctatttttatcttatgatgcaatcaccagagcgtaatctgcatgttgtgaaaaggctattagggcatgccagtattacatcgatattagaatacattgatgaaagtgttgataacttgcgagatatacttgaagcggaattgatggggcgagaatattag

SEQ ID NO: 2212 - DNA, 957 bp, Proteus mirabilis
ccaggtattgctatatattggttagggggcctcaataggccccctttacacatctgctatgagaacatctatggctcgcccatagaaaagtcgaggaagaaacaaatgtctggaattaccgctgcattggtaaaagaactgcgtgaacgtactggcgcaggcatgatggaatgtaaaaaagcgctggttgaagctaacggtgatatcgaattagctatcgacaacatgcgtaaatcaggtcaagcaaaagcggctaaaaaagcaggtcgcgttgctgctgaaggtatcatccttgcagaagttgctgctgatggtaaattcggtgcgctggttgaactgaactgtgaaacagacttcgttgctaaagatgctggcttcatcgcattcggtaaagatgttatggctgcagtattagcagacaaaactgacgatatcgaagcactgaaagcgaaattcgaagacgctcgtactgcattagttgcaaaaattggtgaaaacatcaacattcgccgcgttgctattttagaaggcgaagagttaggtacttacctgcacggtgctcgcatcggtgttttagttgcagctaaaggcgctaacgaagaactgatcaaacacattgctatgcacgttgctgcaagcaaaccagaatatgttcgccctgaagatgtgcctgctgatgttgttgagcatgagcaccaaatccagatggacatcgcaatgcaatcaggtaaaccacgcgaaatcgcagaaaaaatggttactggtcgtatgaacaaattcaccggtgagatctctctgactggtcagcatttcgttatggatccaagcaaaactgttggcgatctgctgaaagaaaacaatgctgaaatcattaacttcgttcgtttcgaagttggtgaaggtattgagaaagttgaagctgatttcgcagcagaagttgcggcaatgagcaaataa

SEQ ID NO: 2213 - DNA, 669 bp, Proteus mirabilis
aagagacacgctcatctcgttaatttaagagaacgctttatgaacctttttttccaaaatagcttagcctttcctagcattatctttagtgtcttacttattattatcctcttttattggctatgtgctgcttttggactattagatatcgatttatttaatatcgatagcgaattagatgtcgatgcgacgggccttgcgggttggctaactaaattagggcttgccggcattccggtaaccattatattaaccttcttcactttgttcggctggtttattagttacttttgcgtacattggtttattcgttttattgaaacagatttattgcgttatgttatcggctttattgcttttattatcatcagctttgtttctcttaatttaacagcgctatgcttaaaaccaatccgcaataagctcatttctcgtagcaaacctaaatcagttcaccaactagtaggaaaatttgctgtagtacgctccgaatatgtcacagaaaataaaggtgaagccctattagaagatggtggtgccggtttaattttacagatcagagcgccagcaacagaaaatattaaacgaggggatagcgtaattattattagttatgacgcgcctactcatagttatcaagtcgtaacggaagatgaatttcaccgctaa

SEQ ID NO: 2214 - DNA, 2934 bp, Proteus mirabilis
attatatatttgagagctgagtttatatatatgccttttactcttggtcaacgttggattagcgatacagaaagcgaacttggactaggtactgttgtggcaattgatgcccgtatggtgaccttactttttcctgcatgtggcgaaaatcgtctttattcccgccatgatgccccaataacgcgggtgatgtttaatgtgggggatactgtcaccagtcatgaaggctggaagctcgccatcgacaacgttgtggaagataatggcttacttatttatcacggcgtacgtttagataccgaagagccagcacaactgcgtgaagtattcttagataacaaactcacttttaataagccacaagatcgtctttttgctggtcaaatagaccgtatggatcgttttgctttacgctatcgtgcgcgtaaatttatgagcgaacagtttaagcaagcacaaagtggtctacgtggtattcgcgcaagtcttattcctcatcagctctatattgcgaatgaagtgggtaaacgtcataacccacgtgttttattagcggatgaagttgggctgggtaaaactatcgaagcgggtatgataatccaccagcaaatcatggatggacgcgctgagcgtgttttaattatcgttcctgaaagcttacaacatcagtggttagttgagatgttacgtcgtttcaacctacgtttttcactgtttgatgatagccgttatagcgaatctttattagatagcgataatcctttcgaaacagagcagatgatcatttgctcattagactttgtgcgtaaaaacaaacaacgctttgaacaccttgttgaagcgacttgggatatgttagttgtcgatgaagcccaccatctggtatggagtgaaaaggcaccaagccgagaataccaagttatcgaaacgctggctgaagcgatcccttctgtattgttattaaccgcaacaccggagcaacttggtcaagagagccattttgcccgcttacgtttgctcgatcctaatcgtttccacgattacaacgaatttattaatgaacaacaaaaatatcgccccgtggccgatgcggtaaccattttgctttcagaagatgatttaaataacgaacagcaaaatagcatcagtgagatgatcagtgagcaagatatagagccgttgctaaaagcctctaatacccaaggtgaagagcgtacaaaatcttgccaagcacttattcatatgttgatggatagacacggtacgggtcgtctgttatttcgcaatactcgctccggcgtcaaaggcttccctaaccgactgttgcacgcaataaaaatgccactaccaactcagtatcaaaccgccattaaggtggctgagattatggcagcgaaaaagagcctcgaagtacgagcaaaagagatgctctatcctgaacgtatctaccaagagtttgaaggtgaaaatgccacatggtggaactttgatccacgcgttgaatggctactaggctttttaaccgccaatcgtcatgaaaaagtattagtcatttgtgctcaagccgccacagcattgcaattagaacaagttttacgtgaacgtgaaggtattcgtgctgcagtattccatgaagggatgtctttacttgaacgagatcgtgcagccgcttatttcgcctcagaagaggaaggcgcacaagtgttactatgttctgaaatcggttcagaagggcgtaacttccaatttgctaatcaactagtgatgtttgatctcccctttaatcctgatttattagaacaacgtattggtcgtcttgatcgtatcggtcaaaaccgcgacattgatatcagtgtgccttatcttgaaggaaccgctcaatctgttctattacgttggtatcacgaagggttagatgcatttgaacatacctgcccgacgggtcgtacaatttatgacaacgaatatgatgcgctagtcaattatcttgctcaacctaatgaactaggtgattttgataagtttatcgtttcttgtcgtaagcaacatgatgagatgaaactcaaactagaacaaggtcgtgaccgtctattagaaatgcactctaacggcggtgaagttggcgttgagttagcgaataagattgcagagcaagataacgatcccgatctggttaacttcgccttaaacttatttgatattgtgggcattaaccaagaagatcgtagtgatagcttaattgtattaacgccatcagatcatatgttagttcctgacttccctggattaccgcaagatggttgtacaattacctttgatagagagcacgcactctctcgtgaagatacgcaatttatcagttgggaacatcctattatccgtaatggtttagatttagtcttatctggtgatacaggtagttgtgcggtttctttattgaaaaacaaagcattacctgtaggtacgctattagttgaactgatttatgtcgtagaagcgcaagcccctaaacatcttcatttaactcgcttcttaccggcaactccagtacgcttattacttgatttaaaaggtaataatcttgcatcacaagttgaatttgaaagttttaaccgccaattaaatgcggtaaatcgccacacatccagcaaattggtcaatgcggtacaaaatgaagttcatcatgtactaaaagcatctgaatccttaatggaagcggaagcgaaaacgctaattgaacaagcgaagcaagaagctgacaacgcattaacacatgagttatcacgcttagaggcattacgtgccgttaacccaaatatacgtgatgacgaagttgaagcaattgaaaatgagcgtacgcatattcttaaccacttagatgaagcgacatggcgcttagatgcgatccgtttaattgttgttacccaccaataa

SEQ ID NO: 2215 - DNA, 591 bp, Proteus mirabilis
gggatatatttctcttttttatgcctacagacgatgataacgatgaatgatatttccactgaattaaaacagcttacgcaaaattatgttgatttatggcaacaagagtcagggtttcctcctgccagccatgagctttatggtgttccttctccttgtatttctcgtaccggagataatgtggtttattggttaccacagccttttacgggtcgagataaattagaaaaagttgaaaaagcgatggggattattattcgccctgaattacatgactattttactacgcaatatgctggtgatatgcaagtccgttttgattcgctcaactttactctgcttcaaatttggagtgaagaggattttattcgcctacaagagaacatgatcggacaccttgtgacacaaaaacgattgaagctcaccccgactttgtttatcggtacaacagcgtctgaaaacgatattatttctgtatgtaatctttcaggtgaagtaatactagaaacttttggtcaaaagaaaagggaagtgcttgcagataatttatcactatttttaacaaaattaacccctgtttttgataagtaa

SEQ ID NO: 2216 - DNA, 2034 bp, Proteus mirabilis
cacaggagcgcaagtaatatggaacctcttcagttactgatgtggtcaatcatcctgtatgttgttggtggcgttattgcactgtttttaaagaaacaggaaggattggcaatcctaatatcggggatcagcgcaatcatcggtggtgtattaggtgttttaagcgcattaccagttattttaaatggtgaaacaatcagttttgctatggctgggccatttgatttcgccgcttttgtggtgcgtatggatatgcttggcgcctttatggtgtttgtcatttctttactcgtcactgtttgtgcgttgtattcactctcttatgttcaagaatacaaaggtcgcggcgcatggagtatgggattttttatgaatctctttattgcttccatggtaggactgattgttatggataatgcgttttactttattatcctatttgaaatgatgtcgttagcatcttggttcttagtcatcgctgaccaagatgacgaatctatccacgccggtttactctacttctttatcgctcacgcaggctctgtgctaatcatgatagccttcttcttaatgtggcgtgaaagcggtagccttgattttgattcattccgtcaactttctctttcccctgcaatggcttctgtggtgttcttactgggcttcttcggatttggtgccaaagccggtatgttgccattacacagttggttgccaaaagcgcaccccgcagcaccctctcacgcttcagcattaatgtctggggtgatggtgaaaattggtatttttggcatcatcaaagtaggcattgatttattaggtgcttcacaaatgtggtggggaattgtcgttctcgcattcggtgctgtctcttctgtattaggggttatgtacgcattagcagagcacgatttaaaacgtctccttgcatggcacaccgttgaaaatatcggcatcatcttgatgggcgtgggagttggcatggtaggtatggcaaccgatcatccagtgattgccgctctcggtctgcttggtgcgttataccacttattaaatcacgcggtatttaaaggattattgttcttaggtgccggagccattattaatcaaattcacactcgtgatatggataagatgggtggattagccaaactaatgccttacactgcaacggcattcttaattggttgtatggcaatttcagcattaccgccattaaatggttttgtgagtgagtggtatacttatcaatcactatttacgatgagttacgatggtaactttgtcatgcgcttaagtggtcctattgccattattatgttggcaattaccggggcattagcggccatgtgtttcgtcaaagtttatggcgtcagtttttgcggtggcccacgtagtgagcaagcgactaaagctaaagaagtaccgttgccaatgaccattgctatggggttattagcacttttctgtgttgtattaggtgtgggtgcggcttttgttgcgccaattattgccaatattgcaatgtcacttagcgaaaccagtgcattaacagtgactcaaggtgcgatattagtccctgatagtgcatcacaagcgatgttctctcctgccttaacatttattttattaatcgccttaccactaattccattcttaatttatctcggcttaaaaggtggtcaacctgcatttcgccgtaaaggtaatccatgggcttgtggttatgtctgggaaaaagacatggcggtgtccgctgggggctttactcaagcactacgtagtatgtttgcaccactttatcgtatgcgtaaacagcttgatccatcaccttggctttcacgtggctttaataaaacacagcgcggtgctgaaaaggtcgaaccattctgggatgaaagcattatttatccattggttcgtggtatccaacgttttgctaaacgtatccaatgcctacaaggcggcgatttcagactctattgtctgtacgtggtggcagcgctggtcatcttgcttttagttatcgcagcgtaa

SEQ ID NO: 2217 - DNA, 804 bp, Proteus mirabilis
atgacatatttattaatttcaggagatgtaatgaagattattacatgttacaagagtgttcccgatgagcaggatattgtggtcaataatgccgatggttcactcgatttttcgcgcgccaataacaaaattagccaatatgatttaaatgcgattgaagcggcgaatcagttaaaaacacaacttgatggtattcaaattacggcaatgagcgtaggtggtaacgcgctgactaacgctaaagcacgtaaagatgtgttatctcgtggtgctgatgatctcgtggtggtggtcgatgagcaattggaagcttctcttccttatcaaacggcgacagtgcttgcagcagctgcaactaagcaggggtacgatcttatcttatgcggtgatggctcggcagatctaagttcccaacaagtgagtttgctggtgggggagatcttgaatattcctgccattaatggggttaataaaattgtttctattacaactgattccatcaccgttgaacgcgaattagaaaacgaaattgaaacgcttactatcaccttacctgcggtgattgccgtttctaccgatatcaactctccacaaattccatccatgaaagccattttaggtgccgctaaaaagccggttcaacaatggagtgtggccgatcttggtttagagcccataacaccacgttcagagcaaaccgtgttagcaccgaaacaaaaagtacgtcagcgcatcattattgaaggtgatggcgatgatcaaattgctgaatttgcagaatatttacgaaaaattattaagtaa

SEQ ID NO: 2218 - DNA, 780 bp, Proteus mirabilis
cctatcctagcttttattttgaacgttttactttttatggatcttaccaatatgacaatgaaacgtaccaaatcgattaatcgcgatgcttttcgtaaagcatttcgcccttatcgtctggcgcctgttgccatcgccatcaccgcggtattcgccctttcagggtgtgaagagagtgatgagacggtttcactgtatatgaatgcacaagaatgtgcgcaagcgaatccatcacaagcagcacaatgtgaagattcttaccgcacggcattacaagaagcgcaacgtacagcacctaaatacgcaacaatggaagattgtgttgctgaatttggtgatgcgcaatgtacacaaactgcctcaattgatggtaaccccgttaacaccgaaaacgccaataacctcaaccctgatagttcacaaatggcacaagctaactctggtggtagcttctttatgccactgatggcaggttatatgatggggcgtttaatggggggtggcgcaccagcacagcctttatttagctcacgtaatccaagcagcccagctaatggtaagtttgttgatgcaacgggtcgtaactatggtccagctgtcggtggtcgtcaaatgaacgtccctaaaacagccatgactccaaaaccatctacaacatcaaccattacgcgtggtggctttggtaataccgtttcacgacaagcggcagctcaacgtgcaagcgcgacaaataacaaccgtagctcaacaggctcctcttcatatcgtgcaggtggttaa

SEQ ID NO: 2219 - DNA, 1026 bp, Proteus mirabilis
gcaatgccagctgttgatgaggtcttcatgagccaatcagcacgtatcactctgttgttgctgttattctcagtggctgtagttattgctatcactagtggtaagtattcacttacagtcaatgaactgtggacagtcgtcagtagcaaattaaccgggcatattgaagagagtcgaacagcaaccgtgttctggcaaatacgcttgcctcgagtgcttgctgccattttaattggaggtgggcttgctattgcgggggcggcttatcaaggtatgttccgtaacccactagtatcacctgatattctcggagtgtcatcaggggctggtgtcggtgctgtattgggtatttttcttggtcactccatgttgtcaattcagctttttgcttttgtcggagggcttatcactgttgctttagtctattttattgccaaattggcgaaacaacaggatccggtcctttctcttgttttagttggtattgcgattagcgccttatgtggctcagctatttcattaatgaaaattttagctgatccttatactcagctaccttccatcactttttggctgttaggagggctatcaactatcacggcgcctgatttactctctgttgcacctttaatgctactcgggtttattccactgattttattacgctggcgaatgaatattctcagcctttctgatgaagaagcgcgctccttaggccttaatgtagaaattaccagacttatctttattttatcggccacattaatcaccgcgagtgcagtttctattgcgggcattattggctggttaggtttaattgttccgcatatcgcaagattgttagttggtgctaacttcggatatcaactgcctatttccttacttgtgggcgcaacaatgttattaataacggatacactagcacgaactattgcgaatattgagttgcctttaggcattttaacctcggctattggtgcgcctttctttctgatgttattactcaaaacaaggcgggatagatga

SEQ ID NO: 2220 - DNA, 837 bp, Proteus mirabilis
agccatgcagcaactatggttaagaggggcaggatgttaagttttgaacagctttccattgatattgcgcagtttcgttggttaggaaagcgcacttggcagcctttattaaaatctatttctcttgatattaaacctggcaaaatgctggctttagtggggggcagcggtgaaggtaaaagtttactcctgcaaagtgcattgggactactacctgctaatatgcgaacccgaggcacaattaaacttaatgggcatccgttaaccgagcgagagcttattgcttatcgtggtaatactttttgctatattcctcaaggtgtaacagcgcttaatccgttaattagcattggtgaacaactgggccgttcagcgcggttaagtggtgctgatatcacctatgaagatattaaacaccaatttggtttatatcacctctctagctcgttagtgaaaacttaccccgcaaaattatcggggggaatggctaaacgagtactcgcctgcaatgcaacattatctaatgcacaatatatactggctgatgagataacatcatggcttgatgatgaacacgcttgtttattgctagagcatttaaaagagttatgtcatcaaggtaaatcagtcctatgggtcacccatgatttagctttggctgctcgttatgccgataccattgctgtgttgaggcaaggggagctaaatgagatagtcgctgctaaagcgctttatcatcatggtgggagtgagtggctaaaaacattgtggaatgcactgcctgaacagcagtttttagatctacaagagggggcttgcaacccatacccatattga

SEQ ID NO: 2221 - DNA, 1035 bp, Proteus mirabilis
ccaaaaatggcacacattgtaactcataatcacaccaccagagaagtctggttaacacaactcgcgcaggcaatcagtgatcctgttgaattactccaacttttagcgctggaacatcacgctgaactacaacggggtgctcaggcgagacgactttttcctttacgggttccccgtgaattcgttgcgcgcatgaaaaaaggcgatcctaacgatccattacttttacaagtattaactgcacatgctgaatttaccctaacgccgggattctctacggatccattagatgagcaacaaaatgcggtgccgggtttattacataaatatcagaatcgtgcattgcttttggtcaaaggtggttgcgctgtcaattgccgttactgtttccgacgccattttccttacgaagataacaagggaaacaaagctaactggcaaaaggcaatagagtatatcaaaaataacccaaaactcgatgaaatcatcttttcgggtggcgatccgctgatggccaaagatgacgagctagattggttaattactcagctagaagccatcccccacattaaacgtttacgtattcactctcgtttacctgtggtgatccctgcgcgtattactcatacgttatgtcagcgcttacagcagtcacgtttacaaaatattatggtattgcatatcaatcatgcaaatgaaattgatgatgcgttaagagaagcttgcttaaaactaaaaaatgcccatgttacgctattaaaccaaggggtattactgcgaggggttaacgacaatgcccaaacccttgctgatttaagtcgtgcactatttgacgcaggcattatgccttattaccttcatgtgctagataaagtacagggagcggctcattttatggtaccagacagtgaagcgcgcgaaataatgaaatcattaatgagtcttgtctctggctatatggttcctaaactcacgcgtgaaattggaggagagccaagcaaaaccttgcttgatttaggcttacgacaagtatag

SEQ ID NO: 2222 - DNA, 279 bp, Proteus mirabilis
cagatggtggctctcatggctaaatcaacacgtatctcctctgtctcttcttggacatctcgtattagtttatgggaaatgttggctgttgcttcgttatttactgtgatcacccactctattgcaggaacagcagcatttacattggttcttgttatttctatgttgctatctaccattatgttatttcataagaaattacaaatgtgggtgatgatccccgccggcgttgtgatcacctatagcttaatgaccttttttttaacctatcatgggtag

SEQ ID NO: 2223 - DNA, 345 bp, Proteus mirabilis
ttaaagaaggctgtatttgataataaatacttaattaatcatgaaagaaaagaagatagtatgctaattaatatggtgtcagtattgctattctttaatattagctttgtcgctattatagggtatagccaagccttaaaagttgattttcagcgcttagtggctatccaacaagccggagcgtctctttttgctttttatgggcaaatgtcattcaactctgttgataaccttaaaataatgacacaatcacttattgaagcggaaggctgtcaaaaaatagagggatcgataacccaccattcaggttatgtgacacgcttataccattggtcatgtgattaa

SEQ ID NO: 2224 - DNA, 426 bp, Proteus mirabilis
accaaggaggcgttcatgtctgatgacgctaaagtttacttttggtcattaagacaaaagtttgttgatagcgatgatgatatacctgagcaggcgcaacaagtgatgtactactcgttggcgattggtcatcacgtcggcatgattgactgcttaaaaacagagttggtttgtcctttagaaaaatatcaagcatggattgatttattacctgagggggaagcaaaacgaaaaatgcaaggattgctaactttcggtgagatcaatatcaattctgaacatactcacatgttagctttagctttcgatcctattgccaaaagtgatgatccactttttagtgagtggagccaaacgctgattaatttattaggtgaaattgttatagagccagcgatttatttgatagtaaagagaaaaccatga

SEQ ID NO: 2225 - DNA, 1170 bp, Proteus mirabilis
tcatcgctttatgaaattatgcaattggtatgctattccccgccaaagccaattcgcgaatgcgatcaacacaaaaatttttggagaataaacatgatggatcatcagcctttttcaggctcttatctactgggtgatgttgattttttactgcaacccgtcaagattgaaatgacacctgttgagttaaaagaagaacttatacagtctggtaaacgtcactattctgatatgttaagccaagagccagaacccacaacctggcatcttgaactgtttgaaaaagcactggctgctggcgcaacacgtttagctacacaagtaattatgctagcaaaatcacttattgcgcattttggtgacacccctattattctgacaagtcttgtgcgtgcgggtgttccacttggcgtgatgttacaacagaccttgcgcaaaatgggaaaaacgtcttatcactatggtattagcattattcgtgatagaggtattgataacgaagcgctttcatggattgagcaacgccatgggacagaaggcattgtatttgttgatgggtggacaggaaaaggcgctatcacaaatgagttaattcgctcattagcgggacgtgaaggttttcctgcacaaccccatcttgtcgtccttgctgatccttgtggttgcgcttggttaagtgccagtgatgaagattggctaatcccttttgggattatgggagcgcccgtttcaggattaatttcacgttcaatttggacagagcaaggcttccatggttttgtcgattgccaacatttaaaacaatatgaatgtagtcgctatcttgttgataaagtcggaaaaatagttgacgccttaatagataacgatattccactcgccacatttaaacatcaaccgtcagacttaaaaaaactgagcgaaaatgtcgttagtttacttgccaacaaatatgacatttcaaatatcaatcgtataaaacccggtattgctgaagcaactcgcgccgttttacgccgtgtacctgagcatattctggtaaaagaaattgcagatcccgatgttgcactactgatttatcttgctaaacaaaaaaatattactgtaaccgaggcaggtaaagcattaggacaatatcgtgccgttactatcattaaaaaggtgcaataa

SEQ ID NO: 2226 - DNA, 501 bp, Proteus mirabilis
ctctcaatttatttaggaggcgatatggaacagaaaataattgttatgggggcagatccttcaggttatgagcttaaaaatgccgtcaaatctcatctacaagcaaaaaattacacaataaaagatattaccgaatcagggcctattggttattgtgatgttggtgataaagtaggcgctattatttcagaacatcctgaatatattggttttgttttttgtggcacagggatgggagtaagtattagtgctaataaacataaaaatgtttattgcggggtttgtgagagtgttaccactgcgcgtttttgtaaagtgattaataattgcaatatgctagccatggggggtttactgattactccctttaaagccaatatgatggtagatgcttatttatctgcaacctttacacaagggttttctgaagcgaccccagatgatttacaatgtggcttacagaccatgaaagaagttgaaaagcgcatttatactgactaa

SEQ ID NO: 2227 - DNA, 720 bp, Proteus mirabilis
cgcgctacttactttgtgggatgcacccgttgctacacctgcgatgacaaaataagttttcctataacgataactaaggatcagaaaatggtattaactcatcatcaaattattctttggctacaacaatgcgctcaactttttgaacaaaacagtgactatctcaccgatcttgaccgtgaaattggcgatgctgaccacggcttaaatatgaatagaggcttcaaaaaggtagcggagaaattacctgaatttgccgataaagatattggttttatccttaaaaataccggtatgacattactgtctaatattggtggtgccagcggtcctctttttggcaccttctttattcgtgccgctaagcccaccgcatcattacaaagtctcgatgtaaatcaactttatgaaatgactaaagaaggtgttgatggcattgtcagtcgcggtaaagcacaaccaaatgataaaactatgtgtgatgtttggtggcctgtggttgatagtttaaagcatgcgaatgaccaaagtttatctatagaagatgctattgataatgcactgaaagttgcagaaaaagcggcggaggaaactattcctatgcaagcgaaaaaaggccgtgccagttatcttggtgagcgcagtataggacataaagatcccggcagtgcctctgtggtattgatcctccaagcgctgtctaatgctatccacgcataa

SEQ ID NO: 2228 - DNA, 810 bp, Proteus mirabilis
ggtaagtattatattattataaaaaattgtaattattattttataagggtcggtatgtatttttttcttggttttttgttatttctaattgttttgatggttatttgcaggattagagttttatggttggcaagaaaaaatacaataactgaaaagaattttaaaaccttcaaagagtataacaatattgaagattatgaaaaagaagcaaagcaagctgtttatgctgcaacaataagcaaaactctttttgaagaatgccaatgtctcataaccttaagaacaatgcttgaatccctacacactgattatgaaaaatatgaaaaagtaaatccgttattaatggagctattacgcaaaaaatttacttttacatactccgctttcattactatctatccagaacccatcgaagaaagcgggctagaacgatttagtttaattaatacaaaaaaatactgtccagaacatgtatggaaacatattctcaaatccgctatttataccaatgaagaattggatgactattttgggtcgcaggaattactcccactggagcggatgtgtacagatatggatttatataacgagtttaaaggcacggttttatttgatgaagtgatcgggtgctatgttaatgaagaaaacgaaggatctcaaatttttgataatgaggtttattctgttaccgaagaacagttacgccagtggctagatgaagagcttgcatttctgagttatgtcactgaaggtcttttgaatatttgtattgaatacataagaaaagagaatggaattataagggtttga

SEQ ID NO: 2229 - DNA, 594 bp, Proteus mirabilis
tttttagattattttataagagaagttaatatgaaattcaataaattaggcgtaatggttgctggtgcacttcttatgggttctttatcaactcaagttatggccgctaaaaacgcagacgttacattttctgcacgtttagttgcagcaacttgtgatatcagcgcaagccaagatcgtgttgatttaggtacttatgcaactactgatattcaaaatattaaccaagctgtatctgaaaaagatttcaacttagtgttaaacaactgtactaagattggtaaaccagctgaaggtgaagatcctgctgtaactgtatctaatattgaattattagcaagcggtaatggcctagttggtaatgagcaattatttgctagcgctggtgcaactcaagctggtatcaagttaactgcaatgaactctgtagtactgaaaccaaatgagtcaacagaactgcaaaacttaaaagcagaaggtgaaggtaacctgattattcctatgaaagcaggtttatttgctacagaaactggtgactcactgaaagcacaagatattaatgttccagtaacctttagtgttgcttataactaa

SEQ ID NO: 2230 - DNA, 597 bp, Proteus mirabilis
ggataccttttaattaatctattgaaatatagcgatatcgaaagaagcttattcccccctacaagcctctttcgaatatttcgaatacttgactatttttcgaatatttcagataatctagttattaaaaggggggaaatactaatgaatacgataagtgagagacttagtgctgaagatattgcattagcaaaattaagtagccaagagctatccgctgttatggatattaatggcaaaacgcagaagctatccattatagataagacgggtaataatcatattgtacaaataccaaatagtgcattacgcctaatgattgaaattcttactcaactagggcaagggaatactgttagtatcacaccaatccatgctgagctaacgacacaggaagcggctgatatactcaatatgtcccgtcctacatttgtaaaattattagatacacgagcgataccctactctagaaaaggaaatcgtaggaaagttgcttatgctgatattgttgcttataaaaatgaattggagcaaaaacgacttgatgcccttgctgaattatcgcaattagatcaagaaatggatatggggtattaa

SEQ ID NO: 2231 - DNA, 924 bp, Proteus mirabilis
aaaagccactatcacaagcactggcttttgcttgtgtcatttccattggtgattttggtattgttgccttatttggaaatgaaacttttagaacattacctttttacctctatcagcaaatcggtgcttatcacacacaagatggcgctgtcaccgcgatgctccttttgctgttatgtttcacgctttttagccttatcgaacgcgtttcaggaaaatcctatgattaagttagagcagctttcttatacctatgagcaccaacatctgacctttaatttaacggtaaaagcgggggagcgtattgctattttaggtcccagtggtgcaggtaaaagctcattactcagcttaatagcgggttttctgccctcagagtcaggctcgttatttttaaaagggaaagatcataccaaaacagcccctgcccaacgccctatctcgatgttatttcaagataacaatctttttcctcatctcacggtaagacaaaatattggtttagggctagatccagggctaaagctcactgtggcacagaaagcactattagaaagtcgagccaaacaggtttctttaagtgattatctagagcgtttaccttcacagctatcaggaggtcaacgtcaacgagtggcaattgcccgttgtctggtacgtgaacagcctattttattgttagacgaacctttttccgcccttgatcccgcattacgtatcgaaatgctcacattattagaacaaatttgtgatgaaaaaaatctcactttactcatggtgtctcacagcttagaagatgctcataaaatcgcaccaagagcgcttgttattgataatggcaccattgtctatgatggaaatacagcgtcattaatcaaaggcgaagtggatcaatcactgcttttagggataccttttaattaa

SEQ ID NO: 2232 - DNA, 1431 bp, Proteus mirabilis
tctatgttatacagagatcagttgcacttcagtttgttatttcgggagaaaaaggagtcctacgtgataactcatgtcagcccattaggttccatggatctgctttcacagctagaagttgatatgcttaaaagaacagccagcagtgatctttatcaactgtttcgtaactgttcacttgcagttctcaactctggtagccttactgatagtagtaaagaactgttatctaaataccaagattttgatattaacgtactgcgtcgcgaacgtggtgtaaaattagagctagttaatcccccagaagatgcctttgttgatggaaaaattattcgctctctacaagcaaacctatttgctgtactgcgcgatattttgtttgtgcatgggcaaataaccacggcaaaacgcgacctacatttaaaccttgaaaacagcgcccatataacaaacaccattttctctatcttacgtaatgcaagagcgctgcatatcgatgaagatccaaatatgatcgtttgctggggcggacactccatcaatgaaacagagtatctttacggtagaaaagtcggtaatgaattagggttacgcgaactgaatatctgtactgggtgtggacctggagctatggaagcgcccatgaaaggcgcagcagtgggtcacgctcaacaacgttatagaaatagccgttttattggtgttacagagccatcaatcatcgccgcagagccaccaaatcctctggttaatgaacttatcattatgccagatattgaaaaacgtctggaagcttttgttcgtattgcccacggcattattattttcccagggggcgtaggaaccgcagaagagctactctatctacttggtattctgatgtcaccagaaaaccaagaacaagtactgccactgattttaacgggtcctaaagagagtgcagactatttccgagtactcgatgattttattgttaataccttaggtgaagatgcacgacgtcattatcaaatcatcgtcgatgatgcggctgaagtggctcgtattatgaagaaatacatgccattggtaaaagataaccgtcgtagcacaggggatgcttacagctttaattggtcaataaaaattaatgcggacttacaacatcctttcgagccaactcatgaaaatatggcatcacttaatttaagcacgcatcaatctcctgaaaaactggcggctgatttacgccgtgcattttccggtattgtcgcaggtaacgtaaaagaagtgggaatgaaggcgatagaagctcatggcccttataaaattcacggtgaaagcgatattatgcgccgtatggatattttattggcgggttttgtcgaacaacatcgtatgaagctacctggtggtagtgcctatcaaccttgttacgagatcatcagctaa

SEQ ID NO: 2233 - DNA, 951 bp, Proteus mirabilis
tcgattgatttacttaagggaaatagaatgagccaattagaaaccgaactcaaacttagtgcgatacctgccgctattcctcagattattcagcgcattctgactttgccataccagcatacaccaccgcataaattgactaatctttactttgaaacctccgataatcagatgcgtaattgggacatggggctacgtatccgtggcattgactctcattatgaaatgacaattaaaacagcgggtaaagtagttgcggggttacatcaacgcccagaatataatgtgacattaaatgagccaaccctcgatttaacccgtttcccagcagaaatttggccggataagaccgatttaacggcattacaagcacaattaaaggttctttttcataccgattttcatcgtgaaatttggctggtggattatttagagagtcaaattgaagtggtgctagataaaggcactattcgtacagcgcaatatgaattacctattgaagagtttgaactggagctaaaaaaaggccaagtggcggatgtgattgctttggcgacttttttaggtgaacaagggggattacgacttgcttcacgcagtaaagctgcccgtggttattatcttgctaaagataagcccgcattatcgttaagtgtggtcaatcttgcacctaatgacacaatagcggaacaactgactaagtggttagcggctattcaagcgttagaagaagctatttttgctaatccgacgccaccaacactcactatgcccgctatgttagcactgttttctgattggtgtaaaaagcagcctcagttacctgaatcaatgcagcaagcactcgataatctttcgttgttatcctttacccgcgcaacggattattatcatgtgttatggctgaattttaaattatctgcaatggcgtggttgctggctatcgcttaa

SEQ ID NO: 2234 - DNA, 678 bp, Proteus mirabilis
aaaatatctctatccgtgatagattgtcaagaatattttattatgaggacgcaaatggcaaaattagataaagaacaggttattgataacgcattgattttattaaatgaagtcggtatggaagggttaacaacacgtaagttggcgcaaaaattaggggtagagcaaccgacactttattggcatgtaaagaataaacgtgcgttattagatgctttagctgagactattttacaaaagcatcatcatcatgttttgccattagcgaatgaaagttggcaggattttttgcgtaataacgcaaaaagttttcgtcaggcgctattaatgtatcgtgatggtggaaagatccatgcaggcacacgaccatcagccaatcaatttgagacatcagagcaacaattgcaatttttgtgcgatgctggctttacgttaacgcaagctgtttatgcattaagttccatcgcgcattttacacttggttcagtgcttgaaacccaagaacatcaagagagccaaaaagagcgagaaaaagtgccaaaaacagagataaattacccaccattattaacacaagctattgatattatggatagtgataatggtgaagctgcattcctttttgtgctcgatgtgatgatttcagggctagaaacagtgctaaataatcatcattaa

SEQ ID NO: 2235 - DNA, 2904 bp, Proteus mirabilis
gggagctcatatcagatgagaaaatacttatcgcaactttggattatgttgctattgatgctagtcagtatcaacagcttcgcaacagatccactttggcaagtattgccggatagcattgaaaaaagtgaaagtgatccacgtgattatcaggctattaaattagctaatgatatgaccgtattactggtttcagataaaaaagcggtcaaatcattaaccgccgttgctctgcctgtcggtgcattagaagatccagatagccaacaaggtcttgcccactatttagaacatatggtgttaatgggctcgaccaaatacccaaaatcaggggatctgacagagtttttaaataaaaatggtggctctcataatgccagcacaaccacttaccgcaccgcattttatttagaagttgaaaatagtgccattaatgaagcagttgatcgtttggcagatgcattagcggagccattacttgatcctaaatatgctgatcgtgaacgtaatgcggttaatgcggaattaaccatggctcgctcccgcgatggaatgcgtttttggcaagtgagagccgaaactttgaatccggctcatccaagctctcgttttatgggaggaaacttagaaacattaagtgataagccagagagtaaattacaagatgaattagtgaaattctatcaaacatactattctggtaacttaatgaatggggtgatttatagtaataaatcactggacgaactcgctaaattagcggctgatactttttcccgtattcctaataaaaacacccaagcaccagtaacgacggtgcctgcgatgacagaaaaagaaaaagggataatgatccacttagtcccagctcagccacaaaaaaccttacaaatcgaatttggtattgataataatcttgccgattttcgcagtaaatcagatgaatatattggctaccttattagcaatcgtagcacgggaacactagcaacttggttacaagagcaaggattagcagagaatattagtgcttcatctgaatcctatatcgatcgcaatcaaggttcatttaccatttatgtttctttaacagacaaaggccttgctgagaaagataaagttatttcagcgattttttcttatattcaactgatccaaaataaaggggtcagtgagcgctattttaaagaaatagccaatgtgcttgacctctcatttcgctatggctctattgttagagatatgaactatattgaagatatctccgatatgatgctgcgctatccgattaaaaatattcttaatgcggattttattgccgatgactatcaaccttccgcgatcctttctcgtctagaatcgcttacaccagaaaatgcgcgtatttgggtgattagccctaatgagccttcaaataagcaagcctattttgttcatgcaccttatcaagtggataaaattactgcgaagcaattagcttcatggcaggaattagccagcgacatctcattgtcattaccgacactaaacccttatattcctgataatctgtcacttattgatgctgatagtaacatcactaagcctcaactattatggcaagacagtcatgctcggttattctatatgccatcgcactatttttctgatgagccgaaagccagtgtgacgttaagtttagtgaacaaaaatgcagatcgcacagttaaacagcaagttatacaaacattgaccaattaccttgctgatctaacctctagtgaactggcttatcaagcttctgttgccggcatgaatatctcctcttcttctgggcgtggagtcgatttctcagtcaatggttatactcaacatttaccagagctagtaaatgccacactaaaaagctatataacgtttgaagccactcagcaagagcttgatcaagctaaatcttggtatcgtgaacaactggaagtgacgcataaccttaaagcgtatgatgctgcaatgttacctgcccgtcgcttaaatacgatcccttattatgaagaagccgataaacttaaggcgttagagtcgataacgttacaagatattaaagataatcgtcgtgatgtcattgaaaatgcagcgcttcaagcattaattatcggtaatttaacgccagagcagagccgtgagatagttaaatcggcacaggcattattaggtaatacaggaacagaatattggattggcgacacattagtttttgataaattaaatcaagttacattccaaaataaatctaaaagcaccgataatgcgctaggtgaattgtttatccctgttggctatgagcgcctacaaggaaaagcgattacatcagtattatcctctatcgtgcatccttggttctttgaacaactcagaacagaagagcaattaggttatgcggtctttgctttccaagcttcaatgggcgagcagtccggtttaggctttttactgcaaagtaatgctaaaccacctgtttatctcaatgagcgttatcatgcattttatcaacaagcttatgatcgcttgaaaaagctaagtgaagctgaatttaatcaatataaaaaagccattattgatgaagtaaaacaaccaccgcaaacattttatgaagaggtttctctttatcgtaatgatttctatcgtaataacttaaaatatgatggtcgtgagaagtttttagcccaactgaataaggtaacgctaaaacaagcgatcgaattttatgaaaaagcgataattaaaccgacaggactcgtgtttgtttcacaaataatcgggaaagagggtaacaacgctgattatgcgcaaaataaacagtggaaaatctattcaaccgtgagtgaattacaaaaaacattacctgttgaggaaattaaagagtga

SEQ ID NO: 2236 - DNA, 645 bp, Proteus mirabilis
ccagaggaatattgtatgaacaaaaaggaaaatacaccatttttatatacacgtaatgatgttgagctgataagtaaaaaaacacgctataaaggctttttccgtatgaacgagtatcgtttcaaacaccgtttatttaagggaggatggagtgcagaagttaagcgagaagtgttcgaacgtggtcatgcgggtgttttattggcttatgatcctaaacgagacgaagttgtattaatcgaacaaattcgtattccagcttatgaaacaagtcaaacaccttggttattagaagtgattgccggcatggtggaagaaggagaaagccctgaagaggtggtaagacgggaagccacagaagaagcggggatcacaataggtcgttgtaagcccattgtaagttacctttcaagccccggaggaaccagtgagcggatgtatgtctatgtaggggaagtggatgccacaacagcaacaggcatacatgggctagcttgtgaaaatgaagatattcgtgttcatgtcgtcagccgagagcaggcttatcaatgggttgaagaaggaataattgataatgctgcttctgtcatcgcacttcagtggttacaacttcatcatgtcaccttaagaaaagattggttgtga

SEQ ID NO: 2237 - DNA, 552 bp, Proteus mirabilis
aaaagacatctcatatctgacaaaaaatttattttgggttttaaggagtctatcgtgaaaaaattgttatgtgccgctgccctaggaatggcattgacgatgtcagcaggcgctcaagctgcagataaagtaggtgttgtgaacatcggtcaagttctccaaaaagtgcctaaccgtgatgcggtagagaaacaattggaaaatgaatttaaatcacgtgataccgaattgcaaaatttaggtaaagcattacaaactgcggttgagaaataccaaaaagatgcaccaaccatgaatgcgacacaacgtgctaatacagaaaaagatctggttgctaaacgtgaagcttatgcacaaaaagcacaagcttttgagcaagactttagccgtcgtcaagcagaagagcgtaataaaatcatgaaacgtgtattagacgctgttgatgctgtagcgaaaaaagaaggttatgatgtgattttagatgcaaacactgttccttatttcgcagacggtaaagatattactgctcaggttcaaaaacaggttaaataa

SEQ ID NO: 2238 - DNA, 1476 bp, Proteus mirabilis
ggaaacaatctgctagaattgtttctatacaagattaacagaggcaactcagcgaaactgttgcaacaaggaattaaaatgaaaaaactgctctctcttttagtcacgatgagtttgacaggattcagcactgcaagtcaggctgaggatctgctacaagtttatcaaaaagcaaaggacagtaacccagaattacgtaagtcattagctgaacgcaatcaagcttttgagaaaatcaatgaggcacgtagcccattattaccacaattaggattaggcgcttctattgattataaaagtggctatcgtgatgctaaaaataccgagtctaactctcttggtgcgaatttaacgctgacccagactatttttgatatgtctttatggcgtcaattgaccatgcaagaaaaaacggcgggtatgagtgatgttacctatcaaacaagccaacaacagcttattttagataccgcaacagcttattttaatgttctgcgtgccattgactccttatcatttattgaagcacaaaaagagcaggtgtatcgccaattagatcaaactacacagcgttttaatgtggggcttgttgcgattactgacgtacaaaatgcgcgtgcaaactacgacagcgtgttggcacaagaagtggctggacgtaatgaactggataacgcattagaaaaactgcgccaagtcagcggtgtgtattatattaatctggcttcacttaatatcgcacgtttttccaccactccaccagacgccattgataaactgttaaaagacgcagaagagcgtaacttaagtttactcagtgctcgtttaggtcaagatttagcccgtgaaaatattcgtttagcgcaatcaggccatttgccaaccgtaaatttaaatgcttcaacgggtgtctcaaacagtcataatcacggtagtgctttaccaccagaaacacctgctaacagccgtaatagctataatggtcaaagcagcatcggactctctttaagcattccattatatacaggtggcagaacgagctcacaagtagaacaagctcaatatggctttaccagtgccagtgagcagttagaatcggtataccgttctatcgtacaaattgcacgttcttcttataacaatatttcagcctccatcagtagcattaaggcctatcaacaagtggttgtgtcagcgcaaagctctttagatgcaactgaagctggctatcaagtgggtactcgtactattgttgatgtcttaaatgcaactacaacgctttatgatgctaaacaaaaattatcaagtgcacgttacgactatttgattaaccaattaaatattcaatatgcacgtggtaccttaaacgaaaatgacttaattcagttaaataatgcgttgggtgaagagatttccacttcccctgacaacattattcgtccattaacaagtcccgtactgaatacgacaaattaa

SEQ ID NO: 2239 - DNA, 312 bp, Proteus mirabilis
tttgtttttcaacctttaatcgccggccaaggtaataccaagctacaagtgtggacaggtgccatgtatcaagatattacccaacggtttaaaggtaatatcaataatttaaatcttcccccagcgtttgctggcatgatcgccttaatgaacgatcctgatatgaaattcgacgttgaacaacatcttgctcataaatggaaccaaacggtaggggctcgtttagaagtcacccgtaactttaatgtgatcaccgaagtgggctttaataatcgtaatagtttctttgtttctggtgagttccgtttttaa

SEQ ID NO: 2240 - DNA, 519 bp, Proteus mirabilis
gaagcccttcattacatcaattatattttgatgccaatgcaaaacgcgatctttggaaacaaatctatcaacatgaagaccatttccccattaaaccctgctgatttacctttagcatgggaaattgaaaaactaagtcattcattcccttggagcgaagaaacattctatagtaaccaaggtgatcattattttaatctaaaaatttgcattgataatattatggtaggttttgctattacgcaattaatattagatgaagcaacgctttttaatatcgcgatacatcctgattatcaaggtaaaggctatggaaaagcattgttattagaacttattgataatattgaaagaaaagatattgctacattatggcttgaggtaagagaatccaatcaaaaagcatctaatctctatgaatctataggatttaattcagtatctgtacgtaagaattattatccaacagcaacgggaaaagaagatgcgataatcatggcttatccaattaaattctaa

SEQ ID NO: 2241 - DNA, 219 bp, Proteus mirabilis
aacagccctcagtcgaatttagaaacgattagtttactgattttgataaaaaacaatctgaccctgatagacattagggccagatatgttagtcacgagctagcttatcaatgtacacaaccattgtttgttactgacatttataaacttgtccactcattttgctatctagtggcgcaaagctatcgacaatgctacctgcacctgtaccaacattaa

SEQ ID NO: 2242 - DNA, 372 bp, Proteus mirabilis
acggacactcaaagaaatgaggggatcatgcgaattaaattgttattgggagccactgcagcgttgttgttagcaggctgttctgcaacaaatacattgaccagtgcaggttcacaggtacaaattactgatacgcaaccaggcagcgagtgccagttattaggcacagtaaccggcgttcagaataattggttatcaggctctcgtactgaaagccaatcactacgcggtgctgctaatgatttacgcaacaaagcagccgctatgggtggtaatgttatttttaatgttggtacaggtgcaggtagcattgtcgatagctttgcgccactagatagcaaaatgagtggacaagtttataaatgtcagtaa

SEQ ID NO: 2243 - DNA, 1173 bp, Proteus mirabilis
cggcaacatcatcagtggttgccgtcaggggtatggcctgcatcgacttatacacgtgtgactatcgaatcaagtagacccttgaaatatcgccagtttgcgttatcagcaccagatagaattgtggttgatcttgaaggtatccaactgaatagcgttctgaaaggtatggctagtcaagtgcaaacaaacgatccttacttaaaacttattcgtgtcggtcaaaataccccaactacggttcgtttagtgtttgaaattaaaacccccgttcagccacaaatgtttactttaaaacccgttgctgaatttaaaaatcgcttagtgctcgatttctatccaagccatgcggcgacgagtgaagatgatccgctattagcgctattgcgtgaatataacgaaggggatttacaacaagcagtgcctgaacaaacggatacgcgtaagcccggaagagcaggacgagataggccgattattatcatgattgaccccggccatggtggtgaagatccgggagcgatggggaaatataaaactcgtgagaaagatgttgtactacaaattgcccgtcgcttaagagctttgattgataaagatgccaaaatgaaagcttatatgacgcgtaatgaggatgtgtttatccccttaaaagtgcgagtagcgaaagcgcgtaaaatgcaggctgatctctttgtctctattcatgcagatgcatttaccaatcgctcggctagaggctcttctgttttcgcgctatccaaaacaggcgcaacaagtaataccgcacgttacctagctcaaacccaaaatgaagcggatttaattggtggggtgagtcgaagtggtgatcgctatgttgatcacgcaatgcttgatttagtacagaccgcgacaattaatgacagcctaaaatttggtagtgaggtattaaaattattaggtggcgtgaataagctacataaaaataaggtcgatcaagccggatttgcggttttaaaagcccctgagatcccttctattttagtagagacggcttttattagtaatattgaagaagagcgaaagctcaaaacggctaaattccagcaacaagttgctgaatctattttcaaaggtattaaagcctattttgctaatggtggtgaactgacattagctgatcgaggctga

SEQ ID NO: 2244 - DNA, 3390 bp, Proteus mirabilis
aatgaggatctgatgttccatatttaccattcaaatcaattatcactacttaaatcactgatggtacattttatgcaaaatcggccactatcatcgccttttgagcaagaagtgattttagtgcaaagtcccggaatgtcgcagtggttacaaatccaattagcagaaagtttgggtattgctgctaatatccgttatccattacccgctacttttatttgggaaatgtttactcgggtattatcaggtatacctaaagaaagtgcgttttctaaagatgccatgacatggaaactaatggcattattgcctaattaccttgatgatccggcatttaaacccttgctacattatcttaaagatgatgaagacaaacgtaaattacatcaactagcggggcgtgtggcggatctctttgaccaatatctggtttatcgtcccgattggttgtcggcatgggaaaatgatcaactaattgatggcttgagtgacaatcaatactggcaaaaaacactgtggttggcactgcaacgctatacagaagatcttgcgcaacctaaatggcatcgtgctaatctttatcaacaatttatttctactttgaatgatgcgccagtaggggcgcttgcgcactgttttccatcgcgtatttttatttgtggtatttcagcattgccacaagtctatttgcaagcactgcaagcaatcggtagacataccgaaatttatttattgtttactaatccttgccgctattactggggagatattcaagatccaaaattcctcgctcgtctaaatagtagaaagcctcgacattatcagcaacttcatgaactaccttggtttaaagatgaacaaaatgcatcgacactatttaatgaagaaggggagcaaaatgtcggcaatccactattagcgtcttggggaaagttaggtaaagataatctctattttctttctgagcttgaatatagcgatgtgttagatgcttttgttgatataccaagagataatttattacatcaacttcaggccgatatactcgatttagaggatttttcacaaataggtcagacgcttgaggattaccaaagtagtgaaaaaaaacggatcatcgccaatgatgatcgttctttgacctttcatgctagccatagcccacaacgggaagttgaggtattacaagaccaattattgcatctcctcgagcaagatgctgatttattaccgcgagatattattgttatggtggcggatattgatagctatacgccctatattcaagccgtatttggtaatgcgcccgcagagcgttatattccttttgccatttcagaccgaaaagctcgccaagtacatcctgtcttacaagcttttatcactttattagaattacctcaaagccgttttaccgcagagcaagtgcttgcattacttgaagtacccgccttagctgcacattttgccatttttgaaaatgagttgaagctactacggcgctgggttgaagagtcaggtatacgttggggattagatgatgaaaatgtggcctcctttttattacctgtgacaggaaaaaatacgtgggagtttgggttattaaggatgcttcttggttatgcgatggacagtgaggcagggccgtggcaaggggtactgccttacgatgaatcaagtggcctagttgctgagttagcagggcatctagcagattttttatataccttaagtgaatggcgaacacgattaagcgaaactcgcaacttagaagagtggcttgatatcggtcaacagcttgttgatgccttttttgacacagatgaagagacagagctggtattggcgcttatcacacaacagtggcaaaaggtgataaaaaatggtctagaggcgcactatcaacatgaaattccattagtgctgatccgcgatgaacttacagtgcgttttgatgatgagaaaattagccaacgctttttagccggaagccttaatttttgcaccttaatgccaatgcgttcaattccatttaaagcagtctgtttattgggaatgaatgatgggatctacccacgtaatattcagccattaggatttgatttaatggcagaaaaacgtcgtcgaggtgatagaaaacgtcgtgatgatgatcgctacctgtttttagaagcattaagctcagcagaaaaatacctttatatcagttatattggtaaatctattcgtgacgatcgcgaatgtaatccttcggtattgattaaagagttacaagattatattgggcaaaatttccgtttaagggaagatgcatcattaaatgttgatgacagtgcgcagcgtatcatcagccacttattaacccaacatagtcgagtgccttttgcgccagaaaactttaaaacggatgctttatatcgctcttatgccgctgaatggttaccggcagcaagtgggaaagggactgctcaccaagcattttcaacaccattaaataaaaaaattgagaaagtctctttagatgaactatcacgcttttatcgccatcccgtacgcgcttttttccagcaaagtctaaaaacgaattttgttattgaagagaccgagctaccggaagaagagccttttgtcattaatgcattacaacgttatctattaaaccaatggttattaaaagccttaatcgaagggacatcaacagaagcactttatgaacgcattaaagctgctggaaaattaccagctagtgcgtttggtcaaatttattgggagcaacaaatagaaacgttgcaacctttagccgaaaaagtcagaagtgaacgtttagcaacccattctgtcacaatagaataccaatttaatacgatcccattaattggtcgtttaaatgaagtacaagccgatgggttactccgttggcgacccgccacattaacagctaatgatctactgcaattatggatagaacatctcgtgtactgcttaagtggtggaactggcgaaagccgtttttatggtagaaaagagtcgcaatggtgtctatcaccggtgtctgcggatattgcgtattcaacccttgaaagattgatccaagattatcaaacaggtatgaatacacctttagccttattcgccaacagtggttgggcttggttacaagcttgcttcgataaaaaaacacagacgtttttatttgatgatgaagagatacaaaacaaggcagaattggtattaacgcaatatttaaccgatagctataaccgagaaggtgaaatgaatgatatctatattcaacgtgtatttcatcagcttgatgcaccttttcttgaggcagtaaaacagaccacgttagccatatttaagccaatcattccatttataaaaaaataa

SEQ ID NO: 2245 - DNA, 435 bp, Proteus mirabilis
ttatctagtcacttggttaataaaaaggaaaaaactatgagcttatatttatctagtgaaatgatctcttatgatatggatctaaatagaaacgaaggtgaagaaagtaaaattcaagctaaatttattcatggctctaattttacaatggcattttggacatttaaaactaatgccattattcctgaacataaacatgaacatgaaactgccacatccatactaaaaggctctttgaaactgacggtaaataaccgcattgtttatttacatgctggcgactcttttattattccctcatgggccgttcatcacgcaattgctttagagccttctgaggttattgatgtctatacccccgttagagaagactatgttgcaaggcaaaatggcgtcattaaaacctatttagaaacatctcaaccccaaggataa

SEQ ID NO: 2246 - DNA, 1233 bp, Proteus mirabilis
gttttcagtcaagaaaataacggggagagcagtgtggcaaaagcagccaaaagagcctttgtatgtaatgaatgtggtgccgattacccgcgttggcaaggacaatgttctgcgtgtcatgcgtggaataccattacggaagtgcgccttgcggcgacaccttctgcccgtaacgatcgttttagcggttttgccggagatgcgaaaggaataagtcgtgttcaaaagctctctgaaattagccttgaagcattacctcgcttttcgacaggatttaaagaatttgatcgtgtgttaggcggaggggttgtgccgggaagtgccattttaattggcggaaatccgggggcaggtaaaagtaccctattactgcagaccatgtgtcgtttagccactgaaatgaaaaccttgtatgttacgggagaagagtcattacagcaggttgccatgcgggcgcaccgcttaggtttaccgacaaccgaattgaatatgttgtcagaaaccagtattgaacaaatttgtttaattgccgctcaagagcaacctaaattaatggtcattgactcgatccaagtaatgcatatggccgatattcaatcttccccgggcagtgtggcacaggtacgagagacagccgcttatctgactcgttttgctaaaacgaatgatattgccattattatggtgggtcatgtcaccaaagatggcacattagcgggacctaaagtattagaacactgtattgactgttcagtgatgcttgatggtgaaacggactcacgttttagaacattgcgtagtcataaaaaccgctttggtgcggtgaatgagttaggtgtttttgctatgactgaacaaggtttacgtgaagtgagtaatccatcggctatctttttaagtcgtggtgatgaggtgacttcaggcagttctgttatggtggtgtgggaaggaacgcggccattactggtggagatccaagcattggtcgaccactctatgttatcaaatcctcgccgtgttgcggtgggattagagcaaaaccgcttagcaatattattagccgttttgcatcgtcatggtggtttacagatgtctgatcaagatgtctttgtcaatgtcgttggcggtgtcaaagtaaccgaaactagtgcagatttagctttattactatcattagtatcgagttttcgtaatcgtcctttaccgcgtgatttagttagttatttttggtga

SEQ ID NO: 2247 - DNA, 336 bp, Proteus mirabilis
aagtctatccaacccgaaagggctattttagcaagacaatttcaaactaaagtgggttatcaggttatttttgatataaaaacagcggaaaatatagcgataccttttggtgcaatggcttctttgacagatgaaaaagataaacaggtaaataccggtattattgatgcctatcaatctctttatatgagtgggttacccaatgatgggaatgtcgtggtgacttggaataacaatacgggcaaacattcatgtcaatttagttattcagagcttgaaaagattgaagtatcacaacaaaacccaataagaatggtgaccgttaattgtcaataa

SEQ ID NO: 2248 - DNA, 1770 bp, Proteus mirabilis
tcagcaatccatcaatatcggttcaggagaagtaacgtgagctatcaaaattatgtcagtagaaaagagggaaacgaactcggtgcgggttatgttgctaaagttcgagaaaaattcccatcagctattcttgatgaagagcgacaaaccgctgatcaattgacgataacagttaaaacgggatcactgcctgaagtggtggagtatctatattacggtttaggaggctggttacctgttttatttggtaacgatgaacgtagtttaaatggtgattatgccgtctattacgccttatcgatggaagagggtgaaaagtgctggatagtcgttaaagcacacgttagtcctattacacttgaatttccttctgttaccccgcgagttcctgcagcagtatggggagagcgtgaaattcgtgatatgtatggtcttattcctgtgggcttaccggatgagcgtcgtttagtgcttccagatgattggcctgaagatatgtatccgttacgtaaagatgccatggattatcgccaacgtccaacgccaaccacagaaacagaaacctatccgtttgtgaacgaaggcaaacaagatgcgcgtgtcgttcctatcggccctatgcatattacgtctgatgaaccgggacatttccgtttatttgttgacggtgaaaatattgttgatgctgactatcgcatgttctatgtacaccgtggtatggaaaaattggcagaaacccgtatgggctataatgaagtgactttcctatcagaccgtgtctgtgggatttgtggctttacacatagcgtggcatataccacttctgttgaaaatgcgttaggtattgaagtgcctcgtcgtgctcatactatccgttctattttattagaagttgaacgtctacatagtcatttattaaatatcggtttagcaagtcactttaccggatttgataccggtttcatgcaatttttccgtattcgtgaaaaatccatgcagattgctgaaatgctgacgggagcacgtaaaacctacggcttaaacttaattggtggtattcgtcgcgatattttaaaagatcaacgtattaaaactatccaattagtcagagaaatgcgcaaagaagtcactgaattagtcgacatcttactttctgcgccaaatatggaacagcgtaccgttggggtcgggattttagataagaaagtcgcgcgtgatttcagcccggtaggcccgatgatcagagccagtggttttaaacgtgatgtacgctttgatcacccatttgcagattatggcaacttaccattaaccctatttagttatgaaggtggggatgttttctcacgtgtgatggtgcgtattaaggaagtgcttgattctatggcaatgattgaatatgccttagataatctgccggaaggaccgttattaacagaaggctttacctaccaaccttataaatttgcacttggttttaccgaagctccacgaggtgaagatattcactggagtatgttgggtgataatcaaaaattattccgttggcgttgtcgtgcggccacttacgctaactggccagtactacgttatatgttacaaggaaatacggtttctgatgcaccattaattatcggtagcctcgatccttgttactcctgtactgacagggtaacgcttgtcgatgtgaaaaaacgtaaatcgaaaacagtttcttataaagaaattgaacgttatagcatcgaacgtaaaaattcgccgctcaagtga

SEQ ID NO: 2249 - DNA, 519 bp, Proteus mirabilis
aaggagaaccaagtgcgttggctcccattaattgttatctgccttcttatttatatagaagctgtgatttttgtgcatgttgcctcttcaattggcgttcttacaaccctattcctagtggtactgacttcttgtgtcgggatctctttggtcaaaaatcaaggtgtgaaaaatattgcttcaatgcaacaaaaattagccatgggagaagtgcctgcggctgaaatggtgaaaagcgtttcgttggtgttggcagggattttgttattgatccctggcttctttactgatttcctcggcttacttttattgttacccccattacaagcgctattggtaacaaaactgattacgcgtatcaaaatttatacccccggacagggtggaaatggcttttcttcccatcaaggtgggagtacttttgaaggtgaatatcaacgtaaagaagattcacctagtaagcaactgaataataaggatgaacatcaggataatgaccatttttctgataaaaaataa

SEQ ID NO: 2250 - DNA, 483 bp, Proteus mirabilis
ccattaggtcttaactggaatttaaaggcttgtagacgtttcatattatctattatactttggtctatgaaaaatgaaactaatattcgccgtggcagacattgtgtattcctgatgcacgtccatttggtctttgtcacaaaataccggcgaaaaatatttgatcaggatgcaattgaaaaattgcgaggctactttgccagtgtttgtgctgattttgatgttgaactggttgaaatggatggggaacgggatcacgttcatttattgattaattacccgccaaaactggcgatatctaatctggttaacagccttaaaggggtatcgagtcgattacttcgacgtgatcgtcctgatattgcccaacgtgattactacaagggggttctttggtcgccgagttatttcgcggggagttgtggtggcgcaccaatatccattatccgccagtacattgagcaacaggaaacaccgagttag

SEQ ID NO: 2251 - DNA, 471 bp, Proteus mirabilis
ccattgggtcttaactggaatttaaaggcttgtagacgtttcatattacctattatactttggtctatgaaaaatgaaactaatattcgccgtggcagacattgtgtattcctgatgcacgtccatttggtctttgtcacaaaataccggcgaaaaatatttgatcaggatgcccgatgctactttgccagtgtttgtgctgattttgatgttgaactggttgaaatggatggggaacgggatcacgttcatttactgattaattacccgccaaaactggcgatatctaatctggttaacagccttaaaggggtatcgagtcgattacttcgacgtgatcgtcctgatattgcccaacgtgattactacaagggggttctttggtcgccgagttatttcgcggggagttgtggtggcgcaccaatatccattatccgccagtacattgagcaacaggaaacaccgagttag

SEQ ID NO: 2252 - DNA, 195 bp, Proteus mirabilis
gtaaaaaaacatccgttttgcggatgttttatattaatgagtgatataagtgtcacaaccgccaaaaaaagacagttttgtaacttatatcactcatggataaacagtcatcttgagcctatcttttttaaaaaacgcacatccttaaccctttcttcatcagtatcaagacaaaattacttatacttagcctaa

SEQ ID NO: 2253 - DNA, 2484 bp, Proteus mirabilis
tgggacttgcacttttcaatgatttctctcgcttataataaaataagcagggaccggttaggaaaacacaaaacaacgatggcgatgaaaaagttgcttatagcgtcgctgctgctgggcagcgccactgcatacggttcagacggattcgtagttcaggacattcaatttgaaggtcttcaacgcgtcgccgttggtgcagcattactgaacatgcctgtccgagttggagattcggtcagcgatgatgatattagtcgaactatccgttcattatttgcgacaggaaacttcgatgatgttcgggttctgcgtgacggaaatgtacttattgttcaagttaaagagcgtccaacaattgcgagtattactttctcaggtaacaaagcaattaaagaagatatgcttaagcaaaatcttgatgcttccaatatccgtattggtgaaacacttgaccgaacaatgttggctaatattgagaaaggtcttgaagatttctactatagtgttggtaaatataacgccacagtaaaagttgttgtgactcctcttcctcgtaaccgtgttgatttaaaactggtatttgccgaaggtgtttcagctactattcaacaaatcaatattgttggtaataaagcatttagtactgctgaattagttaaccgcttccaactacgtgatgatgtgccttggtggaacttagcggctgatgaaaaatatcagaaacaaaaactcgctggtgacttagagacattacgaagtttttatctagatcgtggttatgcacgttttgatattgaatccacaaacgttagcttaacgcctgataaaaaaggtatttatattactattaacctgaaagaaggtgataaatacacggttgaaagtaccgaaatcaatggtaataccgcaggctataccaaagagattgaagatctgatccaaatcgcaccaggctcactatataacggtgctcaagtgaccaaaacagaaaatgagattaaaaatctattaggtcgctatggatacgcctatccacgggtgatgacaaatcctgaaattaatgatgaaaataaaacggtaaaactgcatgttaacgttgatgcagggaatcgtttctatgtgcgtcaaatccgttttgcgggtaatgatataaccaaggactctgttttacgtcgtgaaatgcgtcaaatggaaggggcttggttaggtagcgatttagttgaacaaggtaaagagcgtttaaaccgtttaggttattttgaaacagtcgaaacggaaacacagcgtattcccggatctcctgatcaagttgatatcgtttatcgtgtcaaagagcgtaatacgggttcacttaactttggtgtcggtttcggtacagaaagtggtgtcagcttccaagttggggtaacacaggataactggttaggaacggggaatgccgttgcgattaatgccagtaaaaatgattactcaacgtatgctgaattgtcagtcactgatccttactttactgtaaatggtgtcagcttaggaggtcgtattttctataacgatttccgagctaatgatgcagatttatccggctataccaataaatcttatgggttagacggcaccttaggtttccctatcaatgaatacaactcggctcgtcttggcttaggctatacccataacggcctgtcacggatggaacctcaagtggcgatgtggcgttatcttgaaagtatgggggaaaacccaggctttgataaacgcgaatcctttaatgcggatgactatactgtcagtcttgggtggacatttaataacttaaaccgtggtttcttcccaacctctggggcaagaagtaatttaagtggacgtattactataccgggctctgataacaagtactataaagtaacttgggacggtatggcttattaccctcttgatgaaaaagagtcttgggtcaccttgttcaaaggtcgtttaggttacggtgacggtttagggggtaaagaattacccttctatgaaaacttctatgccggtggttctggtacagtgcgtggtttccgttccaataatatcggtcctaaagcgatttatttgaaaaaaattgcaaaagatgggcgtacgataattgatccttcattatctagcgatgcggtcggtggtaatgctatggcagtcgccagctttgaactgatcacaccaacgccatttattgatgataaatattcctcatccgtcagaacttcaatgtttgttgatgcgggtacggtatgggataccaactggaacagtactaattctaattggactgctggtatgcctgattttggtaaggcaagtaatatacgtgtttcaaccggtgtggctttacagtggttatcacctttaggtccgttagtcttctcttatgcgaagccaattaaagattacgaaggcgataaatctgagcaattccagtttaatattggtagaacgtggtag

SEQ ID NO: 2254 - DNA, 474 bp, Proteus mirabilis
ccaaacatgcaattgagctctcgccaaatcagagtttttaagctggctatacttttaagtacagggaaaaaagtccccacgattaagattatttctgctcttgaatgctcggagccaacgctcacccgtgttttaaaagaaataagagagtcttatagtgctgaaattaagtacagtaaatcatccagatcgtatcaaatgactgaacgaggtcagcttgataataaaacattacgtcgtatgcgagaggcattatcttcgaatgaagaactacaacatagtggcacaacgagtcgtgtttatttagataaagataagaaaaaatcagtatcactatctttaaaaatgtcagcactacggaaaatagataaactttcgtttttaagaagtacaacccgaagtcagacggttgagtttcttgttgataattatgtagaacatttaattcaagttgctctccaagataaaaaataa

SEQ ID NO: 2255 - DNA, 1500 bp, Proteus mirabilis
atatcacagcagcttttttcctatcagttgatcctcactcgtgggataggaatatgggtattttgttgcggagaaagtatgtcatttagtcgtcgccagtttttacaggcttcaggcttagcggtatgtctgggctcattatcttcatctgttcgtgcaggagcagttagtgatagaaaactacctattcccccattacttgaatcacgtaatggtcagcctctttttgtaacgttacaaaaagtgcattgggcctttgatggcacacaaaaaacagaagtctggggcattaatggctcaatgccgggtccgacaatcaaagtaaaaagcggtgatgatgtcaaactgatttatagcaatcgccttaatgaacccgtttctatgaccgtaagtggcttattagttccgggaacacaaataggtggagctgcaaggatgatgtctccgggagcctattggtcaccggtgttgcctattcgtcaaaaagcgaccacctgctggtatcatgcgaatacgccttttaaaatggcgcctcatgtctataacggattggtaggcatgtggattgttgaagacgaagagagcaaatcgttaccattgcctaaacattatggggtaaatgattttcctattattcttcaagataaacgccttgataactttggaacgccacaatacgacaaagaagccgcgacagagggcttttatggtgacacattattagtgaatggctgtgaagatccctatattgaagtatcacgaggttggattcgtttacgcttagttaatgcctcgaatgcccgacgctatgagttatcggcgaatgatggtcgctcactctatctgatagcctctgatcaaggtttgttaacgtcaccggtagaattgaaatctattcctatggcaccgggtgagcgacgtgaaattcttattgatctatcagaaggcgaagaagtgactatcactgctgggcaaagtgccggatttatggatagattacgtggtatttttgaaccttctaacttattgcgcaataccaatgtgctaaccatcaagcctactggactgatgtcattggttaccgataaagttccacaacagttggtggtggatgacacacaaatcaccacctcaattcaaccgagaacgatccaattgcaaaacagtcctcctggtattaataatgcgcgttgggagttatcaaggatcgatcttgtcggtaaacaaaatggctgggaacgttggctagtgacagtggaaacaccacaaccttttcatattgaaggtgcacgttttaaagtgattaatcatgatggacaaaaaccagcgcctgctgattttggttggaaagatacagtgtggatcgaaaaacagagtgaattattagttgagctaaaacagccttcttattctcatttcccttttgtttattatagccaaatactcgaaaatgcggataaagggattgcggggcaaatggaaatcacgccatcagaataa

SEQ ID NO: 2256 - DNA, 738 bp, Proteus mirabilis
ctcatctggcaacatgcacatacttgcttacgcaaaaggttgaacatgcttaaagataaactaaaattcaaactacaaaaaacagcgattatactgatttgtatcgcattattggcttttttgatgcaaggcgcctcttattttagccgtgcaaatcagcacgcccgtatcacccagtttgaagagcttgccaaaacactggcagaacaagttgccttctcattatccaattatatggatgacagtagcaaagataacgtaaatccacacattatagctaatttaaatcatctaactcacgatagtcgggtactggatgcaagtctttattggcaagatggcacacaaatagcgcatagtggtgaaaatgtgacggtaaaagagcgattggccttagaaggacaaaaaagtggcggttcttttaatcatcagctggtggtgcctatccctggtcaagatcagccaaagggttttctaagattgacgttagatacacaccaacttgtcacagaatctggccaagtcgataacaccaccaatttattgcgtgtgatgctattggttgctctggcgattggttttttactgtcccacagcttattgcaattaacaccagtgcattggcagcaatcgccctatttattaaccgcaagtttacccactcgtcatgaaaaagaagatgatgaacaaaaaagtgatcagcaagaagaaacagaaaatagatctgaagttaaataa

SEQ ID NO: 2257 - DNA, 1116 bp, Proteus mirabilis
ggacaccggcatctcgccatgaataaagtagcattatattgtcgccctggttttgaaaaagagtgcgcggcggagataacggataaggcaggacaaataggtgtttatggcttttctcgagtgaaagagggaagtggttacgtcatttttgaatgctatcaagaaggtgatgcagataaaattgctcgtgatgtggattttagagggcttatctttgcacgccaattatttgtttgtggtgaattattaaagaacttaccaccagaagatcgtattacccccattattgaccagctaaaaggtagtacagaaaaagcaggtgaattacgtgttgaagtcgctgataccaatgaaagcaaagagttattaaaattttgccgtaaattcactgttcctttgcgtaatcaattacgtaaagaaaagatcttattaaaagttgaaaattatagtcgtccggtgatccatgtcttttttattgctccgggatgttgttacgtgggctattcctatagctttaataactcgccattctatatggggatcccccgcttaaaattcccagcagatgcaccaagtcgttcaactttaaaacttgaagaagcgttccatgtttttattccttatgaagagtgggaagagcgcttagccagtgggatgagtgcggttgatcttggggcgtgtcccggaggatggacttaccaattagttaaacgtagcatgatggtgcatgccgttgataatggtcctatggctccttctttaatggaaacaggacaagtgcgccaccatcaagctgatggctttaagtttgagccgacgtcaaagaatattacttggctggtgtgtgatatggttgagaagcctgccaaagtggctgcattaatgacaacgtggatagttaatgaatggtgtcgtgaagcaatattcaacttaaaattaccgatgaaaaagcgttatgaagaagttgcgcatatccttgataaaattagagctgaattagctgagaaaggcattaatgctaaaattcaggctaagcatttgtatcatgacagagaagagatcacggtacatatccaaaatatctgggctgcttatcgtcctgatcgcgagttttaa

SEQ ID NO: 2258 - DNA, 711 bp, Proteus mirabilis
ggtgataggcagatggtaaacaaaatacgcttttttcaatatatttcgttgtgtgttttaggagtattatttttatcatttcaggttcaagccggtgtcggtttaagccagactcgtattattattaatggggatactaatacagcctctattagcgctagaaataataatgcacaaccttatttagtctctaactttataaccgaaaaactggatacctcatcaccacctttgagtggtatgtttgttattactccaaacattttcaggttagctccggaaagtgaaaatacaataaaaattcaaataataccaacaaatcttcctaaagatagagaatcactttattacttccactcgcgaaatattccatcaacaaataaaaatgaagatgggataaaaatagcgatggaaaatattatcaaggtattttatcgccctattaatttagcgataaacccaaaagaagccggtgataaattagttgtaaaagcaacgcctaatgggatcagtattgagaaccctacgccttattatattaatctttttaagattaccgttaaaaatgaaacgataaaattaaataaaattaataatatgatagaaccattttcttctaaaaactatgtggtaagtaataaaacaggtgctgttaatattcatattatcaacgatttaggcggagaaagtgtctacaataaaaaactttaa

SEQ ID NO: 2259 - DNA, 888 bp, Proteus mirabilis
ttgctcaggcaaagtgatcaaaaagcatttgcaataagccataagtgggttttcgtgacagttaattataactgcttatttttattgaaaaaggaatatgacatgagccaatcattacatctaacaacacgtggttcagtgcttgaaattatattagatagaccgaaagccaatgcaattgatgccaaaaccagtcatgaaatgggtgaggtatttatgcgttttcgtgatgatcctagtttacgcgttgccattattacaggtgctggcgaacgattcttttgtgccggctgggatttgaaagccgcagctgaaggagaagcccctgatgcagactttggtgctggtggctttgcgggcttaacggaattatttgatcttaataaacctgtcattgctgccattaacggctatgcttttgggggtggctttgaattagcactggcagccgacatgataatttgttcagacaatgcttcttttgccttgccagaagcacaattaggtattgtccctgacagtggcggtgttttacgtttacctaaacgcttacctcctgcaattgtcaatgaaatgctcatgactggccgtcgtatgaatgcacaagaggcgctacgctggggcattgctaaccgcgttgtcagtacgactgaactgatggatagcgcccgtgaattagccgatcaaatcgccaacagtgcgccacttgcagtcgctgcattaaaagagatctaccgtgccactagcgagctttcgattgaagaaggctacaaattaatgcgcagtggtgttctaaaatattacccaagtgttttacattcagaagatgcactcgaaggcccgctagcctttgccgaaaaacgctcacctgaatggaaaggacggtaa

SEQ ID NO: 2260 - DNA, 228 bp, Proteus mirabilis
ggtgagaggcacatgccggtaatcaaagtacgtgaaaacgagccatttgacgttgctcttcgtcgtttcaaacgctcttgcgaaaaagcaggcgtattagcagaagttcgtcgtcgtgaattttatgaaaaaccaacgactgagcgtaaacgcgctaaagcatcagcagtaaaacgtcacgctaaaaaattagctcgcgaaaacgcacgtcgtactcgtctgtactaa

SEQ ID NO: 2261 - DNA, 1155 bp, Proteus mirabilis
gaggttattaacatggattttagattgaatgatgagcaggaactgtttgttgacggtgtccgcgaattaatggccagtgaaaactgggaagcttatttcgcacagtgtgatcgcgaaagtaaatacccagagcgttttgttaaggccttagcggatatggaaattgacaatctgcttatccctgaagagcacggtggtttaaatgccggatttgttactgttgccgcaatttggatggaattaggtcgtttaggcgcgccaacctatgtgctctatcaattaccggggggatttaacaccgtattgcgtgaaggaactcaagaacaaatcgacaaaatcatggcgtttcgtggtacaggcaaacagatgtggaactcagcgatcactgaaccaggagccggctctgatgtgggtagcttacaaaccacttatacccgtaaaaatggcaaagtttatctcaacggtagcaaatgctttatcaccagtagtgcttataccccttatatcgtcgtgatgagtcgtgatgcggcttcccctgataaacccatctttaccgaatggtttgtcgatatgagtaaacccggcattaaagtcactaagttagaaaaactgggtttacgtatggatagctgctgtgaaatcaccttcgacaacgttgaacttgaagaaaaagatatgtttggtcgcgaaggtaacggctttaaccgtgtgaaagaagagtttgatcatgagcgtttcttagtggcactgactaactatggtaccgccatgtgtgcgtttgaagatgcggcgcgctacgccaaccaacgggttcaatttggtgagactatcggtcgcttccaacttattcaagaaaaattcgcccatatggcgatcaaactcaattcaatgcgcaacatgttatatgaaactgcatggaaaagtgacaatggcttaattacctccggtgatgctgcaatgtgtaaatacttctgtgcgaatgcagcctttgaagtggttgatagtgcgatgcaagtgctgggtggtgtggggatcgcaggtgaacaccgtattgcacgtttttggcgtgatctacgcgttgaccgtgtatctggtggctctgatgaaatgcagatcctgacattaggacgcgctgtactcaaacagtatcgttaa

SEQ ID NO: 2262 - DNA, 930 bp, Proteus mirabilis
atgagtattaacgtagaggtagataataaccataaagaaacaaataaaattaatgacatggtaatattatcttctatctttggtacaaaaaaaataacagaaaaacagctatattttgtattgagatgtgagaataaattaggaaccttaacggcgttaatttcagttagtcaagtcatggataacttatatcctgaaaaaaaaattgattgggaattagtacctgaaaactatttaattgctcttttttcacaatctttatcaacattattatttcctttttctaaagagccaatgtcatcatgtgttgaaaatatctgtttaggtgctgaaaaaggatcttgctatccttgtgtagataccacattaggtcatgtttttatttgcgatattaaatggaaatatgaattgacagtatttccaaaaaataaaataggttttataacaagttttattttaggttacagtaaaatatcactttcattattaaaaacaatattaccaggggatgttttattaatagatgatatccatttttcttttaatgttggtgataaaaaatatttttatttttcatgggatgagggtaattgtgtgacattagatgctatcgttgaaaatagtgaagaaaatgaagaggatgagcaaaacgatgccataatagaagatagcattgatttagctcaatcacttgatttaaattcaattggcgctattccgattacaatatcttttcttttagccaataaaacattatcaattgatcaacttgaagaattagcaccagggaagaaatttattttacctgataatgccattcgtcatattaatattttagcaaatggtaaagctattgcccaaggagaattaatcaaaattaaagatatgttagcggtagaaattaataaattatctataaaatgcgaataa

SEQ ID NO: 2263 - DNA, 984 bp, Proteus mirabilis
caactgattaatctacaggtcttattgttttgtgaacatggtgaggctgatatttttatgggtgattataattcactgtttaaacagcatacggagtgtaatattcatactattacacttattcgtgattccattttggcatctagtcagaaattacaagaaaagctagcattgctggaagaaatggaacatctctttaatgacatgcttatcaatgcagaatcattagtggtcttttttaatgaaattgatgagcattttactcatagtaatgaagaaattgagaattttgctaaatggctaaataaaataaaagatagcgctaataatattgataaactgtcaaatcaagccaatatattatcaattaattcagcaatagaggcaggacatataggtcatgcaggtgcaggattttctgtattagcacaagagatgaaaagcctttcacaaaagatccaaaatcaggcctcagaaatagcgtctatcaacaataatgtaagtgcccgctttacaccaataaaacaaaatactcagaaaaatcaagaacaattgaagcaaataaaaaatcttgttacggaaggtcatgctaatttatctgcgcttgctcaacaagccaatgatttaaaaaatatctttcagtttatgtcgatacaacaattttttaatactgtgaaaatagatcatgttttatggaaagaagcgatttatattcacttattaaataatgatgatgaaaattgtgttaatcagcatactgaatgtcgtttaggaaaatggtactaccaaggtgaaggacgcaaatttgccggtagtgaagcttttcgtcgtttagaagagcctcataaattggttcatcaaagtgggcgtcttgcattggcggcgaatatggccggtgatcaggatgcggtagtgaagtatattcagcaaatggaacaagcgagtgttgatgtcattaaatatattgatgctttacataattaa

SEQ ID NO: 2264 - DNA, 3543 bp, Proteus mirabilis
cctccagttaaaatcttatttttggtatataaaatgaaaatgaaaaataaatcaatattatatatattgtgtcctctctatatatggcctattaattgctacagcaattataatataaatgatatgggagactcaatttataacccttttagtattgcaaataatgcaagtcaatattatgaattcaatcataatagatatgaatacattaaacatctccacggccgtgtcttagataagcatagttacaaccaacagttaatgacgccgtttggaagcacttacatatatgcaacaataagtgatgatacactttcattatataatcgtatagctgatgaaggtgaacgtaatattcaaaaaaagatacctaattataatgttagagaaaccgtttatttctcagaagaactcttaccaaatgaattatttattagtatagatggcggaaagaccataaaaaaaataaataaagaaaataatccgcaattagatcttctttacctttcccatatttcaaaaaatagtaaaactgttgttgggtatgcctttgcaggtgctagagccagattagagcagatggttaaaaataatagtatttttgaagatactatcggttgtggtacatacaatggatgttatgtatttgcctataacgtatataacaatacattttctattttagatagaaatatggagattagatatttaacgaaagatggtaattttattttatatgaatacaaaggtgatgagagaaagaagctatatatttatgatatctataaaaaagaaaacttcgaattaacattcgataacgttaataagtatttagctaatcatctagaaaaagcaattttactttcaccaattactgaatatcctttcttaaagggaataaaaagaagaggtgttgatattcaaaaaatcagtgataatggtcaagtctttattggccagctaaaccgagatttgcctaaaaagaaattactggatagagaatatcctaaagttgcctttatcacaacagcatcaggccctatacgagaacttagtctctctgaatttggatcgacaaaacttgcagatacctcagcagatgggaactatagtgttggctggggagatgtttggcataataattatgcaattaggttacctactagaacaaaaacttcttcagcaatttttagtcaagcattactctatgacttctctaatgataaactcatcaatattggtaacctttctacaaaaaaagaagaatcggaatttagaaatgctagagcacttgatattactgctgatggtaaatatgttgtagggtggtctgaaactgatgagtataacttaaaaaccattccaaaagatctaacaggcactggtcctcatgcctttatcatgtttcatcgtcatggttttatttatttcaataatcatatgtatgacttaggaacacttgacgggggaaaagattcagaagcacatgccatctcagatgatggaagaatcatttatggtgtagccactaatgaacgtaataactggcgtcaagttatttggagaaatgatgaaatcgatgataaatatttcaatactgaacaaaaagaaattgcagatgaaaaagataagcaagctgagcaagaaaaggcggagctagaaaaagcggagcaagagcgcctagccagactgcaagctgagcaggaaaaagcgaagcaagaaaaagcggagcaagagcgcctagccagactgcaagctgagcaggaaaaagcgaagcaagaaaaagcggagcaagagcgcctagccagactgcaagctgagcaggaaaaagcgaagcaagaaaaagcggagcaagagcgcctagccagactgcaagctgagcaagaaaaagcgaagcaagaaaaagcggagcaagagcgcctagccagactgcaagctgagcaggaaaaagcgaagcaagaaaaagcggagcaagaaaaagcggagcaagagcgcctagccagactgcaagctgagcaagaaaaagcgaagcaagaaaaagcggagcaagagcgcctagccagactgcaagctgagcaggaaaaagcgaagcaagaaaaagcggagcaagagcgcctagccagactgcaagctgagcaagaaaaagcgaagcaagaaaaagcggagcaagagcgcctagccagactgcaagctgagcaagaaaaagcgaagcaagaaaaagcggagcaagaaaaagcggagcaagagcgcctagccaaactgcaagctgagcaagaaaaagcagagcaagagcgcctagccagactgcaagctgagcaggaaaaaacggagcaagagcgcctagccagactgcaagctgagcaagaaaaagcagagcaagagcgcctagccagactgcaagctgagcaggaaaaaacggagcaagagcgcctagccagactacaagctgagcaagaaaaggcggagcaagagcgcctagccagactacaagctgataaagaacttccccctgtagaagatgaacaagtacaacaggctaaagcaaaggtaaaagagaaagaaacagcaaaatcatcgacagctatcagtaaaccaatcgatgtagaaaacagctataaatccatgcaattaatggctgaaaatagctataaacttatcgatatgcaacagggtcaattgcgttatttagcttccgccacctgttctgtcggtactgaaaaagcatgtcttagtggcttcacacactatcaaaatattgataaagccaacgctatacaaacgggcattagtggagcttatcgttttgatatcaatcaaacaccattagtggttggtcttgctattgatagcgatagctactcttctttacccacaggctatgaatatcaaggataccctttaccgttaattggttttagcgttgatttaatcccgtcactaaacccaacctcgaatggcaatgcattacatctttcattaaaaggggcatatgtaaaccgcaaagtcacgattaaaagaccaatattagataataccgaagcgggtaaaggccacgcaaagatctccggttattatattgattttcaaggatattatccttgcacactcaataaccttatcactgtaacgccttttgcaggacttacttttaatcaaacatcacgctctgcttatagcgaaacacaagggactaaacttgcagtccattatcaagaacttaatgcacattcattgcttgcaaaaataggattaggaatagagtatacagtcaatgccaaactcaaactggacagcaaagcgggtttattatggcatttatcacatcaccaaggtgacttccaaagtcatattgattatctaggtcagcaaaaaattaactataacgacaacaaaaaacagttagcacagcgtccatttgctagtgtagggctaacttaccaactagataaacagtcatctgttaatacgacaacaaattggcaaatgaccccttatcgtaatcaagatattcatatgggtattggttatacatatcgtttttaa

SEQ ID NO: 2265 - DNA, 2220 bp, Proteus mirabilis
aagatattcctcttgttgtccttaataaagaggaagaaaaggaagaaaaggaataatagtatgaataagattaatcaaagtaatgaacatagtagattagcttcgccttttgtttctgaagaagtaaaaaatgttattaaaaatactactaagcaagcaaatgcaattaataatataagtaattatgtgactactcaacaacagaaggagaatcaaagtaagtttgatataccacttcttagagtacctcatgaacaggagaggaatgcgaaaagaattaatattcaagatgatccacaatataaaatgacgacattttcactagaaaatgatgaagacaatactaagccttccttagcagaagaagaaccgaagaataataaaaaaaaagatgatcatcttgacgtatctgcacaacaaaattcatcattacctacttccagtcccgatcatttagaaaataaaaaatccaacaaagattatgattttttatttttacaattatcttaccagcatgttatacatgaagatattttgaataaaattaaagatccagagaaatttgattattacagagataaattacaaaagctatctaatggcatagatgatttaaaagaactttttaaatctggcttcaatgagcttgataaaaccaaaggtgcttttgttgattactggatggaagtttataaccaaataaaagaaaagaatttcaaaaaagagtctgaagttaaaagttttttaaataattgcaatattcctgattcattaattcaacagttattattaggaaatattcactctaaagtggatatggaaaaagcccttgaagatgttttccctttcttaaactttcctagtgatttttctaagctttcattagatgaactagataatttatctaaaaaattggatggtttttttgatgattcttttaattacctaccaaatatttctttaagtgaagataaaatcaataaaattacttcacatactgatgaattaaaggcattgatcaacaaaaaagaaagtgaatcaataaaaaaacaattagcagaaataagaggtctatttaaagaactgactatttcacaaagttccttggagcttgaaattgcatctaactctttatccggtatgtcattactgacatttctgttatctaagacacgtgagttgacgttaaaggtcatgttacatcgttcggaaagtgaacagaaactttttaatgaaatgcaagaggtgactgaaaaatcacttaaagataaagttgaagagcaaaaatcattaatcaaaaaacaagaagaaattcagttttgggctggtattggtttaaaaatattaggcggattattaacgcttgttgcaggtgtttcttctatttttaccgctggctcttcaatggtattaataggagtcgcaacaaccttatttgttgctgatgctgggttaactattgctgatgaagtgtatcaatctattcataataaatcttttatggatgagattatgcaacccatatcagatgcggttatggaagctatcgataaggttagtgattttctagtgagtttagttaatagttctttggatggactcaaagaattagggctagataaaaaaatcatcgaagagatgaaaaattcaatacaagacaaattgaaaatggcaactaaaatacttgtcacagtcgttttatttgttgccgctacggcattgagttttgttattggacctgccatgaaaggtatttcagatgcggttaataaaatatcgaatcagcaaattagacaaatactaaaaaaagtgctcaatgatggacttgaagcggtattggggaaaatgatcaaagatatcattattaaagcgcttgaagaagcactggaaaaaattgataagcagttagctaaagagatttctaaaaaagcaagtattatgttgaatagaacggtggttgcttctaagttaaccaattcagcagcaacaaatactgttaatatttatggttctgttatcgcgtcaaaaataatccagtctattgccggtagtaaaaaattaactgcagttttagatattattcaaaaattaatggataagataatggaaacttatcatgagaatattgattctataacagatattttaaaaaacctcagcgataaatcttcagtaagtaataaattaaaatcagacatgataagaaatatatctatttaa

SEQ ID NO: 2266 - DNA, 864 bp, Proteus mirabilis
aagcgagctaaccttatgatttattatcccgatgcttttcttgataatttattgctggaagatattcaatatggcgatttgacttgtcgcgcactcaatattaaccatcaattaggcacaataacttttacatgtcgtgaagccggctgcgtcagtggaatcaccctaggctgccgtttattagaaaaattaggactgactgtcaccgcacatctacaagaaggtgattttgccaagcaaggtgattgtttaattagtgcagaaggtcgagcagatgcactacaccaaggctggaaagtggtgcaaaacgtgctggaatggagttgtggtgtgagtgactatatggcaaaaatgctcgaaatctatcatcgctaccaacctaaagggcaaattgcctgtacacgtaaaaatatccctaatacaaaattactggccactcaagcggtacttgcgggtggtggtattattcatcgccaaggctgttctgaaactattttactctttgctaaccatcgtcattttttatccgagccagataattggttacaacaggttacacagttacgccaagcagcacctgaaaaatgcattgttgtggaagcagataacttacaacaagcaagagaagcgttaaaagcgcagccagatatcttacaactggataaattttctattgaagatattaccttactacaacaagaggctccgcagattgccccacgctgtcatctttctgtcgctgggggaattaatctaaatactattgaaaaatatgcccaaacagggatcggcttaatggtgacatcagcaccttattacgcaccacctagtgatatcaaagttcgcctttaccctaaaaattaa

SEQ ID NO: 2267 - DNA, 1491 bp, Proteus mirabilis
aaaacttataacacatacaacccatattcgggagtctgcttgatgtttaaaaacctatttgttgttttacaaaaaattggaaaatccttaatgttaccggtatctgtgctacctattgccggtatcttactaggggttgggtctgcgggactatcatggatccctgtctctgtttctcaagtgatggcagaagcggggggctcggttttctctaatatgccactgatttttgctattggtgtggcgttaggttttaccaataatgatggtgtctcagctcttgcgtccgtcgttgcctatggcattatgtcaaaaaccatgctggtggtggcaccttgggtcttaggattatctcctgatagtgttgaaatacaacgtttaactgatacgggggtactcggtgggatcattgccggtattattgccgcatcaatgtttaaccgcttttatcgtattaaacttcctgaatatttaggcttctttgcaggtaaacgttttgtacctattatttctgggctgattgcgatttttgtcggtattcttttatcctttatttggcctcctattggtactgctattcaacgtttttctgagtgggctgcgtatcaaaatccagccgttgcatttggtatttatggtgttgttgagcgtgcgttagtgccatttggtctgcatcatatctggaatgtaccattccaaatgcaagtgggtgagtatgtaaatagcgcaggacaagtgttccacggtgatattccacgttatatggcaggtgatccaactgcggggatgttatcaggtggcttcctatttaaaatgtttggtctacccgcggcagccattgctatttggcatacagcacgccctgaaaaccgtgtaaaagttggtgggatcatgatttctgcggcattgactgcctttttaacagggatcacagagccaattgaattctcatttatgttcgtagcacctattctttatgttattcatgccattcttgccggtttagcatttgttatttgtatcttgttaggtatgcgtgacggtacaagtttttctcatggcttaatcgactttatcgtattgagtggcaatagcagtaaactgtatctattcccaattattggtatactttatgcgataacttattactctatttttcgtttcttaatcgtgaaactcaacctgaaaaccccagggcgagaagtagaagataaaaacgcgaaacaagcggataaaagtgcgatgggacaatctttagtcgctgctttcggtggtaaagataatatcagtagcttagatgcttgtattacacgcttgcgtattggtgtaaaagagattgataaggtcgatcgtgatgagctgaaaagactgggagcggctggtgttgtggtggttggatccggtattcaagcaatttttggccctaagtctgataatttaaaaactgaaatggatgaatatattcggtctataggtacaactgaaaaataa

SEQ ID NO: 2268 - DNA, 1008 bp, Proteus mirabilis
ttacgatataaaatgaaaaaaaaacgcccctcattacaggatgttgccgaccgtgttggtgtcacaaaaatgacagttagtcgttttttgcgtaatccagaacaagtttccgaagcattacgagtcaaaatcgctcgtgaattagacagcctgaattatattcctaatcgtgcacctgatattttgtcgaatgcgaccagccatgcgattggcgtattattgccttctcttactaaccaagtgtttgcacaagttattcgtggcattgaatctgtgacggataaatatggttatcaaaccatgttggcgcactatggctatcaagcagaaaaagaagaagagcgtcttatttctctgctttcttataatattgatgggttgatcttagcggagagaacacacacacccaaaacggtcaaaatgctggaaacggcgggtattccggtggtggaaattatggatagtgtttcaccttgttttgattcggcggtagggttagataatattgaagcctcgcgaaaaatggtcagtgaaatgatccaccgtggttgtaaacgaattatctatcttggggcaagacaagatgagcgaacattaatgcgtttacaagggtatgaacaagcgatgcaagaagcaggcttacccataggtcatgtgatgacacctaaaagctcttcttattcgttaggtacagaacttttacatgaggcacgcaagcaatatcctgacttagatgggctctattgcaccaatgatgatattgcgataggggctattttcgaatgtcagcgtatggggattgcggtacctgagcaaattgctatttccggtttccacggtcatgatgtgggacaagtcatgactccacggttagccagtatttttacgccacgtgatgaaatgggacaacaagcggcggatttattactaaaaagaatgaagggtaaaattgctcgtgggcaagtgattgatgtgggattccgtatcatcaccggtgaaagtatttag

SEQ ID NO: 2269 - DNA, 1401 bp, Proteus mirabilis
aattttaataagaaggttctcatgtcaaataaaactcgtatcgaagaagacctgttaggtaaaagagaagttcctgctgatgcttactacggcgtccacactttacgtgcaattgaaaacttctacatcagtgatcgtacaatcaatgatgttccagaattcatccgcggtatggtcatggtgaaaaaagccgctgcattagcaaacaaagagcttcacactattcctcgcgaaatcgctgatacgattatcaaagcctgtgatgttgttttagaaacaggcaaacacatggatcaattcccagttgatgtattccaaggtggtgctggtacttcattaaacatgaatactaacgaagttatcgcaaacatcggtttggaattaatgggtcatcaaaaaggtgaatatcaatatctgaaccctaacgatcacgtgaataagagccaatcaacaaacgacgcttatccttgtggtttccgtatcgcagtttataactctgttattaaattaactgagtctattgagctactgaaagcaggttttgatagaaaagcaactgaatttgaagacatcctgaaaatgggtcgtactcaattacaagatgctgtaccaatgactttaggccaagaattccacgctttctcagtattaatgaaagaagaaatcaaaaacctaaaacgtactgctgaattactgttagaaatgaacttaggtgcaactgctatcggtactggtttaaatactgcacctggctaccaaaaattagctgttgaaaaattagcagaagtaactggtttaccttgcgttccagctgaagacttaatcgaagcaacctctgactgtggtgcttacgtgatggttcacgctgcattaaaacgtctagcagtgaaaatgtctaaaatctgtaatgacttacgtttactttcttctggtcctcgtgccggcctgaaagaaattaacctgccagaattacaagcaggttcttcaatcatgccagctaaagtaaacccagttatcccagaagttgtgaaccaagcttgctttaaagttatcggtaatgatacttgcgtcaccatggcagctgaagcaggtcaattacaattaaacgtaatggaaccggctattggtcaagcaatgtttgaatcaatttctctattaagcaacgcttgccgtaacttagttgaaaaatgtgttgatggtatcactgctaataaagaaatctgtgaacacttcgtatttagctcaatcggtatcgtaacttatctaaacccattcatcggtcaccacaacggcgacatcgttggtaaaaattgtgcagaaacaggtaagagcgtacgtgaagtggtattagaacgtggcttattaactgaagaacaactggatgatatcttctcttgttga

SEQ ID NO: 2270 - DNA, 1227 bp, Proteus mirabilis
acaggaaataaaagtaacaccagtggtggactttgcctcatgatacgtaaggttttattcttattctcattgttcttatttagctttagcgtgatagtgagtgcatcagcgaatgatattcctcaactaaaaacagatagagtgattgatagtgcaaatttattgactgcacaacaattcaaagcgttaaatactttattggttaacttcgaaaatagtcgtaatgatggatcacaatttgttgtctatatcgttccaacgacagggaaagaaaccatcgaatcctttgcttttcgtgtttttaatcaatggaagataggcagaaaagggaaagataatggattattgctcgtggtggcaattaatgatcgtaatgttcgttttgaagtcgggtatggctatgagggagcattaactgatgtactggcaggacgaattattcgcaatgaaatgttgccattttttcgttcaaataattattatgcaggcatcgaacaaggggttaaaaatgctattcaagccgttaatcatgaaccaataagtttcactaactcacagataaatactaatacacttaaaatattccacacacattttatcctaatttatttggtaatattaggcggtgtttattggtttcagttgatattctcgacgcgaaaaataaaaaccaaaattaatcaattattagcgcctagaggaagaaaaaagaaaaatccagcagaccaaaaaggtaagttaagtataaagcaacgtaaacagttgaaaaattatctgcaatattcgtactattttcctacattttcaacgttatttttccccatgacactctgttttgcggcggcgatgttttatacacaagtctttcttgatggtattattgataattttgttttagtgataatagtcatattgtcattattatgtaattttatcgtattagtggttttatttggtattatcaacctgttatttccaatttatcggcaacaacgaaaagaatggaaagcgatttgtgtcgctagtccgtttggttcaccgtttaatcaactgccatattcaaaacgtattcgtagacgtagtggttattcaggctctggtggttattcgagttcgtcttattcatcaagttcatcaagttcatccagctcttctagttcttctagttcttctagcggtggcggcggtggttcgagtggtggtgggggtgcttcagggagttggtag

SEQ ID NO: 2271 - DNA, 549 bp, Proteus mirabilis
catttttgtaacataaagtgcaaatataataacgactacaaggatcctcatgtgctaacgattatcggattactcattattatttctattgtgacattactaatgatggggaaaacaagcccaattattgcaatgtcggtcataccattaattggtgcgcttgtcgcaggttattcatttactgaaatatctactttttttgaattaggtattaaaaaggtgagtagtgtcgcaacgatgtttttatttgcgatacttttttttagcataatgaaagatctgcatatttttaaccctctgatccgtatgatgatcagtatcacccgtggcaatgtcattatagtgtgtattgtcacagcgttagtcgcggctgttgtacatttagatggttcgggtgcggcgacattcttaattattattcctgcttttttaccgctatatcgccgtttaggtatgagcccttatcttatgttgctaattatgtgcaccagtatgggggtgatgaatatggtaccttggggagggcctttaggtagagcctcgctgtaa

SEQ ID NO: 2272 - DNA, 552 bp, Proteus mirabilis
aaggttggtaatcatctcacaactcaacttaataataaaaaaggcggacatttgttcgcctttctcttttttactgggctaatttgcattaaattagggcggtttaatttttgtatagacaataataaagaggatatacccatgcacatgcgcttgctacttattggcattatagcgctgtttatgaccggctgttcaatgcagaaatcatctgatgttgatcagtctaagtttacggatatgcgtttaaataaacctggccaaccacaaaagcccaaacagcaaactttatctcctgttcgcattgttgaaaaaacagaagatcttttaggtgcgccttttaaagatttaggtgttgttgccggtgaatcttgccgacaaacactacaagatccacccgcaagcttacctgctgcgaaaaaaagaatggctatcaaagcggcttataaaaatgcgaatgcagttttattacatgaatgccaaatagtcacaggaatgggttgctatcaatcggcaatctgtgaaggttcagcactattaattactcaatga

SEQ ID NO: 2273 - DNA, 867 bp, Proteus mirabilis
catccctgttttccgccttgctatccctacattgataaattaattatggctacttatttaattggcgatgttcacggctgttatcgtgaattacgccaacttctcaatcaagttaatttcgacgccaatcaagatacactttggttaacgggggatctggttgctcgaggacctgattcacttgaagtattgcgttttgtcaaaagcttaggctcagcgttaaaactcgtattagggaatcacgatctgcatctactgggggtatttgcaaagattagtcgtaataaacccaaagataagcttaatgaattactcaatgcaccagatgctgatgaattaattaattggttacgacgtcaaccgctattacaagttgatgaagaaaagaaaatcgttatggcacacgcaggtattatccctcagtgggatttagcaacagctaaaaaatgtgcccgagaagtagaagccatattaagtagcgatagttacccccttttcattaattccatgtatggtgatatgcccaataattggtcacccgaattaactggcttaccgcgattacgctttagcaccaatgcttttactcgtatgcgctattgttttcctaacgggcagttggatatgatttgtaaagataagcctgaaaatgcgcctgcgccattaaaaccttggtttgatttacctaatcaactaccaaatgattacagtattatctttggccactgggcctctttagagggaaaaggcacccctgaaaatatctatgcgctagatactgggtgttgctggggcggtgttctaacctgtctacgttgggaagacaaacgttattttatccaacctagtctcacacacttaccatag

SEQ ID NO: 2274 - DNA, 1506 bp, Proteus mirabilis
gttgttatcaagggatacttttcagtatccctctttaaaaaagagaatgtcactatgcgtaagacaaaaattgttgcgactcttggccctgctagttgctcagaacagatgattgaaaaactgattttagctggcgctaatgtatttcgtttaaatttttcacatggtactcgcgaacagcatcagtccacagccgcaactatccgtcaggtcgcaaaaaaacatcgtgtatttatcggcattttagctgatctgcaaggccctaagatccgtatagcgagttttaaaaataatgctattcaattaacacaaggggatagttttatcctcaatgcagatttagacagcacacaaggcgatgaacaacaagtggggttagattacccacaacttgtacaagaagtcacaccagggaatattctgttacttgacgacggtaatatccaattaaaagtccgtgcagtaaataataataatattgagacagtggtcactgtcggtggaaaattatctaaccgtaagggaattaatttactcggcggcggtttatccgcaccagccttaacggacaaagataagcaagacatacacacagcagccgctattcaagcagattatatagccgtttctttccctcgtaacggtgctgatattgaatatgcccgtcgtttaattgttgctgcaggcagtcaggcaaaaattgttgccaaagtagagcgtgcagaagtcgtttcatgtcaagccaatatggatgacattattaaagcatcggatgtcattatggtagcgcgaggggacttggcggttgaaattggcgatgcctgtcttcctggtgcacaaaaacagttaattgctcgttgtcgtgctctaggctgcccggttattacagccacccaaatgatggagtccatgattgaaaatcccatgcctacccgtgcggaggtgatggatatcgctaatgcagtaggtgatggcacagatgcggtgatgctttctgcagaaacagctgcaggtaaatatcctgaagaagccgttcgtgcaatggctcgtgttgcagaaggtgcagagcgctcttttgccgccaatgccgaaaacccatggcaatccccttcttactattcacaaacaggccgttggattgctttagcggcgaccacagcagcttttcataatgataaacatctgagcgttgctgctttaactgacaatggtcaatcagtcacgcttctatcgcgctttatgccaaataacaatatctatgcattaacagataaccccgcacttgctggtcagttgactgtattacgtggtgtaacgcctgtcacttatcaacgtcaaaataataatgatggtgatgaaaacatcatgcaaaaactgcaaacagagggattattaacagatattcattcactcttaatcacccgtttatcgacctttgaaaaaaccggtgaaagtgactgttgtcatctggttccggtaaaacaagttacaacagctttaacttaa

SEQ ID NO: 2275 - DNA, 519 bp, Proteus mirabilis
aacagtaacaatgacaaggaaaacaagcaggaggcatggatgacaggcaatcattattcccactctaaacatttagggagtagcttattcgaggtgcttattgttatggctatagtagcaatattgagcgctttatctttgaactcatatcatcagttgttacgccaacgccagttagttcaaagtgtaagagaagtgatggcgtttttagcttatcaacaacaacgctcactgctctttaattgcaaagtgcaaattgtattgtggctatcacccatcaataaaatagaggcaaaatcgttaacaacacccacaaccaaagaaagtattcaattagggttaagcaatcagcttattcgctctacagcaacacgctttacattttgtggcttacgccaaacgttacgaccgatgcattttgtgctgtcaaatggtgatgaagaggtcaaaattattatctcttcattagggcgtattcgagcgtgcagtcagacaataaaggcattttcagtatgctaa

SEQ ID NO: 2276 - DNA, 1386 bp, Proteus mirabilis
ttatctggcaaaaaaagagtcaataaacttagtaacaagcttattgataatccattaaatttttatatgaacagggatccttcaatgcacctcattatgagcttggtcggaatggccacattgatattgatagccattcttttctccagcaaccgacgtgcaattaaattacgcacggtcggtggcgcattccttattcaaattggtttaggcgcatttgtactttattcagaaagtggccgtaaagtgttattggctatttctgatgccgttaaaaatgtcatcgattatggtgaaaacggcatgagcttcctttttgctggcttagtttccgacaaaatgtttgagctatttggcagcggtggctttgtttttgctttgcgtgttttacctgttattgtgttcttctcttcattgatagcagtactttattacttaggtatcatgcaatttgtcatcaagattttaggtggcggattacaaaaagtattaggcacttctcgtactgaatcaatgtctgcaacagccaatatcttcgttggacaaacagaagcaccactggtggttcgcccctatattgctagaatgacaacctcagaactttttgcggtgatgtgtggtggattagcatcagtggcaggttcggtactggcaggttatgcaagtatgggtgtgccattggagtatttgatcaccgcttcatttatggcggcaccaggtggtttactctttgcaaaactcttggttcctgaaacagaaacacctgatgatcaaaaagatgcttttgataacttaagtgatgaagaaaaacccgctaatattattgatgctgcggcatcaggggcttcttcaggattacaacttgcgttaaacgtaggtgcaatgctactcgcttttgtcgcattaattgccttaattaatggtattcttggcggaattggtggctggttcggttatgaagacttctcgctagaattaatcttaggctgggtatttgcaccaatcgccttcttaattggtgtgccttggagtgaggcaaccattgctggctcttttattggtcaaaaactggtgatcaacgaattctatgcttactcggagtttagtaaatatctgcaagatgaatcacaattagcagcagcaggcttaatggccttgtctgaacaaacaaaagtgattatctcttttgcgctgtgtggatttgctaacctttcctctgttgcggtattactgggtggtttagggggaatggcaccaaaccgtcgtaaagatgtcgcacgcttaggtatgaaagctgttttggcgggtacactctctaacttaatgagtgcaaccatcgccggcttcttttttgcattaaccgcaatggctgtggttgctgcttaa

SEQ ID NO: 2277 - DNA, 558 bp, Proteus mirabilis
acgatgttaaaattgtttaaaaccattatcaaaacaggcgatgcaacaacaaaatatccttttaaaccattagaactccctgatggttttagaggaaaacctgagtactcacctgagcaatgtattgtttgtggggcttgtacttctgcatgtcctgcgaatgcactgaccatggaaaccaacctcgaaacgggtgaacgtcactggcagttatttattggtcgttgtatttattgcggccgctgtgaagaagtctgcccaactcgggcaattgtattatcagatatgtttgaaacggcagtcacacaaaaatcagatctttatattaaaggtacatttaaattattaagctgccgtgagtgtcatcaaccctttacacctagaaaatctgttgattacgctatggcactgctggtgcaatcgggttgggatgcacaaactgttgaggcaatgcgtccacaatttgaaacttgcccagaatgtaaacgtaaacataacctactctctgatggtcaagaaaatattagtatgggcaatgtcgggagtgtgaaaaaatga

SEQ ID NO: 2278 - DNA, 951 bp, Proteus mirabilis
tgcaatataaaaacagataactattcccttcacctgcaaatgacgaggttattgcgtatcgatattaaacagttattttatttaatcgctttggataaaacgcaacattttggtcaagctgccgagatgtgccatgttacgcaacctaccttatcaatgcgattacgtaatttagaaaaagagcttgatgtggttcttatcaagcgtagctctcgctttgagggatttaccgaagaaggcgagaaaatattaaaatgggcgaaaactatgcaatctgcttacgatggattacaagcagaagccgctaactttcgacagcaactatttgggcaactgcgtataggtattgtgcctttaaccaatttaaatcctatgctgatgttgcagaaaatatcggcactattccctgagataagttttcaagtgctctcaacgaatagtgaaaatattatagatcgacttaatagtaatagtcttgatattggtatctgctatttggaaaaagcgaatactcaacagcatgaaatttatgcattaaaacaaacggagttagggcttttatttcatcgcaatcactttatgccttcaacaagaactatctcgtggcatgaagcggttaaacaaccattggctttattaaataaagagaatcactttaggcaatccgtggatttagcttttcagcgttataacttacaccccaaggtgttggtcgaaagtagttctacattacatcttatacaatcagttaatgcagggttttgcgcctcgattgtccctattgctaaaggtatggaaaatctcagccaagatctagatgttgtacctattgttgatgcaaccattaatgccccattggggattgtgatccgcaaagaagagccgcgctctatattaattgaaaaatgctttgcacaaatgcgtacttacttagaaagtacaggtctatag

SEQ ID NO: 2279 - DNA, 711 bp, Proteus mirabilis
agaggtcaaaattattatctcttcattagggcgtattcgagcgtgcagtcagacaataaaggcattttcagtatgctaaagcgtcctttgtctattcaacatcatgattttgcgggttttatgttgatggagtgcctctttgtgatgacgataagtagtattttattagtttgtattggacgtgcttatccttatattatcaatgagttaacttcttcttatcaacaatatcgtttagagatttatctaaaacagcgtttgcagttactggagacgcaattaaggcgagcagggtactgcaatggtgattgcactgttaaaaaagcttctttacctgcatcacttaaaataggtcattatccttatcaccctcatggctcttgtgttttgtttgtttacgatatgaacaataacggccgttgggagagtccagaagaacaagagagtgattactttggttttagattaaaaaacggtcagcttgaacaacgtcgtggtgtgcaaaattgtgattcaacaggttggcaacagatcttcgaaaaagaagaaattgaggtgacagaatttatcttaactccctatacacactattctccaataaaaaaacgtgcatttaactatctatcattatcattaaaattccaagcaaaacaaaatattaacctaaaagtacactatcaaacatcaatactattaaggaatatttcgtga

SEQ ID NO: 2280 - DNA, 324 bp, Proteus mirabilis
ttaaataaaaatatcattgtgtcgataaaaaataaatcttatcgatatgcgcatataggtatttttatcatgagtattaaacgaaccgtaaaattaggctcttctttactgttattgatttttattctatcgtctgccttatcttcattttttatttataaaatgcaaaacaattttactcaagttgatgtcttatctgcacgttatgacgatgtgttgatggctcgttatcaactggctattatgcgttctaatgtcaattatctattacaagacaaagatagtcgtgtcgcagatcgtaacaaaattattcagcacaaataa

SEQ ID NO: 2281 - DNA, 594 bp, Proteus mirabilis
cattacaaaaaagttaataactgcctaaaggagcaatatatgaaagatacccaatccctacaccatgtctttatcttaatgggggtatcaggcagcggtaaatcagcggttgcaaatggtgtagcacaacgtatcggtgcggcatttttagatggcgatttccttcatcctcgtgcaaacatcactaaaatggcttcaggtcatgctttaaatgatgaagatcgcaaaccttggttacacgctctcaatgatgctgcttttgcaatgcaaagaaccaataaagtgtcattaatcgtttgttccgcattaaaaaaacagtatcgcgatatgttaagagaaggcaatcactgcttacattttctctatttaaaaggggattacgcgctaattgaaagtcgtttaaaagagcgtaaaggtcacttctttaaaccacagatgttgattactcaatttgaaacattagaagagccaacgaatgacgaacctgatgtttatgaaatagatatttcgccatctcttgataacgtgattgaaaatgtcatcaacactatagaatctgttactaaacctattactgaggagagtgcggtatga

SEQ ID NO: 2282 - DNA, 873 bp, Proteus mirabilis
ctaacaaaaaagagagactacatgaagcagtatctggcattgtgtcaacgcattatcgatgaaggtgaatggattgataataaacggacaggaacccgttgtttaacggtgataaatgccgatctggaatatgatgttgccaataaccaatttccactcataacaacgcgtaaaagtttttacaaagccgcgattgcggaactattagggtacttacgtggttatgataatgcagcacaatttcgtgctattggctgtaatacgtggaacgcgaatgctaatgaaaatagcgcatggttaaataatccgcatcgtaagggtgaagatgatatgggccgagtctatggtgttcaaggacgccaatggcaacgccctgatggctcgcactttgatcaattacgtaaagtggtagataacttaactaacggtattgacgatcgtggtgagatagtcactttttataatcccggagaaacagcgttagggtgtttacgtccatgcatgcatacacatactttttcattgctcggtgacaggctttatttaacctcatatcaacgtagctgtgatgtcccattagggttgaattttaatcaaattcaatgctttgtattattagcgctggtggctcaaatcacagggcataaaccaggtaaagcattccataagatagttaatgctcacatttatgagaaccaattacctctgatgcgtgatgttcaactaaaaagagagccattgccattacctaagctacatattaatccaaacattaagacattagatgatatagaaacttgggtcacgacagatgactttagtgttgaaggttatcagtgtcacgaggcgataaaatacccgttcacggtgtag

SEQ ID NO: 2283 - DNA, 948 bp, Proteus mirabilis
cctatgaaaaataataccgattttcgcttcatattagtgatgcgaaaaagtcgcctacaagaattaattgagcgttttaacacttggtcacaagccaaattctatttagaacataaccatgttgaggtaacagattatcttaatgaacataatctctatcaaaaacaactcacagaagctgagcttattttaaaatcatttgggcgttttcagctcttggaaagaggattattgcctagttatcaattttcctctcatgatattgtagtggtaataggtcaagatggcctcgtcgctaatactctgaaatatcttaatcaacaacccgttattgctatcaatccagatccttcaagatgggatggtaagctcttgccctttgaaatagggcaattgaaagagattataattaatacaataaatcacaaaatgccttttaattcggtcacttttgcacaagcaaaaaccaatgatggtcaatcactgttagcggttaatgacttatttattggccctaaaagccacacttccgcacgttatatcttacaatggggagactctcaagaagtgcaatcctcatcaggcattattgtatcaacgggacttggctctacagggtggtttcaatctattcttgctggagccatggccatcaccggaaaagcatcacaccctcttttacaagggtttagctggagtgataaaaaattacaatttagtgtaagagagccatttcctagtagaacaacaggcaccgctttaacttttggcacgattgagccggactctccattgcaattaggatctttaatgcccgaaaatggtgttattttctcagacggcattgaagaggattatttacattttaatgctggctgtattgtgcaaatcaatatcgcagatagacaagggcaactcatcgcccctaaggggcgtcagcctatttaa

SEQ ID NO: 2284 - DNA, 207 bp, Proteus mirabilis
ttacagagaaatttaaaatttttgaatataaataaaatatttatcgtctatactttaataagtaacaactcattgagtgagatatttttatttggttttaatgattatcaatcagatatcttttctttgaccatgactctcaatttatttaggaggcgatatggaacagaaaataattgttatgggggcagatccttcaggttatga

SEQ ID NO: 2285 - DNA, 702 bp, Proteus mirabilis
aacgggggaaagctttatctcccccgttattttgctgagatatccactatgatggaagtttataacccccccactgatccttggttacacgttttatatcaagatgagcatattattgttgttaataaacccagtggattgctatctgtacccggcaaagcgctagaacatcacgacagcattatgtcgcgtataaaagccgattttcctgatgcggaatctgttcatcgccttgatatggccacgagtggtgtgatggttgttgcgcttaataaagccgccgagcgtgaattaaaacgccaatttcgtgaacgagagccgaaaaaaacctatattgcccgtgtctggggaaagcttgaaaaaccacaaggattagttgatctgccgttgatctgcgattggcctaatcgacctaagcaaaaagtatgttatgaaacaggaaagtctgcacaaactttttatgaagtgttggaatatgaagaaaatgcaacgcgggtaaaactatcaccaataaccggacgctcccatcagctacgggttcatatgctagcattaggtcatcctattttaggggatcgtttttatgcccatccgcaggcaagagcactcgcacctcgcctgcagttacatgctcaggaattatttattacgcatccggcctttcattcaccgatacattttgaatgcctggcagatttttaa

SEQ ID NO: 2286 - DNA, 333 bp, Proteus mirabilis
aaaaataccctattagaaataccctcatggtttaattggaactttctcgaggcatggggggcaacaccaatgcagataatcaagaaagttttattaccagaatctttaccaggtttaattaatgctgcgaccattacactcattacattagtcggttattccgcaatggggggcgctgtgggtgccggtggtttaggtcaaattggttatcagtatggttatgtgggctataatgccacagtaatgaataccgtcattgtactacttgttattcttgtttttatcattcagtttattggcgatcgtttagttaaactgacaacacataaataa

SEQ ID NO: 2287 - DNA, 1032 bp, Proteus mirabilis
aataggctgaataacaattattttgttcagacaggggaaaacaggagaataagtatgtcaaatagtctgacctattgctatttaccggatgagatccgtaaatggccaggtctaccgctatcactcagtggtgaagaagtgatgccactggattatcgtgcaggcgatagcggatggttactttatggacgagaacttgataaaaaaagaataagtgagttccagcataaattaggtgtggctattgtggtggtttcttcatggcgtattgatgattaccaagtggtacgtattgcgggaagtttaacccgtcgtattcgtcggttatctgatgaatgtggtttagatgttgtaccctttgggcagatcccacgtttacgctctccgggacttttagtgatggatatggattccactgctattcaaattgagtgtattgatgaaatcgctaaactggccggtgtcggtgataaagtggccgagataacggagcaagcgatgcaaggtgaaatggattttagtgaaagcctaaaattgcgtgttgcacaattagcgggagctgatgcgaatattttacaaaaagtaatggataatttacctctgatgcccgggttaacaagtttagtgcgtaagcttcaggcaatggattggcaaattgcgattgcatcagggggatttacttattttgctgataacctaaaacagcgattacgtttagttgcagcggttgctaatcagctagaaattaaagatggtaaattaacgggcaaagtcaaaggccctattgttgatgctaaatataaagcgcaagtgcttacacgcttagctaaagatttagatataccgctggaacaaaccattgcgataggtgatggcgcaaacgatcttaaaatgcttagaaaggcgggtttaggtattgcctaccatgccaaacctaaagtatatgcacaagccaaagtagctattcgtcatgctgatttaatgggtgtgatgtgtattttaagtgcaggattaaagcacgaagaacgataa

SEQ ID NO: 2288 - DNA, 2373 bp, Proteus mirabilis
atactcatgaaaaaaagttatcccacactgctggccaccttagtttgggccacaatttatgctcagcctgcatatgctgatcttgcctctcaatgtttactgggagtccctgtttataataagccattagtcgaaggcgatcctaactcattacctgtcaccattacggctaaggatatgcagggggaatacccacgcatgatccaatatagaggcaatgtagacattaaacagggaaatcaaacattaagcgcagataatgttgagttgacccaaacagaaggtgaaacaccattaagaatggtcaccgcgacaggtaatgtctcttatgatgatccacaaatcatcttaaaaggcccacgtgcttggtctaatctaaataataaagatactgatatcgaagaaggtaaataccaaatggtgggccgacaaggccgtggctacgcgaataaaatgcaaatgcgtggcgaaaaccgctataccattatggataaagggatgtttacctcttgtctacccggcgacgatagttggagtgttgtcggctctgaggttatcttagatcgtgaagagcaagtagcagaaatttggaatgcgcgttttcgtgttgctaacgtcccagttttctatagtccttatctgcaattaccgattggcgataaacgtcgctctggtttcttaattcctaatggtaactattctcgtagttctgggtttgacttccaactgccttactattggaatattgcccctaattatgatgcgactattaccacgaattatattagtcgccgtggtttaaagctcgataatgaatttcgttatttaacaaaaccgggtcgcggtactattgcggttgattggatcaaccacgacagtcaatacaataaagataaagcagacgaaaaagcgggttatctggcgcgtgattctgctacacgctggttattctattggggtcacagtggggtgatgaacaatgtgtggcgctttaatgttgactacacaaaagtcagtgataacaaatatttcaccgactttacttcgcaatatggtaataccactgatggttatgcgacgcaaaaattcagtactggttatgctcagcaaaattggaatgccacattaaccactaaacagttccaaattttctcagataataaagatgcaagggcttatcgtgctgagccgcagcttgatcttaattattataaaaatgatattggcccatttgattttcgtacttatgcacaatttgtccgctttaccagtgtcggagaaaacacccctgaagcgaaccgttatcatatagagccaaccatttccttacctgcctccactggctgggcaagctttaataatgagtttaaattgatggcgactcattatgatcaagatattcctgatgcttataagaagaagtatccacatcaaaaacttgatgatagcgtcaaccgcgtactaccacaatttaagtcagatatgaaagtggtatttgagcgccaatatgacactaacgatattacgcaaacgttagagccacgagtacaatatctgtatgtaccgtataaagatcagtctaatatcaataactttgactcagcgctattacaatccaactatagcggacttttccgtgacagaatgtacggtggtctagatcgcattgcttctgcaaaccaattaacggcgggtgttacttcacgtttttatgacagtgaactggttgaacgttttaatatttctgttggtcaaatctatttctttgagcgtcctaaaacaggttcatcgaatgaaattatcaatagcaaagatgaaaccggatctatggtatgggcaggcgatgcatattggcgcattactgatactttaggtatgcgtggtggtttacaatatgaccgtcgtttaggcagtgtctctatgggtgatgcgattatggagtatcgccgtgatagcgaccatctcttacaattgagctatcgttatgtagaccgtgattatattcaagcaacacgggttcgcccttatgatggcggggtcaatcaactaccagaataccaaaaaggcatttctcaaattggtgttgtcggcagttggcctttagcagaacgttggggactggtcggcgcttattactttgataccaaagattcagagccagtaagccaaatggttggcttacaatataacacctgttgctgggcggtaaacgttggttatgaacgtaaaattgttggctggaaagaagaccacagcgatattgacaacaaatggtcaatcaatttggaactcagaggcctaagtaacaatcatagtttaggtagtcaaaaaatgcttgagcgcggtatcttaccttatcaaagagcgttttga

SEQ ID NO: 2289 - DNA, 873 bp, Proteus mirabilis
ttagccatgaacagcagatgcgcttcgataaataaaatactgcctttttcttgtgttgatggcccaggcaatcgcctcgccatcttcctacaaggatgtaatttacgctgtaagaactgtcacaatccctacactatggggatttgtgataactgcggggattgcattgccacttgcccacagcaagcgctttcattacaaaacggtgtaataaattggaacgctgacagctgtgagcaatgtgatacttgtattcagcaatgtcctcgccaatcaagccctatgacattgacctatacggttgatgaactaattgcaattacgcgtaaatatgcagcctttatcaatggggtaaccgtaagtggcggggaatctacgttacaacttccatttttaattgattattttaaagcaatcaaagaagcccctgatcttcgacatcttacctgtttaattgacagtaatggcactctttcacttaatggttggcaaaaaatcgccccctttatggatggagcgatgattgatttaaaaagttggagtgaagaaacacatatttatttaaccggacgtagtaatcaacgtattaaaaaatcaatcaaatggttaagtgagcataatttacttgcagaattacgccttttatatattccagaaaaaaccgattatttagagaatatagaaccgctttcccagtttattaattcacttgatgaatccattccaattcgtattaatgcgtttcatcagcatggcgtatatggtgaagcgaagaattggcgatccgcaaataaagaacaaatcataaatctacaaaatgaattaatacttagaaaagtaaatttaattaaaataccaaatatatatacataa

SEQ ID NO: 2290 - DNA, 1200 bp, Proteus mirabilis
ttaataatgaaacaaataactatattaggctcaacagggtctatcggaacaagtacgttatccgtcattgaaaataaccctgatgagtttcaggtgcttgctttagtggctggaaaaaatgcaactaaaatggcgcagcaatgtcgcgcttttcagcctaaatatgcggtgatgtcagatgaaaaaagtgccggtgagctgaaacgattattagccaatacatcgtgtaaaacggaaatattatcaggctctaatgctgttaatgaaattgctgcattggatgaagccgatcaagtgatgtctgctattacaggggtggcggggcttaagcctacattggctgcgatagaaaaagggaaaagaattttattagccaataaagaatccctgatcacgagtggtcgtttattctttgatgcggtggctaaatatggtgcgaaggttttacctattgatagtgaacataatgctatctaccaaagtttacctacaggtattcaagacaatttaggccatgcatctttagaagcccatggcatcaccagtattttactcacaggctccggtggaccgtttcgctatacgcctttagatgagctagatgcaatgactccagaccaagcttgcgcacatccaaactggtcaatggggcgtaaaatttcggttgattcagccactatgatgaataaaggcttggaatatatcgaagctcgttatttctttaatgcctcggaagcagagatggaagtcattattcatccccaatcggtgatccattcaatggttcgctatcgtgatggtagcattatcgcacaaattggtgagccagatatgagaacgcctatcgcttattccatggcatatcctcatcgcaccgaatcgggcgcgaaagcattagatttttttgagatacaagccctagaatttatccgtccagactatcagcgctatccttgtttagcacttgccatcgaagcctcgcaacggggacaagcttcaacaacggtattaaatgccgctaatgaggttgttgttgatgcttttttaaacgaaaaagtaaaattcactgatattgctaaaattaatcgcaaagtggttgaacattttgacctctctgagcctcaaagtatcgacgatgttttagaaattgataaattagcaaggttacaaacacagcagattatcgcacaaattgtataa

SEQ ID NO: 2291 - DNA, 1014 bp, Proteus mirabilis
aaaataatgaatattgatttttcgatgatttggtttgcgatcattatttttgccacacttatgtatattattgcagatggatttgatctggggattggcattattttgccttttacccgagataaaatacaaagagataccatgattaatagtgtggcaccagtttgggacggcaatgaaacatggttagtattaggaggggctgcgctctatggtgcttttcctcttgcctatgcagttattattgatgcgttaacaataccactgacattgatgcttattgggcttattttccgtggtgtggcatttgaatttcgcgttaatgcacttcctaaacatcgcctattttgggattcagcttttattggtggctcttttcttgctactttttgccaagggatcacagtaggtgcagttattaatggttttaatgtgacagagcgccatttcagtggctcggcattggattggttaacaccattccctattttctgtggttttgctttgttagtcacttatgcattgttaggcagttcatggttgattatgaaaacagagcatcaactgcatcgtaaaatgtgcactataacggtgtatctggctattacattgctggtggtgattgcaatagtaagcttatggacaccacttacacatgcagatattgcacaacgctggtttagtttacctaatttatactttttattacctgttccgttgctcgtattggcttgtgcttggggcattgttcgtagtgcctataactatggtcattatcagccttttctattatcacttttattggtacttattggttttgcaggattagggatcagtatctttccttatattattccaccttctatttcgatttggcaggcggcagctcctgttttaagtcagaaatttatgttagttggggcggttataattattcctgtgatattagcctataccagttggagttattatgtatttcgtggaaaggtaaatgccaatgaaagttatcattag

SEQ ID NO: 2292 - DNA, 1152 bp, Proteus mirabilis
agaataatgaatagtttgattggctcttctgtttatcgtcgccaactcacttgtggcacattaagcgtaacgccaaattgctcattagaacatcttgatgaactttttgatattgcggaaagacgcaaccctaagcgcgcttttttgtttgtcagtaaagtattagggcgccatattcctgtttcacctaagaaaatgcgtgaaacttatcaacaaatggccaaacaatttcctcaatcactcgaaggccctattctttttattggtatggcagaaactgcggtcggtttaggtgcgggaatttttgatgaagtaagagatcgctatcctcaagccctctaccttacttcaacgcgccatcctattgctgatagtgaattattctgtaaatttaaagaaaatcacagtcatgcaactgatcacctactttatttgcctcataacctagaacaacgccaatggatccagcaagcgaaaaccattgtgttaattgatgatgaagcaaccacaggtaatacctttcttaacttgctgtctgcattacgtgaagaaggtaagttaacacaaattaagcagattattgctgtcacattaaccgattggagtggtgatgctctgcaaaagcgttcaccattacccataacaaccttctctttagtgcagggaaaatggcaatggcaagccaatcccgatgcaccattacctgttatgccaaatgtcaatattactgcttcaggacaggttgctatcacagggaaacaaagctggggacgcttaggcatgacaacccctgctaatgatcttggcctatttattcatgtttctgagggtgaaaaaatattggttttaggctctggtgaatttgtctgggaaccctttttattagcagaacgcttagaaaaacaaggggctattgtaaaatatagctcgacgactcgctcacctattgccactaattttgctatccaatcagcgataacttttactgacaattacggattaggcattcctaactttgtctataacgtggctcatcagcaatttgatcgcattctgctttgttgtgaaacccctgccgaaagtattgatagtcaacttattaaggctctctataaagttgcccctattgttgaagtaattagctatgactaa

SEQ ID NO: 2293 - DNA, 1491 bp, Proteus mirabilis
atgacaatgaaattatttggaaaagatgatgaatataaaacttttgtgctctctatagggaataaaaaaaacatctctttgggaaaagatgatatttctttaggaataaaagatttatctttacttataagcaatagtaatagagactttatgattgttaataaagataaagaagttttatttcttaaatttacattagagttgaaatgtgctctggaaaaatacatacttgaaaaaaataaaaaaaaagataggctgaagaaattaaaagatattcttgaaaaagaaagattaactgataaaataaaaatacttgataataaggtaattgtatcaggaataaaagatgctaatgatataaatgtattattttcctctttgttaaagaataaagatgattctagtacactttttaataaaatatttagtaataaaaatactataattaatagttttatctctaaaaaagaaaaaaagatttctgatgacatagaaaatattgcaaataaaattatgcgtaaacctaaatttacattatataataatgtaaataaatatcaaaatataattactatttcgaataaaatttttaaggaaccagagaatactgatataacaaaagatgattctcataataaaaataattttgaaaaaacagaaaaaacagacctctcaaaaaaaaccaaaaaatcaaaaaaagcagccctgatggaacaacttgataaagataaacagaaaatgaatgagttgttagctacttctagccaagggttattaaaaactgtagagtatatagataatctatctaatttaattagttctaaaactgataatggtacttgtaattccgacctcattgaccaattcaaaatgtctattgaaactttggtaaaaaaatgtaatgtctttaacaaagatagtcagtttttatctaaaaaagatattgagatagagttaagtgacataaaaataacaattgaagaacttaatgaaattataaaaaagatggatggttttaaatctaatcagttatattgtttttataaggaagcagataaatctaattttactacagttaacgagattaattttaattttaaaaaggttttttttaataatataaaagatatgttttctcaattatcttcttataataaatcattaaaggaaaataaaggttttttccttaaactatataaattattatttaaaaacaaatacctaagaaaaaaagagataaatgataatgctgttaaaaaattagaaatattggataggaatttattccttttgcttgaatctctagattttaaaaataattatgtacctgactggacttgcaaattagtagcaaaaataataaatgaatcaatgcctagaaatgatattttttggcgattctctaaagagcgcacagaatggaataaaatttataaatcatttattgtagatagatcatttattgtagagagaaagagagaagaaatatag

SEQ ID NO: 2294 - DNA, 1083 bp, Proteus mirabilis
ctcgggcagaatagcgtgaatgtcccatattctacttatataaagaacaagatgattaaactgacgaatataaataaagtatttaagcagggagcgcgttcaatacaagcgctatcaaatattaacctgcatgtgccacaagggcagatttttggtgtgattggatcgtcaggtgcaggtaaaagtactctcatacgctgtgtaaacatgttagaaaagccgacatcaggtgaagtttgggttgatggtcgtgatctaacaaaattatctgataaagaattaaccaaagcacgtcgtggcattggcatgattttccaacattttaatttactgtcctcaagaacggtatttgataatgttgccttacctctagaacttgataacacgccgcgtgcagatattaataaacgtgttaatgagttattagaattagtgggtttagcagataaaaaagagtattaccctgccaatttatcagggggacaaaagcagcgtgttgcgattgctcgagcattagctaattcaccaaacgttttattgtgtgatgaggcaactagtgctcttgatcctgcaacgacgcgttctattttagaactgttaaaagatattaatcgtcgtttaggattaactattttacttatcactcatgagatggatgttgtaaaacgtatttgtgaccaagttgccgtgatcagtggtggtcaattagttgaaagtgatgcggtaagtgaggttttctctcaccctaaaacacccgtttctcaagcatttattcaatcaacattacaattggatattcctgacgattataaagaacgtatgaagccagagtgggaagaaggcttattcccgctgttaaagcttgaatttaatgggttatctgttgatgcgccattaatgtctattgttgctcgtcgttttgatgctgatattaatattttaagttctcaaatggactatgccggtggagtaaagtttggcgtgatgctagcagaattacacggtaaaaatggtaacacagaaaagtctatcgcgtttttagaagagcatcatgtgaaagtagaggttctcggttatgtctga

SEQ ID NO: 2295 - DNA, 2319 bp, Proteus mirabilis
aagataaagaatattaacttaacaataattcttatttatgggtggtctttggggtggtttatgaaacctatgttgcataaaattctttgtatcaatctttgtgttttatctgtggcaatgccgaaaatcgcattgtctgataattactttgatccgaatcttttactaaataataatgacaatattgatttaagtaatttcagcaaagaagactacattgcaccaggagactatagtttaagcgtttttgttaatactgagccattaggtgaaaagacaattttatttaaagcaaacaaagaaggtaaagttgtcccagttgttacaatcaaagatttgaagctatttggggttaatgtttcagcgataagtaagctaagtgatctacccgaagatacagaaattgataatatagaagcgtatattcctaattcaaggctaacctttaatattaataaattaacattaaatgcatcttttccccaagttaatatggataagagctttcaaggtgaaattcccgcagaattattagatgatggcgtgagtgctgttatccttaattatatggctaactttattaaaaatagaacgacaggtgattattcaagccataataacaactttttcttgaatcttaatggtggtgtaaatataggcccttggcgtttaagaacaaattattcttataataattcgagtggttcagatcagcgttcttcaagtgattctgaatttagtaatacctatgtaatgcgaaatatcgcttatttaaaatcaatgctgaaaattggtgaaattaccactggagggaatattttttcaagtattccgataaaggggatttctttagccactaaccaacaaatgttaccaagtagtatgcgtggatatgctcctgtggtaagaggttttgccaacagcaatgcaaccgttaccattcgtcaaaatggtcaaattatctataaatcttttgttgctcctaggaattttattattaatgatatttccgccggcggtattggtggggaccttgaaataaccattgaagaagaagatggctctaaacgtgtatatacacaagcctattcatcgctgcctatcatgttgcgtgaagggcaatttgagtatgagtttagtgcggggcaatatgatggtggtatcacgacagattccaaaaaaagtaaatttgctttaggaacgtttagttatggtatcaataactcaatcactgcatacggtggtttattaattgccaatggttatacctctggtgttatcggttcgggtgtttctcttgggttattaggtgccttatctgcggacgtcactctcgccagagctaatttggataaaacttatcacggtcaatcatatcgggttcgttattctaagagtttattatctacagggacttcgtttgatttaaccgcattacgttattcaactaaagattactatgactttagtgattacaataactcaggttatgaattgcgagaaggtattgcaccttggttaagccaacgtcagaaatctagttttcaaacttcaatttcacaatcattaggaaaatacggttccatgtatcttcgtggtgaaaccagccgttattgggggaatagccgtgttaataatagtgtcacattaggctataacactgttctgaaaggtattgcatttaatatagattattctatttctcgcctaaaaagtgatgacaatacatggccagaaaatagacaaattaattttaatatgaatatgccactgagtgtgttctcaaatgcaagtggcttgcaaaatatgaatgcaagctatcttctgacacatagcaatgatggaagaacttcgcaacaagccggtttaaatggctctgcatttgataatcaactctcttatggtatctaccagaatacagataacaaggcagatagttatagtggcaatatgaatatgagttattcaggaagtaaaggaacgctttctgggggttatagctatgggaaaaatagaaatagctttaatggtagccttattggtggtgttgttctgcactcaaaaggagtgacattatcaaggatgttaggtgacagtattgccatagtgagcgcagataaagcaaagggcgcagaaatcaatggaaatgtgaaaatagatacatttggtaatgccattgtccctcaattaagtccttatgatacaaacagtattagcgtaaatgtcagcacattacctgatgatgtgacacttaatgaaacgtcaatgaaagtctatccaacccgaaagggctattttagcaagacaatttcaaactaa

SEQ ID NO: 2296 - DNA, 2304 bp, Proteus mirabilis
cgttttaggaatgtctatatgagtaagaaaaaatcacctattcctggagtgaaaccctataatggacccgcaggaggatggggggcattaaaagcaacagctatcgcggtacgcactcaaatggatgcttttattgcacctaaaacattgcttaatactaatcagcctgatggttttgattgccccggctgtgcatggccagacaaagagcatcattctactttccaattttgtgaaaatggagctaaagcggtcacatgggaagcaacaaaaaaaagagtcacacctgaatttttagcacaacataccgtaacagaattactgacaaagtcagacttcgaattagaaggctacggtcgtttaacccatcctctcgcttatgatgcagatactgacactcttcgtcctgtgacttgggagcaagcatttactcgtattggtgaactattaagaaatatgccatcacctgatagtgttgaattctacacctcaggtagagcttccaacgaagctgcgtatctattccaactgtttgcgcgagaatatggcaccaataattttcctgattgctcaaatatgtgtcatgaaccgactagtgtaggcttacctcaatcgattggcataggtaaaggcacagtttctttagatgactttgataacactcaactcattattgccattggacataaccctggaactaatcacccaagaatgatgggaacactgcatgaagtagctcgtcgtggtgtacctattgttgtatttaatccattgaaagaacgtgctttagagcgatttaccgaccctcaaagtgttattgagatggcgacttatagctcaaccaatatcgcctcatcttattatcaagtcaaagccggtggtgatgctgcggcgttaaaaggcattatgaaaaccttaattgagtgggataatgagcgtggaaacattctcgaccacgattttattgctgagcatacactaggttttgaagccgtagttgaagatcttaaacaaacttcttggcaagatattgaaagtgaaagtggcctttcgcaagcagatattgagagtgtcgcactcctttatgccaattctccggccaccattattacctatggtatggggatcacccaacataacaaaggtacagcgaatgtgcgtctgattgctgatttgttattaatgaaagggaatattggtaagccgggtgctggcatatgcccattacgtgggcactctaatgtgcaaggtaaccgaactgttgggatcacagaaaaaccatctgtcgaatttttacaaaaaatagaacaaacttttggttttaaaccaccttataaacatggtcacgatgcagttaacgcaatgcaagcgatggttgatggcacagcaaaagcgttaatttgtttagggggtaattttgccgtggcattacccgaccctcaacaatcatttgctgcaatgagaaagcttgatttaagtgtacacatcggcactaaattaaatcgctcacatttattaacggcaaaaaatacctttatattaccttgcttggggagaacagaattagatgtacaagcattaggtcgtcaatccatcacggtcgaagactcaatgtcaatggtgcatgcctcttctggtaaattaacacccgcttcaccattattaaaatcagagcctgtcattgttgcaaaaatggctgctgcaacactgacagatagcaaaaccccatggctaagatttacggaaagttatgatcttattcgcgatatgattgaaaaaaccattcccggatttgataattacaaccaacgaattcgtgtccccgggggtttccgtatgccactccctgccgttgagagagtttggaatacccccacaggtaaagccatgttctcggtatttaaaggtgtaaaagagaataaaatggtcatgggtgatgatgttcttcgtttagtcactattcgtagtcatgaccaatataatacgaccatttatgcacttgatgatcgctatcgtggcatctttggtagacgcgatatactgtttatgaataatgtcgatatgatagcaagaggcttaaacgaaggtgataaaatcaccattgaaacggtcagtgaaaatagaaaactacaacttgataatattacagttgtttcatttagcattgcccctggcacagtggccgcttattacccagaagccaatgtccttgtaccattagattatattgataaagagagtggtaccccctcttataaagcaatacctgtcagaatttatgataaaaaaacacaagtcgcttaa

SEQ ID NO: 2297 - DNA, 726 bp, Proteus mirabilis
gcgctttacctcataaactctgatgatttacggagctcaatatttatgcaaccacaatttgaaaacgcaaaaaacaccgtaaaaacattatcagtgtttgattttgatggtactttaacctatcacgatagctttatcccttttctaaagtttgcctttgggcgtcgtaaatttgctcgtcgtattatcaaaatggtattccccacattacgttgttttagacgtaaactgactcgtgatgaattaaaagaagtgctgattaaaacttttttaaccgatatcaaagaagaatggctcaaagaaaaagccgaagccttttgtaaagcctactggagtaagttaatgcgtcctgcaggtttattagccgttgctgaagagattaaccgtcatgctgaagtgaccatttgttcagcttctccagctatggtgttgcaaccttttgcggatcgactcggtataaagttaataggaacaacacttgaagtggttgatggtgtgctgacaggaaaaatcattggcaataactgtcgttgtggcgaaaaaatcaaacgattagagcgtgtctatggcgatcttactcaataccacttaagggcgtggggcgattcacgtggtgatcatgaattactctatgctgcacaagatccacatcggcgctatttccacacaggaagtaataagtcaaaaaaatcacctattaaaataacgcttaaaaaagactcataa

SEQ ID NO: 2298 - DNA, 183 bp, Proteus mirabilis
tttatttttttatctacgaaaataggaaatactgaactcttttttgccgataagaattcattaaccatcgttttaacattgttttttcttattatgtctttaatgacagttttttcttctattcctacatggggttgtagtttgtatttatctatcttagatgtttttttatttattctctga

SEQ ID NO: 2299 - DNA, 633 bp, Proteus mirabilis
ttatcacttgaattgataatacaactaagaggaaaactgatgagtatctatgcatttgaaggtgttattcctgttgttcatccaacagcttacattcacccatcagcagtactaattggcgatgtcattattggtgctggtgtttatattggccctttggcttcattaaggggtgattatggccgtttaattgttgaagcaggtgcaaatcttcaagatggctgtgttatgcatggttatacggatatggataccattgtgcaagaaaatggtcatattggtcatggtgctattcttcacagttgtattatcggtcgtgatagcctagtcggcatgaatagcgtgattatggatggtgcgatcattggtgaggaaagtattgttgctgccatgagctttgtgaaagcgggctttcaaggtcaggcgagacaaatgttaatgggaagcccagcaaaacatgtacgtgatattagcgaccaagatatgcagtggaaacgtatgaatactcgtgaatatcaagatctcactgttcgttgtcgtcaaagcttagtagaaacgacaccattaacagcccctgaagctaatcgtcctcgtttaagaggcacgacagaagtaaaacccaaaggccaataa

SEQ ID NO: 2300 - DNA, 228 bp, Proteus mirabilis
tacgcacttgaggtttatttaacaaacctgattatatccttaggttatacactatttcgaataaagtttatcggatgtcttcttagatttaattttgaatgcctctcccttgacttaagccaaaggaaatatagtatgcatcgttatataatttatgaaataacgattattaatataaaacaacactacagtgtgaacctatggctatccacagacgacaatttctga

SEQ ID NO: 2301 - DNA, 1971 bp, Proteus mirabilis
ttatatattgagattaaaataatgaaactaacacctctatgctgtttattccttgttctactgccttgcagtgtaatagcccagacaacttaccagcaatcaatccctgatgtattaaccgtttggagcagtcccattgcggcaaatcccgatgtattaacacaacagcaaatgctcgaacaaaataaagtcaatgcggcacaagcactggcaacattacctggtattgtgatgcaaaaatcaggtaatcgtaacgaatatacccttaaagtacgtggttttgatagtcgccaagttccggtgttctttgacggtattccaacctatgtgccttatgatggcaatctcgacttagcgcgttttaccactaatgatctcgccagtatcgaagttaacaaaggttatacctcattactgcaaggccctaatctgatgggaggtgcaattaatatcaccaccgcaacgcctcgcaaaccattagaaggtcatattgcttattcgcaaggttttgctcgtggtgctgattatgctcataacatgagtgctcgtttaggagcacgtactgaatatggttttatccaaattagtggcagtcaactccagcaacgttttacccccatacctaatgcagatgaaaataataacgcagtggggacacatggacgtcgtagtcattcagcaacagatgataaacgaggaatgatcaaagtgggttggacaccacgcgcttctgacgaatataccctcacctatgtaaaacaagatggtaataaaaatagtccaccgaatagtgatcctaatgccaaaggtcgatataaatattgggcatggccagattataataaagagagttactactatagtggtgtgacacaacttacggatagcataaatctacaaagtcgtgcttatcatgataagtttgaaaataccctttatatgtatcctaaaaaaggtaatagggtcgattatagccattatgatgatcacagcacaggcgctgcattacaattcggtatcgatatggaggaaagtgatctgctctcttttgcggtacattggaaagatgacgttcaccgtgcccaaaaagaaaaaaacggtgattgggtacgttttaaagatagaacttggtcattagccacagaatatcaatgggtagtgagtaacgatcttgatgtcgttggcgccataagttacgactggcgcaaaagtatcgatacagataaaaaggctgataacaacaaacaaaatgccattaactgggaaatcatggctaaatattcattatccaatgacgataatatacgttttacaatctctgatcgcagtcgcttccctacccaaaaagagcgctataccaccgaaaaacccaaagatggatcaagagggattattaaccccaatttagatccagaacgcgcattatcctttgatatgacctacgaaggttatctcaatgagaaatggggctaccaaactagcctatattacaatcgtgtaagtgatgccattatggcgcatacgctttatcgtcacggtgaagcgctatttcaaaaccaaaacagtggacgtgttgattatctaggcttggatattggtactaaagggaaaatgaccgattggctagaacttggcctaaattatagctatatccatagtgatccaaagcaagttgaccatattgaaggtttaccaaaacataaagcctatatgtggttaacctttattcctgttgaacaagtgcgctttactattatggaagaagcacaaagttggacttataaccgtatagatgagaataataaactggctggctatacaaaaaccgatctacggttagattatgatgttggatatggtatttcagttaatgcttccattaataatctttttgataaatcttatcaatatacacaaggttatatagaagatggccgtaattattggttaggcgctgaatataaactctaa

SEQ ID NO: 2302 - DNA, 807 bp, Proteus mirabilis
cttatgattgataaatccgcagtaattcacccttcttcaattattgaagagggtgcggtaattggtgctaatgttcgcattggccctttttgcgttattggtagccatgttgagattggtgaaggtacagatatcaaatctcatgtggttattaatggccatacacgcattggccgtgataatcagatttaccaatttgcctctatcggtgaagtaaaccaagatctgaaatatcgtggtgagccgacccaagtcattattggtgatcgcaatcttatccgcgaaagtgtcactattcatcgtggtacgacacaaggcggtaatattactaaaattggcaatgataacttattgatgatcaacacccatgttgctcatgattgtatcattggcgatcgctgtattattgcaaataacggtactttaggtggacatgtcactttaggtgattatgtgataatcggtggtatgagtgcggttcaccaattttgccagattggttcacatgtcatggtgggcggctgttccggtgtagcacaagatgttcctccttttgtaattgcacaaggaaaccatgccaccccttatggtttgaatattgaaggattaaaacgtcgcggttttgcaaaagaagatctgcatgccattcgtaacgcttacaagatactttatcgtaatggtaaaacgcttgaagaagcgcgagaagagattgctcaattagccgcagacaataataatcagtatgtaaaaatattcagtgattttctggaaaattcagcaaaatcaaaccgcggtattattcgctaa

SEQ ID NO: 2303 - DNA, 810 bp, Proteus mirabilis
agagatgttgacgattgggttagcagggtaactatcatgctagtactgttgcaatatatacaatcttatttaatcgatatttttttgctcattgctagattatttcctatttttatgtttattccattcctcaatagtcgagttctcaatagtcaattattaaaatatattattattttttatatagcattaggaataaaacctagcatcacgataacaggggttttaagagagacttgggctattgttctaattagtgagttaattataggtctagttatcggcttgctacttgccacgccattttggatagcttctgcgtttggagaattcgttgataatcaaagaggagcaagcataggagatacaattaatcctactacaggtattgaatcgtcagaatttgcgtcattaaccggattgttttgtatggcctattttttagctacaggtgggctcgttgttttaatgagtaccataaaagagagttacgatgtttttcctattgggtatattaataaaaatatcggttacgattttatcggtcattggctaaatgatatggttaaagtggcgattattttggtttctcctgtattaattaccatgttcttaagtgaagttgcattaggggtttattcattattttgtcctcaattaaatgcattttctctctctctttgtatcaaaggtattatcgcttttttagtattattgctcttttttacctcagcaatgacgaatgaattatatcatttttttaacagtagatacttttattctatttttatgagtatttatcatggctga

SEQ ID NO: 2304 - DNA, 1035 bp, Proteus mirabilis
ctttttactgaggaaaatagcgtgttaataaattctcttcgttcaactcttttattcagtgcactaggtttgttcagtgcttttgccgcaaatgcacaacaaaccaaacccacacttaccgtctatacctatgactcttttaccgcggattgggggcctggtccggcaattaaaaaagcatttgaacaacaatgtgattgtgagctaaaactggttgccctttcggatggggtttctctccttaatcgtttacgtatggaagggagtaaaagtaaggcagatattattttagggctagataacaatcttattcatgcggcaaaacagaccggactttttgcaccaagcaatattgatacatcaaaactggcattacctgaaaaatggactgatgacacttttgtgccttatgactacggttattttgcttttatttacgataaaaatcgtattactcatccccctaaaagcatggatgagctgttaaatagccaacagccgtggaaaatcctttatcaagatccacgtaccagtacccccggcttaggcttaatgttatggatgcaatcactgtatccaaacaataccgcagagcagtggcaaaaattggcgaataaaacactgacagtaaccaaaggctggagtgagtcctatggcttattcttgaaaggagaaggggattttgtgcttagttacacctcatctccgggctaccatattttggcagataaaaaggacaattatgcagctgctatttttgatgaaggacactatttacaggtagaagttgcagccaagctaaaatccagcaaacagccagaattagctcagcaatttatgcaatttatgctaacccccgctttccaagaaaccatcccaaccactaattggatgtatcctgttattgatatgccactacctgaggtctactccgttatgcctaaaccgcaaaagtcattacaatttgatgctgatgtggtagccaaagagcgccaaacatggactcgtaattggcaatctgcggttagccgctaa

SEQ ID NO: 2305 - DNA, 372 bp, Proteus mirabilis
ttaatttatgagcagggggaagcaatgaatcaacaaaaaataaaattagtattagcgctcgtcacgggtatgacagtgacaatgataagtacagcaactattgcggagacatcgtggtataacgaaattgataaaactaccagtaatgttaacaatgaattaagcgatacggcaatatcgaaaaaaatcgaagaaacactattacctaacccctccattgacagtggatcactttcaattcgtactgaatttggtcatgtcacagttgccggctttgttaaaaatgcagagcaggaaaaacaactcattcagatcattgaaaaaattgatggtgtaaaaagcgttgaatcatcagtgaatattcaaggctaa

SEQ ID NO: 2306 - DNA, 3642 bp, Proteus mirabilis
agagtgagtgaagtgatacaggcacaggtattagatccctatacacttcctttgtatcaaagacgcctcattgaggcgtctgcgggaacagggaaaacgtacactatagggttattgtatttacgattactgcttggattagggggcgagtcagcattttatcgccccttaagtgttgaagagatcttagtcgttacttttaccgaagcggcaacggatgaattacgcgcccgtattcgtcaaaatattcatcagttaaggctagcctgtatccgtcatcaagtagaaaatgacaataacgcttaccaaatattattagatcaaatcccgaataaaatggtggcggcgcaatggctattagaagctgagcgtcaaatggatgaagccgctatttatactattcatggtttttgtcagcgcatgttagccactaacgcttttgaatctggtgtattgtttgaacaggtgttgatccaagatgaatatgagttaaaaaaacgtgtctgcgctgatttttggcgcaggcactgttatcccctttcttatgatgttgcctatgcggtaagcgaaatttggtctggccctgagcaactgctgtatgaaattcaaccctatttacaaggcgaatgccccgaaattcaaggtattgatttcgacgctaaaaaagagactgttgaacagcgtcatcaagcagtcattgaggccattgataaagttaaagcactatggcgtcatcattgcaatgaaattgcagattggataacttcatctggtgttgataaacgcagttacagtagtcgtttcttacctaaatggatcgatgaaatcaccgcatgggccactccactcgaaactaaaagttatcagttacctgactgtttaagtcgtttttcgcaagcaaccctacatgaaaaaactacaaagggtgctgcgcctgagcacgctttatttgcggaaatcgaactactttgccaacaaagtttaacgttacgtgatgtgatcattgccaatgccattcctgaaatacgccaagggatagaaaatgaaaaaatgcgtcgtggtgagttgggatttgatgatctgttaacgcgtctcgataaggcattgcaacgagaaggcggcgaagcattagcagatgctattcgccaacgttatcctgttgcgatgattgacgaatttcaggataccgatcctcagcagtatcgtatttttgatactatctatggtgagcatacagagagtggtttgctatttattggtgatcccaaacaagccatttacgcatttcgtggtgcagatatctttacctatattcgggcacggcaacaaaccgatcaccactatacattgaatactaactggcgctcggctccgggtatggtaagtgcagttaataaactgtttttacgttctaaaaccccttttttgtttgatcatattccttttattgaggtcaattcggctgaaaaaaatcagcatatgaagtttatttaccagcaaaaaacggttgccccattaaatttttggttagctgaaggtgaaagcctttcaactggtaattatgaacaattaatggcctcgcaatgtgcgatgcaaattcgtgactggttatcagccggtgacaatcaacaagcttggttaatcgaacaagacaataaaagcgctgtcacatctgccgatattgtggtgctagtgcgtagtcgccgagaagcattattgatccgagatgcattagatctgttatctatccagtcagtatttttatccaatagagaaagtgtgtttgaaaccaatgaagccaaagatctactttggttactacaagcagtggtaacccctgaaaaagaacgggtgttaagagcttctcttgccagtgcactgtttggatttaacgcacaacaaattgatgaacttaatcaagatgaacagcgttggaaccgctatgtggagcaattcgctgattattttgtcttgtggcaaaaacgtggtgtgttacctatgctacgtaaagtcatgatagaaaaccaaatcgctgagaacttactcgcaagccaagcaggagaacgacgtttaaccgatatcatgcatattggtgagttgctacaagaaacatcattacagcttgatagcgagcacgcccttattcgttggttagcccagcaaatttctcgaccagatgcacaagcggaaagtcagcaaatgcgtttggaaagtgataaaaatctagtgcaaatttgtaccattcacaaatctaaaggattggaatatcccattgtttgcctaccttttgcctgtaattatcaagaacaaaagggcgcgctttatcatgatagagatgaattttacgcaaaactagatatttttaatcaacctgatagcgtgcgtcttgctgatgaagagcgattggcagaggatttacgcttgttgtatgtggcattaactcgggcgaaattttgttgttatgttggtgttgcgcctttggttaaaggaaataaacgtaagtcaggattaactgatttgcataaaaatgcgctgggatatctgttgcagcatggggaagagggtaatagtgagctattacatcaatccattaatcaattgcttgatgacaatataaaagtgatcacgttaggtgatacctcaacgcatcgatatcaatctccacatacaacggatattgctttagatgccgccatatttaagcgaaaaattaatgataattggcgtatcaccagttattcgggattaacggcacaacactctgctcgtggatatctatttgatagtgctgatttggatgccttggtacaatctatcgcaccgggcttagataccgatgctaaaggtgagaaaacagcgcaacacagcgatgaactctctattcatcacttccctcgtggtgcagtcgcggggacatttttacatagtttgcttgaagagcttgatttttcacagcctattgatgaaagttggatgcaagagcaacttattgcccaaggttttgaggaaaaatggacgccattgttggtggcttggatggaaaccctttttcacaccccattaaatgcgcaaggcttatgtttagctgatattcccaaggagcatcaactcgatgagctacaattctatctgcctattgaaaaggagatgtcggcggcacagttaacagcattaacccgtcaatacgatcctttatctgcgcaatgtccagccctcaattttcagcaagtgcaaggcatgctaaaaggttttattgacttagtattttgttgggagggtaagtattatgtggttgactataaatctaactggcttggtgaatcgagtgaggattacacgcaagaggcgatgagcaatgcaatgcgcgatcatcgttatgatttacagtatcaactctatactttagcgctacatcgatttttacaacaacgcttacctgattatgattatcaacgtcattttggtgggatctgctatctcttcttacgtggtattgatgctgactacccgggcaatggcgtctatacctatctacctgaagaaaagtttgtagaagcattagatgcgctatttaaaggggaagcgcttgaggttaacggcagtaaagtgaacgcgctgggtgagaacaattcaaatgattaa

SEQ ID NO: 2307 - DNA, 1386 bp, Proteus mirabilis
agattttgcctgcacttacccgtcaactatctaactgatttagtcagcagagaagataacttctctgctttatttgcaagttctggagatgttatgtccgattccgaagatattttcgatgccattattgttggcgcaggattagcgggctctgtggctgcacttgttttagccagagaaggtgcgcaggtattgctaatagaaagagggaactacgccggcggaaaaaatgtaacgggtggtcgtctatatgcccatacccttgagcgcatcattcctgaatttgcgcaacaggctccggttgagcgggtgatcacccatgaaaaactgtcatttatgacacaaacaggggctatgactatcgactatcaaaacgctgaaacgcataaccctaatcatgcctcttggtctgtattacgtggtgaatttgatcaatggctaatggcgcaagccgaagatgcaggcgcccagtgtatcacgggcattcgtgttgataagttagttgagcgtgacggtaaaattgtcggtgtagaagcagatggtgatgtattagaagccaaagcggtgattttggctgatggtgtgaactcacttttggctgaacagttaggcatgacaaaacgagttgcagctgaaaatgttgccgtgggcgtaaaagagatcatcgaactgcctgaaagtgtcattaaagatcgttttaacctaaaagataacgaaggtgtggcttggttatttgccggctttcctaccgatgggctaatggggggcggttttttatataccaataaaacgacgctttctttggggcttgtctgtgggcttcaccatattaaagatgccaaaaaatcggttccacaaatgctagaagattttaaacaacaccccgttgtagcaccgctgattgctgatggaaaaatggtggaatatagcgcccatgtggtacctgaggcagggttgcgaatgcaacacgaacttgttcgtgatggtgttttgatagcaggagatgcggcaggcatgtgtatgaatctaggctttaccattagagggatggatttagccatggcatcaggggaagctgctgcaaaaacggtgctttcagcaatggcaaaaaatgattttagtaaacaaacccttaatgagtatctcaaccatttagcacaggggcctttgcgcgatatgaaagcatatcaacgtatgcctgatttactagataatccgcgtatgtttactgcttatcctgacatggtggttggtattgcaaaagatctctttactgtcaccgatgatgcccctgtaccgatgcgtaaaaccatcatgcgtcatagcaaaaaagtggggtggatgaatttaataaaagatgggatcaaaggagtaaaagcaatatga

SEQ ID NO: 2308 - DNA, 834 bp, Proteus mirabilis
tattcgttcgatttttatccagttaaacgaggagaagcaatgccctctcaattgatgaggacaagtgccgtcttcgctttcttgatttcactactctttactggtgtgagttttgcctctaccagtaccggcagttcccgaatgctgcaggcggatacattcaaaagcacgacaacctcgttgccagatttgaaaaaatatccctcgggaactcagcgtaagaaagcgtttttaaatgtcatagttcctattattgataacattaataataagatattgagagatcgtgagtggttaaccgctcaacgtaaagcccaacactggggcagcgcagatttgaaaaaactgcgtgaaatctgtcaatactatggcgtaacatgtaccagccccaaaaaagtgaattgggattcgttactggctcgcgttgatattattccgactcattttgtcgcaacgcaagccgcaacagaatcaggttggggaacatcaaaattggcacagcaaaacaataacttattcggtatgcgatgtggtaaccggtcttgcaataatgtccctgggaaaaccaaaggctatgcagcctacccggatattgaaggctcagtgattgcttatatgcgtaatctcaatacgcaccgcgcctataattcactgcgctcatcaagagcacagcaaagaatgacgcaacagcaactcgatccacgccagttaatcaccgacttgaaaggctattcagaattaggttcaagttacaatgattatctgaccgaaatgttcgactcaaataaaaagctgatcacgcaagttcagttacagtcgaaacgagaaagttag

SEQ ID NO: 2309 - DNA, 1374 bp, Proteus mirabilis
atttatatcgagagaggcattatgtttggattagatgcttttcacctagcaagaatacaattcgcgtttaccgtttcatttcatattatattccctgctatcaccataggattagctagctttctagccctattagaaggcttatggttaaaaacaaaagaaccaagttacctttctctatatcagttttggataaaaatttttgccgtaaactttggtatgggtgtggtatcagggttagtgatggcatatcaattcgggactaactggagtggtttttcacaatttgccggtagtatcacagggccgatgctaacttatgaagtcttgaccgcctttttcttagaagcgggatttcttggcattatgttgtttggttggaataaagtggggcgaaaacttcacttctttgcaacttgtatggtagcgcttggcacattgatttctactttttggatcttgtcatccaatagttggatgcaaacaccacaaggctatgctattgaaaatggtgttgtcgtgcctgttgattggctacaggtcgtgtttaatccttccttcccttaccgtttattgcatatgtctattggggcttttttagccagtgctttatttatcgcctcttgtgccgcatggttattattaaaaggacaaaatacagcacctgtacgaaaaatgttttctatggccttatggttagtactaattattgcccccatacaagcgtttgtaggagatgctcatggattaaatacactagaacatcaaccggctaaaatcgcagctatagaagggcattgggataatgcaacgaaagaagcgactccgctgattttatttggcatcccagatatggcagaagaaaaaacaaaatatgcgattgaaattccttatttaggtagcctgatccttacccatagtttagataagcaaattccggcattaaaaagttttgcgccggaagatagacctaattctagcattatattttggtcatttagagtcatggcaggtttaggtatgctgatgatttgcttaggtttgttgagcgttattttacgtaagaagaaaagactctatcactcaccccttttcttacgctttgcattattaatggggcctacaggactgattgcgatccttgcggggtggtttaccacagaaattggccgtcagccttgggttgtttatggtctacaacgtaccaaagatgccgtttctgctcatggtgatattcaaatgagtttgagcttattggcctttattttggtttatttttcagtatttggcatcgggtatttttatatggtgcatctgatgaagaaaggccctgtagtgcttaaatccgaccaattaacacagggtgaaaaataa

SEQ ID NO: 2310 - DNA, 630 bp, Proteus mirabilis
gcaagcagcgaatgcagttttagaattagcaggtcaataatggaatttgtctatcctaaagcaaacctaattgctggcgtcgatgaagtcggtcgcgggccattggtgggggcggtagttactgctgcggtgatcctcgatccagctaatcctattcagggattaatggactcgaaaaaattgaccgagaaaaaacgcaatgcgctttatgatgaaataaaagaaaaagcattatgttgggctattggacgtgctgagcctgaagagatagataaactgaatattctttgggcaacaatggaagccatggagcgtgctgtcgcgggattatccataacgcctgatatggtcttagtcgacggaaaccgttgtcctaacttgccaatggcatctcaagcggtgattaaaggtgatagtttagttcaagaaattagcgcagcgtcaatactggctaaagttacccgtgatagggaaatggaacagctagataaactttatcctgattacggctttgccaaacataaaggttatccaacagccttccatatggaaaaactggcttcattaggggcaacgccttatcatcgtaaaagttttgcgcctgtaaaacgtgctttaaatttagtctaa

SEQ ID NO: 2311 - DNA, 2265 bp, Proteus mirabilis
aaggtattagataacactatgctgacacgtttgcgggaaattgtagaaaaagtggctatggcagcgagtctgccagaagcacttgaactattagtgaaagaaacgtgtcaagccatgcacacggatgtgtgttctatttatcttgccgatattccccatcgctgtttctatttaatggccacaaaaggattgaaaaagccgaaagggcgtgccgtcagcctctcatttgatgagggggtggtgggtgaagtaggacgtctttctgagctgattaatctggctgatattcgtgaacatcctaattttacctatctgccacaagtaaaagaggatgatctgcgcgcttttctcggcgtgcccattgtctatcgtcgtcagttacttggggtgctggtggttcagcaaaaagagcgacgcttatttaatgaaagcgaagaatcttttatggtgacactggccacccaattaggggcgatattgtcgcaagtgcaaacgaaaggattatttggacaatatcgtcaaagccgtattaaagccctatccgtttctacgggggtagtgatggcatatggttggcaagagatgtctcagccaaccttagatcatgtttttaaagcaagtgcactggatataaaaagtgaattaaaccgattaacggtcgccttagaagatgcgacatcggagtgtcgccgttttagtaagcgctttatggcaaattcacaaaaagagagtgcggctattttcgatctctattcgcatttacttaacgatccccaattaagacaaaaaatgactggggttatacaacaaggctatgttgctgagtgggcagtaaaagtggtgatagagaagttttctgcacagttctcaagtcttaaagatagttatatgcgagaacgagcttcagatttaaaagcattaggtcagcgcttactatttcatttagatgatgatctcagtacgacaaatacatggccagatcgctttattcttgtggcggatgagcttagtgccaatttattggctgagttgccagaacaacaactggcaggggtgatagttcgtgatggtgcaactcattcacactcagcgattttagtgcgagcaatggggatccctgccattatgggggcagatattcaaccggagctacttcacaaccgaatgctgattcttgatggttatcgtggtgagatttttattgaaccagaaccctttatcatgcaggaatatcggcaaattattgatgaagaaagagtattgagtcaacttgctgaagagcagcttgaacagcaagcggtattaaaaaatggtgaatccatcagtgtgcaattaaatgcagggctaagcattaaatatgaacaacgtattagcgttggcatagatggtgtcggtctttatcgcacagaaatcccttttatgttacaaagcggttttccttccgaagatgaacaaaaaaaccgttatcgtgaaatcttatcattttttcccaataaacccgtcgtactacgtgctttagatataggtgcagataaacagcttccttatatgccgataaatgaggagaacccttgtttagggtggcgggggatcagaatattacttgatcagccagaaatatttctgatccaactacgagcgatgttaaaagctaatcttgaatttaaaaatttgaaaatattgttgccgatggtgacaagtattgatgaaattgaagaagcgaaagcattgttactaagagcatgtgctgaagttagccgagaaatgaaatgcgaatgcattctaccacctgtggggatcatgcttgaagtcccctcattggtctttatgttaccgcaattagcacatcgagtagattttatctcgattggtaccaatgatttaacgcaatatttacttgcagtcgatcgtaataatacccatgtagcactgctctatgataatttgcatcctgcattactgcgttcgcttaatattattgctttagaatgccaacgttatcagttaccagtcagtgtttgtggtgaaatggcgggtacgccgatgggggcattgctactaatagggctaggttttcgtcagttaagcatgagtggccgtagtttacctagggtaaaatacttattgcgccatctagatcctgctatcttacagccttttatgcaacaggtgttgaaagctgaaacggcaatagagataaaaaaattgtctgctgattttatggaaagacaaggattaggtggattaattcgcggaggtatctga

SEQ ID NO: 2312 - DNA, 402 bp, Proteus mirabilis
cgcacactagacctaggaggtattatgtttacttcatccaaagtggcgatacaggtacaaagcgtttacattgagagccaatcttcgccagaagaacagcgctatgtttttgcttataccatcaccatacataacttgaataaacatgctattcgcctcctacgtcgctattggttgatcaccaatgcacaaggaaataccactgaagttcaaggtgaaggggttgttggtgaacaacctctgattgaagctggctcacggtatcgttataccagtggcgcagttcttgaaacgccgatgggcaccatggaaggtcattatgaaatgattgacgcacaaggacgtctgtttcaaattgacatccctgttttccgccttgctatccctacattgataaattaa

SEQ ID NO: 2313 - DNA, 1653 bp, Proteus mirabilis
gtcgttatagaaatatctcagtgcagtgcattcacttgtttatcaactagaagatcactattgatgtctaatcctatttttcagcaagaagttgctcgtcgtagaacttttgccattatttcccaccccgatgcgggtaaaacaaccatcactgaaaaagtgttgttattcggacaagctatccaacgtgcaggaacagtaaaagggcgtggctcaaatcagcatgctaaatcagactggatggaaatggaaaaacaacgtggtatctccattaccacttctgttatgcagtttccttacgctgattgtctagttaacttacttgataccccagggcatgaagacttctctgaagatacgtatcgtactttaactgccgttgactgttgtttaatggtcattgactcttcaaaaggggtcgaagatcgtacccgtaaattaatggaagtgactcgattacgtgatacgccaattttgacctttatgaataaattggatcgtgatattcgtgatccgatggaattaatggacgaagttgaaactgagctaaaaattgcctgtagtcctgttacttggccgattggctgtggaaaactgtttaaaggggtttaccatatcttaagagatgaaacctatctttatcaaacaggccaaggtcatactatccaaaactcacgagtaatcaaagggttggataatcctgagttagatgaagcgattggtgatgatttagccgttcaattacgtgatgagctagagttggtgttaggtgcatcacatgagtttgatcatgaagctttcttagcgggtgaattgactccggttttctttggtaccgcattaggtaactttggtgttaatcacatgcttgatggtttggtgaagtgggcgccagcgccaatgcctcgtcaaactgatatgcgagaagtgacagcggctgaagagacattcacgggttttgtctttaaaattcaagctaatatggatcccaaacaccgcgaccgtgttgcttttttacgggtggtgtcaggcatgtatgataaagggatgaaactgcaccaagtacgcacgaaaaaagatgtggtgatttcagatgcattgacctttatggcaggggatcgttctcatgttgagcatgcttatcctggtgatattattggcctgcataatcacggtaccattcaaattggtgatacttttactcaaggtgaaatgttaaaattcaccggtattcctaacttcgctccggaattattccgccgtatacgtctgcgtgatccgctaaaacaaaaacaattgttaaaaggtctggtacaattatctgaagaaggtgcggtacaggtgtttagacccctagctaataatgatttaattgttggcgcagttggggtgctacagtttgatgtcgtggttgcacgcttaaaaggtgagtataacgttgaagccatttatgaatcagtgaatgtatcgacggctcgttgggttgaatgtagtaacgaaaagaaactcgaagaatttaagcgtaaaaatgagcaacatctggcattagatggtggtgataacttaacttatattgcaccaacgatggttaacttaaatttaacccgtgaacgctatcctgatattgagttccatcaaacgcgtgaacactaa

SEQ ID NO: 2314 - DNA, 3486 bp, Proteus mirabilis
gatatggcagatcctcgttttatccatctaagggtacacagcgattattcaatgatcgatggattggcaaaaacagggcctcttgtgaagaaagtggcttcgctgggtatgcctgcttttgcaattacagatttcactaacttatgtgggttagtgaaattttatggtgcggctcatggtgccggtatcaaacctattgttggtgcagatgtctatctggaaacggaactattaggtgatgaatacgcgcatttaaccattctcgcccgtgataatgtgggatatcaaaacctaacactattgatttctgaagcttataaacatggttatggtgcagccggaccggttatcaaacaagagtggttaacaacatataaagaaggtctcttgttgctttctggcggtagaatgggagatgttggtaaattcctactacgcggtaatcgagctttagttgagcaatgtcttgaatattatcaaacgcactttcctgatagctattatttagagcttattcgtaccgggcgtccggatgaagagagctacttacacgaagctgtagccttagcatcagaaaaagggcttcctgttgttgcgacaaatgatgtccgttttctggatagtgatgattttgatgctcatgaaattcgcgtggctattcatgatggttttacattatccgatcctaaacgtcctaaacactacagtcctcagcaatatatgcgcacagaagaagagatgtgtgagctttttgctgatattcctgaagcattagaaaacagtgttgaaatagccaaacgctgtaatgtgaccattcgtttaggtgaatactttcttcctcaattcccgaccggggatatgagtacagaagatttcttaattaaaaagtccaaagagggcttagaagagcgccttgcctttttatttcctgatccgcaagagagagaaaagcgacgtcctgaatacgatgagcgccttgagattgaacttaaagttattaaccagatgggattccccggttactttttgatagtgatggaatttatccaatggtctaaagataacggcgttcctgtagggccaggacgtggttcaggtgctggctcactggtggcttattcgcttaagataacagatctcgatcctcttgagtttgatctactgtttgaacgttttcttaatccagaacgtgtatcaatgcctgattttgacgttgacttctgtatggagaagcgcgatagagttatcgatcacgttgcggatatgtatggtcgtgatgccgtatcacagatcattacctttggtactatggcagccaaagctgttattcgagatgttgggcgtgttttaggacacccttatggctttgttgatagaatttccaagcttgttccccctgatccgggaatgacgttagaaaaagcttttgccgcagagcctcagttacctgaaatttacgaagctgatgaagaagtgaaatcgcttattgatatggcgcgtaaattagaaggggtaacgcgtaatgcgggtaagcatgccggtggtgtcgttatttctccaaccaaaattaccgactttgcgccactttattgcgatccggaagggaataacccggttacacaatttgataagaatgatgttgaatatgccggtcttgttaaatttgacttcttagggttaagaacgctgacgataatcaactgggcattagaaatgattaatgctcgacgggctaaaaaatcacttgagcctgttgatatatcagccatttcattaaccgatcagcgtagcttcgatatgttgcaacgctctgaaaccaccgcggtattccaattggaatcccgtggtatgaaagatctgataaagcgtctgcgaccagactgcttcgaagatatgattgcgttagttgcactgtttcgcccagggcctttacagtcggggatggtggataactttatcgaccgaaaacacggtgttgaagagatttcctaccctgatgttaaatggcaacatgagagcttacagcctgtattagagccaacttatggtgttatcttgtatcaagagcaagtgatgcagatagcacaggtacttgccggttataccttgggtggcgcggatatgttacgacgcgcgatgggtaagaaaaaacctgaggagatggcaaaacagcgctctgtgtttgaagcgggggcgattaaaaatggtgttgatggcgaattagccatgaaaatctttgacttggtagagaaatttgccggttatggatttaacaaatcgcactcagcggcttatgccttagtttcttatcaaacgctctggttaaaagctcactatcctgcggagtttatggcggcagtcatgactgccgatatggataataccgaaaaagtggtcggtctggtggatgaatgttggcgaatgggtttaaaagtccttcctccagatattaatagtgggctttatcatttccatgttaatgatgaaggcgaaatagtgtatggcataggggccatcaaaggggttggagaaggccctattgaggcaattgtcgaagcgcgtcaacaaggtggtcattttaaagatatttttgatctctgtgcgagaacagaaaccaaaaaattgaatcgccgagtgatggaaaaactgataatgtcaggcgcatttgataaattagggcctcaccgtgcagcattaatgtcttcgctggaagatgccttaaaggcggcagatcaacacgcaaaagcggaagccattgggcaatccgatatgtttggtgtattggcagaagccccagagcaagtggaacgttcttatgccaatgtacctaaatggccagatcaagttgttttagaaggtgagcgagaaaccctcggtttatatttaacgggacatcccatcacccgttatctaaaagaaattgaacgatatgcggcaggaacccgtctaaaagatttagtacctaccccccgaggtcagatggtaaaagtggcaggattagtccttgcttcgaaagtctttaccactaaacgagggaatagaattggtatatgtacgttagatgatcgttctggtcgtttggaaattatgttattttccgatgcattagataaataccaacatctattggaacaagatcggattttaattgctaccgggcaggtcagctttgatgatttcaacggtgggcttaaaatgacagtccgcgaattaatggatattaacgaagcgcgtgaaaaatatgctagagggcttgctatctcgttatcagacaggcaaattaatgagcaattattaaatcgtcttcgcggcgttttagaacctcatcgttcaggcacgatcccggttcatctttattttcaaaagcatgatgcctgtgcacgtttgcgttttggtgcaacatggcgagtaacgccgactgatatgcttttgaccgatctgcgaactctgctgggtaatgagcaggtggaattagaatttgactag

SEQ ID NO: 2315 - DNA, 1182 bp, Proteus mirabilis
ccaattgaagaaacagatttattttcgcaaaaggacaagataatggcgcaaccttcccgtatttcacttcagatcaaaaaaacagttatttcattagccattgctgctttaggctttacggcttcctcttctgcattggcttatcaaaaagtccatcaacccgataatagctatcagcaatatatttctcagcgtcaaacggtggatatgttgatccaagatgcattagaggcatttaaatcgccagcgcgtgtttctgacgctggatttacgggaaaactaccttctaatatggaagtggtagcacaaaagctacaacaagcttataaattagagccttatcgcttagatttactatttagtgccgccagtgcttatgtctataacaatcaaattgagcgtgcggtaacgatttataaacaaattttagaagctgcaccggatgatattgatgcactaatttatgtgacttcttggacgcgttttgaaggtaaagataaagaaagtgaagcctattttaacaagttaaaatcccttaatccggcaaaagctgaagagctaagtcgcttttttgctcaaattgatcgtgtaagcaaaatgccattaagtgataagttaacgccagcagatttggcaacactaaataaaaccaaaggaaataatgccattgtgacattgggttatgcacttaatccagatggtacgatgaatcagatcttgattgatcgtttaaataaaacccttgaagtcgcaaaacagttacctgatgcaatgattgttgtgacaggtggtgtgccgaaagcacatcaaaccgaaggtaaattaatggcggattggttagttaaacaaggtattcccgcagagcgaattttccaagataattatgcgcgctcaacggtggagaatgcgttatttagccgttatgcattaaccaaacaccgaattaaaacagcggtgattattagctctggtagtcatgttcgtcgtgctgatgctatttttacggttgcgagttggcaaagtggccccagtgatatcacttatttaacggttgtagcccccgataaaccattagccgaattacaaaaaacatcaaagtctgatttacaaggtatttatcgcgatggcttaaaagcattaggattatggagcttccgtagttatccattagaagagcgttga

SEQ ID NO: 2316 - DNA, 438 bp, Proteus mirabilis
cacaaggaagaacaactctcagtagaaaagcgtgacgattggctctcatatcccttcgaggaatacagtgtcgataatgctaccgtgagagaaatcgatgaagtcatcaatgtgccaaatattggacctgtcgtggtgactagtcatgaacaggaaaggtttgttgaatggttttctgacagagtgcccaagcatccttggaaggctttggcttcaaggttatttagctcatcattgacaaaagcaattttgcctgaaaaggtagctcttcataagaaccaaaaatatagtaacaaagctgatatttggctgcacagtaacagtgatttgcattttgtagtcgttcagtcaggagcaatgaagactttggttactgttttcagactaaataagtctctcaaaaaatctcaaaatgaaatcaagatgtgtgtccgataa

SEQ ID NO: 2317 - DNA, 2214 bp, Proteus mirabilis
acctatggagaaaaatgtatggatttggctttcgttatgcctttcttaacaattattggctgtgtgatcttagttattttagggctctttggtttattcaaagcgttttatattaaggttccacaaggtacagcattaattgttaacgacatgacatcacaacctaaagttcattttactggggctttagtttatccggttatctacaaaaaagagtttatgcgtatttcgcttttaaccttagaagtcgatcgccgtggtaaagatggattaatttgccaagataatttacgtgcagatattactgtcgccttctacctgcgtgttaatgaaacgacggaagatgtattaaaagtcgctaaagcgattggtgtagatagagcatcagatcatcaagccgtgagtacattatttagtgctaaattctctgaagccttaaaaaccgtcggcaaacaatttgagttatcgaaattatttgaagatagacaaaatttccgtgatcgtattgttgatgtgattggtaaagatctcaatggttatgcgttagaagatgtggccatcgactatttagagcaaacacctaaatcagcccttgatccaaataatatttttgattcagaaggtattcgcaaaattaccgaaattactgcaatacataatatcgaaacgaatcaaaaagagcgtgaccaagagttagcgattcaaaagaaaaatgttgaaactcgcgaagcaagtctggctttagagcgccaacaagcagatgcagaagctcgccaacagcgtgaaattgataatatccgtgcccgtgaaagttcagaaaccttacgagtacaagaagaagagcgtctaaaagcagagcaagctcgtattcaaactcagcaagaaattgaaatacgagaagaaaaccgtatgcgtgaagtcgaagtcgcgcaacaaaaccgcaccagagcggtagctattgagcaagagcgcgttaatcgtgcccgtgaattagaaattgtcgctcgtgagcgagaagttgaactacaacgtattgaaaaagaaaaagcgttagaagaagagcgcaaaaatatttcaaatgtgatccgcgagcgtgttgctgttgaaaaaacggtcgcacaagaagaagagcgtattaaagaagtacgtgaagtctcagaagctgagcgtatgcgccaagtgacggtgattaatgcgcaagctgaagccgaagaatctttagtacgccaagtgaaaaaagccgaagcggatgaatcaagtgcaaaacataaagctgaagaaatcagcaccatggcaaaagcagaattagaagcctctgtgaaacaagctgaagcgaaaaaacgcttagctgaagggatcgaagctgaacacgcagcattaggccttgccgaagcacgtgttcgtcaagcaactgccgaagcagaagaaaaagaaggtttagtacaagccaatatcacagcggaacagctgttggcacaagcgcgtggcttgaaagaaaaaggcttaagcgaagcgcaagtcatggaagcaaaagcacaagcgcaacaacaacaaggttttgctgaagcgaaaattcttgaagagaaattagcagctcaagctcgcggtgaagagcaacaagcgaatgctaaagaaaaactgggtcttgctgatgcgaaaattcttgaagaaaaactggccgctcaagcgcgtggtgagggtcaattaggttcagcacaagcagaagtgatccgccaacgtctgaaagcagaagctgacggtttaacagataaattcaagtcaatggatcacctcagtgatactgctcgtgctcatgaagagttccgtatgcgccttgaaaaacaatttgaacaagccatggcttctattgaagcaaataaagagattgctcgtgagcaagcggatgtattagcagcagcactgagcaaaacgaatattgaaattgtcggtggtgatggcaacttctttaataccttctctaaagcactgagcttaggtaaagcggttgatggttttatggataaaagtagctttgccaaagagaacgttgagaaattgattaatcgtactcagcaagataaaaaattagatgttgcttcactgctaaaaaatccagaagttcaagaattaattaatggatttatggcgactaaaggtgcgggtcaactgatcaaagaagtcacagcaaaatcagacaccccaaaagaagattaa

SEQ ID NO: 2318 - DNA, 1536 bp, Proteus mirabilis
atatatttggaaaatttacctatgagcaaagataataaaaaggcaggaatagaaccgaaggttttttttccgccattaatcattgttggtattttatgctggttaacggtacgcgatcttgatgcttcaaatgaagtgatcaatgccgttttcagctatgttaccaatgtctggggttgggccttcgaatggtatatggtgatcatgtttgggggctggttctggttggtttttggacgttatgccaaaaaacgcctgggcgatgagaaaccagaatttagtacggcaagctggatctttatgatgtttgcttcttgtacatcagcggctgtgctgttttggggctcaattgaaatatactactacatttcaagtcctcctttcggtatggaaggttactccgcgccagccaaagagatagggttagcttacagcttattccactggggcccgctaccttgggcaacctatagtttcctgtctgtcgccttcgcttacttcttttttgtacgcaaaatggaagtgatccgcccaagtagcactttaacgccattagtgggtgaaaaacacgttaatggtttatttggtactgtcgtcgacaatttctatttagtcgctttgatcctagcaatgggcaccagccttgggcttgcaacgcctttggtaactgaatgtattcaatacttatttggtattcctcacactctacaattagatgccattattatttcttgctggatcttactcaacgctatttgtgtggcatttggtctacaaaaaggggtaaaaatcgccagtgatgtgcgtacttacctgagcttcttaatgttaggttgggtatttatcgtgggtggtgccagctttattgtcaattacttcacagattctgtgggtacattgctgatgtatatgccacgtatgttgttttacaccgatcctattggtaaagggggttttcctcaggcttggactgtcttctattgggcttggtgggttatttacgccattcaaatgagtatcttcttagcgcgtatttctaaaggtcgtactgttcgtgaattatgtttaggaatggtatcaggtttaaccgcaggaacttggctgatttggactattctggggggtaacactttacaactgattgaccaaaatatccttaatattccgcaactgattgatcaatatggtgtaccacgcgccattatcgaaacatgggccgccttacccctcagtacagcaaccatgtggggcttctttattctctgctttatcgccaccgtcactttaatcaatgcctgctcttacacactagcaatgtcaacttgtcgctccatgaaagaaggggctgaaccaccattattggtacgcatcggctggtctgtattagtcggtattatcggcattattttactagcattaggcggcttaaaaccgatccaaaccgccattattgccggaggatgcccactatttttcgtcaatatcatggtcaccttgtcctttataaaagatgccaaagtgcactggaaagattga

SEQ ID NO: 2319 - DNA, 597 bp, Proteus mirabilis
tatcgtctggaagataaccagttcccaagggtttataacgtgattaatgaaatcaaaaaagatgctcaagaacgcatggacaaaagcgttgaagcactaaaaagccaaattaataaagttcgtactggccgtgcgtctccaaacctattagatggtattgttgtagaatactacggcgcaccaactccattaaatcaagttgctaacgttgtggcagaagatggccgcacattggcaattacagtgttcgatcgtactttagcacctgctgttgaaaaagcgattatggcatcagatttaggcttaaatccttcatctgcaggcgcgatcatccgtgttccactgcctccgttaactgaagaacgtcgtaaagacttaatcaaagttgtgcgtggagatgcagaacaaggtcgtgtctctattcgtaatatccgtcgtgatgctaatgataaaatcaaagcattactgaaagataaagaaattagtgaagatgatgaacgccgttcacaagatgaaattcagaaattaactgatatgttcattaaaaaaattgatgaagcattaacgctgaaagaagctgagttaatggaattctaa

SEQ ID NO: 2320 - DNA, 189 bp, Proteus mirabilis
atgttttcggacgcggggtggagcagcatggtagctcgtcgggctcataacccgaaggtcgttggttcaaatccggcccccgcaaccaatcctttccctaattttattttctacaaattcccattaaatactctcttaatccctactctatttacaataaccaatatactccctgttactgagttatga

SEQ ID NO: 2321 - DNA, 816 bp, Proteus mirabilis
agatttgaggagtctatgcgctattggggaaaattattaggccttatcatcggtagttttgccgggatcggcttttggggcattgtgattggggtttttctaggacacctttatgacgtacaaagaagtaaattaagctatggtgggcgctataatcgtgatagacaagcctatttctttgctgccacattccaagtcttagggcatttaaccaaatccaaaggacgagtgacacaaaccgatatcacattagccagtacgttaatggatagaatgaatttacatggggcagcacgtcaagcagcacaacaggcgtttcgagaaggtaaagaggttgatttcccacttagagccaccttacaacgtgttcgccaaatttgtgccggtcgccgtgatttactgcagatgtttctggaaattcaattacaagccgcatttgctgatgggcagttacatcctaacgaacgtaagatgctgtttattattatagatgagctcggattttctcgtgcccgttttgaacatatattagccatgatgcaggcggggcaaagttttcattatcaacaagggcaaaattatcagccacaaactcaaggcccaacgctttctgacgcctataaagtgttaggtattaaagagggtgatgatgttaaaacaataaaaagagcttatcgaaaattaatgggagaacatcatcctgataaattggttgcaaaaggtttaccaccggagatgatggaaattgcaaaacaaaaagcacaagctatccaagttgcttacgatttgattaaaaaagaaaaaggatttcgttaa

SEQ ID NO: 2322 - DNA, 1581 bp, Proteus mirabilis
aggggtgaggagatgaatcaaacaaccatgttaacaatcttaatgtttgcaccgctggtattttcgatattggcatttttaagcccattattgaaagcagcggcacgtcctatcgttacaggcattcatactataggtatttttgtcttagtcattgccgcgttaggcactgttgctgatgtgatgtcccatggcgaaatactggcggcagcgaaatgggttcatgttgatagtttaggggcactatttctagccattttaggcatcattggttttttaaccggcctgtattctattggttatatgaatcatgaagtggatgagggcgaaatttctgttcgtactttatgtaactactatggtttcttccacctcttccttttcaccatgttattagcgatcaccagtaataacttgatcttgatgtgggccgcgattgaagccacaacattaagctctgctttcttagtagggatttatggtcaacgctcttcattagaagctgcatggaagtacattattatctgtagtgtcggtgtcgcatttggtctttttggcacaattttagtttatgccaatgcagcaagctttatgcctgatcctgatcaggccatcttctggacagaagtgttgaaatatacacatcagttagatccaacactgatgcatttagcttttgtatttattttgatcggtttcggtaccaaaaccgggttattcccaatgcatgcatggttaccagatgctcacagtgaagcgccaagccctgttagtgcgctgttatctgcggtgttattaaactgtgcgctgttaatcattattcgttactacattattattgatgcagcaataggcactgaattcactcgtaacctattgttaatctttggcttcctctctgttgctatcgccgcgttctttattctgatccagcgcgatatgaaacgcttattagcgtactccagtgtggaaaacatggggttaattgcagtggctctgggtattggtggcccgattgggattttggcggctttattccacacgttaaaccacagcttagcaaaagcattgctgttctgcggctctggtaacgtgttactgaaatacggtacacgggatctaaatgtcgtgaaaggtatgtttaaagtaatgccattaagtgctgcattatttgctggcggtgctttggcattagggggcatgccaccatttaatgtctttatcagtgaatttatgattgttgttgcaggcttagcagctaagcatatgggattaacaattctattattattgttattaaccgtagtattaggtggattagttcgtatggtagctaaaacggtatttggtccaaaaccggatgtggttgccaaaggtgaattaggtctgttaaccacactaccgatgatcattttgattgcgcttatgttgttaatgggaacacatattcctaagccagtcagtgagttattggagaacgcagccaatatcgtgatgaatatcgatgagagtggatcaccaaattatacatggccaacaacgttaatcagcaatccatcaatatcggttcaggagaagtaa

SEQ ID NO: 2323 - DNA, 879 bp, Proteus mirabilis
atctgggaggataatttgcttaagtatcgtgtcattactgcattaatactaatccctattgttattgctgctttatttcttcttcctcccgcaggatttggattagttattattgccatttcaggcttagcgggttgggaatgggctcaatttatcggctggcattctcaaggcaaacgtattgctactggtgttggatttgctgcactcttagttcttatgcaagcctcgttaccggattttgatcatctgcttgatacagcaatgattaagaatagcttatgggctgggctcttttggtgggtagcggcgattttattagttgtcagttatccgaattcagccaatatgtggaaaaattctgttcttcttaagttattgttcggtatattgacgattgttcctttttattgtggcatgatggcgctacgtatgttgggatatagcacaaactcatatacaggggcttggtggttactgtatgtcatgttattggtttgggctgcggactcaggggcttatgcatttggccgtttaatgggtaaacataaaatggcaccgaaagtatcaccgggtaaaaccttggaaggtctggtgggcgggttaatcactgcaggtgttgtttcatggctatttacgcgtttcgcaccaattactgaagtgcctaaccatctattactgatttcgggcatcgtggtgattgtttccgtattcggcgatctggctgagagtatgtttaaacgtgtttccggcataaaagacagtagtcagcttatccctgggcatggtggtgtgctagatcgtattgatagtttgaccgcggcgatccctgttttcgctggattggtgtttttagtttcttctggctttcaaatgtaa

SEQ ID NO: 2324 - DNA, 594 bp, Proteus mirabilis
tgtactatactcaaatatacaaaatgccccctcgttgggggtgatttagtagaggttgatatggagttaataagagcaattaatgtttttaacaaattcagtaagcaaggtagaaatatcttcctcaccaaagatttaaaaatgctttttcctgatgagtctccgaaaacattacaaaaatcagttgaccggctgatcgcgcatgatgtgctacgccgagcatcaaaaggtgtgtatatctatactcaaggttcattggggccttaccctttagaacgtctggccgaaaatattcgacgaggccactacaactacattagtttggaatccgctctatctcagtacggtgtaatttcacagatccccatcgacagacttacgattatgtccacaggtcggtctggagagtttgtaacgccttggggcgttattgaggttacccatactgccaagaggcctcttgaaatactcaatactacggtggaaggaagggggccattaagaattgcaacaaaggagactgccattaaggatctaatgaaggttggcaggaatacacacctcatccaacgtgaggaattaaactatgtctga

SEQ ID NO: 2325 - DNA, 945 bp, Proteus mirabilis
cctgttgtacttgttcatcttctacagggggaagttctttatcagcttgtagtctggctaggcgctcttgctccgccttttcttgctcagcttgtagtctggctaggcgctcttgctccgttttttcctgctcagcttgcagtctggctaggcgctcttgctctgctttttcttgctcagcttgcagtctggctaggcgctcttgctccgttttttcctgctcagcttgcagtctggctaggcgctcttgctctgctttttcttgctcagcttgcagtttggctaggcgctcttgctccgctttttcttgctccgctttttcttgcttcgctttttcttgctcagcttgcagtctggctaggcgctcttgctccgctttttcttgcttcgctttttcttgctcagcttgcagtctggctaggcgctcttgctccgctttttcttgcttcgctttttcctgctcagcttgcagtctggctaggcgctcttgctccgctttttcttgcttcgctttttcttgctcagcttgcagtctggctaggcgctcttgctccgctttttcttgctccgctttttcttgcttcgctttttcctgctcagcttgcagtctggctaggcgctcttgctccgctttttcttgcttcgctttttcttgctcagcttgcagtctggctaggcgctcttgctccgctttttcttgcttcgctttttcctgctcagcttgcagtctggctaggcgctcttgctccgctttttcttgcttcgctttttcctgctcagcttgcagtctggctaggcgctcttgctccgctttttcttgcttcgctttttcctgctcagcttgcagtctggctaggcgctcttgctccgctttttctagctccgccttttcttgctcagcttgcttatctttttcatctgcaatttctttttgttcagtattga

SEQ ID NO: 2326 - DNA, 423 bp, Proteus mirabilis
aaaaaaacacttttctcccccttgaagttttattggatgcccccacttgtatcgtcatggtactggttcatcttaggcactggtatcaaccttaatcctgatatggacttttttataggagatctattaatgaagattcgtccattacatgaccgtgttattgttaaacgtaaagaagtcgaagctaaatcagcaggtggtatcgtactgactggctctgcagcgggtaaatcaactcgtggcgaaatcttagcagttggtaacggccgtattatggaaaacggtgaagtcaaaccactcgatgttaaagttggcgatatcgtaatttttaacgatggttatggtgttaaatcagaaaaaattgataacgaagacgtgcttatcatgtctgaaagcgacattttagcaattgtagaagcataa

SEQ ID NO: 2327 - DNA, 951 bp, Proteus mirabilis
cttaacaaactttctttttatatcactattattatggtcatacgtcctaatcaacactggttttttcggttatttgattggcacggttcagtgctatcaaaaataatctttcgcttatgtcttaatattgcaatgtctattatcgctattttggtttatcaatggtatgagttattaggtattcatttaactgttgccccatttagtttattaggtattgctatcgcaatatttcttggttttagaaataatgcaagttatagccgacttgtggaggcaaggacattatggggaaatatgttaattacccatcgcaacatattaagaaatataaaagccttattaccggaagataaacaatttaatcgtgacttttctaatctacttattgcttttagttggagtctaaaacatgagctaagaaaaacaaacccaatggtcgatctctatcgcctcttaccccgacctttatttgatgagataatgaatagcccttaccccactaatcggattttattgcatattggcctaaaaattggcgaattgcgagataacaaagtaataagtgatgttatctttcaatcaattaataaagatattaataacttatctgatgtattgggtggctgtgaacgtatttcaaatactcctgtaccttttgcctatacgctcatattgcaacgtacggtatatctattctgtgctctgctaccttttgcattggttgccgatctccactatatgacgccatttgtttccgtatttatctcttatacttttttatcttgggactcattagctgaagagttagaagatccattcggtgtttctgccaatgacttaccattaaatgcaatatgtaacaccatagaaaggaatttattagagatgcaagatatcaccccactccccatcaaagttaaacccgaccaatattataatttattgtaa

SEQ ID NO: 2328 - DNA, 423 bp, Proteus mirabilis
actttgatttgtaatattgttggagtaaatatgtgtgaagaagacataaataaaccactctatttgttaattgcagactgggttcaagagcaacaacgctgggtgagtgcgaaagagatcgctaaaaattttgatatcccccaatgtaatgcgattaatatcgtttcttatattctttctgatgtaaaagagattgagtgtgaaaccaaaagcgtgcctaatcaattggaaggaagagggtgccaatgccaacggatgatcaaagtcagtcatattgatcctgctctttactctcgtttaaaaggtcatacgcaaagtaaaagtcgtttaagcgccccagagaaattagcagctatgatcccccatgggctggatcaccaacaaaaatggcaatggatgttgtcaaaatcacaacggcgttaa

SEQ ID NO: 2329 - DNA, 2958 bp, Proteus mirabilis
atgagtgaactgactcatgatggtgtagagcgccaaccgctccacttatttacggaaaatgcctatctcaattattcaatgtacgtgattatggatcgtgcattgccttttattggcgatgggttaaagccagtacagcgtcgtatcgtctatgcgatgtctgaattaggtttaaacagcagtgctaaatttaaaaaatcagcacgaacagtgggggatgtattaggtaaatatcatccccacggtgatagcgcctgttatgaagccatggtattgatggcgcaacccttctcttatcgttatccattaattgatgggcaaggtaactggggggctccggatgatccaaaatctttcgcagctatgcgttataccgagtctcgcttatctaaatattcacagatcctgctaagcgaattgggacatggtactgttgattggatccccaattttgatggcaccctgcaagagccaaaaatgttgcctgctcgtttacctaatattttattaaatgggacaacggggattgctgtcggtatggcaacggatattccgccacataatgcgcgggaaatcggccaagcattaaccatgctattagataatcctgatgctgggttatctgatgttatgcaatatgtacaaggacctgattatccaacagaagcggaagtgatcaccgctcctgaggatatcaaaaagatttataaaacaggacgtggttctattagaatgcgtgctgtttggcaaaaagaagagggttgtgcggtgataacagctctccctcatcaagtctctggtgctaaggtacttgaacaaattgctgcattaatgcgagcgaaaaaattgcctttagttgatgatttacgtgatgagtcagatcatgaaaatcctactcgattggtgattgttcctcgtagtaatcgcgtcgatttagaacaagtcatgtattacttatttgtaaatacagacttagagaaaagttatcgcgttaacctcaatatgattgggttagataaccgtcctgctgtgaaagggctattaaccattttaaatgagtggttagtttatcgccgtcaaaccgtaaccaatcgtttaaaccatcgcttagaaaaagtattacgccgtttagaaattctaaaaggtttattaatcgcttatctcaatattgatgaagtgattgagatcatccgttatgaagatgagccaaaagcggaattaatgcgtcgttttgcattatcagatattcaagcagaagcgattttagagttacgtttacgtcacttagctaagcttgaagagataaaactgcaagctgaaagtgatgaactggaaaaagagcgcgacagtattgtaaaactgttaaattctcctcgccgtctcaatacgttattgaaaaaagagatagaggcggacgctaaagagtttggtgatgaacgacgttctcctattcgacctcaagaagaggcgaaagtggttaatgaacaagatatgttgccatcagagcctgtgactattgtgctttctgaaatgggatgggtgcgtagtgcgaaagggcacgaaattgatcctagtaccatgagttatcgtgccggagacagttatcatagtgcggtacggggtatgagcaaccagccagtattgttccttgattcaacgggtagaagctatagtttaagtcccaatgacatgccatcaggccgtagccaaggtgagcctttaaccggtaaattgaccttcccccctgacgccagcgtaaaatatatgttagcgggagccgctaaacaggagtatttactggcaacaaaagagggttatggctccgtactcagttatgaagagatggagacaaaaaataaaaccggtaaagggttgttaacggtttcagatgaaacagaattgctagcgcctttcttagtcgatgcagaaaagaaaaacaatcaacattggttagttattatcaccgataaaacacgtattctggcgatatctgcagaacatctaaatgagatgaataagaaaggtcgaggcactcgcttagttgcattaggcaaagagcaaagtgatgttatcgaacaaatcgtgttaatagcaaaaaatgaagccctcacatttactgttgatggtcaacaacaaacattaaaagcagaagagattagctattttagtggtgatgttggcgatgagcctatcccattaaaacatcttcaccctgaagcggttaccgtgatcatgtccgaaaaagggcttatccgttgccaaaaaggccataacattgatgcgaaatcagtgggctttaaaacaggggatgattattttgatgcagttgaagggatgagcaatcaagcggtacatctgattgataccacgggtcaaagttatactgttgatgttgacgcattaccatcaggccgtagtaaaggtgatgatttaactggacgattaaaagtccaaaaaggggctcaattacgtcatgtagtgatgggggaaagtagcgataagatcttaatggcatccgacgctggttatgggtttatctgtagtattgatgacttaacctctaaaaatagagctggtaaatcattattaacattacctgaaaatgcattaccattaccacctcaacgcttaaatgatgaattgagtgatttgatcatgatcattactcagggtgggcgaatgctgatttttgaagcctctgagttgccaactatggtaaaaggaaaaggtaaccaaatggtttctattcctgcttcacaggctgcaagtggtgaagataaagtcgcttggttgcgggtattaccagaaaatgccagtgttacattgcattttggtaaacgtaaactcacgatgtcgatgaatgaattacagacatttaaagccaaacgtggtcgtcgtggaacatcgctccctcgtggtgcacaaagtatcgatcatatagatatcgaaactcattaa

SEQ ID NO: 2330 - DNA, 375 bp, Proteus mirabilis
gaaggggattgccatgggttttcggcattggcggcaaaagagcgctctgcaccttctgcaacacgagccattgcacgaacggcttcttcaggatatttacctgcagctgtttctgcagaaagcatcaccgcatctgtgccatcacctactgcattagcgatatccatcacctccgcacgggtaggcatgggattttcaatcatggactccatcatttgggtggctgtaataaccgggcagcctagagcacgacaacgagcaattaactgtttttgtgcaccaggaagacaggcatcgccaatttcaaccgccaagtcccctcgcgctaccataatgacatccgatgctttaataatgtcatccatattggcttga

SEQ ID NO: 2331 - DNA, 438 bp, Proteus mirabilis
aatgaattctgttcgctgtatctcattcatctttctatctggtgccaatatatgtacgataatttaaaaaatttagggatccaacatcctgaagatattgatcgctataccctacgtcaagaagctaacaacgatattttaaaaatttattttcgcaaagataaaggtgaattctttgcaaaaagtgtaaaatttaaatatccacgccaacgtaaaacaatttctgatactcaatcaggacaaggttttaaagaagtcaatgaaatcaacactaacttacgttatgtgattgaagaattagatcaaatttgccagcaagatcaagtggaagtggatttgaaacataaaatcctcgatgatttacgtcaccttgagcacgttgttgccaataaaattgctgaaattgaagccgatttagaaaaattgactcgtcgttaa

SEQ ID NO: 2332 - DNA, 645 bp, Proteus mirabilis
atttattgctgtcatagaactaaaagctcaccaataaaaggatattttatgcgtaagttagtcgttggtttggttttgcttcttatcattatttttgttgtattgattaattcttataataaaatccagaagaatgacgagttagttactgcggcggcatcagaattattaaatcaatatcaacgtcgtttagatttgatccctaatctagtcaatacagttaaagggtactcaaattatgaaagccaagtattacaagatgttgtaaaggcaagagcgtctgttggacaaattaatgtcaatacgcgtttatttgaaaattctacacttgctaccagttatcaaaaagcacaggatgatttgggaaaatctttatcacgtcttttagctatttcagaaagatatcctgacttgaaagctaacacattatatcaagatctgatggtgcaattagagggagccgaaaatcgtatctctgttgctagagggcgatatatcgaggcagttcgtcattataatactcagattagacagtttccttataacttcatagctatcgttatgggatatgataaaaaagtcaatttcactgttgagagtgaacaggaaataaaagtaacaccagtggtggactttgcctcatga

SEQ ID NO: 2333 - DNA, 1560 bp, Proteus mirabilis
atacatttatgttatttaattaccggggtggattatttcatgagtattgaaagaacagcgaaagtaggctctattatactattagctattttcttagtgacatcagctttatcatcgttttttatttatcaaatgcaggataattttgcttcattaaactcgttaaccacgagattaaataatgtgcaagaggcaagatatgaactagcaaccatacgctctcatgttaactttttagtcaatattggtcatgaaaatttagatatgcaagaaaccaaagctcgattagtttctgaagctaaaacattagcggctaaatcaaaagagacaattaacgcttgggaaagggaaagcaaaatcagtgctgacgcacaaagaaactcagaacaattatcggcactatttatcaaactcgtcgatactattattgcgcctattgatacgctagcttatgaaaatattgatttatcgaaagatttttccaaacttgctgagttgtttgatgaatacttagtgataactcaaaatgttaatgatcaaattgaagacgaacaaaaatggatgtttcaactctttatttacactacatgtattgctttagtgatactgattggactgctttatttagtgatccgttgggttaataaaacctttctctttaacctcaatacactctctgccattttgcaaaaagtgggagaagggaatttaaacttctcgttacccaaaaatagaaaagatgagtttggtacactattttctcatgtcggtgatatgcaaaatgcactgacatcgactattggtttggtgaaagaagaagcattagtgatcaaaagcggttcagcagaaatcgcagcgggtaatcaagatctctcttctcgtacagaagagcaagcgagtgcattgcaacaaaccgcagccagcatggaagagataaaaattgcggtagtgaataataccaataatgccgtattagcaaactctatcacagcacaaacgcgtgatttggctatcgatggcgctagcattatgaatgatgccattacttcgatgaaaaaaattgaagtcggtacgttaaaagtcgctgaaatcaatgacgtggtaaacaatattgccagtcaaaccaatattcttgcgttgaatgcggcagtggaagccgctcgtgcaggggagcaagggcggggttttacagttgttgcaacagaggttcgcaatttagcagccagaagtgcggaagccgctcgtgaaattaatcagattattcgagcttctgtggcggatgtcgcacatggtcgtgaactggttaataaaaccggtgagcatatacaagaaattgtcacctcaattaccaaagtaagcgatattatgcagggaattagcattgcatcggaagagcaaaaagtgggaattgaacaaatagccgtcgcgataaatcaaatggattctgtggttcagcaaaatgcggctttagtagaacaaggagccacctcaaccatgatgttagatgaaaaagcacaaaatctgaccgataaagtatcagtttttcaaatcaaagaataa

SEQ ID NO: 2334 - DNA, 810 bp, Proteus mirabilis
tatgggcaatgtcgggagtgtgaaaaaatgagtctaccagaaattcccatcaatcatcatgtcagccaacctatcacattaagtgatcaggtgaaaaagctgaaaaaaacgttattgaaagatattcaacgttccgcgtatgtttatcgtgttgactgtggtggttgtaatggttgtgagattgaaattttctctgcaattacacctgtttttgatgccgagcgatttggtatcaaggtggttgcttcacctcgccatgctgatattttgttatttactggtgccgtaacacgccaaatgcgtgtaccggcattacgtgcttatgaatcagcaccagatcccaaaatttgtatctcttatggggcttgtggttgtggtggtgggatattccacgatctctattgtgtatggggtgggagtgaaaccatcgttcctattgatgtgtggatacctggttgtcctccgacacctgcagcaactatttatggttttgctgtggcattaggcttattagatcaaaaactaaaaggtcaaaatcacactgaagtggataatgagcaagcgtcactgttactgccgtcgatccctcttgatactcgcgtaatgatagagcgtgaagctcgtcgtcttgctggttattatcaagggcgacaaattagtgatcatttcctcactttacttgatggtgccacagtacaagaagtcagtgggcgtgttgatgaatggttacgccaagcgaatgatcctcgtttagcggaaattgtaaaacgactggtgcattcattaaaccaaggaggcgttcatgtctga

SEQ ID NO: 2335 - DNA, 186 bp, Proteus mirabilis
tcaacgaaatgtcattgctttgacgtcgagattgacttgggagtcggtaatgtagaagtcgtgcctgatatcaagggaagaattcctctcattaactgggttcaggccggtgattggactgaaatagcgaaggaatttgcctatgaagatgctgaagagtggcgtgaagtcacagggaaagcatga

SEQ ID NO: 2336 - DNA, 801 bp, Proteus mirabilis
agtaaggagtgttcaagaatgagtcgatttattgatacgcattgtcattttgattttcccgtcttttatcacgaccttgagaatagccttgctttagcacaacaggctcaggtaaaaaaaattattattcctgcggttgctcagtggaattgggacgcggtaacggaattgtctcgttataacaatgcactatattgtgcactaggtttgcatcctttatatattgaagcgcatacagagcagcacttgattgaacttaaaacacgcctaaaaacgacgccacgttgtgttgcaatgggggagatgggtttggataactatatgacaaatccacatccggaaaaacagcaacaatttttaatagcacaacttaaattggcgatagaatttgatttaccagtgatccttcattcacgtaaaactcatgataatctaagtgctattttgcgccgttattcagttcctcgtaaaggtgtgatccatggtttttccggcagtctgcaacaagcagaacgttttgttcaacaaggctattttattggggtagggggcactatcacttatccacgcgcacaaaaaacacgtcgtgcaattgcctctctacccttagagcgcttgttattagaaacggatgcgcctgatatgcctgtaagtggttttcaaggcgagcctaaccgccctgagcgaattctcgctgttttttcttctctttgtgaattgcgtcaagagtcagcagaggttattgcaaaccaactttacctaaatagtctacaattatttcagttaacagatgatgcctag

SEQ ID NO: 2337 - DNA, 354 bp, Proteus mirabilis
ctaagtaggtgcgcatttagcataaaaataggatgtgcagtccgtcagcgttacgaagttagagtaaaattatatataaaaaaagcaccgccttggcggtgcattataaaatcactatggacagacagggtaaatgtacaggaagtgaaaaaaaacagtagcatcagctacaaagtctggaatttccagacaacttgcaaacacaacatcacaaccacaaagccaaaagttttgcagtattgctactacacaacttttcgttccggcttaggaagtgcgagtactataggtatttactggctaatcatcaagggacaaattataatgcttcgcataaaaaaaactaataactaa

SEQ ID NO: 2338 - DNA, 267 bp, Proteus mirabilis
gggtggtttcgcacttcgcgtaaaaggcgacagtatggaaaatccaagcggaaaaaaatcatacccgagggggctgtgatcgttgttgatcctgagttatcttattcttcagatttattggttgttgcgcgtttggatgattcgaaagaagcaacctttaagcagttagtcattgacgatgaacagaaatacctaaagcctctggactcccaatattcagcaacagcgatcaacgacaacggcaccatcattggtgtggcacgataa

SEQ ID NO: 2339 - DNA, 594 bp, Proteus mirabilis
gtcatgtctcgtatcctctatttacatggttttaatagctcgcctcaatcagccaaggcgcaagggtttaaacaatggttatcagtcactcatcctgatattgagctacttgtaccccaattacccccttatcctcagcaagccgctcaattaattgaaaaattagtaaaagataatgccaatgataagttaggattaattggctcgtcgctggggggctatcttgctatttggttatcacaacgttttcatttacctgcagtggtggtgaatcctgcggttcgcccgtttgatttgctacaggattttttaggcgataatgaaaatccttatacacatcaaaagtatagattagcacctcaccatatggatgagttacttgccttacgtattcctacgataacttcccccgaacttatttggttgcttcaacaaactggagatgaaatacttgattatcgtcaagcggtttcatatcttggcgcttgtaagcaaacagtagagcagggaggaaaccatgcttttgttaattttgaacgttttttcccggaaattgttcagtttttgaaaataacatcgttttcgactcattaa

SEQ ID NO: 2340 - DNA, 1914 bp, Proteus mirabilis
accgtttatcgccgaccgacaccaacccaaattactttgaagtgtggataccgtcttatggagcaaaacccgcagtcacagctgaagctacttgttacgaaaggtaaggagcaaggctacctgacctatgctgaggtcaatgaccatctgccggaagatatcgtcgattcagatcaaatcgaagacatcatccagatgattaacgacatgggcattcaggtcatggaagaagcacctgatgccgatgatctgatgttggcagaaaattcaaatgacactgatgatgatgctgtcgaagccgctgctcaggtactttctagtgtagaatctgaaattggccgtacaaccgatcctgtgcgtatgtatatgcgcgaaatgggaaccgttgaactgctcacccgggaaggtgaaattgatatcgcaaaacgtattgaagatggtattaaccaagttcaatgctcagttgctgaatatcctgaagcaatcacttatcttcttgaacaatatgatcgtgttgaagccggtgaagcgcgtctttctgatttaattactgcctttattgaccctaatgccgaagaagtggcagaaagtgatgatgtcaatttaggcaaagacgacgatgaaatcgacaacagcgccgatgacgaagatgaagacgaagatgaagatagcgacacagacagcgatagcgatgatgataacagcatcgatcctgaacttgctcgccaaaaattcaccgagcttcgtgaacagtacgaaaaaacgcgtcaatctattaaggccaaaggtcgtaatcataaagataccgaactggaaattttacagttatcagaaattttcaaacagttccgcttagtgccaaaacagtttgattatctggttaacaacatgcgtgaaatgatggacagagtccgtgctcaagagcgtcacatcatgcgtctttgtgttgatcaggtcaaaatgcctaagaaaaacttcattactctgtttacaggaaatgaaactaacgacacatggtttactgccgctcgtgcgatgaataaaccttggtctgaaaaactggcaggtattgaagaagaagtacaacgtagcttacaaaagttacaacaaattgaagttgaaacaggactgacaatcgaacaggttaaagatattaaccgtcgtatgtctatcggtgaagcaaaagcacgccgtgcgaaaaaagagatggtcgaagcgaacttacgtttagttatctctatcgcgaaaaaatataccaaccgtggcttacagttccttgacctgatccaggaagggaatattggtctaatgaaagcggttgataaatttgaatatcgtcgtggttataagttctcaacttatgcaacatggtggatccgtcaggctattactcgttcaatcgccgatcaggcacgtaccattcgtattccggtacatatgattgaaacgattaataagctaaaccgtatctcgcgccaaatgttgcaagagatgggacgtgagccttcaccagaagagcttgcagaacgtatgctgatgcctgaagataaaatccgtaaggtactaaaaatcgctaaagagcctatctccatggaaaccccaattggtgacgatgaagattcacatttaggtgattttatcgaggatactaccctcgaattacctctggattcagcaacatcagaaagcttacgttcagcgacacacgaagtattaggtggtttaacactgcgtgaagctaaagtcctgcgtatgcgctttggtatcgatatgaataccgaccatacattggaagaagtgggtaaacaatttgatgttacccgtgaacgtatccgtcagattgaagcaaaagcgttgcgtaaattacgccacccaagccgttctgaagtgctacgtagcttccttgatgaataa

SEQ ID NO: 2341 - DNA, 1074 bp, Proteus mirabilis
tgctacaatcgatccattacgccattgcgcgaggaagaatttggaagcgtcatgcgagttttaggtattgaaacatcttgcgatgaaaccggtatcgcaatttacgatgataaagccggtctgttagcgaatcaactctatagccaaataaaactgcacgccgactatggtggtgttgttcccgagcttgcttcacgagatcatatccgcaaaacagtgccactgatccaagccgcccttaaagaagcaaatttaactgcaaaagatattgatgcggtcgcttatactgcaggaccagggctggtaggggcattgctggtgggggcgaccattggtcgttctctggcgtttgcatgggatgtgcctgctattccagttcaccatatggaagggcatttattagcgccgatgcttgaagagaaaacgccagattttcctttcgtggcgttacttgtctcgggggggcatacacaattaattagtgtaacagggattggggaatataccctgttaggtgagtctattgatgatgctgctggtgaagcatttgataaaacagccaagctattggggcttgattatcccggcggccctgttttatcaaaaatggcacaacaaggtgtagaaggacgttttgtttttcctcgtcccatgacagacagacccggactcgactttagtttctctggtttaaaaacctttgccgctaatactattcgtcaaaacgatgattcagagcaaactcgagcagatattgcgcgtgcttttgaagatgccgtagtagatactttggcaataaaatgtcgtcgagcattagagcaaacaggctttaaacgcttagtgatggctgggggcgtaagtgctaaccgtactttacgcgccaaaatggcgatgataatggaacaactcggaggggaagtgttttatgctcgccctgagttatgtaccgataatggtgccatgattgctttggcggggatgatccgttttaaaggtggtaccgaggggcctttaggggtgacagtgagaccacgttggcctttagctgaattacctgctttagcggataaataa

SEQ ID NO: 2342 - DNA, 756 bp, Proteus mirabilis
aagcttatgctagccattattcgaggcattattgtcattctgtacaccattattgtggtgacttttgggatgatctattgcatgttttctcccagaaatccgaaacacgtaatgacttatggacgtttattcggcaaattatcacatgtctttgggatcaaattagttgagcgttttcctaaagaagctaaaagttatggacccagtatttatattggtaaccatcaaaataactttgatatggtgacaatgtcgaatgcggtacaacctaataccgtgacggtaggtaaaaaaagcttggtgtttattcctttctttggacagctttattggatcactggcaatattttgattgatagaggtaatcgctctaaagcccatagcaccatcactcaggttgcagagcaaatcaaagcgaaaaaaatctctgtatggatgtttcctgaaggaacacgtagccgaggacgtggtttattaccttttaaaacaggggcttttcacgcggcgatgcaagcgggggtgcctattgtgcctgtttgtgtctctaccacacaaggtaagataaaattaaatcgctggaataatggctacgtgattgttgaaatgttgcctcccattgatgtatcaaaatataacaaagatcaggtgagagaattagctgaagattgtcgtcagatcatgaaggctaaaattgaagagcttgataaagaagtggaagaaatgaataaacgcgattttgcaggtaagttaaattaa

SEQ ID NO: 2343 - DNA, 213 bp, Proteus mirabilis
ttagttatttttggtgaggtaggactcgcgggagaaattcgtcctgtaccaagtggacaagagcgaattgcagaagcagcaaaacacggttttaaacgtgctattgtgcctaatgcgaatatgccaaagaaaaatccacctgatatgaaagtgtatggtgtgaaaaaactatcagatgcgttatctgtacttgatgatttggacgacttctaa

SEQ ID NO: 2344 - DNA, 204 bp, Proteus mirabilis; identical to SEQ ID NO: 1188

SEQ ID NO: 2345 - DNA, 1812 bp, Proteus mirabilis
aaggccgtgctttcttatgagagcgcggcttattctcgttcaacaacaggcgtaaaagggcttatggctggacgaattccacgttcatttatcaatgatttattagcacgaaccgatatcatcgatcttatcgacgctcgtgtgccgcttaaaaaacaaggcaaaaatcattcagcgtgttgtccgtttcataatgaaaaaacgccctcttttacagtaaatagcgacaaacagttttatcactgttttggttgcggtgcgcatggcaatgctattgattttttgatgaactacgacagacttgattttgtcgaaaccattgaagagttagcagcaatgcatgggttagaagttccttatgaatcaggaactggcagtagcccgattgagcgacatataagacaaaatctctatcaagtgatggagaaattgaatcagtattacaaaagcaccctcaatacccctgacgctcaggaagcaagaaattatcttgcgcatcgcgggctaagtgaagaggttattacccgcttttctatcggctttgtacctacgggttgggacaatatcctaaaacgttttgggcaaaatcccgataatcaagccctgttacttgaagcaggaatggtaataacaaacgataaaggtcgcacttatgaccgttttcgtcagcgcgttatgtttccgattagagacagacgaggtcgtgttattgcatttggtggacgtgtattaggtgatgatttacccaaatacttaaactccccagaaacagagattttccataaaggccgccaactttacgggctttatgaagcacaacagactcaccctaacccagctaagttattagtggttgaaggttatatggatgttgtggcattagcgcagtttggtattgattatgctgtcgcctcgttgggtacatcaacaaccgcagagcatatccagttgctgtttagaactacggataacgttatttgctgctatgatggtgatagagcaggacgagatgccgcatggcgagcattagaaactgcactgccttttttaaacgatggccgttctttacgttttatgtttttacctgaaggcgatgatcctgattcactggttcgccgcgaagggaaagaggcatttgaaaaacgaatggaacaagcacactctttatctgagtttttatttgattcgctggttccacaagtggatttgagcacccaagaaggcaatggcaaactctatagtttagcgcgcccattaattgatcagatcccaagtgagactttacgtctatatttattaagagagcttggaaatttaacgggaaatcccgatattgagcagatggatcgtttatttggtagaaactcgctacatcacgaaacatcgtatcaaccgacaaaactacgtactacaccaatgcgtattttaattgccttgttgatacaaaatcccgagttttgccaattagtgccaccgcttgaggggctaaatacagaaaaaatagcgggtttatcgctttttattgaattagtttctctttgccaagcgcagccaggcttgaatacaggtcagattatcgaactctatcgagagaataaattcggtaaacaacttgaaaaactggcgatgtggaacgatatagatatagatgagatagctgaaaaaacatttacagatacgttagatcatctctttttaaccgcaatggatgaacgtttaaacgccctcattgccaaagagagaactgaaggtctaacacaaaatgaacgcgaagaagtccaattgataatacaggctcgcgttaaaaagtaa

SEQ ID NO: 2346 - DNA, 654 bp, Proteus mirabilis
gctgttaaacgtttttctcggaggatgtggcgaatgaatcgctttgttattgcagagccacaacgatgcatagggtgtaatacctgtatggcagcttgttcggaagtacaccaagctgtgggattacaggcgcatccgcgtcttacagtggtaaaagtggaggatcagaccgccccgatgctttgtcggcattgtgaggatgctccttgtgctagtgtgtgcccagtcaatgccattactcatgaagataatatgatctttcttaatgagagcttgtgtattggctgtaagttatgcggtttggtatgtccttttggtgcgattacaccatcaggcagtaaacccgttaacttaccggctgtgtttgaccattttgtgcctgaagagatgctggcagatgtgcccgcaagtcttcctactaccaatccattccttgcatggaatgcgggtattcgcgcaatagcagtgaaatgtgacttgtgtgctttctcagatgaggggcctgcttgcgtaaaagtctgtccgacagatgccttacatctagttgaagaagatagccttgaagagcagatgaaagcgcgtcgtttagactctgtgatggaacctatgacaagtcttgatgatctatctacgttgacacaggagcgcaagtaa

SEQ ID NO: 2347 - DNA, 1167 bp, Proteus mirabilis
accatgaaacgcgaacaaattattgaacgtcctgattggcgcgaaaaagccactgaatatggttttaacttccataccatgtatggcgagccttactggtgtgaagatgcttattatcaattttcaatggaagaagtggaaacattagaagaaaccacggaagagcttcatcagatgtgcttacaagtcgctgataaagtggctaatagtgaagagctattgactcgttttcaaattcctcgccattgctgggattttgtccgtgagtcatggaaaacctcgcaaccatcgctttattcacgtcttgatttagcttatgacggtaaggggccggcaaaattactcgaaaataatgccgacacaccaacttcattgtatgagtctgcttttttccagtggatctggcttgaagatcaaatcaatgcgggtcgtttgccacaaaatgccgatcaatttaatagtatccaagaaaaattgatcgacagattcgctcaattgcgtgatcaatatggtatgcgttatctgcacatgtcatgttgccaagatacgcaagaagatcgcggtaccgtacaatatttacaagattgtgcagaagaagccgaagtcactaccgatttcgtttttattgaagatattggtttaggtgaacggggtgagctgaccgatctacaagaccagatcatcagcaatatgtttaaactctatccttgggagtttatgttccgtgaagatttctcgaccaaacttgctgatgcagggatccgttggttagagccagcttggaaaagtattatttccaacaaatcgttactgccaatgctgtgggaaatgttccctaatcatcctaatttattaccggcttatttttatgacggtaaagcgccagattcattatcacgctatgtcatcaaaccgctcttttcacgagaaggggcgaatattcgtatcgttgaaaatggtaaagatatcgctgttgctgatggcccttacggtgaagaaggctttattgttcaggacttccatccactgccaaaatttggtgatagctatacattaattggtagctggctagttaacgaccaatctgcaggtatttgtattagagaagataaagagcttatcacgcaagatctgtctcgtttctatccacatattatcttagattaa

SEQ ID NO: 2348 - DNA, 1311 bp, Proteus mirabilis
atggcggtgcgatggttgttttggagtttactcatgacacagtcactgctgtctgatattgatgtactattaattgatgatgatgaggatattctcgaatcttatcgtcatttgcttaatcttgccggaatggttgccagagtgactgattcgccagaaaaagcattgagtctgctgacaccagaatatgaaggtgcggtagtgttagatatttacatgcctgcgatgaatggcatggaagtcttagcgcgtattcaacaaattgatcctcgtattccggtgattatgatcaccggccacggtgatataccccttgctgtagaggccgttaaaaaaggcgcttatgattttattgaaaagcccattaatccaccgctatttttagagttagttgctaaagcgcataaagagcgaaaatcacttctttcacttagaaaaacgatgatcaccaccactcaagagcgtctagttggcgatagtgcacaaattaccgccattagacagcaagtacagcaaattgctgatattgataaagacttaatgattgaaggtgagatggggacagggcgacatctactcgctcagttattacatgaattaagtcctcacagcgataaagcggtgactacggtagattgtcaaaatttagtagatattaagccactgattgctcaaatagagcaagaggaagtcggcacacttattttacgctccccttatgatttaccttctggtgcacaacgttggttaagtgcttacctattagatatggaaaggcagggtaagcgccaatttagaacgatcgcgattttagaaaataatacccagcaattagtcactgaagggcgattgatacctgagttctattactacttttcgcaaataactttttctttgccaccattaagcgcaagacgcccggatattattcctctatttagagcctttttacggcaaagtgctcagcggcttgggatcgccgtaccaaaaattgatcgtaattatctcgatatattaaaacgttatgattggcctggaaacattcgtgagctacggaatgtcgctgaactctatgctgttggtattgtgaaaatggttgatagtgagcaacatcgtgccattatcccccctgaagggcctttagataacttagttgatgattatgagcgtcgcttaattgaagatgcactctatttatttgctggccgtgtgagcgatgtggctgattatttaggtatcccacgtaaaaaactctatttacgcatgaaaaagcatgaactggataaagagagttataaacctaaggtttga

SEQ ID NO: 2349 - DNA, 1515 bp, Proteus mirabilis
tcctccaagcgctgtctaatgctatccacgcataatcattcacaatataatcaagagaggtctgccatgattaatatcgtgattgtttctcatagtaaacatcttgctgagggtattgagtcgttggctaatcaaatgcttaacccaacgcattgccgactagccattgccgcaggtgttgatgatgaagcgcaccctattggtactgacgctgttaaaattatgacggcgattgaatcgctcgccgaagctgatgcaattattgttatgatggatttaggtagtgccatactcagtacagaaacagcaattgaactgcttgatacagaattagcgcaaaaagtgacactatgctcagctccgctggtagaaggaacattagccgctgttgtcgcagcgtcatccggagctagcttagaaaaggttctcgaagaagccaaccatgcactaacccctaaaaagatgcaattgggtgaaaacatgggtggctcagagccaaatgatgtcacgccttctattcaaatgcacggcaaagaagctcattgggtggtaaaaaaccctcatggtttacacgttagacctgcagcgacactggttgaactactgtcaaaatttcgtgctgactatcaattaattaagggagatagacgcattaatccccttagtttaaatcaactttctcttattcaaattcgtcaaggtgatgaaataaccttaattgcttcaggagaacaagaaaatgaggctattgatgcctttttagcactggctaaacaaggttttggcgaagcattaccggatgaactcacggagcaaagtttaactggtactctcgtacccgcttcccccatcaagggaccagcttttatttggcatgagctagaattagctcctattgaaaatttatctgcaccactcgatagcacaatacaaattgagcaatttaatcaagcgataaaagatacactcaatgatttgaagcactatgctgaaaaagccaatcacacattaggtgaacaaataggcgctatttttaacggccatatcatgatgctggatgatgaagaattactcaccaatgttatcgatcgtattaaaacagataacgttagcgctcagcagagttggacgaatgaaatgaaagaacgtatccaactctaccgtactctcagtgatccttatttgagagcacgggagttagatcttcgtgatctgcgcaatcaagttctttaccatttacaacagaaaacgcctcctaaatttaccccatcacaaccctctattttagtggctaaagagttattcccctcgacattaattcagtttgatgcaactcaattattagccattaccttagctgaaggggatagttgttctcacagtgccattatcgccacgcagatggggctacctatgttagttcatttaggtgatggattattaaaaataaaagaagcacaagaattaacccttgatctcaagagtagtgaattaattattggatcaataaattaa

SEQ ID NO: 2350 - DNA, 654 bp, Proteus mirabilis
tcaaatatttttcgccggtattttgtgacaaagaccaaatggacgtgcatcaggaatacacaatgtctgccacggcgaatattagtttcatttttcatagaccaaagtataataggtaatatgaaacgtctacaagcctttaaattccagttaagacccaatggtcagcaagagcgtgagatgagacgctttgcaggggcttgtcgttttgttttcaatcgggcattagcacgtcagaataagaatcacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaagcgtaccgcttttcctcgattcaagaaacgcggtaaaaatgacgcttttcgctacccgcagggcgtgaagctcgatcaatccaatagtcgtatatcattgccaaagttgggatggatgcgctaccgcaacagtcgtgaagtcatcggagaagtgagaaacgtcacggtcagtcatgcggtaaatggtacgtcagcattcagactgagtatgaagcgacagaaccacaacatgaatcaacctcaatag

SEQ ID NO: 2351 - DNA, 1347 bp, Proteus mirabilis
tcaaatatttttcgccggtattttgtgacaaagaccaaatggacgtgcatcaggaatacacaatgtctgccacggcgaatattagtttcatttttcatagaccaaagtataatagataatatgaaacgtctacaagcctttaaattccagttaagacctaatggtcagcaagagcgtgagatgagacgctttgcaggggcttgtcgttttgttttcaatcgggcattagcacgtcagaatgaaaaccacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaagcgtaccgcttttcctcgattcaagaaacgcagtaaaaatgatgcttttcgctacccgcagggcgtgaagctcgatcaatccaatagtcgtatatcattgccaaagttgggatggatgcgctaccgcaacagtcgtgaagtcgtcggagaagtgagaaacgtcacggtcagtcagtcatgcggtaaatggtacgtcagcattcagactgagtatgaagcgacagaaccacaacatgaatcaacctcaatagtcgggcttgatgcaggcgttacaaagctggccacgctttcagacggtacggtatacccgcccgtcagcagttttaaagtaaaccagcgaaagctggcaaggcttcaacggaaattaagccgtaaaatcacattcagtgccaactggcaaaaacaaaagcgcaaaattcaacgtctgcattctcatattgccaatatcaggaaagactaccttcataaagtcaccagcgaaatcagcaaaaaccacgcaatgattgtcattgaggacttaaaggtcagtaacatgtctaaatcggcaaaaggtacgacagaacggcatggacggaacgtaaaagctaaatctggtttaaaccgctcaatactggagcagggctggtatgaaatgcgccgtcagcttgagtacaagcagctctggcgaggaggtcaggtactggcaataccaccggcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtggagggagggtgcagtcagaccgcccgtcgaagcaggaacccgccgaggtgattcagaggaacgcagtagggatccacgtcctttag

SEQ ID NO: 2352 - DNA, 1065 bp, Proteus mirabilis
atgaaaaagcttattaatcgtgttgatgatgttttatcagaacaactgcaaggttttgctaaagcccaccctgaaatcaatctccatccctcttctttttatgtcacccgtcatgatgcccccgtaaaaggtaaagtagcccttttatctggaggtggcagtggacatgagccaatgcatgccggttttgttggaaaaggcatgcttgatggggcatgtcctggtgagatctttacctcaccaaccccagataaaatgtacgattgcgcaaaagcaattgatagcggtgaaggtgtattaatgatcgttaaaaactacaccggtgacgtactcaattttgaaactgcgacagaactactacatgatgaaggtgtaaaaattgctacggtattagttgatgatgatgttgcggttaaagatagtctgtataccgccggtcgtcgtggtgtagcgaataccgtattaatggaaaaattgctaggtgctgcagctgagcgtggcgatacacttgatgatttggttaagctaggtcatcaaattaataataatggtttttctattggtattgcactacaggcttgcaccgtacctgctgcaggaaaaccctcttttactctccctgaaaatgaaatggaatttggcgttgggatccacggagagccaggaatagaccgtcgcccatttacttcattaaatgataccgttgatgcgatgtttaataccctaattgaaaatggtcactatcagcgcaccattcgcagttgggatcgagtcaatggtgattggattgaagagacacaagaaaaacagccactaaaatcaggcgatcgtgttatagccctagtcaataatcttggcgccactcccctttctgaattatatggtgtttatcatcgccttgccctgtgctgtgaaaactttggtcttaacatcgaacgttcgttaattggctcttattgtacctcgctcgatatgtcggggatctcaattaccttattaaaagtagatgacgcgctacttactttgtgggatgcacccgttgctacacctgcgatgacaaaataa

SEQ ID NO: 2353 - DNA, 1500 bp, Proteus mirabilis
aacctatttagaaacatctcaaccccaaggataacaaaaagcgaggatcacctcgctttttctattcttactataatcgcaggagcactttctatgtttagcacctataatattgatgttttaacagaacaaaatcatcaatatttaccaatagaaaacaccctatcattacagaatatattttccatctcttggcacccatcattatggaaatctttacccgccaagcaacttcctgaatacccagatatacatgccttaaattattgcaaagaaaagcttaagcattatcccccgctaattttagcttccgaaatcagagcatttaaaaatttattaaaacttgttgcaaatggtgaagcttttcttctgcaaggaggagactgtgcagaatcttttgatgattgccaagccactattatccgtgatttaacattcactttatcgcaaatgtccgcattaattgaacaatcaacgggattgccggtgattaaattaggtcgtatggctggacaatacgctaaacctcgtagccaagcatttgaaacacaaaatggcttaactttacccagctatcgaggagaaattattaatggtcttgatttttcagttaaaagtagagagccagatccgattagaatgataactgcctatcatcactcagcagcgaccttaaatctgttacgtgcgatgaattatacacaatataccaagcaacaatgggccttggatattaacgctcatcctggctctacagagcctgagcattatttccatttgctagaacaactctatcattcacaacatcatattattaataaacagcccgatacctcttcctattatgttagtcatgaagctttgttactgcattatgaggaatcgatgactcgtcaagattccattgacaacaaatggtataactgttcagcacatatggtttgggtaggagaacgaacaaccgatattgatcatgcccatatgaggtacctacaaggtattgaaaaccctatcggtataaaatgcagcaccagaatgtttgaagaaaaactgattaagctaatagatactcttaacccgagcaatgaagttggaaaaattatcttaatcattcgcgtgggtaaagatgctattcatgcatatcttccggaattagtaagaacggtaaaagaacatcaacgagcggttatttggcaaatagatccaatgcatggcaatacacaatcagcaaatgacagtatgaaaacccgacatttcaatgatattgccgaagaaactcgtgcttttattcatattttacatgagatgggcatacaggctggggggatacatttagaaatgaccggacaagaagtcactgaatgtactggaggattacaacaaattcgatacactgacctaagtcatggttatcaaactttatgtgaccctcgtcttaaccggacacaatcattagagttagccttcttggttggacggcattggcataattcactttaa

SEQ ID NO: 2354 - DNA, 486 bp, Proteus mirabilis
atgaatattagtttaatcgcagcattagcggcggatcgtattattggtatggaaaaggcgatgccttggacattaccgggtgatctcgcatggtttaaaaaaaatacattaaataaacccgttattatgggccgggtgacttatgagtctatcgggcgtcctttacctaatcgactcaatattgtattaagcagtcagcctggaaatgatgacaatgttgtttgggtgaaatccgttgaagaagcactacaagttgctgaaaataatgatgaaatcatggtgattggtggcggtaaggtttatgagcaattcctaccaatggcgaataaattataccttactcatattgatgctgaagtgattggtgatacaaccttccccgattatgagcctgatgagtgggattctacttttatggaataccatgaggcagatgaaaataattcgcataactactgttttgaaatattaaaaagaagaaaataa

SEQ ID NO: 2355 - DNA, 546 bp, Proteus mirabilis
aattgttatagagccagcgatttatttgatagtaaagagaaaaccatgagtgaaacaatgacagcacctaaggtcgtattaacggtaggaaatagcatgatgggggatgatggagccggtcctctattagcggacttaatggaagcaaacccgattgatggttggatggttatcaatgggggaagtgcgccagagaatgtttcttatcaaataagagcattacaaccgcaatgtgttgtcattgttgatgcggctgatattggtttaaaacctggtgaaataagggtaatagatcctgattatattgcagaaatgtttattatgagcacccataacatgccgttaaattttctgatagatcaattaaaggacgatatccccgatattactttcttggggatccagcccgatctggtgggattctattacccaatgaccgaagcggtaagaaacgctgttgataaagtttatcaaggcattaagtcttggcgagttgattactttcctgagcttgaagtctgtgatgaagacgatatcgaagaatag

SEQ ID NO: 2356 - DNA, 258 bp, Proteus mirabilis
agaaaacatagaaaattcactcttatcattatacccggcttttcccttagggagataaaaacggtttttataataggttctattctttatttgccttttattggtatggacttaggtgtctcatggcattttattagcattaagtatgatgatgatgagccctattacataatctggacctttaaacttaatttattatcgccatggatggttggggactgttatctaaaggactcattaatcaatatcttgatttga

SEQ ID NO: 2357 - DNA, 399 bp, Proteus mirabilis
acagtgaatagtcgtacattgcttatgttttccgcaatcagtggttttttttatgtggcttttggggcattcgctacccataaattagcccctcatttatcgccacagcattgggaatatattcagttagctatgcgttatcaaatcgtacatactttactacttgtagggttagcggcgatattaatgcgcaaaaccattttatggctttattgggcaggtattttctttggtttaggcattttacttttcagtggtagcctttattgtatggcgctaacacaggttaggttattatcttattttacgccaattggtggatttagttttcttattggttggattttaatttttattggcgctttgcgtctaaggacaccggcatctcgccatgaataa

SEQ ID NO: 2358 - DNA, 1644 bp, Proteus mirabilis
atgaaaagtagactgaaaaacctatataaatatcttattgagaacaggaaacatgaagtcaatggatggcacaaagcctatcgtgacttttacagtcaggtcgctcaaattcgtgagcgaatcacatctggagaaggcttgtctcaaaatgatgaagcttttctgaagcagttaatctatgagaagagcaacggtatcgcttctcgcggacagtctgtgttgagcaatgacaatttccagtcattcattaaaaacaagaatttcatatccgcattagaaaaatttatattgattccaaacagtgaaaacttcacgattttttctgatacgtggtctaaccaaggtaaatccaacaaccctgttctcgttaatcgagtggctgcagcttgtacactcgaagtctccacaacggttgactccggtaaattcaatcaggtttttaattggcttatacgcgaaggaataattccagtatacccaacagaagaaaatcaaagttggtttgctaaaaacatttttctattaaaaagcatcaaaagcgagtttgataatgagcttcgggaaggtaaaactgatgagttttatcttagtcagtttgtttgggtgctttacgagaatttgtcaaacccattcagtttaaagaagcagattattaaatacggggcaccggggacagggaaaacttatcaagcacgcctgcaaacttcgctcatgtttgacatctggaaagaggaatttacttccaatagccgtctcacacatgcaagtcagattgagttggttcaatttcatccttctttcagctatgaagactttatggaagggctacgtccggttttgggcagtgatgggaactcccaattaaggttgcaaaatggtgtttttaaagagttttgtcgaagcgctggtaagtgggaaatcgatgtatatgggcttggacttgctcagaagtgggagtctcttactatcaaggaacttctcccgtttagagaaaagttatcaggtgagcattggcgggatgttttcgaaatatcagatacatccaagcttgtatcggaagcagtaccaccatttttctttataattgatgaggtaaaccgggctgagttgtctcgcgtttttggtgagttaatgtactgtctggaataccgaggcactagaggttgcgttaaaacccaatatgccaatctgaacaatgaacatactggtatgcttaaggacgctaaagggtatttgttcttcattccaacaaacatctatcttattggaacgatgaacacgatagacagaagtgtcgaaagttttgacttcgctttacgtcgaagattccgttgggaagaagtggtgcctgatatggcgctattgaaataccatttgaaccaattttgcaaagcttggctgcccctggtggataaccttgaacgcttgaatgaattgatagctaaagagcctttgcttggtaatgattaccaaattggtcatgcctatttgatggatttgaagtatgcaaccagccttacagtttcggaggtacgagagcgtgtatgggatgattgtattcgtccgttattacaggagtatcttcgtggaacgggtaaggagactgaactgattagctccttcggaaaggcgtttggggtttaa

SEQ ID NO: 2359 - DNA, 1431 bp, Proteus mirabilis
acagtgtggcttttcgatatcattaagaacggcacactggtcgataaccagtcctattttgtcagcgaaggcattttgaaaaatagacgtttaggaaagtcgataacccttagaaccaaatcaaaagggcagtggacctatcctcataacgacgagtctgcaatttggcactttttgaattcggtatctcgtgatgtcgaaaaaacgctgaatgataatatttccgatgctttaatactcttcaatgatgaagattacgaacacaatacagatggcggtttcatcgatgtctctggtacggatgccagaaattttaatctcgacacgggcaatttaatcggatttgttaagcgaggagattactctctgaagatcagctcacgttttggtgatgctttccttcaatacatcattgcagatgccgatggatttctcgaattagaaaacattggaggagaaagtcacgcagacggttacgaatggcttttagcatatctatggaacattaagtttaagagagcctaccgcttgggcttgccaaagacttatattacaagaaatgatcgtatttcccgcgtaaggggaactataaatgctacagattattttcagaataaatcatctggaaaatatttatgctcgtaccgagagcacagctacgatagccctgcaacttcactttttataaaagcttatgaagcagttgcacattactcattttgtcaccaaacacgaaatatctatagcgcatttctgactgccaatcaggggataaaaaggtcacagcaagaaattttgaggacttctcatttcaccaatcctttctacaatgattataacgtgctcattgacttatctaagcaagttattggccggaagggctctgattttgattcgcagcaggattcgagtgctttctttttcgatatttcgatgttgtttgaatatttcattcgtaagctcatcaagcgagatgggttacgcctgctaggtaagttcgagctatgtcaggaaatagcatctggtgcgctcagcggttatatgagaaaacttgaacctgatcttgttatagaaatcgatgagagattattcgtatttgatgtgaagtataaagcatttgattcacaatttggggtgaagcgtgaagatctttttcagctacatacttacatagggcagtatggaaatattgccgcaatcaaggggtgtggatttatttaccctatatcagaagaacgatgggcttcacttaaccttgaaaaaacacagggggtgatttcagatattattcaccagcaagggcaagagataccgttccatgtgctttttctaaaaattcctgaagatacttatattgattttaataggaaaatgaaagagcagtgtagtattttcattgatgccctttattctaaggttcttaatcagtga

SEQ ID NO: 2360 - DNA, 870 bp, Proteus mirabilis
cggctagtaagagagaaacaaggaaaccttttggaaagccagcttgaattgtcggtggatcaacaacacaccgttagaatattacaaatcacagatacccacctttttgctaatgtggatgataccttgttgggaattaatacctatcgtagctatcatgcggtattggacgcgattaaacagcaagggttatcgattgatttgattgttgctactggggatttagttcaagatcaatcctttgcagcttatcagcattttgctgatgggattgcaagattaccttcaccttgtgtgtggttacccggtaatcatgattatcaaccagcaatgattgatgctttaaatcaggcaggcattctgtcggcaaaacaagtgttaattggtgaacattggcaattgttattattagatagccaaattcaaggtgttccccatggcgagttatctgactgtcagttagattggctaactcgctgtctagaaagccacaaagaaagagatactgtgatcttattgcatcatcatccgatgccttctggctgtacttggttagatcaacatagtttaagaaactctcaccagttagctgagcgtgttaaagatcaccctcaaataaaaatgatgctatgtggtcatattcatcaagaaatggatgaaatgtggaatggtattcgcttattagcaacaccctctacctgtattcagtttcgcccgcattgtactaatttttctttagataccgtttcgccgggttggcgctatttagagttatcattatctgcacagggtaagaggaatattgatactcaagtacatcgtctagtgggtaaagatttttgtccagatcttgacgcggatggctattaa

SEQ ID NO: 2361 - DNA, 216 bp, Proteus mirabilis
ctcgtcgggctcataacccgaaggtcgttggttcaaatccggcccccgcaaccaattcacaacatatgcagtaagttaaaatttatagattcagtcgcgggatggagcagtctggtagctcgtcgggctcataacccgaaggtcgttggttcaaatccggctcccgcaaccaatttctataaatgttttcggacgcggggtggagcagcatggtag

SEQ ID NO: 2362 - DNA, 840 bp, Proteus mirabilis
ccagttcaaagaaagggtaaatctatgtcattgaaatttaaatcacttgctgtagtcagtgcgttagtcggtgctttagctttagcaggttgtggcgaaaaagaaaaagatcccaatcatatccgtgtgggggttatttctggttctgaacaacaagttgctgaagttgctaaacaagtcgctaaagataaatatggacttaatgttgaactcgtcactttcaatgactttgtcatgccgaatgaatcattaagccgtggtgatattgatattaatgcctttcaacataagccttatttagatcaacaaatcaaagatcgtaattacaaaattacggctgtaggtaatacctttatttaccctattgctggttattctaaaaaaataacggatttagcagatttacccgatggtgcacaagtggctatccctaatgatccaactaacttaggtcgttcactgctacttttagaaaaagtaggattagtgaaattaaaggaaggggttggtttattaccgactaaactggatatcattgaaaatccgaaaaacatacaattagttgagttagaagcaccacaattaccgcgctctttagatgatcaaaaaatctacttagcggttattaatacaacctatgcgagtcaagttaacttaactccagcaaaagatggtatttttgttgaagataaagattcaccttatgtcaatattattgttgcccgtgaagacaataaagatgatgaaaatgtgaagaaatttattcaatcttatcaaacagatgaagttgatagcgctgcgaataagatttttaacggtggtgcagtaaaaggttggtaa

SEQ ID NO: 2363 - DNA, 1011 bp, Proteus mirabilis
aaaaataaaaggttcggtatgtcctcttcttttccccaattaagtattgtggtggcggtttttaatggtgaaaaatttttaccacagttttttaattgtttacatgcacaacaactggaaaactgggaacttattttagttgatgatggctctactgataactctcgtcagatcttagataaatgggaaaaacactttcccaatgtcactattttaacacaagaaaaccaaggtgtttccgttgcgcgtaatacaggatttgctgttgcaaagggggaatacgttgcttttcctgatattgatgatgtgatagataaacgcatgtatccccgattacttgaaattgccaaggccgataatttggatgtggcaacctgtaatgggaattatgtttatgatgataaaaaccgaccaacacgccctatctttccttcaacgcgtttaacaaccacagaggtattaaccgggcctcaatggcttgaacgtgctcttgaatcgaaaaagttcttacatgttacatggctaaatatttatcgacgtcagtttttattggagcatggttattactttgagccgggtttgcatcaccaagatattccttggacgacagaagtgttattaacggcgaaacgggtaaaatatatcgatgagcgttattacgactattttattcattctggctccgtgtcgcatacgacacccgatgatcgtattcatgtaagaacaatttataactatatgaaaatacttgagatgctggatgctattaatcaacgccatgctgagatagcaaaaacgatcaatgcttgttattggcaaatagccaaagaaggtttaggtattattcattctattgatgcgattagttcaccagaaaccaaaaaacagatagttaaggtattttttgagcggggaatttgggcattaatttggaaaaatgcgaaagattttagattaaaatggcgtttagggcggcgttattttcgactgaaaaaaatattagcagaataa

SEQ ID NO: 2364 - DNA, 447 bp, Proteus mirabilis
catatggaaagctcaacacaattaatcttgatcctagctcttgccacattggctccttttattattgctgcaggaacttgttatttaaagttttctatcgttttagttatgactcgtaatgcattaggtgtgcagcaagttccttctaatatggtacttaatgctatcgctttaatgatggcgctttttgttatgacaccaattactaaaaatatttgttactatgttattgaaaataaagtggatatgtcatctccagatgcgatcgagtcattttcaaatgaggcgttaggcgattataaaaaatacctatatcattactcagatcctgatttattagctttttttgaacaagcgcaagagaatagaccaaatagtgatggtgataaagaaaacatagaaaattcactcttatcattatacccggcttttcccttagggagataa

SEQ ID NO: 2365 - DNA, 891 bp, Proteus mirabilis
ggaagaatgagtataaactaccttaaatttccagaaatcgatccagttatgttttctatcgggccagtatctttgcactggtacggcatgatgtatttgattggatttgtgtttgcattatggctagcaaaccgcagagcggcaaaacctaacagtggttggcaaaaaagtgaagtcgaaacattactttatgtagggtttgtgggcgtgtttattggtgggcgtctaggatatgttttattctataacttaccggtatttttagataatccactttacctatttaaagtctgggatggcggaatgtccttccacggtggcttaattggggtgatctgcgccatgatttggtttgctcgtcgcactaaacgtcacttttttcaagtcgcagactttgttgctccattaatcccatttggtttaggtttaggacgtattggtaactttattaatggagagctttgggggagagtcaccttagataccccgtgggcgattttattcccaggctcccgtgcagaagatctacagcttgtcgcgcaagatcccactacactattacctatcattcagcaatacggcgtattgcctcgccacccatcgcaactctatgaaatgttcctagaaggcgtggtattatttattattctgaatatctttgtgcgcaaaaatcgtcctatgggcagtgtatcggggttattcttaattggttatggtgctttccgtattattgttgaattcttccgccaacctgatgcgcaattaggtttatttagcggtatcagcatggggcaaattctttccattccaatgataatattaggcattatctttatggtgtgggcgtatcgtcgcgataaagccactccacagacgccaacaacacactaa

SEQ ID NO: 2366 - DNA, 780 bp, Proteus mirabilis
agtcatcggagaagtgagaaacgtcacggtcagtcatgcggtaaatggtacgtcagcattcagactgagtatgaagcgacagaaccacaacatgaatcaacctcaatagtagggcttgatgcaggcgttacaaaacttgccacgctttcagacggtacggtatacccgccagtcagcagttttaaagtaaaccagcgaaagctggcaaggcttcaacggaaattaagccgtaaaatcaaattcagtgccaactggcaaaaacagaagcgcaaaattcaacgtctgcattctcatattgccaatataaggaaagactaccttcacaaagtcaccagcgaaatcagcaaaaaccacgcaatgattgtcattgaggacttaaaggtcagtaacatgtctaaatcggcaaaaggtacgacagaacggcctggacggaacgtaaaagctaaatctggtttaaaccgctcaatactggagcagggctggtatgaaatgcgccgtcagtttgagtacaagcagctctggcgaggtggtcaggtactggcaataccccctgcctacaccagtcagaagtgcgcttgctgtggtcatacagcaaaggaaaaccgcccgtcacaaagtcaattcgagtgccttgaatgtggatatacagcgaatgctgatatcaacggggcacgtaacattttagcggcaggacatgctgtgcttgcctgtggagggagggggcagtcagaccgcccgtcgaagcaggaacccgccgaggtgattcagacatcagtctga

SEQ ID NO: 2367 - DNA, 198 bp, Proteus mirabilis
aataaagggagagcaaacaaacttatttttgcattttttattaaaaagacgttgacgcatcacgctgaatacggtttaatgcgcctcgttgcccggatagctcagtcggtagagcaggggattgaaaatccccgtgtccttggttcgattccgagtccgggcaccattttaaaacttgttaatcagcaatttaaatag

SEQ ID NO: 2368 - DNA, 654 bp, Proteus mirabilis
atcatgactggagcacttattgttaataatttagcggggttaatgatgatcacctcgctactggtgataggcgcaagaaagcctattgcttcctgttggttttatgctctgcaatcctttgttttggtgatgatttttgtcactttagcaaatacgctagatgcacatcaactgacactttgggcgataaccgccttctttaccaaagttctactcgttccacttatcttaggatttgccttccgcaaattatccgatccgagcgccaatatcagtgtcattaaaccggcattattgatgttattagccgccgtgattgtgattttatgctggtttgtggttgagccaattcaaatacctatggtggcggaattgaaacctgcattagcggtctctttaggccattttatgctaggtctactgtgtattgtgactcaacgaaatattctaaaacaagcatttggttactgcttaatggaaaacggctctcacttaacactcgctttattagcgtggagggcaccagagttggtagaaattggtatagcaacggatgccatttttgctgtgattgtcatggcagtattggcgcgtaagatttaccgcacgctcaacacactgaacgtggatcaactgaccgcgctgaaggggtga

SEQ ID NO: 2369 - DNA, 657 bp, Proteus mirabilis
gattttaatggaggaaatatgaatattctcgtcattggcgctaaaggtcgagtaggtcagcgtttaatcgaaatattacttgctaaaggtcatcatgtcataggtacaacccgaaaattatccgacacatcagtacatcatccctcacagtaccatgaaattgaattggacataacaaagccgttatcatccatcaccgatttattgccagacaatttagaggctatctattttacgacaggctcccgaggaaaggatttattacaagttgatttacatggtgctgttaaaacgatgcaagcagcagaaaaaaaaggaataaaaagatatattatgctcagtgcgattaattcattatcacctgataaatggactgaattaattgattattttactgctaaatattttgccgacctctacttacgggatcgtacccagttagatttcacccttgttcaagcaggctatttaactgaaaaacaaggcacatataaaattacgaccaaattggaagataatgctacaaaaggtgaaatcactattgataatgtcgcggcaacattagcagagatattagataagccgaatacatttaaaaaatgcattcctatattagatggtgacgaggcgattaaaacagccctcagtcgaatttag

SEQ ID NO: 2370 - DNA, 345 bp, Proteus mirabilis
caaaaaagtggggtggatgaatttaataaaagatgggatcaaaggagtaaaagcaatatgagttctcctgtaaatgtcgatgtcaaattgggcatcaataaatttaatgtcgatgaagaaaatccacatatcatcattaaacagcaacctgatatgcaagtattagacacactggtaaaagcttgtcctgcgggtctttataaaaaacaacaagatggtagcgtcagctttgattatgcagggtgcttagagtgtggaacctgtcgaattctcggtttagacagtgcgcttgaaaaatgggaatacccacgcggaacgtttggcgtggaatatcgttacggatga

SEQ ID NO: 2371 - DNA, 795 bp, Proteus mirabilis
ttttacttcggtaggcatagcaatatgtctaccgaattatatttgaatagtgaaagatcaatattaaaaggaagaattatggctacccctcatattaacgcagaaatgggcgattttgctgatgtcgttttaatgccgggcgacccgcttcgtgctaaatacattgctgaaacttttttacaagacgtacgtcaagtaaataatgttcgtggcatgttaggttttactggtacgtataaaggccgtaaaatttctgtaatgggccacggtatgggtattccttcctgctcaatttatgctaaagagctaattactgattttggtgtaaaagtgattattcgcgtgggttcatgtggtgcggtattaccagatgttgaattacgtgatgttgtgatcggtatgggagcatgtacagattctaaagttaaccgcttacgctttaaagaccaagattttgcggctattgctgattttgaattagtacaaaatgctgtatctgctgcgaaagcaaaagatattaaagttcgtgtgggtaatattttctcagcggatcttttctactcgcctgatccagaaatgtttgatgtgatggaaaaatacggcatcttaggtgttgaaatggaagcagcaggtatttatggtgtagctgcggaatatggtgcacgtgccctgacaatttgtactgtttctgatcacattaagaaaggtacacaaacaacctcagaagagcgccaaactacctttaatgaaatgattgaaattgcattagaatctgttctgttattagaagactaa

SEQ ID NO: 2372 - DNA, 1359 bp, Proteus mirabilis
ataatattcggagtcatctctatgttaagtttctttaaaaccagaaaggatctgccgctaatcgaagcgtccaatgaaaagatccgctcaatatataaaaaatatcagtggcaggtttttcttgggctagtactaggttatgccatgttctatgtggtacgtatggcacttggtgtcgttaaaaagccgatgctagatgccggtattgtgaccactgcagaactgggtttaatggggtcggcgttcttctttacctatgcctttggtaagttttccaatggcttcttgtcggattatgccaatattggccgctttatgtccatctcgctgattgcgtcctcttttgtttgtatctttatgggaatgtcgactgcgagcctattcttcatcttattgtggggaattaatggttggttccaatcggtaggatctgccccttcttgtgtgtctattttccaatggttttctccgaaacagcgcggtacagtctattctatctggggtggctcacgtaatatcggtgaagcaatcacttggatattaactgcgaccatagtgagtttctttggctggcgtgccggttttatcggtgcaggtatcgcgggtattgcagcaggtatcatcttactgatgatcttaaaagatcgtcctcgtacttatggtctacctgatcctgccagtgcgtatggtgaagagtcagaagccgttaaatcaagtgatccaaaagaaactcgccgtgctcaattatttgtcctaaaacaacctaccgtatggatcatcgctgcagcttgcgctgccatgtatatttcacgctacgcaatcagttcatgggcggtgctttatctacaaggctcaaaaggctattcactgattgatgctggctttgctatgtcaacttaccctattgccggcttctttggcgccatcttagccggtatggcctctgacaaactatttaatgctaatcgtcatatcccaacacttatttatggtatcgccaatattgccggtttcgccctcatgttctggggaccacaaagccgtgttatggatgccattgcattaagtatgattggttttgctatgggcggactggtggtgttcttggcgggcttaacggcttgcgatctgatgccaaaaaacgcagtaggtgcagtaaaaggctttatcggactttttgcttatattgccgcatctgctcaagagcttgtttctgcctcgctgatcaaagtcacgcaagtcggtgatatcactcactatgatttcacaacggtacagtatttctggattggttctgccatcgtgtccatgatcttagctacgctggtctggaatgcgaaaaaagtcaccatggattaa

SEQ ID NO: 2373 - DNA, 1767 bp, Proteus mirabilis
gctattgtcggtttttatttggagaatatagtgaaaagtcaagatttgttgggtttatcttctgctaacattctaaatgctgaatttgagaagaagtaccgtgatgttattgctcactttttcagccgtgatccgcagtattggccgatatttcaggataaaaccattcagtctattacacagtttagaaagaccatgacgaatgataaggatcaattacagcgttatgagaatgggcaggcgttatttgaccgtttaatggctgatgggcagatccagcaacatattaattacccagagaatgatcctaacgagttactcatgttagtgtcgacgttatgcaaaaactgggaaaatccattagcggttgaaaatgtcattgcgatgccaagcgatccgggtgtttatggatcaatattaggattaatgggcaatcctaatatggtttattgtgaatactcaggtgttgctgacgttttagaaaaagtcaccattaaaaaagtagctaaattagtagggtacgatcccgaagtcgcctctggggttttcacccagggtggcaccatgtgtaacttatatggttatctatttggtttacgtaaatcaatgcctaattctaaacatttaggcatggcagccgatcaggattatcgtattattaactctcaagggggtcattattctaatatgaccaacttggcgctattaggggttgatgttaataacaagactatccgcattaaggtgtctgaagataatacgattaatttggaacacttagagcgtgaattaagagcttgttttactgttaagtgtaaagtaccaactattatgctgacgacagggacgacggacacctttggcgttgatgatgttaaaggcgtttgcgaattaagagatcgtctgtgtgaagaatttgaaatcgcggttaaaccacatattcacgtcgatgcagcagtaggttggccaattattttcttcttagattatgattttaatagcaaccctctggctatcaacgatattactttagatggtttacgccaaaatgtggcgaaatttaaacatctaaaatatgctgattcaattactatcgatttccataagtggggatatgtaccttatacctcaagtttagtgttagtgaaaaatggcaatgactttgttgcccttgaaaatgatccggaaaacttcacttactttgaacatgaattagaaggtcaaacccatttacaatcaactattgaatgtacacgtagcggggttggtatttttggtgcttattctgcaatgcattatatggggattgaaggctatcaaaccatcattgcccattgcctacaaaacgcgaactatatgcgccatcaattacttgctatggggaatgccaaagtcatagtgcctcaaaaccaaggcccaagcgttgggtttaaattatatgatccaaacttagtctctgatcctaatgttgcctttgatctagaatcaacctgtgcgacagataaagaagcctatgactttatggtacataatgcacaatggcatagaaaattattcttacaacggggtaaaaaaggattatttaccaactgggttgactctattgcttgctctaagtatgcaaaaaataatcgctatgtttatattccgggggaaaaagctgtctttatgaacccgaatacggaacgttcccatattgataatttcttaaagataattactgaaatgagccatagtttcagtgctaagaaagtcagcaaaatttaa

SEQ ID NO: 2374 - DNA, 1350 bp, Proteus mirabilis
ggagagtgcggtatgagtacattaacactggtgctaactgcggttggctccgtcctattattgctcttctttgtaatgtatgcgcgtttacacgcctttattgcgttaatgattgttgctattggtgctggcattttctctggtatgccgttagaaaaaatcacgcaaaccatgcaaaacggaatggggggaactctgggttttctctccatcgtggtcgccttgggggcaatgtttggtaaaattctgcatgaaacgggggcattagaccaaattgcggtacggctactgaaatcctttggtgaaaaacgggctaactatgcactgggtattgcgggtttagtttgcgcattacctctgtttttcgatgttgcggtggttttactgatcggggtggtatttgctgttgcccgtcgtacggggggaaatgttgttaaaatggcgatccctctctttgccggtgttgcaggggccgctgccttcttattaccggggccaacgcctatgttgcttgctgaccagatgaatgctgattttggttggatgatcttaattggtttatgtgcagccattccaggtatgttattagcggggcctatttttggtaactttattagccgttatgtgaccttagaattaccgaaagattttgatgagccaagcttaggacaaagtaaaatgccttcttttggcttcagtcttgcattggtcttattgccattagtcttggttggatgtaaaaccattggtgcgcgttttgttgagcctgactctcagctattcaatattcttgagtttattggtcacccctttattgccatccttgtggcgtgtttagtggctatttatggcttggctattcgccgtggtatgagcaaagaaaaagtcatggaagtatgctctgcggctatccaacctgcggggatcatcttattagtcacgggtgctggtggcgtatttaaacaggtgctggtggattcaggtgtggggccagcattagggaatgcattaattggtgcaggtatgccgattgctgtggcttgttttattcttgcaggtgctgtacgtgttattcaaggctctgcgactgtggcttgtttaactgcggttggtttagtgttaccggtgatcagtgaattaggttatagcggtgcacaaatggcggcgttatcggtttgtattgctggtggctctattattttaagccatgttaatgactccggcttctggttatacggtaaatttactggtgcgacagaaggacaaaccttaaaaacatggtcattaatggaaaccattttaggtactacaggcgcagtggttggaatgattttctttgcatttttataa

SEQ ID NO: 2375 - DNA, 273 bp, Proteus mirabilis
tttgatggcggtgaactagtggatatggtttatgcggctaataaagctatttatttgattatattgctttcagctgcgcctattgctatcgcgacctttattggattgcttattgggctattgcaaacgatcacacagatacaagagcaaactttaccttttggtgtcaagcttgtgggggtttttgtttgtttacttatgatgatgggatggatgggagataagttactaatttatgctaaagagatgttgacgattgggttagcagggtaa

SEQ ID NO: 2376 - DNA, 1056 bp, Proteus mirabilis
ttttatatagggaaccgtttaggaataattatggtatccacacatattggttttccgacagaaactgtcattgtttttgttgtacttgcgataggcgctatttttatcgatttatttatgcatcgtgcagataagccgataacgttaaagaatgctgttttttggtcaatattctgggtagtcgttgccatggcattcgcgggttttttatacgtccaccatggtgcagaagttgcaagcttattcgtgacgggttatgcattagagaaagtactgtctgtcgataacctatttgtcatgatggcgattttctcttggtttgcggttcctgatcgtttccgtcaccgcattctgtattgggggatcattggtgccattgtattccgtgcgatctttgttgctattggtaccggcttattaagtttagggccttacgttgagatagtctttgctctgattgttgcttggacagccgtaatgatgctgagaagtgggaatgatagtgaagaaattgaagactattcacagcaccttgcttatcgcctagtaaaacgatttttccctatatggccaaaaattactggacatgccttcttattaacacaaaaagaggttgatgtagagttagcaaaaccggaaaacaaagacataactatcgggcgaggtacaaaagctgcgttatatgcgacaccgcttatgttgtgtgtggcggtggtagagctttctgatgtgatgtttgctttcgattcggtgcctgcaatcattgccgttagtcgtgagccactgattgtttatagtgcaatgatgttcgctattttgggcttacgtactctctactttgtgttagaggcattaaaacagtatctgattcaccttgaaaaagcggttattgcattgttgttctttattgctgtaaagctggggcttaatgcaacagatcatatttggcagcatggatatagcatttccgcgacaaccagcctattcgtagtgcttggtgttcttgctctgggtattctggcaagttttgtattcccagaaaaaaagaataaataa

SEQ ID NO: 2377 - DNA, 576 bp, Proteus mirabilis
atatattcaggattaattatgcagacaaaaaaagtgtcaatattaatagttagtctttgtttattattgacgagttgggcttcagttgcagcgcaatcagtgaaatataatttttcagtcgtttttctcgctaaaacgtgtgaaattgttgttccagataatattactttcactagtggtgaaggggctagttctgttagtgctaatgacataaaaaataataaaattagtcaacagatccctatctcgttaactaattgctcaacaagttctttaagtggaacgagcgtttatatatctcaaggtgttactttaaccggaactcgagatttttttaataacaatgtttctgggtcatttggtgttcaacttacagacgacagtggtagtaaaacatataaagtaaataatagctctgtttttaaaccttctgatgattctgttgtgtgggataatataacctcagaaagctcgactaaatcattaacagcaaagttgcgttgtcaaaaagagggatgtactccagaggttggcccttttacggcaacagtagtgcttagctttttttctgattga

SEQ ID NO: 2378 - DNA, 1347 bp, Proteus mirabilis
ttatctcaaggagtaaacgctatgttagccgtagaattgattatcgttctgctggccattttcctcggtgcgagactaggaggaattggtatcgggtttgccggtggtttaggggtgttagtattagccgctatcggtgttaaaccaggtactatcccttttgatgtgatctccatcattatggctgttattgccgcaatctctgcgatgcaggttgctggtggtttagattatttagttgatcaaacagaaaaactattaagacgtaatcctaaatacatcacaatacttgcgccaattgtgacttatttattaactctctttgcaggtacaggtaatatctctttagctacattacccgttattgctgaagttgctaaagagcaaggcatcaaaccttgtcgcccattatcaacaggtgtggttgctgcgcaaattggtattacagcatcacctatttctgctgcggttgtttatatggcatcagtcatggaaaaccctgcaatggtcggtgaaggtaatacagtaagttatatcactctgttatctattttattaccagcgaccttccttgctattattctgatgtcattcatcatctcttgggtatttaactcaaaactgtctgatgatgcgatttatcgtcaacgtttagagcaaggtctagttgaattacgtaatagtaaagagcgtagagaaacattaccgggtgctaaatcttctgtaatgctattcttacttggtgttatttgtgtggtcacttatgccattatcaatagcccaagtttaggcattgtaaaagagccgttaatgaacaccactaacgctatccttatcattatgctgagtgtggcaacccttatcactgttttctgtaaagttaaaacagataacatcttaaactcaagtacatttaaagcaggtatgagtgcatgtatttgtattctgggtgttgcttggttaggtgatactttcgtttcaagtaatatcgattggatcaaactgactgccggtgatttaatcacaggtcatccttggttattagcggttattttcttcttctgctctgccttattatattcacaagcggcaacagcaaaagcgttaatgccaatggctttagctttaggtgtttctccattaacagcgattgcatcattctcagcagtttctggtctatttattctaccaacttacccaacactggttgctgctgttcaaatggatgatacgggtacaactcgtattggtaaattagtctttaaccatccattctttattcctggtactatcggtgtgatattagcggtcggatttggtttcctcttcggcggtatgattttgtag

SEQ ID NO: 2379 - DNA, 1587 bp, Proteus mirabilis
ccgctaatgggtaaatggcttatcccggggctatgtgcctcgggattattacttaccgtcgcccttctctccttcagtgctttatggtttaacgcgccaagtggtgatttatcgactatttttgctgatagttacctatggcatgtggtgcgctttactttttggcaagcatttttatccgcgctattttccattttaccggcaatttggttagcaaaagcgctctatcgacgccagtttgttggcagaacgctctttttacgcttatgtgcaatgagtttagttctaccagtgttagtggcgctatttggcattttaactgtgtatggtcgcatggggtggctggctcaaatatgccaatggttagggattgattaccattttacgccttatggtttacaaggcattttactcgcacatatttttttcaatatgccactggctaccagaatgttgttacaagccttggaaagtatttctaccgagcaacgccaattagcatcacaattgggaatgaatggctggcaacgttttcgttttctcgagtggccctatttatggcgacaaatcctgcctactgcatcactgatttttatgctctgctttgcaagtttcgcgactgtattagcgctgggaggtgggcctgcggcaacaactgttgaattggcaatttatcaagcattaagttatgactacgatttacatcgtgcagcgctattagcattaattcagctattttgctgcttaggattagtacttgttagccaaaaattaaagggaacactctttgtcggtagtcatcaaaaactaagctggcgtgatcctagcgactcattaatcaataaaataacggatagtttaattatcgtacttgctatgctctttttacttcctccgttattagcggtgataagtgatggcttaaacagtcaattattaggtgttctacaacagccggtactttggcaagcctttacaacatcattaattattgcacttggcgctgggggactttgtgttattttaacgatgatgttgctctggagtagtcgagaattacgcttacgccattttaaaaaggccggacaagcgctggaaatgagtggactcattattctggctatgccgggcattgtattagcgacgggcttttttctattattaaacagcacaaccggattacctgaatccccctatcttttagtgatcctcactaatgcgcttatggctattccatatgctttaaaagtacttgaaaacccaatgaatgatattgcagcccgctataatctattatgtgcttcccttaatttgcgaggtattaatcgtctacgttggatagagctacgcgctttgaaaaagccactatcacaagcactggcttttgcttgtgtcatttccattggtgattttggtattgttgccttatttggaaatgaaacttttagaacattacctttttacctctatcagcaaatcggtgcttatcacacacaagatggcgctgtcaccgcgatgctccttttgctgttatgtttcacgctttttagccttatcgaacgcgtttcaggaaaatcctatgattaa

SEQ ID NO: 2380 - DNA, 972 bp, Proteus mirabilis
tatatagggggaaagaatatgaaattagaggaagtctttaatttttattttaatggaaaagagagtttcgaacaattttatacattatctttaaatgatcatattaaagaatttaattttaataataaaaaatgttattcaatcagtgatgaattaaaaacaattcaactatttttatctaaatttatttttgaaaatatagagtttagaaaagatttagtttactcttatcgaaaaggagttaatgtagtagattgtatttctcctcataggtttaataattatatatataaaacagatattgaaaatttttttccatctataggctatgacttaataaaaaataaaataatagaaaaagtaaaagatatttcttttttagatacaaatgatgtaatggttcatttatctagaatattagagttagttactatagataaaaaactacctataggtttttcgtcatcaccagctataagtaattttgttatgtatgatattgattgtaaaatagattgttttgctaaaaataacgatttaatatatacaagatatgcggatgatattattttatcaggtaaaaataacttagataagaattcaattaaccaagagattaataatatattgaattataatcaggataatgtatttcatttaaatgataaaaaaacaaaaataataacaaaaaaatttgaaaggaatatattaggtataagcatttctcctgtaggaactctttcgataagtcgtcagttaaaaaaagagatagaagttaaaatattttttcttattaataataaagataaatttgtcaagttttcagaaatggatgaaatgagtgcaatattttctttagctggaaaattatcttatgcattaggtgttgatccagtttatataaataagctaagacgtaaatatggtaattcaataattaataaattaattaaaaataaaggtgatttgtga

SEQ ID NO: 2381 - DNA, 954 bp, Proteus mirabilis
gtaatagggggagttatgagccagttttcaactgtttgggtgttgagtgatgtactttcccctttaccagaattaatggggggggcttcttcattaggtcaatcaatcaatgtctttacctttaatgatgagcaaagcatcgctgcctttaaattaggggcgacagcggttttccaattagaaggtaaacctgatgatcgcattatggaagattatgcacaaagtatcgttgaaaccattaaatcacatagcgatgccggcttggtcttactgccgaatacgcgtcgtggcaaattatttgccgctcgtttaggtcaccgtttagccgcggtagtatcaaatgatgcgcaatcattaagtacccaaaatgatgcattagtggcaaaacatatggtttacggtggacttgcctttggtgatgaaacattaacaacaccttattgtgttgttaccgcaagtactggtgcttttgacgttgcatcagaaacacaggctacgggtacggcacaaaaagtagcatggattgccccttcacaaagcattatttgccagtctattcagccaagaaaaatcaatgccgtcgatctggataaagctcgttttgtggtcagtgttggtcgaggtattggcagtaaagaaaatattgctattgcagaagagttagcaaaagagattggggctgaaattgcctgctctcgccctgtggctgaaaatgaaaaatggatggagcatgagcgttatgttggcatttctaacctgatgcttaagccagatctgtatttggcggtaggtatttcagggcaaatccaacatatggttggtgcaaatggatcacaaaccattatggcgatcaacaaagataaaaatgcacctatcttccaatttgctgactacggcattgtcggtgatgtaatgaagattttgcctgcacttacccgtcaactatctaactga

SEQ ID NO: 2382 - DNA, 1203 bp, Proteus mirabilis
ggagtttttatgcatataagaaataattctgataacgttacttcaataaaaaaacactatgaaaatataaaagagaaataccaaataaaaaataaaatcaacaatgtgttaaatacactttcaagtctttatattgaaagggaaaaaattactttactatctaaaatatcattttttataaagagtatttttaatattaatgttggggtggtttttctattagacaaaagtcaacatgcgaaaattaatacattatccattttgatgagaaatggaggggaagtatattttaaaaactgtaagctaattaactcagattttgttagctttaagaataaacatttagatacattttttttaactttaagttatgcaataaaaaatgattgtcatgatgatgttaaaagattaatacaatgttatctttatgaaaaatcaaaaacaaaaggagactttattactataataaacattgctttcaatataattaatcattatccaaaagaaatgtttgaacaattgaagaaatatcacccaaagtgcgatgatatggtatattatagtgattttaactataaacaacatattgatatggcattaagttatgtttgtaaagagattaatagaaaagataataatgaattaattaattcaataatgaatttagttactataatgtatagtatttattcggtggagatggataaagcgtttattgtcaatataactaaatgttttattgataaagcaatggaatataatacggtaaactatattaacgatgcttttaaaaagtcaatatcaaattttttgactaataaattaagaaataatgaagacgttcaaaagtttgtagatgatatgcttacattaggagtgttagaaaaaaaagatattattaaagctaaaaaaatgacaatggaagacgagagttttatcactaaacataatagaagaatgcaaaatatttttactaagaatgaaaatagtgatgaaatgaaatataccattgctaatgttattagaaataatcatgagaatattttagaaaaaatagacaatgagtgtggtgatcttaaagataaatataaagatattttactggatattattgattacttaagggacgataaggattggaattttgattcattaataatcgattacacctatttcattgataattatttacatctattttag

SEQ ID NO: 2383 - DNA, 621 bp, Proteus mirabilis
ggatttattatgaagaaaaataaacttatgctatttactgcaacattattattatcatctgcaggtattatttcaacagcatcagctgaggtgacattaaagcatggctatattgatattccacccagcagagcttttctttgttcatccaaaggggggaatttaaataaaaattgtggtccgatacagtatgaaccgcaatccattgaaggggataaaggattccctaaaggtggtcctgcagatggtgaaattgccagtggtggaaaggcaactttttctgctttaaatgcacaaagtgcagatcgctggcataaagtggcaatgaaaagtggcgaaaatacttttaagtggacattaactgcaaaacatagcactgaatcatggcgcttctttattacaaaaccagggtgggatgttaataaaccattgacccgtgctgattttgatttaacacctttttgccaacgaaatgataatgggaaaatacccacagaaaccgtaacattaaattgtaatataccagaacgttctggttatcaaattattttaggtgtttgggatattgctgatacgggtaatgctttttatcaagttattgatgctgaatttaaaaaataa

SEQ ID NO: 2384 - DNA, 2844 bp, Proteus mirabilis
gagtttattatgtctgctaacagtgtgtttcaacaattatgggataaagcacaatgcacgttttctacaaagctcaacgagcttgccccttttagtgagcgagagcagcaattttttgcctttagcccctttgcaaccgagcatttacgtgtcaatcctcactggttaacggaaatcagacaaacaccacctgttagtgatgagtggcaaaattactcatctcaattaaagcaacaactcactcatgttgataatgaagatgacttgatggccattttacgacagttccgtcatcaacaattagtgcgtattgcctggtcacaatttttccaactctgtgatacaccctgtacactcaagcaattgagtgtactcgcggaaaccttgattagtgtcgccaaagataagctatatcagcaatgttgccaacagtggggaacgccttgtgatagagagggaaaacctcagccattacttattttgggaatgggcaagttaggtggacttgaactgaatttctcttctgatatcgatcttatttttgcctatcctgaaaatggtgtgactcaaggtgggcgacgtgaattagataatgctcagttttttacccgattagggcaaaaactgattaaagtgttagatcaacatacaatggatggttttgtttatcgtgtagatatgcgtttacgtccttttggcgaaagtggccctttagtgatgagctttgccgcgcttgaagattattatcaagagcaaggacgtgattgggagcgctatgcaatggtaaaagcgcgtgttttgggggcagaaaaaaaagagtattgccaaatcttacgccaaatgttgcgccctttcgtttatcgtcgctatatcgattttagtgtgatccaatctcttcgtaatatgaaatcgatgataagtcgtgaagtacgtcgtcgagggatgattgataatataaagcttggagcgggggggatacgtgaaattgaatttattactcaggtttttcaattaattcgaggcggtagagagcctgagctacaaagtcattcactattaacggtgcttaatgtcattgctaaattggaattactctctgcacaagaaacatcacagttagcagatagctatcttttcttacgtcgattagaaaatcttcttcaatctattgcggatcaacaaacacaaaggttacctgacaatcttgaagataaggcacgactggcgtttgcgatgggatttgacgattggcaaatgctctatcaacaaattaaccaaaaaatgcaggctgtttccgttatttttacgcaactgattggcgaagatgatgaaaatgaagatgaagaagatgtcagcgaatttaagcgattatggttattagggcgtttacctgatagcgcaacgctttttcatcaagggctaacggcagaagataggcaagctatttgtcaaacactgcaactgtttcgccaagatatcagtaaacgtactatagggcctagagggcgtgacgtgcttgatgcgctaatgcctaaattattggctaaagtgtgtcttcaaccacaagcgttggtgatcttacagcgtatcaccccgttgttattgggcattgtaagtcgaaccacttatctagagttaatgcaagagtctgatgaggtattaacccacgtagtgcgcttatgtgctgcatcaccgatgattgctgaacaattaacacgacatccattattattggatgaattactcgatcctcattccctctatcaaccattaccattaaatgcctatcaggacgaattacgtcaatatttattgcgtgtgccagaagaagatgaagagcaacgtttagaagcattacgccaatttaaacaagcccagctattgcgtattgccgcagaggatattgcaggagtattaccggtgatgaaagtcagcgatcacctaacctatttagcggaagccattatccatgccgttgttcaccaagcatggtcctatatggtgaaacgctatggggaacctgcgcatttagcgcaacgagacggtttaggttttgcggtcgttgggtatggcaaattagggggctgggaattagggtatagttctgatttagatttggtttttttattagattgcccaatgaatattctgacaacgggggcaaaacagattgatgctcgccaattctatttacgtttagcgcagcgtattattcatctatttagcaccagaacctcttccggcgtgttatatgaagtagatgcacgcttacgtccttccggtgaatcaggtatgttggtaagtactattcaagcctttgatgagtatcagaaaaatgaagcttggacttgggagcatcaagcattaattcgtgcaagaatgatttatggcgatgaccaattacagcagatgtttgcacgtactcgccatgaaacattatgtttagcacgtaacgcaactgtactgcagcaggaagtgcgtgagatgcgccaaaaaatggtacagcatttggcacccactcaaagcaatacatttgatttaaaagcctcatcaggggggatcactgatattgagtttatcgcacaatatttggtattgcgcttttcacatcaatatccggctttgacccgttggtctgataatgtgcgaattttggaattaatggcaaaataccaagtgatgagtgaacaagaggctcagttattaactcaagcttatgtcaccctacgtaatgagcttcatcatcttgcattacaaacattacctgcggttgttgatggagattgttttattacagaacggcaatgggtattgagtagtaaacaaaaatggttagatgaataa

SEQ ID NO: 2385 - DNA, 669 bp, Proteus mirabilis
attatcttctttatatacctttttctcttagagaaccctatttttgaggttatttttatgccacttttagcgctacaacaactctctgtgcaacaagccggtaagatgttatggcatgatctctctttttcattagaggcgggagagcgcttaggcatttctgcgccaagtggtagaggaaaaacaacgttaggtcgtgtattagcacaatggcaaatgccgactagtgggcaaattctttttaatcagcaacctctgcctaagaaaggttattgtcccattcaattggttccgcaacatcctgataaatgttttaatccatttagaacaaccggagagagtgtacgtgatgcatgggtgcctgatagcctgtggcttgaaaaattgatgatagagccagagtggttaacccgtaggcctaatgagttatcaggaggagaattggcacgtattgcattactacgagcacttgatcctcgaacacaattattaattgcagatgaagtgactgcacaattagatgcacagatccaagccaaaatttggcaagtattaatcgatgaaagtcaaaaacgtcctttaagtttaattatctttagtcacaataaagccttactagaaaaagtatctaccagaatatggtgggtagataaggaaaaaatatgttga

SEQ ID NO: 2386 - DNA, 795 bp, Proteus mirabilis
gaggtgattatggacagaaaattgatgccagcgctatttgttggacatggcagtccaatgaatgtattggaagataataaatatactcgcctctggacgacgttaggagagacactgcctaagcctaaagcaatattagtcatctcagcgcattggtatacgcaagggacttatattacagcgatgactcatcctaaaacaattcatgatttttatggatttccaccagagttataccaaatagaatatcctgcaaaaggctccattggtctcgttgcattaattgaagatctgattgatccgatgaaattaaaactggatatggagcaatggggattcgatcacggtagttggggaatattagagaagatgtaccctaatgctaatattcctgttgttcagttaagtattgatgctaaccaatcgccacagtggcactatgagtttggaaaaaaactggttgaactacgtagagaaggtgtattagtgattggcagtggaaatatcgttcataatttaagaatgatggattggcaaaatgaccaagcagagccttactcttgggcattatcttttagtgaaacagtagagcgctgtttacaaagtgataaagtgcctgaagcgctttttaccattttatcaacgcaagaagggcaactcgcacacccaacagcagaacattttttacctgcattatatctactcggtttaaaacagccggatgaaaaagtaactttattaaataatgatattattaataaatcacttagcatgatgacctttcaaattgggtaa

SEQ ID NO: 2387 - DNA, 672 bp, Proteus mirabilis
ggcgcgattatggaaatctatttagataccgcagatattgaagaagtgagaaaactttcacaagtacttcctattgctggtgtcactaccaatccttctattattgctcaatcagcgcagcccattgaaacgctattacctgaattaaaagccgctatgggcggtaaggggcggatatttgcgcaggtaattgcccgtgatatcgataccatgattgaagaagcattgcgcattggtaatattgccgataatactgtgattaaaattcccgtcactgaagctggcttggttgctattaaacaattaaagcaaaaaaatatgttggtattggggactgctatttacagtgtgtctcaagggttgatggcggcgttagcaggggctgattatatcgctccttatgtgcatcgtatggatagacaaggctctgatggtgtgagagtagtaagagagttgcaaacgctggtttccatgcataatttacccactaaaatactggtagctagttttaaaacaccacgccaagtggttgattgtctgttgtctggcgcttcggctgtaacacttccgatagagcttgcctactctattatccgttcacccgtagtcgatgatgcgattaataaatttactgatgattggtcattagcctttaatcgccaatcattgtaa

SEQ ID NO: 2388 - DNA, 1419 bp, Proteus mirabilis
tggctcgttatcaactggctattatgcgttctaatgtcaattatctattacaagacaaagatagtcgtgtcgcagatcgtaacaaaattattcagcacaaataaaaagctagctatcatggctaaaaacaccatggaaacatgggtgaaagagaagaaaatgactgttgcagcacaaaaaaatgctgatgatatttcgacgttattttataatctgatagataaattagttttagatcctaataaattagcgacaataaagataaaagctaatcaatttgatcaagattttgaacatcttgatcaattatttgaaaaatatattcagactagaaataaaaatagtctctaccttactcataaacaagattcaatggttgagttttctatctactcaacaattatctcattaattattttattaattgttttgtactttgtgcttcattggatcaataaaacctttgtctctaatcttaatacattgtctgagatattaaataaagtaggtaatgctgacttggttttttctgtaccacaagtaaaaaatgatgagtttggtaaacttttttctcgtgtcagtgatatgcaaaaagcattaacctcgacaatcttttctgtcaaaaaagaggctatggatataaaagggggcgcatttaaaattgcttctggtaatcaagagctttcatctcgtacagaagaacaatccagtgctttacaacaaaccgctgccagtatggagcagatcaaaatagccgttgctaacaataccgataacacaattgaagcaaataatattattaatcaatctactgacattgttatggatggcgctaatgtcatgaaagaagccgtgttatcgatgaagaaaatagaacaaggtgcagtgaaagttggggaaattaatgatgttattaataaattagccaatcaaactaatattttggccttaaatgccgccgtagaagcagcaagagcaggcgaacaagggcgtgggttcaccgttgtggccgctgaggtacggaacttagccgcaaaaagtgctgaagcagcaaaagagattagccaagttcttaaagcatctatcaatgatgttacctatggtacaaatttagttaataaaagcggtgagtgcatgcaagagattgtctcttccatttcaaaagtaaacaagatcatgcaagggattagtttagcgtcggaagagcaacgtcttggtgtcgaacaaattgcagtagcaattaatcaaatggatacggtagtacaacaaaatgcctctttggtcgatctcgccgcctcttctaccatgatgttaaacgataaagcacaagtactgatggataatgtcgcagtctttaatattgacgatcttgaaaaagagccagagcagaaacaagagttaatcaatgaacaagaataa

SEQ ID NO: 2389 - DNA, 1647 bp, Proteus mirabilis
ctaatttctatgctaacactgcttcatttactctcatccgtggcacttttagtctggggaacacatattgttcgcaccggtattatgcgtgtgttcggctctgatttacgccgaattttaggtaaaagtattaataaaaaatcgaatgcttttcttgccggtgtcggtgttactgccttagtacaaagtagtaatgctacggcattgctagtgatttcgttcgtcactcaaggccttatttctattacacccgctttggtgattatgctaggggctgatgtgggtacagcgctaatggcgcgggtgctgacattcgatctttcgtggttatcaccgttactgattttattgggtgtcatgacttttttaagtcgtaaaaaagagcgtatcgggcaactgggtagagtgggaataggccttggtttaattatcttagcattacaactgattgtgacttctgctgagccgataacccatgccagtgcagtacaagctatttttacctctttgagcggggatacgattttagcactattggtcggcgctatttttgcgatggttagttattcaagcttagcggcggtattacttaccgcaacattaagtgcaacaggctttatgcctttatatattagtttatgtattgttattggttctaatattggtagtggattgttggcattaatcagtagtcgtggtcaaagtattagttcacgtcaagtcgtcataggaagtctgttttttaaattaattggcgccttgctggtattgccgtggatcaccatcattgcgacaaaaatccaacaatatgatttttcccctgcggaagtgattatctattttcatgtgatttataacttagtgcgctgtgtgttgatgttgccgtttgtggggccaatggcgaaattatgtcaaaaattagtgccggaattacccgttactgggacagaagttgcacctcgttatttagatccatccgccgttgatactccctctttagctattgctaatgcagtcagagagacattacggttaggggatgtggttgaacagatgttgcaacgttttcaagccttaatggaaggggatcgtctgcaaaaaagggagattagccagctagaagaggaagtggaattgctccatagcagtattaaattgtatatggcacaaattcagcagcatgatcttggtactgaagactctcgtcgctgggcagaaattattgataccgcgatgaatttgcaacaatcttccgctatcatagcgcgtatgtctggtgaggtggtgaataaaagtttagatcatcacttaaatttatcggaggaaggacgtcgtgaattacagacactccttgagcgtctgcaaagtaatctgaatctggcgatgtcggtgtttgtttccggcaatatggagcatgcgcgtaaattacgccgagcaaaacatcgattccgtttactcaaccaacgttactcgtttgctcatgtagaacgtcttcatttgcataatatgcaaagtattgaaaccagttcgctgcataccagtttgttgggtgatatgaaacggttgaactccttattctgtgcagtggcttaccacgcattagagcggagcggatcttcttcagaacaggttaatcttcaacaatga

SEQ ID NO: 2390 - DNA, 1071 bp, Proteus mirabilis
ggagactctatggggaagtatataccggttacattaaataatattactgcacttgaatttcaatcatccttaccacaaggcaaagttgcattagtttgcgaaggcggtggacagcgaggcatctttactgctggtgttcttgatgaatttatgcgctctcaatttgatccttttgatctactcctaggggtatccgcgggggcgcaaaacttatctgcttttgcttgtggacaaaggggttacgcccgcagagtcattaaccgttataccaccaataaccaattctttaatccgattcgttttgttcgtgggggaaatttactcgatcttgactggtatatagaaaccacttcgaaagaaatgcctttaaatatgcctaaagcattacgtcgtttcgatagtggtcgcgagttttatatggtggcaagtcgctccgacaattttaaggcaaattattttcaaccagaaaaaagcacatggcttgatatcgtgaaagcctccagtgcgatccccgcgttttatcgcaatggtgttttatttcaagatgttgtttaccatgatggcggtattagtgatgcgatcccggtaaaagaggcttatcgtcgtggttgtcgtacaattgtcgttatacgaaccgtaccgtctgaatatcaatataccaccgagtgggtggataaaatgggaaaatggtttgagaatggccgttttcaacgctttctcaatatggctcaagtccatattgaaacttatactgacacactaagatttatccaatctccacctgaagatgccgttatcattgaaatatatccaccaacaacactacaatctagtgcattaggaagccgtttaagtgcattaaatcatgattatcatgttggtagacgctgtgggcgctattttctagccactattggtcaacacttctctaagaaaaaatttcagcaacacgataaaaaaatatttagcctatttgaaaatgaagcaaaagcagataaagcggaagatgccgaaatcattcaaaaaggaactcggagtgtgcaccctgaagtaaggagtgttcaagaatga

SEQ ID NO: 2391 - DNA, 183 bp, Proteus mirabilis
gcaagctctatcggaagtgttacagccgaagcgccagacaacagacaatcaaccacttggcgtggtgttttaaaactagctaccagtattttagtgggtaaattatgcatggaaaccagcgtttgcaactctcttactactctcacaccatcagagccttgtctatccatacgatgcacataa

SEQ ID NO: 2392 - DNA, 258 bp, Proteus mirabilis
attaattatattttttatgtagttaaaaaaacaaaaatctggtttttatattggaacgatttacctacatctccatcaaatttcgtcagtagtaaggagggggatctgtatatgctgagcacagtttgtcacaaatacaccaaactacatggtcggttttgtgatgcgcttccgcgtgctggcgaactgtccgttaagctggtggctatagagatttttgaaactgaaatgaattacaaatatattggggaaaattag

SEQ ID NO: 2393 - DNA, 183 bp, Proteus mirabilis
ggttgttatatcaacaatatagttgatatagcccagtccgaaagttcagactttcataatacacttaatttctttcctcatcttcagaaagggaataattcaaatgctgaaccaatggggtattttcaaaaaaaacttaagatttttaagtttgtttttgtccatcacttcaaacccttataa

SEQ ID NO: 2394 - DNA, 453 bp, Proteus mirabilis
agattaaatatgagtaataatacacaacacccttttggtcatgacattaccttagatggattatttcaagacttccagaaatctaaatcatgggaagataaatatcgtcaattgatccaactttcaagaaaattacccgcattacctgatgaattaaaaacaacagaaaacgaaatcaaagggtgcgaaaatagagtatggctaggtgttgagttaaacaatgacggcaaataccatatttatggtgatagtgatgggcgaattgtaaaaggcttactggcggttattttaacaacagttgagaataaaacagcacaagaaatagccaatatcgatatattagctatttttgaacaattaggattggctaatcaaattagtcaatcacgcactgatggtgtcaatgccattattgcgcgattaacgtcgctgacacagacatctcaaccctaa

SEQ ID NO: 2395 - DNA, 840 bp, Proteus mirabilis
ggtataaatatgagtatgaagattaatagtgataatgtatctaatcactatcaaactacaatcaataattctgatgaaggtgaaggtattattgatagaaataagttatataaagaggtagcacctagcttaagtaaattaacaggaatagacagagttaatctaaagcctgttttatctgaaccagagcatataactaaaccagatcttaaacagatattagattcattagaagtagataatgataatgatatttacgatcatgttaaaatagaaaaaacagggatttttaattttgtttcagacgatatgatgaaattaatagatctcattgttaaatatttagaaacaatgataaaaaaatttgaagcatccagagaaatgggtgtgatgctaatgaacattgaattggatatagccgataaagtaaaagataatcttaataaaaaagccaatattatgattggttctgcaattactagtgctggaatttctatggctatacatggtatgggagccactttttctattaaagggatggggaaagagcttattgggcattccaatccaaccatagtgatgggaaatactatttcatctttggcagatccattagcaagggttgcagaccaaactatgcaatctgaaagtagcacaattgaaggtgaacaaaaagtattggatgcgagaggaagtattaataataatgtgattaataataacaatgagatacagcgagaagtgactgaagtcataagagcattattacaagcaatagaggcgataattcatgctcagcaggatgcagcttctacgatttcttcaaatgtaagagcttaa

SEQ ID NO: 2396 - DNA, 720 bp, Proteus mirabilis
aatatgaatatattaaaaacgatttcattactttttagctgttttattttttctgcatcatatagttatgcagggctatctttgtcacaaagtcgcattatattttctgagggagataaaagtcaaagtgtacaaataaataatgatacagataatctttatttatctcaaaatatgataacggctgatttagatggcaaaaaagatgagcattttattgtattgccaccgttaaaacgattagagcctcagtcatcggtttctataaaaattttaccacgctctttagatacattaccaagtgatcgggaatcactcttttttttcactgcatatttgatacctgaaacaaaaagagggcaacaaaataatagtggtgatttatcactaaaaattaatatggtaacaaaaattatcataaaaggattttatcgaccaaatgaattagccataacatcactagatagtcatgctaagaagataacctttaaaaaagtaggtaataatgtgcaagtcaataacccaacaccttattattttacagtatcaaatttaaaattcgatggcaaaagttatcaatcagcaaatgcacctatggttgcgccattttcgtcactcaatttagctatagataaatcaattaaacaggttagttggcaatatattgatgattttggtggattatcaaatacatttgaaaataaaataattgtggagtga

SEQ ID NO: 2397 - DNA, 714 bp, Proteus mirabilis
aatatgcgtattatccatacatgtctaacgaacgttcatcaacattggagaatacaaatgagtgctaacgcacttggaatgatcatcttcgcctatttgtgcggctcaatctccagcgcgattttgatttgccgactggcaagactccctgatccaagaaaatttggctctggtaatcctggcgccaccaatgtgctacgtattggtggtaaacttgcagcggcatctgtgcttatctgtgacgtcctaaaagggatgatccccgtttggctcgcctattacctaaatgtgcctcccttttatctcggtattgtcgcaatagcggcttgtctaggccatatttaccctgtttttttccactttaaaggcggaaaaggggttgctactgcatttggctctatcgctgctattggttgggatcttagcggactgattgcgggaacctggctactaactgttttactcagtggctattcctcactgggtgctattatcagtgcattgcttgccccattttatgtctggtggtttaaacccgaattcacttatcccgttgcactattatcatgcttagtactttaccgtcatcatgacaatattcaacgtttatggcgaggacaagagagtcgcatttggcataagctgaaaaaaaagacagagaaaacagataaagagataatccaagaagccaaagagcaagaaaaagaagattaa

SEQ ID NO: 2398 - DNA, 888 bp, Proteus mirabilis
tcacggctctttccattttttgatgacattaggatatcgattatgtctttatatcagggagataaggctctcgaagcactatcattaggcaaagaaacacaataccacacacactatgatgcgagtctattacaaggtgtacctcgtcgcttaaatcgagattcactctctttaactgctgacaatctaccttttcatggtggtgatatctggacaatgtatgagctatcttggctcaacagccaaggcttacctcaagtggctattggccatgtagaattagatgcaacgacagaaaatctcatcgaatcaaaaagctttaagctctatctcaatagctttaatcaaactcgttttgaaaattggcacattgttgaagaaacattactcaaagatttaactgcttgtgctaaaggcagggtgcatctaacgctttacccactttcccattttacctcacagcctattgtcgattttgtaggagagtgcattgataaccaacctattgaaattgataattaccaattcgatagccaatggttaaacggatcaacaacagatacactggttgaggagacgcttgttagtcatctgctaaaatcaaattgcctgatcacgcaccaacctgattggggatctgtgatgatccaatataaaggcaaaaaaatcgaccgtgaaaaactactacgctatcttgtatcctttagacagcataatgaatttcacgagcagtgtgttgagcgaatattccacgatattatgacattttgttcaccagacacattaacggtttatgcaagatacactcgccgtggaggattagatattaatccttggcgtagtaattgtgagtttgttccagaaactggtcgcttagccagacaataa

SEQ ID NO: 2399 - DNA, 921 bp, Proteus mirabilis
gtcatcggtatttattatcatctggtgggttctaaacttaaaaaaatatctttagatttaaatataaaaaaaggttttaactctttatatataggacgagaagaaaaaaaagcacagctcactgatcagagaataaataaaaaaacatctaagatagataaatacaaactacaaccccatgtaggaatagaagaaaaaactgtcattaaagacataataagaaaaaacaatgttaaaacgatggttaatgaattcttatcggcaaaaaagagttcagtatttcctattttcgtagataaaaaaataaatcaacaacggtatattaagttagtagaaaaaataattaaaaaagaacccgttaataatgataatattgatttagttagcagtgcaactaagcaggaaaaacaggctcaaattcatcagaaagagaataacagtgcatacaaaaatattgagtctagtatggcaatgccgctaaataacgtatcaaaagttgatacaaaagaagagccggaaatttatcaagaaaatatcaatgaaactaataaagttgttcctttttcttcgcaagttacaccaataaaaacggtaattgcattaccaaaagtagccaaaatggtttcacagctacctgcttggcaagtaatagataaaaaaatatctatgttgactctaccacccagcattacttatacatttacaaaatggaagagtcgttatcatcaggctaaaattcattttattgataaacaggttcagttaattgcttcctctggacgcgtttatcaaacagcattagagaatttgaagcaatataatgggggattatccatagatctaactaatagccataaaaataaatcgtggtatatcaactctattaatgctatttatgaaagagaggatgaaaatgaatga

SEQ ID NO: 2400 - DNA, 1356 bp, Proteus mirabilis
gcaatgggtatcctgtggaatctagccgcgtttattatcgttttaggtattcttattacggtacatgaatttggacatttttgggtagcaagacgctgtggcgtttatgttgagcgtttttctattggttttggtaaagcgatttggcgtaaaacagataaacatggcaccgaatttgtcgttgcatggatacctttaggtggctatgtaaaaatgttggatgagcgtgtcgccgaagttgcaccagagcgtcgtcatctcgcttttaacaataaaaccgtcgggcaaagagccgctattgttgccgccggaccgattgcaaatttcttattagccattgtggcttattggcttgtttttatgataggggtgccggcattaaagccaataattgcagatattcgccctgactctatcgcagaacaagcaaaattaacgccgagaatggaactaaaatccgttgcaggtatcgaaacgcctgatcagaatgctgttcgtttagcattagtgagtaaaattggtgcaaaagaggtgactttcgttgtaactcagcctaactctctttctgagagtgagaatatactgaatttgcaacagtggaattttgatcctgaaagacaagatcctatcgtatccctaggcatcatgcctgttggcgcacggttggactctaaagttgtagaagtaacaccagactctgcggctgaaaaagcaggtttacaagcaggggatcggatcgttaaagtcgatggtcagccaattgatacttggcacccatttacttattttgttcgacaaagccccaacaaaacgttggaactgttagttgaacgtaacggtgcttctttggtgttaaatattactcctacagcaatagcgctgaaagatggtagcgaagttggacaagtgggtgcgaagctacaagtattaccgccagatgagcaatacttgataatgcaacaatacaacccattttcagcgttatatgaagcatctgataaaacatggcagttaatgggtttgactgtcaaaatgattggcaagttagtggttggtgatgtcaagttaacaaatcttagtggaccggtttctatcgctaaaggcgctggaatgtctgcggattcaggttttgtttactatttgatgtttatcgcacttatcagtgtcaatctggggatcattaatttgtttcccctgcctgtcttagatggtgggcacctgcttttcctggttatcgagaagataaagggagggccggtatctgagcgtgtacaagatgtctgttatcgtttcggtgttatggcactgatgctgttaatgggacttgcacttttcaatgatttctctcgcttataa

SEQ ID NO: 2401 - DNA, 576 bp, Proteus mirabilis
aggatattcatggcttcttataataccaacgattttcgttcaggtcttaaaatcatgttagatggcgagccagccgtcattactgaatgtgaatttgtgaaaccaggtaaaggtcaggcatttgctcgtgtgcgtctgcgtaaactgatttctaacaaattactggaaaaaaccttcaaatctactgattctgctgagggtgcagatgtcatggatatcaacttaacttacctgtacaacgatggtgagttctggcatttcatgaacaacgaaacctttgaacaattagctgcagacgaaaaagcggttggcgaaaatgctaaatggttgattgaccaagcagagtgtatcgttacactgtgggataatcgtcctattgctgttgttccaccaaactttgttgagttagaaatcgttgataccgatccgggtctgaaaggggatactgcgggtacaggcggtaaaccagcaacattaagcactggcgctgtggttaaagtacctctgttcgtacaaatcggtgaagtgattaaagtggatacgcgttctggtgaatatgtatcacgcgtaaaataa

SEQ ID NO: 2402 - DNA, 1227 bp, Proteus mirabilis
cacaagctcattatgaaaccattttcccctactgtttttcgccaacaatttcctgctattgaggaaaatattgtttatcttgatagtgcggctaccgcattaaaacctgtagctatgattgaagcttcagatgaattttatcgccatagctcagcgacggttcaccgtagccaatatcaacaagctaaaaagatgacacaacactttgagcaagcacgtcagcaagtcgctcaattacttaacgtcgcagatagcgatactattatttggacgcaaggcaccacaggctcacttaatcttattgctcaaggctatttccgcccacgattacaagccggtgatgaaattattgttagcgaacaagagcatcacgccaatcttattccttggttaatgttagcagagcagactggggccaaaattattcgctggccgattgaagataactttttaccttcaatcgccacactgacgacattacttacggcaagaacaagagtagtggcaataagccaaatgtcgaatatcaccggtgcacaaatcgccttagataaagtttctcaatgtgtacatcaatatgatgactgtttactcgtggttgatggtgcacaaggcatagctcatcatgcaacggatatcagcgcccttgatatcgatttttatgctttctctgcccataaattatatggtcccaatggccttggcgtatgttatggaaagcgcgaacttttagaagtgatgtctgcgtggcaagggggcggaaaaatgttaaccacggcaagctttaacggttttgtacccgcggctattcctcatcgctttgaagcaggcacccctaacatagctgctgtaattgctttttcagcaacattagattggttacaaacgcaagatatggcgcaagccaatcaatacgccttaactctggcagataaagcacaggcgcgtcttgagcaactggagggttttatcagctaccgcgcgcctcattcaccggtactcgcttttaattttgagggtattcatcacagtgatttagcggcattaatcgcggaacaaggtattgctttacgcacagggcaacactgcgcacaacccttaatcgatgctttaaccatctctggctgtttacgcgcttcttttatgccatataatcaactttctgatattgataggttagttgatgcggttaaattcgcactgtccttattaaaagatgaagattaa

SEQ ID NO: 2403 - DNA, 1071 bp, Proteus mirabilis
gtatttatcatggctgagaaaacagaaaagccaacacagaaaaagcttgatgattcagcaaaaaaaggacaatcgtttaaaagtaaggaactggtttctggtttagtctatttcattggtgttatatatttatttaatcaagtgaagttggatgaatttaatcaattttatcaatcacttttactgcatccaacaggtatttctttaaagagttatgttgaagttatatcaaaattattctttgatattgtactaccgatcattattgtgacttttttatctggcgcaatcccttctctatttagctcccattttaaacttgctactgaagcaattaaaattgattttaatcatattaaccccatttctggatttaaaaaaatatttagcataagaacaataaaagattttttaaaaacaatattatttattattatatttttaataacttgttatgttttcatgattttacatatgggggaagtcgttatactatatcgcgctgatttagagggggtgattgataaatggtgctcattagttgttagttttatatttatattttttattttatcgatacctattcttattttaaatattattgctgatttctttttattcataaaagatatgatgatggaaaaacatgaagttaagcaagaacataaaaatatggaaggaaatccagaaataaaatcggtacgtagacaacttcatcaagaattactcgatgagccaatgaaacgtgtgatccgcgactcatcagctgttattgtcaatcccacacatgtcgcggtaggtatctacttcgatcctgataatggcataatgccaatagtttcattgagttgtactaatgctaaagcattagcagtaaaggcctatgccaaaaaagttggtacacccgttattcgttatcctgaattagcaaggaagctacatcataaatatcatttatttgaagtgataatagatcaagatttattagatgttatggatgtccttatttggctaaaaagagtagaaattgaagggttatctcgagaagaaatggactatatcaataattaa

SEQ ID NO: 2404 - DNA, 459 bp, Proteus mirabilis
caaattatcattagaattattaatgtcttaaaaattactctgataacaattatgaaaataaaatttattcttttgggggtatttggtggtattcttttattaagtgggtttgttgctcatgcaataaaaacgatacctttggatatgcaaaaagaagctactgtagtttctgtcgaaaaaccgaaaatagtatcacgacaatttccttattatcctacaggcgctaaaaccgctaatattgaaggcgatgtagaggttaggtttgatgtggataaaaatggtaatgtacaaaatattaggatatcagatgatcctattgcagcgatatttgctccctctgtttcactggcgatgaagcattggcgatacgaatcaggtaaaccggctaaagatttaaaagtggttatacaattcagattagaaaatgtgaaacataacggatttaatcaatcacattaa

SEQ ID NO: 2405 - DNA, 420 bp, Proteus mirabilis
gtaaatatcatgagccgtaaagacagaatgttagcccaacttgggattcgtcaatgggtacttcgtaagcctgctgtattaaaaggcgaacattctgtgcaatttccggataccactcgtttacttatcattactgatgatgttgttgatctaaataacgggcttttctctgatatttttagcactatgggaatagataaaagtgaaatctattgtattacctcagaggatgtgagcctgctcacaggatcatttacaccagcctgttggctattaggtactgatatcactctacctgctcaatatacttctctgagaagcccttcattacatcaattatattttgatgccaatgcaaaacgcgatctttggaaacaaatctatcaacatgaagaccatttccccattaaaccctgctga

SEQ ID NO: 2406 - DNA, 549 bp, Proteus mirabilis
ttattcatcatagatgaaaggattatcataatgtcagcatatgaaaaaatgtcagaaaaagaattagatcagctcgcaaactacattgtttctattgtacaaaatggcgcatctatcaaagatgaaagtgaaattccagatggatttatggaaggggattattcatttgcgtatgatttttatcagaaagggaagttagatgaagctgaggcgatttttaagtttttatgtctctatgatttttataatgttgattacattatgggacttgctgcagttaatcaattaaaaaagcaatatcaagcagctatcgatctttatgctttagcttatctaaatgctaaaaatgattatcgacctgttttttatgctggacaatgtaatttatcaattggtgaaaaagaaaaagctaaatattgttttcaccaggtggctcaaaatattaatgatcaaacgataaaagagaaggctaatagctatttagagctattaaaagatattcctcttgttgtccttaataaagaggaagaaaaggaagaaaaggaataa

SEQ ID NO: 2407 - DNA, 1341 bp, Proteus mirabilis
gacgcagtcatgcagcccagaaactttgatgatattcgttttacctcagtacatcgtcgagtgatgttatggggaagtggcggcccttttcttgatggttatgtattagtcattattggtgtggcgctcgaacaattaacacctatattacagcttgatacgcgatggattggtctgcttggtgcggcaacattagcagggctttttattggtacctcactttttggctatatttgtgacaaagtagggcgccgtaaaatgttcctcgttgatattgtggctattgcggtgatttctattgcgaccatgtttgtttcaacaccaatagggttgttagtgatgcgcttccttattgggattgtgattggcgctgactatcctattgcaacttcgatgatcaccgaattttccaataaaaagcaacgtgcctttgccgttggatttattgctgctatgtggtatatcggtgcgacatgtgccaatttagtgggttatcttttatatgatgtccaagatggctggcgttggatgttaggcagtgcttttattccttgcgttattattctaattggtcgctttgatctccctgaatcaccgctttggttaatacgccaaggacgtattaaagagtgtaataaaatgatgatcaaactctttggcgagcctgtggtctttgaagcagaagatgctaaaacgacccgttttatcgaattatttaataaacgccacttctcatttgtgctctttgttgccgtaatttggacctgccaagtgatcccgatgtttgccatttatacctttggtcctcaaattgtcggtttattaggatgggatacaggaagaagtgcggcattaggcaatgtcgtgatcagcctattttttatgttgggttgtattcctgcaatgttttggttaaaccaaacggggcgacgcccactgttaattggtagttttgcgatgatgactttagcattattcacgctggggatattcccgaatttaccgattttattcgttatcttagcgtttgctacctacgcttttttctcgggaggacctggcattttacagtggctttatccgaatgaattatttccaaccgatatccgagcatcggcggtgggggttattatgtcgataagccgtattgggacggttatttccacctgtgcgcttcccgcttttattgccacttatgggatcaataccacaatgcaggtgggtgcggctatttctctgtttgggatgatggtatcagtactgtttgcaccagaaacgaagggattaacgttaaagcagacatcaacaatgcctatgcgacgtggtaaaaaatccctttaa

SEQ ID NO: 2408 - DNA, 324 bp, Proteus mirabilis
ggactatccatgctggacccaaaaaaaattgaacaagtcgctcgccaaatccaaaatgtactaccacaaggtatcaaagatttaggtgatgatattgataagaaaatccgtgcaatacttcaatctcaattaaacaaattagatttggttaatcgcgaagaatttgatgtgcaaacacaagtgctgttacgtactcgcgaaaaattggctcgtttagagcaacgtttaaatgagttggaagcaggacaacaagcgccagcggaagttgcacagattgaagaagttgatgttattgttgaaactgggaatgacagtaaagcttag

SEQ ID NO: 2409 - DNA, 762 bp, Proteus mirabilis
ctggtgaccatatataagaaaaagactaaaatttcgcgctactcttttacttactatttggttattttttatttttgtgggttatatatgaacttttctcattttaataaggtaatgtttgctgcctctcttcttgctactggcttttcttatgcggatagcgatcgccctctgctctctttaagtgtaagccaatccggcggcactgcgttaaatagcgaaggttcgttagatacccgtactcctgcaagccaatctcgcgtattacctatctggggtgatgaagctcgcgcccgaggttatgatttaccagagccatttggtgcaagctatagctatatgaatctacgtcaagatattgttgtggataaaattgggtttattatgccgaaaaatccagaaacagcgaatgctctaaaaatagaagcaggacatactcgtgaaaaaagtgaaacccatatgctaaaactcgatagctgggttttcccttttatgaatgtgtatggtttatatgggcgaactaaaggtaaatcaaaaacaacacttaaaggtggtagttttggtggttttccattaaattttatagaaggtatgccttttaacctcgattttaaaggtgatacttatggcgcaggttttactttagccggtggctataatcaattttttggtacttttgacttaaactacaccaaaactaatcttgatattctcgatggggatattaaagccttagtcatttcacctcgtgttggctattaa

SEQ ID NO: 2410 - DNA, 1233 bp, Proteus mirabilis
cgaggtgacattatgacagaacatttatccatgccacaatttgggccactagctggagttcgtgtggtgttttcaggtattgagattgccgggccatttgcaggacagatgtttgcagagtggggggcagaggtcatttggattgaaaacgttgcatgggcggataccattcgtgttcaacctcattatccacagctttcccgtcgcaatctacatgcgttatcgttaaatattttcaaagacgaaggccgtgatgctttcctaaaattaatggaaaccacggatatttttatcgaagccagcaaaggtcctgcctttgcccgtcgcggtattaccgatgaggttttatgggagcataaccctaaattggttatcgcgcacttatccggctttggtcaatatggcgatccgcaatataccaaccttccagcctacaacactattgctcaagcatttagtggctatctcattcaaaacggcgataaagaccaacctatgcccgcttttccttataccgctgactatttctctggtatgacggcaaccacctcagcattagcggcactgtacaaagtgcaacaaacaggcaaaggggaaagtattgatattgcaatgtatgaagtgatgttgcgaatggggcaatacttcatgatggactattttaatggcggagaaatctgtccacgaatgaccaaaggcaaagatccatactatgccggctgtggcttataccgttgccaagatggttatatcgtgatggaagtggtcggcatcactcaaattgaagaaatttttaaagatattggtcttgctcatctattaggtactcctgaagtccccaaagggacacaactgatccaccgtattaattgccctcatggtcaactctttgaagataaattagatgaatggctagccaaccagccgattaccgccgtactaaaacgcctatctgaactcaatattgccagtgcaaaagtgttaaccattcctgaattagaaggcaatccacaatacgtggctcgagagtcaattactcaatggaaaacgatgagtggtgaaacctgtaagggaccaaatatcatgccgaaattcaaaaataatccaggaaaaatctggcgtggtatgcctgctcacggcatggataccaatgcgattttgaaaaatatcggttatagcgacgaacaaattagggagctagtcgataaagggctagctaaaatcgtagagtaa

SEQ ID NO: 2411 - DNA, 597 bp, Proteus mirabilis
agggagttaattatggtttcattacgcaaggatcagacagtctctctcagtaaacaagcccctgcactgagtcacttaatgtttggtttaggctgggatcctattaagaaaaagggatttctcggtggactctttggtggtaataattcgatagatttagatgcaagttgtgtattactcgatgtaaatggtaaacaaatcgatactatttggtttcgtaaactaaaatcaacttgtcagtccgttattcactcaggagataacttaacaggagagggtgatggtgatgatgaaactatttttgttgatttaaatcgtcttccttcattggttgaatatttggttttcactgtcaatagtttccgtgggcagacttttaatgaagttgaaaatgcgttttgtcgagttgtcgataaaacaaccaataaagagcttgctcattacaaattaacggaacaaggcgctcatactgggatcgtgattgccgctttacaacgtaatcaaggacaatgggatttcacggcttttggctcaccttgtaaagggcttgtcattgacgagatgatgccagatattttggcgacggtggtgcgataa

SEQ ID NO: 2412 - DNA, 1728 bp, Proteus mirabilis
tggaacctaataatgcgtactagccactatttgctctctactttgaaagagacgcctgctgatgccgaaattgtcagccatcaactcatgcttcgcgcaggtatgatccgtaaactcgcatctggtctttatgattggatgccgaccggtgttcgtgtcctgagaaaaattgagaaaattgttcgtgaagagatggacaacgcaggctcacttgaaatttcaatgccggttgttcagcctgctgatctatggcaagaaagtggccgttgggaacaatatggcccagaattgttgcgttttacagatcgcggtgagcgtccttttgttttaggtccaacccatgaagaagtggtgaccgatattgttcgtaatgaaatcacctcttacaaacaactaccactcaacctttaccaaattcaaactaaattccgtgatgaagtacgcccgcgctttggtgttatgcgttcacgtgagtttatcatgaaagatgcctattcattccatatctctcaagagtctctacaagagacttacgacagaatgtatcaagcctatagcaatatctttactcgtattggtttagacttccgtccagtattggctgatacaggctctattggtggtagtgcctctcatgaattccaagtattagcagatagcggagaagatgatatcgtattctcaacagcatctgactatgctgctaatattgaattagcagaagcggttatgccagcaacacctcgctcacctgcaacagaagagttacgtttagtagatacaccaaacgcaaaaactattgctgaattagttgaacaatttaatctgcctattgaaaaaacagttaaaacacttattgttcatgcaactgaagaaagtggtcataaattagtggctttattagtccgtggtgatcatgagctcaatgaaataaaagcagaaaaatgtagcattgtcgcttcacctttagttttcgcgactgaagaagagatccgccaagctgttaatgcaggtccaggctctcttggtccaattaacttgccattaccaatcattatcgatcgcgctgtatctgttatgagcgattttggtgctggtgcaaatattgatggtaaacactactttggtattaactgggagcgtgatttacctcttgctgaaatggcggatatccgtaatgttgtcgaaggtgatccaagcccagatggtaaaggtactttacttatcaaacgtggtattgaagtcggtcatatcttccaactaggtaagaaatattctgaagcattaaaagcgacggtacaaaacgaagaaggccataaccaagttgtgactatgggttgttatggtattggtattactcgtatcgttgcagcggcaatcgaacaaaaccatgatgcccgtggtattatctggcctgatgctatcgcacctttccaagttgccattttaccaatgaacatgcatcgttcttatcgtgtaaaagaagtagcagagaaactctatgctgacttacgtgcacagggtattgatgtattatttgatgatcgcaaagagcgcccaggtgtgatgtttgcagatatggaactgattggtgtaccacacaccatcgtgattggtgatcgtaatctggataacgaacaagttgagtataaagcacgccgtagtgatgataaatcgctggtcaatgtgaatgatgttgttgcctttattaaagagcaactggtttaa

SEQ ID NO: 2413 - DNA, 1029 bp, Proteus mirabilis
ggagtaataatcataatgtcctcattgtcccctgccagcgaagttattcttcgtcatctagatcatttcgcagacaggcacgtgctcatagcaggtgatcttcaagacacgctagcatcacaaattcaggccaaaagtgttagagcctatacaaatcaatatcaccagtggctaccgctactcaaatccatgggtgataatgcattttttggtttagcggcagatcaatcattcgtaaaatattgcgacactttgatttatttttggcctaagaataagaatgaagcaacttttcagttacgtagcttatgtgcaagtttatctgtcgatactgaaatcttcatcgtcggcgaaaaccgtagtggtgtaaaaagtgctacggaattaatgaatggtatagcaaagctaaaaaaaatagattcagcacgtcgttgtagcctcttttttggttcactaacctatcaaacactctttgatcgaaataactggtggcaaacttatcgttatgacgatttaacggtgatggcattacccggtgtttttagtcaaaccgcattagatgaaggcagccgattattactctctacatttgatgatgcaatggtaggtgacttactggatatggcctgtggttgtggggtgattgccacggtattaggcaagaaaaacccgatgttaaaactcacactctgtgacgtcaatgcagccgctatttcatccagtattgccacgttaaatgttaatgaattagaaggacgggttattgcaagcaatgtctattctgcggtagaagaaacttatgattggatagtctctaatcctcctttccatgatggcttaggtaccagctatcaagctgcagaagacattattcgtctcgcgcctaactttttgaaaaaaggcggtaaactgcgtattgttgccaatgctttcttaccttatcaagatattcttgatcacgtgtttggctctcatgaagtgcttgcatcaacaggtaaattcaaagtttaccaagcaaccaagaaatag

SEQ ID NO: 2414 - DNA, 1011 bp, Proteus mirabilis
acgagaataatgcaaactaagctaaaaaaacccctcgttatcacccccggcgaacccgccggggttggtcctgacctgattatttcattagcacagtcacagtgggcacttccttgggtagtatgcgctgatcctcaattattacgagcaagagcacagcaactcaatctcccactcactttagttgaatattccccagataatccacctacagcacatatccctggccaaatttgtgtacttgccgttgaattaaccgacccttcggttgtcgcaggtacactcaatactgccaatggccactatgtggtacaaacgcttgctcgcgcttgtgatggatgtttaaacggagagttttctgctttagtcacagggccggtacataaaggggttattaatgatgccggtgtgccatttacagggcatacagagttctttgccgatcgtagccattgtcaacgagtggtgatgatgctggcaacggacactttaagagtcgctctcgccaccacacacctgcccttaagagaaattgctgatgcgattacgggtgagttgcttaatgagatcatcaccattttaaaccatgatctaaaaaccaaatttggcatctcatcaccacatatttacgtatgcggtctaaatcctcatgctggagaaggcggtcatatggggcgtgaggagatcgatattattgaacccgcattagagcaattacgccaacaaggtattcaacttcatgggccttaccctgcggataccttattccagcctaaatatttaacacatgcagatgctgtgcttgcgatgtatcacgatcaaggattacctgtgctaaaatatgaaggtttcggtcgtgctgtgaatatcacgctcggtctaccttttattcgtacatctgttgatcatgggaccgcccttgaacttgcaggtactaaaagcgcagatgctggcagttttcgcaccgcattaaatttagccattaatatgatacaaaattgtaatgaataa

SEQ ID NO: 2415 - DNA, 219 bp, Proteus mirabilis
ccgtctgttttagcactttttgatgttaatcgttttttttggaatattttcatgagtcattcagaacataatcaaacacgtcgtcgtcttattaaaggaattggcgcgttattgttattaagtgttagtcctgttggcttagcggcaacatcatcagtggttgccgtcaggggtatggcctgcatcgacttatacacgtgtgactatcgaatcaagtag

SEQ ID NO: 2416 - DNA, 1029 bp, Proteus mirabilis
atgttttcaattcgattagctgatcttgctcagcaattgaatgcacagttacacggcgatggtgatatcactatcgccggtcttgcttcaatgggcttagcaaatggtgaacaaattacctttctttccgatagccgctatcgtgaaaaattaagtgaatgtcaggccgctgcggtggtattaacagaggctgatcttcctttttgtcctgttgctgcactggtggtgaaaaatccttatctggcttatgctcaaatggctcagattatggatactacgcccgcgccagcacaagatatacatccttctgctgttattgccgctgatgctaaattagggaataacgtctcaattggtgcaaatgcggtcattgagtcaggtgttgaattaggtaataacgtagttattggtgctggatgttttattggtaaaaaagcacatatcggcgataatagccgtttgtgggcaaatgtctctgtttatcatgaagttatcattggtaaagattgtttagtacaatctggtactgtcattggttctgatggttttggttatgccaatgagcgtggcaattggattaaaattcctcagttaggctcagtgatcattggtgaccgtgtcgaaattggtgcatgtactaccatcgatagaggcgcattagataacacagttatcggtaatggtgttatcattgataaccagtgccaaatcgcacataacgtcattattggtgacaatactgctgtggcaggtggtgtcatcatggcggggagcctgaaaattgggcgttactgtatgattggtggagcaagtgttatcaatggtcacatggaaatttgtgataaagttacggtaacaggaatggggatggttatgcgtcctatcactgaacctggggtttattcttctggcattccgttacaaccgaataaagcatggcgtaaaaccgcagcactggtgctgcgaattgatgaaatgcaaaaaaggctaaagtcgctagaacgtcaagtagaaaatagcgacaagtaa

SEQ ID NO: 2417 - DNA, 552 bp, Proteus mirabilis
tcttcaacaatgaaaaaaaatattcgtctattaacacataatgaaatccctcgcgtttgggaaattgatagaacagaattgattgaaaggctatatgttttacaacaagggcaactggtgttatctgaacagcgttttgatatgaaaggctggcctgaaggtgaggcagaacattatacccctgttttacttgaaagcgctgagcgcggtgcccctttttggggagtctttgaagatgacaagttagtcgctgctgccagtgttgatccacagtggcgaggccaagataacaccttgttacagctctctttcttacatattagccaccagcagcgtgggcaaggattagcccgtatattgtttgattattgtgtggaatatgcgaagcaaaaaggggctagcggattatatatatcctcaacgccttctgaaaatagtgttaatttttatcagcatatgggctgtcgtttaattgatgtgcctgatactgagctttatgaaagagagcctgaagatattcatttagtgcttaattttaataaagaagattaa

SEQ ID NO: 2418 - DNA, 957 bp, Proteus mirabilis
aaaggtgcaataatgattgaacgattatccccttggaatttaggggcaacgctgtatatgcccgcaacacgaaccgatatcgccgcaacaattattgatcaaaaaattgatggattacgttcattaattatttgtttagaagatgccgtcagtgatactgatattccacaagcattacaaaacctagcaacattattaaccacattatcagactataaaaagcatcatgattgtactgaatggccgttgctatttatacgcccccgccatacagaaatggcgcaatggctggttgagcatgtagatttaaccgtgattgacggcttagtattacctaaatttacccaagcttcattacccctttggtggcgtatcatcaaacccacccatttatgtatgatgccaacattggaaacagaagaagtgttcgacgttcttcaaatgacctcactggcagacttgctactagctcacccttgccataagagaattattgccttacgtatcggtggaaatgatttaatgaatgttatttctcttagacgtaatcgccatttaacactctatgatggacctatgggatacgtgataaaaatgttggttgctgtatttggtgctcgtcagtttgcgcttaccgctcctgtttgtgagcatattgatgatcaacaaattatggatagagaattagccctcgatattgccaatggtttagtgggtaaaaccgctattcatcccaagcagatagacaaaatagaacaggcattaatggtatctcagtctgatcattccgatgcgttgcgcatcttaaattcaacacaagccgtatttaaatctcatggtgccatgtgtgaaccggcaacacatcgccgttgggcattgagtattttaactagagcaaaactgtatggcattattcccaattcaaaaaatagtgttcaacgatttaatacaccataa

SEQ ID NO: 2419 - DNA, 237 bp, Proteus mirabilis
atgggtgcaataatttgcaccctttattttttcattaatatacttatcgtaaaattaggttatttcgtaaaaatagcaatttattttgttatatgctcacgattaagaatgagcataacctatataactgatttattagaaaaaactgtgctctatttaaaattttgtcatattgaacgctattgcttgatgaaagtttatgtaaaatcaataaaatgttggatattattcgagtaa

SEQ ID NO: 2420 - DNA, 609 bp, Proteus mirabilis
attatcgcaattagatcaagaaatggatatggggtattaatgacaaactatactgttttgcttgatgcctgtgtcatgtatccagcccctcttagaagttatttaatgtatcttgctaatactggtttatttagagcacgttggagtaatcagatccatgatgaatggatcactaatttattagtcaacaatccaacattaacagctgagcgactaatacgaaccagagatttaatgaatgcacatgttcctgattgtttagtagaaggctacgaaccgcttatttgtggtttaaagctacctgatcctaatgatcgtcatgtgctagcagcagcaataaaagggcaggctcaagctataattacatttaacttaaaagattttccgcaaaaataccttaattcttttgatatttcagctatccatcctgatgaatttttgagtgacatgtttgaattaaatcctagtagctgtattaaagcggcgcaacaacatagacaaagcctaaagaatccaccaatgaccgtagagacctttttaggctgtttacaaaagcagaaattaccccagtttatttcccatttacgggcattccagatattattataa

SEQ ID NO: 2421 - DNA, 1251 bp, Proteus mirabilis
tcacaggcaattaaggatcaagatcccgtgaaaatctaccttgttggtggtgctgtgcgcgaccaactattaaatttaccggtaaaagacagagattgggtagtggttggcgcaacgccagagacactattacaacaaggctaccaacaagtgggtaaagattttccagtttttcttcaccctgatactcacgaggagtacgctttagcgcgtaccgaacgaaaatcaggctcaggttacacgggatttacctgctatgcagcccctgatgtgaccttagaagatgatttgcaacggcgtgatttaaccattaacgccattgcttactctgctaaaggtgaatatatcgatccctatcatggtattgatgatattcatgccaaattactgcgccatgtttctgatgcatttagtgaagatccattaagggtactacgtgtcgctcgttttgcggctcgttttgcccctttaggttttacaatagcgccggagacgatgtcattgatgcaagagatgacaaacagcggtgaattaaatgccctcacggctgaacgagtgtggaaagaaacggaaaaagcacttcacagccaagccccacaagtctattttgagatcttacatcaatgtggcgctctaaaaatacttttccctgaaattaatgcgctctttggcgttcctgcccctaaaaagtggcatcctgagattgatacgggtatccataccatgatggtattagctatggtcagccggttgactgacgatatcgcggtacgttttagcgcgctttgtcatgatcttggtaaaggtgttaccccggtagaaaattggcctcaccatcacggacatggccctgcgggtgttcctttagttgaggctctgtgccaacgttatcgtattcctaaccagatacgtgatctcgccaaactggcagccaaatatcacgatcatctccaccgcatagaaaaaatgcgcccctcaaaaataattcgacttttcgatgcgattgatgcttggcgcaaaccagaacgcatcgatcaactcgctataattagcgaggccgatgcaaggggacgccaaggagcagaaaatttgccttatccccaaggaatattttttcgtcaagcctttaagattgccaatcaagttgatgttaaatcaattgtcagtcgtggtttaaaaggcagtgccatacgagaagcattaactaaacaaagagaagtcgcgataatagaatggaaatcgcgactttaa

SEQ ID NO: 2422 - DNA, 3288 bp, Proteus mirabilis
tgttatccctttcaacataacagaaggtacagaatgaacaaagaaatagctttaagtcaccatcccattaatcagaaaaaaaataccacaaactctctatttcaactctcccttattacttcggcacttcttttttctggctatgctgttgcatattcagaagttggacaattaggtaataaacaaagttgggaaagccctgaatatcaaaaagactgggggcttgcagccatgaatgcctctagtgcttatgctctgggttttcatggtcaaggtgctaaagtcggggtgatggactctggtgcactgctctcacatcaagagttgagtggatctcgttttcatgcagtaaaagccaaaggtgaatatggctctacgggaatgcgctatccacaagaaatgggcggacattatgaaaaaggccaagtctttgatgttgatggtaattggatcaaaggggtgaatgatacccatggcacacatgtcactggtactgtgggggctaaccgtgatggtaatggtatgcatggtgtggcgtggggggctgatatttatttagggaatactggggcaacagacagcaataactatggcccttatcaagactacacctatttctatactggctggaaagcgatggtcgatgcgggtgcgcaagtgattaataatagctgggggactaacccgcgtattattaatacagataaaacagaggggcctgatggtggtgataccacgatacatatgcctgttaacaccacggcacagacagaatacgaatatttctactttaaaaaagtctatggtgataaaccttcctttgttgatgctgcttatgatgcagttaaaggaacgaatgttgttcaggtctttacaacgggtaatcgcgactttgctcaaccttattatcgtcctctttatccttattttaatcccgaagccgaacagcattggattgcggtggcgggattgaagcaaaatgcggataacaccggttatgtattagaaaaagtcttcaatgaagcgggtaatgcaaaatggtggacagtggttgcaccgggtcgaaatatctattctacagtggttgatgaagagggaaatccaaactggaaagtctttagtggtacttcaatggccgctcctcatgtgacgggggcgatgggagtattaatgtctcgttatccttccatgaacgccattcaagttcgtgatgtcatgttcactaccgctaaccatcgtgatcctgatggctctttatatgagagctggacggccgcagaaggtactcctgatgtacgttatgggtggggaacaccagatttagataaagggatgtatggtccgggtcaattgctaggtaaatttgaatataacctaaatgcgacaccgcttgatgtgtggactaatgatatttcccaaacagctttagatctacgtaagcaagaagatctcgcatggttgaaagaatataccgaaaaaggtattgcggcaggaggtgattatcatctcggtactgattttgtgattaatgatggcaatcctgatcctacatcacatattgttagccaagaagatgctgaaaaatggcgtcaagaatattaccaaaaacgcgctgatgctattcaagctaaaattgatgctggcttatatgatggtgctttggtgaagcgaggcgaaggtacgttagtcatgacgggaaataatagttaccgtggtggtacaactgtcgaacaaggtactttatatggctttagcggatcttttgggacgcaagccgtcaatgttaatggtgggaaattaggtattattgagcgttataacgatacttttactcaaaaaggccaattaacctcaaaccaaaaccataaagtaaacattaatattaatgataaaggtcgttatttagtgactgcaggacacaatgttaatattggtaacttagtgcttaatcaaggagccgatattgatgtgggggcagataatgttgggcaactaaaagatatttatcttaataatagtgttgttgtcggtgaggtgaatacagatagtttagtcgataatcgcactaaaacgaaaatgttagccagtaaccgtgtggttgcagatcctgccacaaccactactgtcatcaataatgattatgctttatttgataaacatatcacgataacagataaaaccatcagtggtagtttaactaagaaagaaaatacgactttagccacctttgctgataatgaaaatggtcgtgctattgctaatgcattagataatacaggggatggtgagctatttaatgctgtattaccgatgaatgaaaatgatctgaaaaccacttatcaatcattgggtagtgatatgtatttaaatgccaataatgccagtattgttaatgtattgggtttaactcgtacagtgaaagatcaggctattggtatcggtgatggtcgtcatgcacaactaggtaatagtaatgcgcgtatttggatcagcggcatgggtcagtggggtaagacggattatggccacagtgatatggatattgatttctatgttgggttattaggtgctgaaattgatgttactgaaaatactaaagcgggtctatttttcggtgcaggctccaccaaatataaaggtaatcaatatggaaagatagatagtaatgatattcatattggtgcttatgggatctctaatctttatgatgttgcctcattaaattatggatttacacatacaaaccaagatagagatgccaaaagaacactctggataggacaaactgcaggttataactcaaccagttacgatgcgaaaattagtcaattctttttagaaggtgcttatactcaattgaatactagccagtactcaattgaaccttatgctggatttagttggttaagagtatccactgataatatcaatgaaaatgtgggtaatatgaagtttaccactaaaacagatgcacaagatattcaagttgctacggttggtttacgtggtggatatccatttatggcaggcaatattaatatggcattaaaaggtgatatatcagcaagtcatctgtttggtgataatcgccctgaatcacgtctatggttatccaattcaggtgaggcatcactacgaggtggtaaactagataatttatttggtgttggtctaggtgttgatgcgcagttaagtaaatcaaccactttcggtatctcttatcaaggtcaatataatagtgatatcaattcgagtggtattaatgcaatattgaaaattaatttctaa

SEQ ID NO: 2423 - DNA, 222 bp, Proteus mirabilis
cgtgttcaaataagatgtgctgaaacttcatggaatggcgaaagctcaatgacgggtcgccgaagtgagcatagcgcggtgagagggagctcagctgtcgttgtagcacttgttacaaccacatcttcaaggaaccaagtccgctcgccaacaaaattaatcgctaaccttaaagcgtatgcccatagagggcttgagaaacatcgttggagagttttatga

SEQ ID NO: 2424 - DNA, 807 bp, Proteus mirabilis
agaactcaaatggctattgtaatcaagactgaagaagatattcaaaaaatgcgcgtcgcgggtcgtcttgcggctgaagtccttgaagttgtcgcaccctatgtaaaacccggcgtaagtacagcggaattagatcgtatttgtcatcaacatattgttgatgttcagcaagctatccctgcttgcttaaactatcatggcttccctaaatcagtgtgtatttctgttaatgatgttatttgccatggtattcctagtgaagacaaaattttaaaagacggcgatattgttaatattgatgttactgtcattaaagagggttttcatggcgatacgtcaaaaatgtttatcgtcggtaaaccgactattcaaggtgagcgtctgtgtcggatcacccaagaaagtctctaccttgcaataaaaatggtaaaaccaggtattcgcttacgtgaattaggtaaggccattcaaaaattcgttgaagggcatgatttttctgtggtacgcgaatattgtggacatggtattggcgaaggtttccacgaagagcctcaagtattacactatgatgctgatgacggtggtgttgtgttacaaaaaggcatggcatttactatcgagccgatggtcaatactggagattaccgtattcgtaccatgaaagacggttggacagtaaaaaccaaagatcgcggttggtcagctcaatatgagcatactttagtggttaccgacaatggttgtgaaatcatgacactgcgtaaagaagaagagccatttatttctgccgtattagtcaacgaataa

SEQ ID NO: 2425 - DNA, 735 bp, Proteus mirabilis
aggtctaaaatggcaactgtttcaatgcgcgatatgctgcaagccggtgttcacttcggtcaccaaactcgttactggaatccaaaaatgaaaccattcatctttggtgcgcgtaacaaagttcatatcattaacttggaaaaaactgttccaatgttcaatgaagctctggttgaactgaacaaaattgcttctcgtaaaggcaaaatcctgtttgttggtacaaagcgctctgccgttgaagctgttaaagaagcagcagaaagctgtgaccagttttatgtaaaccaccgctggttaggcggtatgctgactaactggaaaactgttcgtcagtcaatcaaacgtctgaaagatttagaatctcaatctcaggacggtacttttgacaaactgaccaagaaagaagcgttaatgcgttctcgtgaacttggtaagttagaaaacagcctgggtggtatcaaagacatgggcggtttacctgacgctctgtttgttatcgatgctgagcacgaacacattgctatcaaagaagcaaacaacctgggtatcccagtatttgctatcgttgatactaactctgatccagatggtatcgactacattatccctggtaatgatgatgcaatccgtgcggttaaattatatctgaccgctgcagcaacagctgttcgtgaaggtcgttctcaagatctggctgttcaggctgaagaaggcttagtcgaagctgaataa

SEQ ID NO: 2426 - DNA, 1257 bp, Proteus mirabilis
cagacaaaaatatggtcacgccaaatgaaacaattaacgcacatccttaaacctcgaaccttagtcagtcgttctattatactggctttggtttcgctgttagtcgcttgtaaccaagagaaagataaatctcttacgctatcaacacctagcgtgttacctgcagatggttcaagacaactctacaactaccatgatcccaactttgccgcttttgcgcaaaagttaaagcaacgacgccaaagggtacatatcgtacagttgggtgattcacataccgctgcggattttttcagtggtaaactacgtgaacgttttcaagctgattatggcaatggtggtataggttttattccccctaccgctattgcgggtcaacgtattgccaatatccaatatcaaagcagtaaaaaagcgtgggatttactttctagtcgcaaagaaagcgatcctgattttcccttaggaggatttatcgctgagccagtcgcgaaatggtcagcattgcaactaaatgaaaatcccacaacaggtcagcgttaccaattacaagcgttatataaggcgcctacggcttcacaaatccatttacaatccgctggcagtaaaacgctttcactttcacagacacaaggtgaatggcaattttctaaacccacaacgatcaccttcccaatcaatattacgattagtaaaaaccaaccgattaaattaggcggttggttaatcagcaaccaaaagccaggggtgatgttatccgcattaggtattaacggcgcaaccattaatatgatggataaatggggagcacagtggagtaaaacattaggccaattacatcccgatatggtgattttagcttatggcactaatgaagcctttaatgatacttttgatttagtggcttaccgacaactgcttgttgaaaaaattcgtcaaatccgccagcaagccccgaatagtgccattttattagttggtccgtcggattctattaagaataaagatgcatcagattgtcgctctcaacaaccccaatggttaaccgatattattcgtatccaaaaggaagtcgctcaacaagagcgtacattattctgggattggcgcgattatatgggaggagagtgctcaattaaagcatggtctatttatgatcttgcaaggccggatggtgtccacctttctcgtgaaggatatgaaagtagtgcaaatactctctatagccaattatcagcgctgattaataaaagttag

SEQ ID NO: 2427 - DNA, 375 bp, Proteus mirabilis
gcagaaaaaataagagatgacgtgatggatatcgtatttattgaacaattatcagtaataaccacaatcggtgtttatgattgggaaaaaaccattaagcaaaagttagtgttcgatatcgaaatggagtgggataataaacgcgcatcccaaaccgatgatgttgctcactgtttagattatgccagtgtcagtcacgccataatagagtatgtggaaaagcgacgttttgaattagtcgagcgtgttgctgaagaagtggcacagctactgataactcagttttctgtaccacgagtcaaaataaaattagctaaaccaggggcgatagcacaagccgccaacgtcggggtgattattgagcgttacgcttaa

SEQ ID NO: 2428 - DNA, 198 bp, Proteus mirabilis
ctaactgaaattaacgccgttaaggttcctaatttattctcacatctcaatacaaaatatagctgtttttctgttattttttttgtaccaaagatagaagataatattaccatgtcattaattttatttgtttctttatggttattatctacctctacgttaatactcattcattttcatcctctctttcataaatag

SEQ ID NO: 2429 - DNA, 465 bp, Proteus mirabilis
ataaatgaaataggggacattatggctaaaatcggcatttttgttggtactgtttatggcaatgcattggcggttgctgaagaagcgcagcgcattttgcttgagcataaacatcaagctaatatctatgaagaaggtacacttgccgattggcaaaaatattcaacagtactggtgataagctctacaaccggccaaggcgatttacccgatacaatagcacctttattttatgagctacgagataatgttggttatcaacctaatttacattatggcctaattgcgttaggtgatagcagttacgataatttttgtggtgcaggtatgcaatttgaagcgttattacaagagcatcaagcaaagcgtattggtgaaatattaaaaatagacagtatggatattgccgagccagaagtatttgctataaattggctggaaaactgggctacattattgaattaa

SEQ ID NO: 2430 - DNA, 396 bp, Proteus mirabilis
atacacgaaataaggagaataaaaatgagttttttcaataaattaaaagaaggttttaattccgggcgagcggagttaactaagcaagtcagtcgttttaaaaacaaaaaatttatgcaaggtacggtcgcagtttgtgctcgtatcgctattgccagcgatggtgtgagttctgaagaaaagcagaagatgctaggttttttaaaagcatcagaagagcttaaagtctttgatacctccgacccgatcgaattctttaataagctaattagaagttttgaatttgatactgaagtcggtaaaggtgaaacgatgaagtttattcttggcaatgaaagatcagccagaagctgcacaattagcgatccgtgtcggtattgctgttgcgaaaagtga

SEQ ID NO: 2431 - DNA, 720 bp, Proteus mirabilis
aaacgagaaattagaaagtacccagaacttagggagttgatgatggggaaaaaacttttatttgcagccattgctgcagggttatttattatgtcaggctgccaaaataatattggcctgtcactcgatggtaaaattgttgatcaaacatataacagtattctaccttgtgccgattgttctggtatcgacacgactattcttgtcaatcaagatggctcttatgtaatggagcaaagttaccaaggcacttctgatgacaatcgaagtttttttgagtcaggtacttggttattaagtaaagataaactgaccttgactaatagttatggcgagaagagttactatttacctcgtgaagataaattagttatgttggatatcgatggtaatgtaattaattcgggtcttaattataccttagcaaaggttcaacctaagcagttagcgggtgaatttacctattttgctgacgctggaacctttaaagattgccaatctggacgtgtctatgctgctgatggattagtattagaaaaaggctattttgctacaggcgttgatggcggaacgcctgtctatctagaggtcagaggttactatagtattcgtccttcaatggaagatggacagtatgatcgtgcattagtggttaccgataataaaccacgctttgatcgtcatggctcttgcaatagccgtcgtaatagcagaagttaa

SEQ ID NO: 2432 - DNA, 4956 bp, Proteus mirabilis
gccaaggaaatccgttataccatgtctgatattcatgatacgaatcgcgaacaggaaatacttgatagcgctgttgcacaaggtggcgcatatgaaatattgcgtaaacgccttaccgagcaaggtcagcagttacatgtaaaagccactgaactcaatcagcatcgattagctgaatttggtcaaagccaaatggatatcattggccgtattcgtattcgaacagagaataattgccaagcaagagatattgttcgcgttggtgaatggttactatttggttataacgttttcctcggtttaaaacgagaaacgcaccttgaagatgttttttcactttatcgcttaattgataataatggcgagtttgatgttgaagcggttgcttatgaaggcacttttttaaatgataatcgctttatccaagattttaccgagctatacacttactataaaaatacgcaactactacagctagttgagcgtgatggtaaattactcgctagttttcaaattggcgatcgtattaccgatgtacgcgtcttccgttggtcgatatccagtgacaaacaacgtattgaatatattgataatcgtggcgaacgcgatatagcactcccccctgcttacgattttgattggataaaaacacaacgtgaagatacggtaaatgggcgttttcctcatatcaacattttagatacagtctttgtagaaaccaccggtggcgatttgactgtcaaatgtgaaaacaataccgaagatggtttaggaatttatcgtgaagcggtcttagataaaaaccagtcccttgatgatgcacaaattgaatatgcacaaactggcagtttaattttattaaaagtgcttccttaccgcgaagagaattggcgttatttagtctataacacactaacacaaagtgttcagcgtattgatgccattgggcaagcttgtgtgcaacttccggaagatcacggtatcatttttcccggcggctactatctacaaaatggcgattacaaaacctttgatcaaccaatggaaggtatgtattttcgtcgtttgcgtcgttcacctaacggtgaagatgtgctgtatgtcttctattcaccgacacaaggtcgtctcgcgctatttaattacaatatgattgagcgtaaattggcgacaccattggtcggtcatggctatgccatgctagaagatggcaaaatggtgctatttgaaggggaaggcgaagaagctacccgtgttcacccgatgcaagtttggcaaacgcccttctattctgaagaatttgccgataaacaaccgccacgaaacggcttttatgggcgtattggtaatgccgatttagttcgcgggatctcagaaattttacatgtcgccaaagaaattgaaggtagccaagtttccatcgctcgttatgagcaacttagccaacaaccaaaaagcttattagatctctattactggtttaatgatgaacactgtctaggtattggccccttactaaaagagatcgctcaaacaagtgaattagtgcttgatgaatatgaaaaagtcgaaagtattcgtcaacaatcagcgaaatcaatgcaagaagcgatcaaccgtcagaaatctctgttatcactgacactgcctgatagttggaccgatattcaacaatttgttgatagtttaaattcgctcaatacacaccatggacaccttatttctttgcgtgaattccgttatatggatttaacgcaattaaataaaatggaaacggaaataaccgaggcacagcaacgtgtttcgcaagccacagcccaatttcttgccagcgacaaagcgctacagccttttaaaacacagcttactacttttgaacaacagatagaaaaagcacaaaacagtgctcagcttgatgtaccaatgaatgagatggcgcagatgtcagaagatttagacatgctgtcaaatctgatggcatcactcacctttgaggatgtgacgcaacaaacacagattattgatgccatctcccaaatttatgcacaactcaatcaatcacgagctcgcttacagcaaaaaagaaaatcacaaagtagcgtagaaaccgtcgctcaatttggtgcgcaattccgcctatttagtcaggggatcaccaatgctttatcactggcaacagatccggaacgttgtgaagagcagctttcacgattgctagtacagctagaagaattagaaagccaatttagtcagcatgatgaatttcttgatgatatcttgtcaaaacgagaagagttattagagacttttgaggcgcataaacaatcgttacttgatgatcgtcaacgtcgttcacaaagcttattaactgctgctaatcgtctcttagaaaatctgcaacgtagaacaactcggttgcaatcacaagatgaattaaatgctttttttgcctctgatcctttagcattaaaaacacgtgaaatcattgaaaaactaagagaaatcaatgacaacgttaaagcagatgatattgatgcccgtcttaaatcgtctcgtgatcaagccatccgtatcttacgtgataaaacggatatctttgaagagggtggcaatgttattaaattgggccctcgtcaccgttttagtgttaatacacaagagctagatcttactattttaccgaaagaagataagctttggttatatctaaccggtaccgatttccaagagccaatcgaccatccagagcttgaaacactgcgcccttactggaatgcgacattaagttcagaatctgaaacggtgtatcgtgcggaatatctcgcctattcaattatctatgctgcatcaaaacgtcaagatggattaaccctagaaatcttaaaagaagcactgagtgtacctgaaaaattagaaaagttagtacgtgatttcgcaacacctcgctataaagaaggctatgaaaaagggatccacgatcatgatgctatcgccattctaaagaaacttctacctgtaggtgaaagtgctgatctgcttcgttataatccaacagcacgggcaattgctgctattttctgggaaaaagtacaaactaatgaatacccagcattatggccagagcgcgcacgaacggcagtgaatattcaacaactgtttcataatgatgatgcattaattgatttacaggcagaaatagaagcggatatccgcctattccttactgataatccgattaaatgtggatcttatgttccgatccaagccgctgaatatttaagttttgcactagcaagaacaccaatagaattggtttacagtaaatatgccaaagagctcgttgttgccttacaaaaccgattagaagccgctcatatgtggattgattttaatcgttcacaacaaaatttagcctcacgttatgcacaacgttgggcattgattcaaaattggctacaaggattgtgctctcaagccgattatgctcatctaaccccttatattccgggggcaattgccattattatgttagataaaatcgcctctgcacgttatagcgaggttgatttatactttaaggtaaacggattattaggtgagcatcctactattgaaaatcaaacactttcattgagtttagatgattatttcagtcgtatgcgcggacagcgtaaaacctttattcccgcctttaatcattatctgactttacgacaaaaaattgttcttgaagagcgccagcgtttaaaactggatgagtttaaagcaaaacctctcagttcatttgtgcgtaataaactgattaacgatgtctatttaccaattattggtgacaatatggcaaaacagatcggtgcattaggtgaagggaaacgcactgacttgatgggattattattaatgatctccccaccaggttacggtaaaacgaccttaatggaatatgtagccgatcgtttgggactgatctttatgaaaataaatggtcctgctttaggtcataatgttttgtcattagatcccgaacaagcgccaaacgcaacagcaaaacaagagctagaaaaactcaatcttgcccttgagatgggcaataatgtgatgttgtatgtcgatgatattcagcatacacaccctgaattcctacaaaaatttatctcgctatgtgatggcacacgccgtattgaaggggtttggaaagggaaaacccgaacctatgatatgcgcggtaaaaaattctgtgtggtgatggcgggtaacccttataccgagtctggtgaactatttaagatccccgatatgttagctaaccgtgctgatatctataatcttggtgaggtattagggggaatggatgacgcctttgcactcagttatattgaaaatagcttaacctctaactccgttcttgctccccttgctttacgtgatctaaacgatctctatcttttggttgataaagccatgggtaaatcagtttcaaccaattccctcagttatccttattcggatgcggaaattaatgaaattgtgatggtattaaaacatctaattactttgcgtgatgtaattttaaaagtaaatcaacaatatatagcaagtgcggcacaatccgataaatatcgtactgagcctgcattccgcttacaaggcagttatcgcaatatgaacaaattaagcgaaaaagtctctgcggttatgaatgagaaagaaattgaacgcttactcgacgatcactatcttggcgaagcccaattactcacaacgggtgctgaagagaacttattaaaactggcggaaatacgtggcacattaaccgaacaagatgctattcgttggcagcaaatcaaaaaagattttatgcgcaacaaagcattaggtggtgataatgccgatattggcgatcgcgtagtgtcacagttggcgaatttagtagaaagtgtgcagagtttacgctaa

SEQ ID NO: 2433 - DNA, 1440 bp, Proteus mirabilis
atcacacccttagagccatttatgaattttttttcattcgagtttctcggagcctttacgagcttttttattatctattggctcttccaaaaacaggttaagatccaaaatatcttactcatcatagtaagttatgcttttctattctatgtcgactaccgtcctgctgttatcttattaagctatacgcttttgatttactcattagccaatatactcacccgctatacatcaacgaaagtgatttattggttacttgggctgttagttgccctctattttactgcctttaaatattactcatttttccaagaatcattgacacaactattctcacagtggggattaagtgttgaattaccaattattgaactactggcaccattagggttatcgttttatatcttccactctgttagctatgtcgtttcagtgtgtcgcaaagagatccctaaagccccttttcttgatgtcgtgctctacttatgcttttttccaagcattgtggcgggaccgattaatcgtgccaaacaatttttaccacaaattcaagcaccaacccgtaaaattatcgactataaaggggctatcatgctgattgtattagcaatcgctaagctcttttggttaagtggttggttgtcgacaaattatgtcgatcctatttttaatgcccctgatttagccactagcggacaagtactggtggcgacctatgcttatgcatggcatatctattttaacttctcgggttataccaatttagtgacaggtattgcgttattactgggttttgttgtccctcgtaactttaatgcaccttatttagccatcaatcttgctgatttttggcgtcgttggcatataagtttatcaacgtttattcgcgattatgtttatatccctttggggggaaatcgtaagggcgttattcgacaaaatgtgaatgcctttgccgcgatggttatctctggtttatggcatggcgcagctatgacgtttattatctggggagccattcatggtattggtgtggtgatattaaatatcaaacaccgccttttccccgccgccaaacatgacgccaatagcatgctagcatcattaaaaatgttgttatcttggataattaccttccattttgtgtgctttgcgtggatcttttttcgcagccaaaccgtcaatgatgcttggatattaattcaacaactctttagtgcaggtgcttggcagtcgctacaagccgaagggctaaccctgtttatgttctggggactgttcttactgtatccttgttttgtcactttaagggcaattattgcgcgacttgagaaaaaagtgccttggtatgtttatccactaccattagcgttgatccttacaattatatttatgttgtctcctgatggggttccgggatttatttatgccagcttttga

SEQ ID NO: 2434 - DNA, 1674 bp, Proteus mirabilis
actgaacgaattcaaaggaaatatacgatggcagctaaagacgtcaaattcggtatagacgctcgtaataaaatgttacgtggtgttaatgttcttgcagatgcagttaaagtaactttaggccctaaaggtcgtaacgttgttttagataaatctttcggtgcacctgttatcactaaagacggtgtttctgttgcccgtgaaatcgaattagaagataaattcgagaatatgggtgctcagatggtgaaagaagttgcttctaaagctaatgatgcggcaggtgacggtactacaactgcaacagtgttagcacaagcaattatcgccgaaggcttaaaagcagttgccgctggcatgaaccctatggatctgaaacgcggtatcgataaagccgttgtgggcgcagtagaagaactgaaaaaactgtctgttccatgttcagatactaaagctattgctcaagtaggtactatttctgctaactctgatgaaaccgttggtactctgattgctcaagcaatggaaaaagtgggtaaagaaggtgtcatcactgtagaagaaggtactggcttagaagatgagctggatgttgttgaaggtatgcagtttgaccgcggttacctgtctccttacttcatcaacaaaccagaaacaggtacagctgagttagaaaatccattcatcctattagttgataaaaaagtctctaatatccgtgaattacttcctgttttagaaggtgttgctaaagcaaacaaacctctgctgatcattgcagaagatgttgaaggtgaagcactggcaacattagtcgtcaacaacatgcgtggtatcgtgaaagttgctgcggttaaagcaccaggttttggtgatcgccgtaaagcaatgttacaagatatcgctattctaactaatggtactgtgatttctgaagaaatcggtatggagttagaaaaagcaacgctggaagatttaggccaagcgaaacgtgttgttatcaacaaagatacgacaaccatcatcgatggtctgggtgaacaagaggctatcagtggccgtgttgctcaaattcgtcaacaaatcgaagatgcaacttcagattacgatcgtgaaaaactgcaagagcgtgtggctaaattagctggcggtgttgcggtaattaaagtcggtgcggcaactgaagttgaaatgaaagaaaaacgtgctcgtgttgatgatgctctgcatgcaactcgcgcagcagttgaagaaggcgttgttgctggtggtggtactgcacttgttcgcgttgctaatgcgctgcgtgaaatgacaggtgataacgaagaacaaacagttggtatccgtgttgcactacgtgcaatggaagcgccaatgcgtcaaatcgttgctaacgcaggtgaagagccttctgtggtagttaacgatgtgaaagcaggccaaggtaactacggttataacgctgcaacagaagcttatggcgatatgattgaaatgggtatcttagatccaactaaagtgactcgttctgctctgcaattcgcagcttctatcgcaggtctgatgatcaccactgaagctatggtgacagatttacctaaagacgaaaaaatggatttaggtgctgctggtggaatgggcggcatgggtggaatgggcggcatgatgtaa

SEQ ID NO: 2435 - DNA, 963 bp, Proteus mirabilis
ggagagggaatgatgactttccaagaaacaccttcgtttatgatgggaatattcgcggttattcaagcactctttctgctggcgataaccccattatgtacaggtatttctcgccaaattcgtgccaagatgcattcgcgtcaaggtcctggtatttggcaggattaccgagatatttttaaattacttaaacgtcaatccgtagcccctgagcaatccggcgtgatcttccaagtgatgccttatgtgttattaggcagtatgttattagtggcaatggcattgcctgtctttacggcaacctctttgtttggcggtgcagctgacttaattgcattaatttatctgtttgcgctatttcgtttctttttctctttatcgggtttggattcaggtagtccatttgcgggtattggggccagccgtgaactgacattgggtgtattagttgagcctattttagtgctttcgttgattgtggtggcattgattgtgggttcaaccaatgtcggcactatcagtgcgacactcgcccaaggttgggtatcacccacagctacacttttagccttattggcttgtgcttttgcggcatttattgaaatgggcaaaatgccttttgacgtcgcggaagcagagcaagaattacaagaaggaccactaaccgagtactccggctctggttttgccatggttaaactgggtattggtttaaaacaagtggtgattgctgagctgttccttgccgtatttattccttttggcaaagcgactgaatttacttttgtcgcgcttcttgtcgccttagtgttaatggccgtgaaattgctggtcgtgtttgtattagcgtcattagttgaaaacagtttagcgcgtggtcgcttcttactgactcagcatgtgacatggttagggttcggtgttgcggcactggcttttgttttctatttaactggtctataa

SEQ ID NO: 2436 - DNA, 1161 bp, Proteus mirabilis
ggcattttgatgttaacgcgtttggctgtttttaatatcatcttcatattggtcatttcaggatgcactacctcatctgtgtctgaaaacattgctgctcatctggaaagtgaaactcaagaagaagcctcacaagtttggcaaacgccccccgcacttgatgcacctaatggattaaggccttgctgtgcttttggctataatttaaaagtcaaagcatggggaatacctattcctttttatcgtatcgataatattgttgaagcatctactttaggtgatcatcgctataacgataacttttggctgggaactgccgcagtattaggcataggcagtgaaaagtcgggcatagtctattcacataaagggggctttcttgatatcgcccatattcgtgataccgcagattatacttattatctctttagccatatctatcccaaattaggccaagagtggacgctaacactcagtgacgaattagcacagcgtaaaattcactttaaccgctttactcctcctagtagtgatcgacaacgttataccttaagtgcttatcttgccgcgcgtttagcttatcgccttgccgtatggcatgagattgcacagtggtacggttatcgctctgtagcgggattttcagaagggatctccgcattctcaccagaagatctctactctaacctaatgggggcgcgcttatcacttaccctgatcctcaatggtgatgccacaaaccttgagcactataaccaatcaatgcagcgtattattccctcagcactcgctcaactagaggcgcaacctcgtcaggccacccagcagtggtttgatttaattgatggtcaatggtggaatagccaagagcgggtacccgataaatttttagtattaaagcgtgattatcatcttgctgacaaacgctatccggtattgccttttggggagacaactccacctcattatctgacattacccgatgtttacgcaggctattctttaaaacaattagcagaatttcagctttggcctactaaacagatggcaaatttacccatccctaaaacatattggaaagaagcggattttgctgatttagcagaaaaagctcgccaaatcgatcaaaaaactcgaccaaaaacaacaaaaaatgactaa

SEQ ID NO: 2437 - DNA, 330 bp, Proteus mirabilis
aaagagttgatgacaagaaagataccaaagccaaatcaagaaagatatcgatacagaagtggttgcggtttttttaattatcggcttcaccatttagtgtgttatctaaagtataactgtctaaaattacacctctgtgtattatttctgaccgtttttaaaagaaaatggcaaaaattacataaaaaacttgcaagttatcagatcctgagtatagtgcccctctgtggagacgcggggtggagcagcttggtagctcgtcgggctcataacccgaaggtcgttggttcaaatccggcccccgcaaccaattcacaacatatgcagtaa

SEQ ID NO: 2438 - DNA, 1176 bp, Proteus mirabilis
gatatgaccttgtcaggccaatcatctataaaacagcgtccgttagttatcggccttgtggctggtgaaacgtccggtgatatcttgggcgcgggattaatccgcgctcttaaacaaatgcatcccaatattcgttttgttggtgtcgcaggtcctttgatgcaagcagaaggttgtgaagcttggtatgaaatggaagagcttgcggtgatggggatcgtggaagtacttgaacgtttgccacgattattgaagatcagaaaagatctcactcaacgctttacacaacttaagccagatgtttttgttggtattgatgctcctgattttaatatcacccttgaaggtcgcttaaaacaaaaagggttgaaaactatccattatgtcagtccatcagtatgggcttggcgtcaaaaacgggtttttaaaattggtaaagcaacggatttggttttagctttccttccttttgaaaaagcgttttacgataaatatcaggttccttgtcgctttatcggtcataccatggctgatgcaattgcgttacaccctgataaaaaagcggctcgtgaacacctaggtattgatcaagaggcaatctgtttagctctgctaccaggaagtcggcattctgaagtggaaatgctcagtgcggactttataaaaacagcgcagcgattaaagcaacagatccccgcattacatattgttgtccctttggtaaatgcgaagcgacgggcacaatttgaacaaatacatcaaagtgttgccccaaaacttgaaatccaactcttagatggacaagcaagagaggcgatgaccgccagtgatgcgactttattagcatctggtacagccgccttagaatgcatgttaacgaaatgcccgatggtagtgggttatcgtatgaaaccatttaccttttggttagcaaaaaaattagttaaaacgccctatgtctctttacccaatttattagcgggacgggaaataattaaagagttgctgcaagaagagtgcacaccagaagcactggcagaacaattactccccctattaacggatgcggaaaaagcacaacacttaaaagagatatttttacaattacactcagctatccgttgtcgtgctgatgagcaagcagcgaatgcagttttagaattagcaggtcaataa

SEQ ID NO: 2439 - DNA, 891 bp, Proteus mirabilis
aacccactgatattcaggcgcacttttacgcctaccctgataataacaatccatataggcaagaatatgaacaccattgaaaccacagattttgctgagctttataaaaaccatatgcaacaggcacaaagaaccaaaaaagagcctgaacattgggataaacgcgctgaaaaaatggcagaaaactgtgcgaatcccaacgatccctatttgatcaagtttcgtgaaatgatggatttttccgatgctgaaacactattggatgtcggctgtggacctggctctattagtattcatgttgctgacaagtttaaaaaaataatcgggatagattatagtaccggcatgctaaccgttgccaaacgtagagccgcacaagcgggtattcatcatgctgattttcttcattattcatgggaagataattgggatgcgcttccaccttgtgatattgcggtggcttcacgctccacattggtgatggatttaaaagctgcgctgttaaaactaaatcgccaagctaaattacgggtttataccactcacaccgtatcacccacttttgttgatcaacgtattcttcgcttattaggtcgcaatgttcccacattgccgacctatatttacgcagtcaatatccttaaccaaatggggatccaccctaaagtagattatatccgtagccataattgccaaaataattttaatagccttgagcagtttattgacagtattaacttctctgtagggcctttaaacgaaaatgaaattgcacacttaaccacttattatcatgaaagtatgaaaaatgatgtggcccttatatcgccaacgcgtgattgggcgatggtttcttgggatgtcgttcctgaaagcgagctaaccttatga

SEQ ID NO: 2440 - DNA, 2652 bp, Proteus mirabilis
ttaactatgataacctccaatacctttcaaacagcaccaccgtccccttcgttgctgactgaaaatacgctagatagtactttactaaaacactctattgaacaatttcagtcatggttaacagatgcttttcatcatgatgctgatgttgctttgttactacaagctcgtagtcactttatcgaccaactactcacacaattatggcgttatactgaattagcggatcaccctgatctctgtatcattgcagtgggggggtatggtcgccaagaattacaccctctttctgacattgacttgctatttttaagtcaacagcctcttcctccccaaattgccgaaaaagtgagtcaattaattaccttgctttgggatatccgtttagagataggtgtcagtgtgagaacgatggaagagtgccttttagaaggactgtctgatttaactattgccaccaatttactagaagcgcgtcttgtttgtggtaataacgcactctatcaacaattaattaaacatatttttagccaaggcttttggccatcgcctgatttctttgcagctaaaattgatgagcaagaacaacgtcaccaacgctttcatagcaccagttataatctagagcctgatattaaaagtagtcctgggggacttcgtgatattcacacccttatatgggtcgctcaccgtcattttggcgcaacatcaatatctgaaatggtcaactttggctttttaacccctgccgaaggacaagaattactcgagtgccaatataccttatggaagatccgttttgcgctacatttagtcctcaatcgttatgacaataggttactgtttgatcgccaattaagcgttgcccaacttttaaattatcaaggtgaaggcaaccaacctgtcgaaaaaatgatgaaggattactatcgcgttactcgccgtgtgagtgagctaaacgatatgctactgcaactctttgatgaagcaatcctcgcattacaacccaatgttaaacctcgccctcttgacaaagaatttcaattaagaggtacattaattgatgttatagacgatgaatgttttcttaatgatcctattgccattatgcggttatttttacgtatggcagagcatgcagagataaccggaatttattcgaccacactacgccatttgcgttatgcccgtcgtcatttagtacaacctttatgtgagtacccactagctagacaagtatttatgcaaatcttacgtcatcctagggcggtttcgggggcatttgtcccaatgcataaacatagtgtattaagtgcttatttcccacaatggaacaatattgtcggtcaaatgcagtttgatctattccatgcttatacagttgatgagcatactatccgtgtattacaaaaacttgaaagtttcgctgatgatgcaaatcgaaaccgacatcctctttgtgtcgatatctacccgaaactacctcaaattgagttattaagacttgctgctctatttcacgatattgctaaagggcgacatggtgatcactctttattaggtgcacaggatgttattagctttgctcaacaacatggactaaatcaacgagaaatcgctttagttgaatggcttgtaagtcatcacttacttatgtctgtaacggcacaaagacgtgatattcaagatcccgatgttatcttccaatttgcctctgaagtcaaaaatgagagccgtttacgctatttactctgtctcactgttgctgatatttgtgcaacaaacagtagcttatggaatagttggaaacaaagcttactgcgtgaactatttctcgctacggccaatcaattacgccaagggatgcactctattccagatttacgggaacgtatccgcgatcaccgtcagcaagcactaactattttacaacagcaacaggtcgatgaagaaaaactgcaagcgatttgggctcgttgtcatgcggactattttttacgtcatactccagagcaaattgcttggcatgctcaggcacttattgagcacaatagtgctgagcctatggtattgattagccaacaaaccgagcatggtggtacagaggtttttatttggtgtgctgaccgaccttctctatttgcttctgttgcaggtgagctagatagacgtaatttaaatattcacaacgcacaaatttttactaatcgcgacaatatggcaatggatacctttatcgttttagagcctaatggtaaaccactggcgattgatcgctatcatgctatacgccaagcgcttattcgcgttgtatcagccccttataacgccaatgccaaaacccgtgctttaccggctaaattacgccattttgaggtacccactaaaattaactttatcgcctctaaccataataaacgtacttatatggagttatttgcacgtgatcgcccaggcttattagctattataggtaaggtttttgccgatctttctctttcgttacatggcgccaggatcaccactattggcgagcgtgttgaggatttttttgtattaacagataacgaaaataatgcgttaaaccaaaaaatgaaggatgaagtcgtagaaaggttgacaaaagccctcgtttcaaaggataaaatatag

SEQ ID NO: 2441 - DNA, 276 bp, Proteus mirabilis
gagaatatgatggcaagtggatgggcaaatgagagtgctgttcaagaacaaattgatgccactattgatgatgccattgcaagagcgcgtaaccaaatgactcagggagaaagtgctgagttttgtgatgagtgtggtgaagcaattccactagctcggcaaaaagcgattcgaggggttcgctattgtattaactgccaagaggcgatagataaaaaatataatacctttagtggctataatcgccgtggtagtaaagatagccaactcagataa

SEQ ID NO: 2442 - DNA, 531 bp, Proteus mirabilis
ctgaccatgataaatattcatacattgggtcctgcaggaacaaactgtgagaaagccgcttattattggctaaataaaaataatcaacaaggaaatattattcttcaccctacattagaaaccgcagtaaaagaaatggaggtaagccaaaatagtattctattaggttgtattgtttatccttttttacacaatattgtttttaataatctctcttttatcaaattaacagattgttttgttatggatacccataacatgttatttgctagccgatttaataatattaaggagataaaaaagttaggttctcatcccgcaccacaagatctatttagaaaaataacagaactcgataatattgaaagagttctttttaattcaaatagtgaagcagcacttcaatgtggtttagggcgagtagatggctgtattaccacacttagtgcagctaaaaaatatcatttaaatattttatatgattttggccctgtccctatgggattttctattcattcaaaattaaattaa

SEQ ID NO: 2443 - DNA, 1455 bp, Proteus mirabilis
ggagcgatgattgcaatggaaaatatagctcttgcgaccttactcatcccatttgcaggggcgttaattacgtccatactgccaaatcggatggcgaagtggttatgtacactgttcgctttattagccacattaggtactgttgttttaggttggcagttcctcgctgaaggtaaagtcgataccacaattacgctagtacaatatggtgatgttgcgctatttggttttaccattgatcgcgtcagtaccttaattgcttttgccgttgtgttcttaggattactcgtcagtttttattcaacgggttatctcactaacggtaaccgtgagcatccccatgatgggactcgtcgttattatgctttcctgttgatctttattggtgctatggcaggtttagtactgtcatctaccattttagggcaactgctatttttcgaaattaccggtggttgttcttgggcattaattggttattaccaatcagagaagtcattgcgttcggcaatgaaggcattgttaattactcatgttgcgtcaatcggtctgtatcttgcagcagcaaccttgtttgtaagtacgggttcgtttgaactaactgcgatagcaacattagatgagccaacaaaactgattgtctttggcggtattctgtttgctgcttggggtaaatcagcacagcttcctttacaagcttggttacctgacgcaatggaagcaccaacacctgtaagtgcttacttacacgctgcgtcaatggttaaagtgggtgtgtatatctttgctcgtgccattatttcagccggtgatgtccctcatatcattggttgggtggggatcgccatggcggttatcactctgatttatggctttatgatgtatctgccacaaaaagatatgaaacgtctgttagcatggtcaaccattacacagctttcttatatcttcctcgcgttatctatctcaatctttggacctcgtgaagcctttaatggtggtgtggcttatatctttaaccacgcttttgctaaaagtttgttcttcttagtcgcaggtgctctaagttatagctgtggtactcgtatgttaccgcgcttaaaagggttaattaataaatatccattgctgggtgtgggcttttgtgttgctgcgttagcgattgcaggtgtacctccactcaatggtttctttagtaaattccctatctttgcagcaggctttgaattatcgagtgtgttctgggtaatgacacctattatggttctggtgctgattgaatctgttgcaagtttcacttggtttatctactggtttggccgtgtggtgccaggagaaccaagtaaagaagttgcgcaaggacaaccggttcctatggcaatgcaaattgtgattggaatactgattattatgtctttcgcatccagtgttattgctgtgacttggctaggataa

SEQ ID NO: 2444 - DNA, 471 bp, Proteus mirabilis
ggagttgcgatgacttatgatgaattataccaatacgctatatttatgttgtcgcgtcgtgattatggcaccactgagctgaaacgccgtttagcacgtaggatcaacgaagtcgataaagctaaacagagcacaaccgatgaaagatgcttagagcaagtgatcgagcgattattagaaggccaatatctggatgataatcgcacggtatatgctttttttcgtcgttatttaagtaaatcttatggcccgctgcgtattcgccaagagttacagcaaaaaggctttcccagtgaaattattgcacgggtactagaagaaacagaaactgattggtatgcactctgccaagatcttaaagagaaaaaatttggtacaggtaaacccaaagattttaaagagagagccaaacaaattcgctatctccaatatcgagggtttacttctgattatatcaatgcgttattttaa

SEQ ID NO: 2445 - DNA, 2379 bp, Proteus mirabilis
tggatgcagatattaatgcctaagcaatcgggcaaactcggtagacgcctttatttggcgtttatctttagttcgttactcactttattgattggtggggtgatattttttatgtggggaaaattagccactcaaatcaatgcgtctgttggtgactccttacctatgttaaccaccagctataatatggagcgttacagcactaatttacagatgctattaaaagagcgtgaacaaacacaacgtaaatcagtttcagaacaacaaaaacagcagatttatcaactattagataatctgcgcgagtttccgattgagcaacaatcacaacgcactttttataatcaattagtggatgacttatcaaacttaattgagcagcaagatattttattagataaacgtcgtgaactcgaaaataggttagcacagcttttaggtcaattggcttggatgcatgatgcggtaggtgaagatattaagcctctacttaatgaaattgagtggcatgtcagccaaatgcttaatgaaaaaaatgtacaggaaaatagcttacaactgcttttagaatcaacgttacttcaagagttattcactacagaaaatgaattaattagcttagtggaagaaattgcacatcaacgctatagccgtgatattgatgtcgcatttcactatataagtgtcaaaattgatgaaattatcgctttaaatcaaaaattaaaaagctatccttctaccattgctcatcgccaagtattgcaagaaattattgcgatcactcgttttgacggtgatatctatcaaacattgattgatgatgtcgaaaccgaaaaaaaacttaaagcacttactcctaaattaaatgaaaaattatctcagtttgataatgcagtaagaagtaatgtgcttgccaccagtgaagcattgaataagctcaatgataatacgcgacaactgatggcaacgggaaaaattgtcattatcttaattgtcgttgcttcactattgctcagcattattgtcatgaaaatcttaatagataggcgactgattgctagattaaataagttgagtgatgatctcgcccatgttgctaaaggtcatttaacagagcctgtattaattgaagggcaagatgaaattggattattaagtcgccgtttgcggcgcttttggcgtcaaatgaaagaagttgaagccacgaatgccctgaatctgattaataataccgatgccagtttaattacttgtcatcatgatggacgtatggaaaccgtcaatcccagtgctgctactttattaggtattggtcatgaacagagcaataaaccattatggttattatttagtggtgaagccaatacgatattaagagcgcagtttagtcccacaagtccgctttatttgtttgggcaaagtgagtctattgtgagcatggtaaaacaaggaaagcctcattttctgcaatttaatattcgcgaatatcctcataaagacgagcataaatatattgtgacgatcacggatattactcgccaagaattaagtcgattagaattaaaacatcttgtggcattaaaaacccaagatttacaagaaaagaaccaacaattaaatgaagagattgtgcgtcgtgaacaagcacaaaaacacttaattcagacacaagaagagttagtgcaagcggccaaaatggcagtagtaggacaggcaatgaccagtcttgctcatgaattaaatcaaccgctttcagccattaatacctacttatatagcgttaaattaacactacagatggagaaatatgaccaacttcctgatcccattgagcgtattgaaaaattatgtgctcgtatgaataggatcattacggcattacgtaatttttctaaaaaatcctcatctgaagttagctatgtttcagcgccgttacaagggctggtggaaagtgccatggtattagtggaatcgcgctctaaacgagagcagtgcaccattatcaataatatccccagtgaactgaatatttgtgctgatccaacacaaatagagcaggtcttagttaacctgtttgttaatgcaatggatgcagtcgcaggaatgggcgaaagtcagatcagcgtcgacctattatcggatgaagctaaatatcaacgagtggccattaccgatagtggcaaaggatttaatgctgatgttttaccaaaattattcaccccttttaccaccaccaaagatgttgggctagggttagggctatcgatttgccgttctattatgcaacggtttggttatgaaatttacttagcatcggcattaaatggcggtgcgatggttgttttggagtttactcatgacacagtcactgctgtctga

SEQ ID NO: 2446 - DNA, 1059 bp, Proteus mirabilis
aaggttaagattatgtctaatgatatttcagtttatactgaggggattaacgatttacctcatttaaatactagagtaaatactgataattatttcgaaaacctgctagaagatgaggattttttatcttgggaacctaatcgggaatatcaagatatgaattatgataataatagaaagaataaatttatagagaagttacctgatacagataaatattattatttagatgatgattataataaaaccattaatgataaaaataattttttaaatcaattttctaatgatctaaatgatcttagaaaaaaagataatagttatgagactgattcgttaagtgatctttttaataatgttaaacaatctattgtttcaggcaaagcggattatctagatgtattaaaggatatcttttctaactacatgaattttgtcaatgaactaaggcaaaccatatctaatttaaataaatatcagaaagcaggaagtaaagaaggtacggtgaattttgattttaaatctttttttaatgacttatctaacattagagataaatataaaaatccaacaggtactgtcgacgatccttttgtttttaaatctcgtttgttttttcaacatcaaaaggatgggacatatttacgcaccattgatggccaagaagttcattatagcgatctacaacaggtaaataatgcggcagatgcgttagaaaaactattaaaaggtataaatggaataagcgtatcaatacaaaggcgtgggggggagcctgatgttgacattgattgtcgaggtagaattgattgtactgacctagaaaaattgctaaatgatctatctaagaaggtatctaacacggatgatattaatcaaacagaatttgagttattcagaaaaaccatcgacgcattagataagaaaattaacactaatttagatgaactttccaaaaaatacagtacagcaaatagtaattatgataattttgttaagattgtcagtagtacaatgaacactttattagaaatggcaaaaggatttttacgtttctga

SEQ ID NO: 2447 - DNA, 1425 bp, Proteus mirabilis
aacagtaagatcggattttacttgccatttccgctcaaaaagaataaaaatacattaaatgcgaataaaaattcacttgagaggggctttatgaaagagcgtagcaccgaattggtcgatggttttcgacactcggttccgtatattaatgcacatagaggtaaaacatttgtcattatgctagggggagaagcaatagcccatgagaactttccctctatcattaacgatattggtttattgcatagtttaggaatacggttagtggtggtttatggcgctagaccacaaatcgatgtggctcttgaagagcaaaaaatttctccgctctatcataaacacacacgaattactgatagtaaaacccttgaagtagttaaacaatctgccggtactttacaactcgatattactgctcgtttatcaatgagtttaagtaatacgcccttacaaggagcgcatattaatgtggttagcggtaattttgtcattgcacaacctttaggtgtcgatgatggggttgattattgccatagcggtaaaattcgccgtattgatgaagaagccattcatcgtcagttagataaccatgccattgtgttaattggccctgttgccgtctctgttacaggggaaagttttaatttaacctctgaagaggtcgcaacccagctagctatcaaacttaaagcacaaaagcttattggcttttgctcttcgcaaggggttgtagatgcaagtggccagattgtgtctgaactcttacctaatcaagcagaagaacgaattcaagcattacaaactacaggcgattatcactcaggtactgtacgttttttacgaggtgcggtaacagcctgccgtcgtggtgttgagcgtagccatttattaagctatcaagcggatggtgccattgttcaagagttattttctcgtgacggtattggtacgcagattgtgatggaaagtgccgagaaagtccgtcgcgccaatattaatgatattggtggcatattagagcttattcgtccattagagcaacaaggcattttagtgcgtcgctcaagagagcaacttgagatggaaattgatcaattcactattattgagcgcgataatctcaccattgcttgtgctgccctctatccttatcagtctgaaaaaataggtgaaatggcctgtgtcgccgttcatcctgattatcgtagctcttgtcgaggtgaagtgttgttacaacgcatatcaacccaagctaaacagatggggttagataaattatttgtgctcacgactcgtagtattcattggttccaagaaaaaggctttacgcctgctgaaatcgataaattacctattgaaaaacaggctctgtataattatcagcgtcgctctaagatcttaattttagatctacataaagagtag

SEQ ID NO: 2448 - DNA, 588 bp, Proteus mirabilis
tttaaggagatttccgtgcaacgtgaagcattattagaccacgtacttatccaattagagcaacatgggcttgccgctacgttgcctgagttattgcagggatttgatattactgaatctgaactccaacctttttggcctgataaagacgcgttaatttttgattgtctacgccatcatggacagcaaattgatatttggcaacgtcaagtgatattagatgaaacgctgaccacagagcaaaaattactagcacgttacgatcagctggctatgcgcttagaaaaaaatcgttttccaggctgtttgtttgttgctgcttgtagtgcttatcctgatgagcattcacaaatccatcagttaagccagcgccaaaagcaaagctcatttgaatactctagaatgctactacgcaagcttgatcttgaagatagtgagttagttgctaaacaaatggaactcatcttagaaggctgtttaagtcgcttaatggtcaatcgtcgtgctgacgatatcacgacagcaaaactattagctcaagatattcttaaaatcgcccaatgtcgtaaaaatggtgcgctaagctga

SEQ ID NO: 2449 - DNA, 1212 bp, Proteus mirabilis
atttttaggatatttatgaataaatcaattattatcatactgcttgtcacagtattagatgccattggtattggccttatcatgccagtactaccaacactattaaacgagtttgtgagcgaaaacagactcgccaatcattacggtatattattagcactctatgcgacgatgcaggtgatcttcgcacctattttaggaaaattatcagataaatatggcagaaaacctattttattattttcgctattgggtgcggcattagattacctattaatggcttgctctacctcattatggatgctctacattggacgcattattgcgggtataacaggagccactggtgctgtatgcgcatcagcaatgactgatgttactcatcctcatgaaagaacacgttatttcggttttttgggtggtgcatttggtgtgggtttaattattggccccatgttagggggattactgggtgagatcagcgcccatacgccatttatctttgcggctatttctcattcgttattatttatattttcattactttgtttccaagaaactcaaaccacaaaaatatcgactgaaatatccgcattaaatcaggatacaacgcctcactctgctactggttttattaaaaagagtctctgtttttggcttattgcctattttattattcaactaatagggcaaattccggccactatttgggtgctattcacacaagtgcgtttcgcttggcacactactgaagtaggtttatctcttgcatttcttggtgtattacatattttttttcaagcggttctcgcaggaaaactggcgcaaaaatggggagaacgcaacacggttatcattagcatgtctattgatgcatttggttgcttattattagcctggataagccatgtttgggttatgctccccgctttaatctgtttagctgcgggaggaatgggacaacctgctttacaaggatatttatcaaaatctgttgatcatcatgttcaaggacaattacaaggaacgttagtcagtctaacgaatataactgggattgtcggcccgttactcttctcttttatttatagttacagcgttgaatattgggatggcttattgtggtttattggtgcaatgctttacagtgggttacttgtagcctgttattttaaacagaaatcaccaatattaaaaaaatttccctcataa

SEQ ID NO: 2450 - DNA, 999 bp, Proteus mirabilis
cgtagatacttggaagtggacttgtcagtaatacgtcaaacagtaggatttttcctgcgattattatgcctgctgctggtaacaacagcaggtgtttttattttattaagtttttcgccgattgatccgatcaaggcctatatcggtagtgatttgctaaacgttccgcctgagcagtatccgctgatagcggctcgctgggggatggagcagccactatggatgcgtttttggctctggtttagccagataatccaaggtgattttggttattccatgctctataacatgccggttattgatgttattcgccaacgggcagggccttcgtttatcctgcttttttctgcatggctattttcaggtgtaataggggtgttaatggggttagtggcaggacgatatcttaatcgttggcctgataggatcatctcaaccctctcttatttgctggcctcattaccgactttttgggttggattgctgttgttatcgctgttttcggtaacgttacactgggcacccatttgctgtgcatggccgatgggcagtagtgctgaagcagccacattgggccaacgtttttcgcatcttattttacctatgatagcgttaggattattaggtacaggtaatatcgcactgcatactcgcgcaaaagttgctgaagtgatgggcagtgaatttattcattttgctaaagctcaaggtgataaaggttgggctatgatgctttttcatgttctacgtcatgccattactcccgcactttgcttacagtttgcatcaattggtgaattgttaggtggttcattattggcggagaaggtttttgcttatccgggattagggcaagcgacagtagatgccggattgcgtggggatatccccctattaatggggattgttgtatttagcacaattctcattttctttggaaacagtatctctaactacttgttacgacgaattaataaaggaattttgcgcgacttatga

SEQ ID NO: 2451 - DNA, 831 bp, Proteus mirabilis
tacaaaattgtaatgaataatagagtccatcaggggcactttgcccgcaaacgcttcgggcagaactttttaacagacagctatattattgaaagtattgttgaatctatttatccacaacccggtgaagccgttattgaaatcggtcctggtttaggcgcgcttactgagccggtgggggaaagaatggataaaatgacggtcgtcgaaattgaccgtgatttagctgcacgcttagaagttcaccctacattaaaagataagctaaccattattcagcaagatgcgatgacgattgattttgcccaattagcaaaagagcgtcagcaacctctgcgggtttttggtaacctaccttataatatttcaacgccattaatgttccatctatttagttttgctgatgccatttctgacatgacttttatgttgcaaaaagaggtggttaatcgcctagtggcaagtcatggtagtaaaacttatggccgcttaagtgtcatggcacaataccactgccaagtcattcctattattgaagtgccaccaagctcatttaagccagccccgaaagtagattctgccgttgtgcgtctgatcccttataaggaaaaaccctatccggtgacagatattgctatgttaagccgtatcacatcacaagcctttaatcagcgccgtaaaacgttacgtaatagcttaggtggactacttacagcagaagatatgctggcattagatattgatcccactgcacgcgcagaaaatatttctgttgagcaatactgtaaagtggcaaactggttatcatcacaacagcaacacgctgagtga

SEQ ID NO: 2452 - DNA, 828 bp, Proteus mirabilis
agcctcgctgtaaccggtatttcggctgcggaattgtggcaaaagatcatcccagtacagataattggtatttttggctcgatgctttttgccgcggttatgggggtgcgagaaaccaaacgtattgctaaagcaaaactaaaagggactacgccttatgagcaagattctttattaagacaatttgatgaagatcagccagaaacaggaacagaaaaaccacaaaaattttggatcaaccttctgttaattatcggctcaattacgtgtttagccttaggattattttcggcaccttatatttttatggttgcattatcagccgctctagtgatcaactatcctaagccaaaagatcaaatagcgataattaatcatcatgctcctcaagcactctctatggtagcaattattttagcggccggtgcttttttaggcatcatgtctaatgggaagatgctggaagctattgcccttgatttagcagcagtattaccttctcattgggtcgataatttgcatattgttgtgggtatattaggcgttcccatggatatctttaccagcactgatgcttattattttgcgctattgcctattgtgcaggaggtcacagctagtggtggtgtccatgttgctgatgttgtgtatgctatggccataggtaataatgccggaacctttgtaagtccattctcaccagccgcttggcttgctatggggcttgcaggcactgatatgggtaaacatttacgttactcatttggttggatttggctatttagcttctttaccctaggtgttggcacattattgggactgttttaa

SEQ ID NO: 2453 - DNA, 972 bp, Proteus mirabilis
aataggaatgttatgagtcttaattttctggattttgaacagccaattgccgagttagaagcgaaaatcgattcgctaaccgcagttagccaacatgatgaaaaaattgatattaatattgatgaagaagttgcacgcttaagagaaaaaagtttagaacttactcgaaaaattttctctgatcttggtgcatggcaagtggcacaacttgctcgtcatccattaagaccttatacccttgattatattaatcgtgtttttactgattttcaggagttggcgggcgatcgcgcttatgctgatgataaagcgattgtcggtggtattgctcgtttagacggtcgtccggtgatgatcattggtcatcaaaaaggacgtgaaacgaaagaaaaaattcgtcgtaattttggtatgccagctcctgaaggttatcgcaaagcgctacgtttaatggaaatggcacaacgttttaaattacctattatcacttttattgatactccgggagcttatccgggggtgggcgctgaagagcgtggacaatcagaagcgattgctcgtaatttaagagaaatgtctcgctttggtgtgccaattatttgtaccgttattggcgaaggtggctctggtggtgctttggcgattggtgtgggtgataaagtaaatatgttgcagtacagcacctattccgttatttcgccagaaggttgtgcttctattctatggaagagtgctgataaagcaccattagctgctgaagctatggggatcacggcaaatcgtttaaaagaattaaaattgattgatacggtgatccctgaacctttaggtggtgctcatcgtcattatgatgaaatggcagcatcactaaaagcgcagctaaaagctgatttagcgcagttagatgagtttgatacagaagagctcactaaccgccgttatcaacgcttaatggaatatggctattgctga

SEQ ID NO: 2454 - DNA, 753 bp, Proteus mirabilis
ctaatctgcttaggacagaacaccatggcaaccaatgcaaaacccgtatatcagcgaatcttattaaagctgagtggcgaagccctgcaaggcgcagaaggttttggtatcgatgcgagcgtacttgatcgcatggctcaggaaattaaagaactcgttgaattgggcatacaagtcggtgtcgtaattggcggtggtaacttgttccgtggcgctggtctagcagctgcaggtatgaaccgtgttgtgggtgaccacatgggaatgctcgccacagtgatgaatggcttagcaatgcgtgatgcattgcatcgtgcttatgtcaatgcacgattaatgtcagcatttccacttaatggtgtttgtgataactacagttgggctgaggctattagcttattacgccatggccgagttgttatcttctcggcaggtacaggcaacccattctttacgactgactcagctgcgtgtttacgtggtattgaaattgaagctgacgttgtattgaaagcgacaaaagttgacggtgtattttcagccgatccaaccaaagatcctgatgcggtattatatgaaaagctgacttatcaggatgtattagaacgtgaattgaaagtcatggatcttgctgcattcacattagcccgagatcataatttacctatccgcgtattcaatatgaataaaccgggtgcattacgtcgggttgtaatgggtgaaagtgaaggaactttgatttctcacgcttaa

SEQ ID NO: 2455 - DNA, 489 bp, Proteus mirabilis
ttagattcagttttattagacaggaagagtattgcaatgagtgataatcatactctgcaaatcgaagaaattttagatttacttccacaccgttacccatttttattggttgaccgtgtccttgattttgaagaagggaaatttctaagagcagtaaaaaatgtatcttttaatgagcctttctttcaaggtcacttcccaggcaaacctattttccctggtgtactgatcctcgaagcaatggcgcaggcaacaggtattttagcattcaaaagcgtaggaaaactggaacccggtgaactttactattttgctgctattgacggtgctcgctttaaacgtcctgtcttacctggagaccaaatggttcttgaggttgaattcattaaagaacgccgtggcgttgcacgctttaaaggcgtcgctaaagttgatggagaaattgcctgcgaagctgagatgatgtgtgctcgccgccgtgaggtctag

SEQ ID NO: 2456 - DNA, 864 bp, Proteus mirabilis
tgttctccagttagtgtccttatgacattaactatatattgtcttatggacactattggtgtcaagtcatttagtgtctttatgacaaaatttgattttcatgtgtttaacattaaaataaactcattatctttttataaagtgcagaccatgaacgaacaaaattttttagcaaattacaatcgccgtgattttctatcgccgcttattactgttgattcagtactattcacttaccatgaagggcagttaaaagtgctcttggtggaaagagctaatcatcctgaaaaaggaaaatggggattacctggtggctttgttgatgaaacacaagataactgcctagaagatactgtgcttagaaaattaaaagagaaaacaggagtgatcccgccgtatattgaacaactctgctcagtgggaaataatcagcgcgatgtaagaggttggtctgtcactgtatgttacacggcgttgattgctcaccaagcatgtaaagcgcatattgatagtgtggatcatgtgatgtggttgcctattgatgaagtagcacagaaaaatctggcatttgatcataatgaactgattgcgcaagcgagagagcgattaaagcaaaaatcgctttattctattgtgccgggatttgcgttacctgaagtgtttactttgcctgaattacagcatgtgcatgagatattgataggtaaagagatccagaaaaaatcttttagacgacggattgaacaagccgacttattaattgataccggagaaaaacgtgctgagaagggacgccctgctagtctctatcgacttaagaagtcgtctgcggattatcgttttattcgtaatcttgaattttaa

SEQ ID NO: 2457 - DNA, 1569 bp, Proteus mirabilis
gaacatacagtgagaactcctctaatgatctgcgcattgatgacctctttttctagtttcgccaattgcttatcaataacagaaaataaagaaatatcaggccaatttaatcacgataaggcactctgttttactacacatttacagagccagcgctatgctgagttagatgttaaaggtatacaaaatctgcaattagcaaaccaagatggcactcatattcgtcgcttattaaaagatgtgcccgttgatggacaacaacaaaagatacgcttcctattacctgaaacggcaaattatcagtttattgcccaaggagaagttggggtacagtggcatatcacactgaaaacatacccttatcagcctttagataaagatgcgggtatagcattaactagccctagattgcaaatgctggcacaagatctcaccgccagcaatatacagttattctggcaacagatacagcaagagggaactccccttgttgaaccttacgataatcataacaagcgcgtgacttttttatggcaaggtgcgcaatctaatgtatatctattgggatcgcctgcaggtgatcatgatccgttaacgcgtttagccaatagcgatatttggtatcgtagttatatcgtgcctaacgatacattaatgcaatataaattagcaccagatgtgccagtcattgaaaatgcaacagctgcacagcagcgccgtgctattttaacgacggcacaggccgatccttttaatcttcacccttcaccaagtaaagcggacgatcgttataattacttttcattgctgtcacttgattatccccgtgaatgccagttgccagatatcttagatagggcaatgaatggcaatacatcaatcagtcgttttcatagtgaaattttaaacaatgatcgagagattgcgctttatttacccgcacagaaaatgacgacaccgcgactattggtgctatttgatggacaaatttatcgccaacaatatggcatagaccggttttttgataagttgattgaagaggggaaattacctcctattgctatcttatttgtcgatagtattgatagtgatcgtcgtagtgttgaattaccacctaatcctgattttcaccgctttttagcggatgaacttttggtttggttagagcaagagaaaggcctgcaagtagccgctaaggaaactatagtctcaggctcaagctatgggggattggcctctgcatgggtggcatttaaccgtcctgatcgctttgggaaagtgcttagtatgtccggctcttattggtgggcgccagaaaacgaagccccagagtggttaattcgccaatatcaacaggcggataaaaaaccattacagtttttcttagaggctgggttatttgagtctcgcgaaggcgctggaggaatattaaataataatcgccaattaaagcaggttttacagcaaaggggctatcctgtgcaatcgctcgagatggcgagcgggcatgattatatctcttggtgtgaggcgctttatatcggcactaaagcgttaactaacgattaa

SEQ ID NO: 2458 - DNA, 585 bp, Proteus mirabilis
gcggagaaagtgtctacaataaaaaactttaaaagaacagtattgttagcgatgatggtgtatgcagtaaactgtcaatccgcaaataatggtactctcaacttttctgctaatgtaacacgtggcacttgtgaatttagcgatagtaatgagctgagtaaacatgtctcatttgaacagttttttactattggtgatgcagaagacacaccaataaaggcgcctattaaaggtagtctcggcactaagcaatttacttatcttatcgattgtaaagagtacgaacctgatagtgagaaaaaaatcacgattaatgtaaaaacaggcgcgaatactgaatattcagatcaggttttttatggaaaaggcgatacgactcaaacaggttttttagtaaaaggttgtcttgagggtgaaaatgcgagttgccaaattctagaaaacaataaaaagttatctttttcttctcactctaattcagcgataagtattaactacatcgtcgattttgttagacgcaacaataataaaatgacacctggtgattcaacggcgactattttatttgaatatattcaggattaa

SEQ ID NO: 2459 - DNA, 1647 bp, Proteus mirabilis
aatcgtagagtaaataccgttagactcaggtacaagtggcactatcccacaatacctgagcttacggcaaaagcatgggataacagtttaatggatgtgattggcagacaacacttacggcaaatgtgggatgatttagctgaagtttatgataaaaaaacagcgctaatttttgaatctgcacaagggaaagtcagacaatttagctacagtgaattaaatgaagagatcaacagagccgcaaatctttttcatgcctgtggtataaaaaaaggcgaccatgttgccttacatcttgataactgcccagaatttttcttttgctggtttggactggcaaaaattggcgctgttatggtgcccattaatgcccgctttatgtatgaagagagtgcttggatcattaaccattgccaagcacactttgtggtaacaagtgataatttctctccaatttaccaaccgatgttgcacaataagcactctcctttaacgcaactgtttttaataacagaaaacggtctccctactgaaaaaggggttgttgattttttaagtgaaaaagccaagcatcccgttacgcttaatcatcacaccccattaagtgtggatgacacggctgaaatcctttttacctcaggtactacttcacaacccaaaggagtagttattacgcattataatttacgttttgctggctactactcctcatggcagaacgccttacgggaagatgatatctatcttaccgtcatgcctgcttttcatatcgattgtcagtgtaccgcatcacttcctgctttttctgtcggtgccacatttgtactactggaaaaatacagtgcgagagccttctggaagcaaatcctcaaataccaagcaacggtaacagaatgcatacccatgatgatgcgcaccttaatggcacaaccaatctcaccagatgaaaagcaacataaactgcgcgaagtgatgttttacctcaatcttgcagatgaagagaaagatgcctttatcgaacgctttaatgtgcgattactcacctcttacggcatgacagaaaccattgttggcttaatcggtgacagacctggcgataaacgccgctggccatctattggtagaccgggattttgttatcaagcgcaaattcgcgacaaacaaaatcagcaagttcctaacggtgtagtcggtgagatctgcgtcaaaggtgaaccgggaaaaaccttatttaaagagtattacaatcgccccgatgcaacagaaaaagcgctagagcctgatggttggttacacacgggtgactatggttatcgagatgacgaaggctttttctattttgttgatcgcagttgcaacatgatcaaacgcggtggtgaaaacgtctcttgtattgaaattgaaaatatcatcgcatcacatcctaaaatccaagatgtagcagtaattggtgtacctgatgatattcgcgatgaagccattaaagcctttgtggtactggttgacggtgaaacgttaagtgaagaagcctttttcgccttttgtgaacagaatatggcgaaatttaaagtgccttccgccgttgagtttaaacaggggttaccacgtaattgctcaggcaaagtgatcaaaaagcatttgcaataa

SEQ ID NO: 2460 - DNA, 540 bp, Proteus mirabilis
ggtagtctggtgatcgatgatgatggctaccgcccgaatgtggggattgtaatttgtaatcggcaagggcaagtgctttgggcccgtcgctatggacaacattcatggcaatttcctcaagggggaattaatcctggagaatcaccagaacaagccatgtatcgtgagttgttcgaagaagttggattaagtcgtaaggatgttaaaatccttgcctccacgcgtaactggttacgttacaagttacctaagcgtttggtgcgttgggacacaaaacctgtttgtattggacaaaaacagcgttggttccttttgcagttaacaagtaacgacaaggacattaatgttcagcagagcaaaacgccagagtttgatggttggcgttgggttagctattggtatcctgttcgtcaagtcgtctcttttaagcgagatgtatatcgtcgcgtgatgaaagagttcgcaccagtagttatgccattacaagaacaagtgtctatgtctcgtccttcctatggatatcgccgtaaaaggtattag

SEQ ID NO: 2461 - DNA, 756 bp, Proteus mirabilis
ttaattatggtacatttgctgatcattgatgcattaaacctgatccgccgtattcatgcggcatcaggttcttcatgcctgacagtgtgtgaacatagcgtgaatcaattgcttaatcacacacggcctactcacgcggttgctgtttttgatgaagatgatagggaaaatagctggcgccatcagttattgccggaatataaagcaggccgctcgccgatgccggctgatctgcaccaacagcttccagaaattaaagcaatgctacttaacttaggtataaaaagctggcattcaggaggcgatgaagcggatgatgtggccgcaactttggcaacaaaagtcgctcaagccggacataatgtgaccattatttcaacagataaaggttattgccaattactttcccctgccatacgtattcgtgactatttccaaaaacgctggctcgatcttgaatttattaatcaagagtttggtgttaaaccgacacaattaactgattattggggattaacaggcgttagcagcagtaaagtttccggtgtccccggtattggccctaaaagtgcaacagaacttttgcaactttatcctaatttagagtcactgtatcaacacattgatgaagtgccaaaaaaatggcaaaccaaattgagtgataataaagaagttgcttttattagccgccaaatcaccacacttcgcactgatattaagctaaacggtaatttacaacagttacgtttaaaatag

SEQ ID NO: 2462 - DNA, 1476 bp, Proteus mirabilis
caagttatggtattatttcggcttatttttgaaaataatgtggagtatgggatgaaagtaacgctgccggattttaataaagccaatgtgctggttgtcggtgacgtcatgttagaccgttattggtatggtcctacaagtcggatctcaccagaagcacctgtgcctgtggtaaaagtagataccatagaagagcgtccgggtggtgcagctaacgttgcaatgaatattgcttctttaggggctaattctcgtttggtggggttaaccggcatcgatgaagcggcaaaagcattaagcaatacattaagtcaggttaatgtgcgttgtgatttcgtctctattgcgacacatccaactattactaaattacgtgtcctatcacgtaaccaacaacttatccgccttgattttgaagagggatttagcaatgtctctccagagccaatttatgagcgtattcaacaagcattaccctcaatgggtgccttaattttatcggattatgctaaaggtgcactttctcacgtacagcaaatgatccaattagctaaaaaagcaggtgtgccggtactaatcgatcctaaaggcagtgattttgaacgctaccgtggtgccacactattaacaccgaatatgtcagagtttgagcaagtggtgggcgtttgtcatacagatgatgagctagtagaaaagggcactcaactagtaaaagatttagcacttgatgcactattgatcactcgttcagagcgtggcatgagtttattacaagccaatgaagcgccattgcatttacccactcaagcacaagaagtttatgatgtgacaggggcgggagatacggttatcggcgtgcttgctactgcattagctgcaggcaaaccattagcggaagcgtgctttcttgccaacgctgcggctggtgtggttgtggggaaactgggaacgtcaacggtttctcctattgagcttgaaaatgctattcgcgggcgtgctgataacggctttggtattatggaagagtcacaactcaaacaagcggttgctttagcgcgtcaacgtggtgagcgcatagtgatgacaaatggttgttttgatattcttcatgctgggcatgttagttatttagctaatgcacgtaaattgggtgatcgcctgattgttgcggtaaatagtgatgcatcaactaaacgattaaaaggtgaaagtcgcccagtcaacccattagagcaacgaatgaccgtattaggcgcgttaggggcagttgattgggttgtcgcgtttgaagaagataccccacagcgtttaattgcatcagtattgcctgatattttagtaaaaggtggcgattataaacccgaagacattgctggtagtaaagaggtgtgggctgcgggtggtgaagtgaaagtacttaattttgaagatggtatttccacaactaatattattaatgccattaaaaagaaataa

SEQ ID NO: 2463 - DNA, 354 bp, Proteus mirabilis
aggttctcggttatgtctgaaggaatgatttatttattaattagtgggatctgggaaaccttagtcatgacatttgtctcaggcttttttggttttgtcattggattaccattaggtgtcttactttatgtgactcgaccagagcaaattatggcgaactcccccgcttataaagtgatttctgctttagttaatatttttagggccatcccttttattatcttattagtttggatgatcccttttacacgtatggtagtaggaacatccatttgtttacaggcggctatcgttccgttaactgtaggaactgcaacttttatatgcacgtattgtaaaaaaataccctattag

SEQ ID NO: 2464 - DNA, 1557 bp, Proteus mirabilis
gttgctgaggtggttatgactgaacaatctgttatccaacgttgtcaacaaatcgtagaaaatccaaccctttcccccgaacaaaaacgtcattttctagcattagaagcggaaaatatgttgccatacccgacattatctaacgaggcgagccttgcgctaaatgaacgggttatctgcgatatgtatgaaggtcatgccccttataaaccacgttatgtattacctgattacgcgaaattcttagcacaaggctcgcgctatttagagcttgaacctgcccaagattttgatgatgcgctaaatatgctgactatcctttatcatcatgttccttcagtcacttcaatgccggtttatttaggtcgtattgataaaatcttactaccttatgtggggaatttgacgcaagagcaactctatccaaaattaaagcgtttctggcgctatcttgatagaacccttcctgatgcctttatgcacgctaatattggccctgaagactctatcattacacgtttaattcttaaggtagatgttgaacttcaacaagtagccccgaatctcacctttatttatgacgcggcactaacaccttctgatttattgcaccaagcaatcaccaatatttgtcatagtagtaaaccccatattgctaacggtacattgcaagatgctgtatttggtaaagatgaatacggtattgttagttgttataactctctaccgcaaagtggtggcggtagcactttagttcgtatcaatctcaaagaagtagcaaagcgcagccaaaatagtgccgactttctagagaatgtattgccgttttacatgcaaaaacaaatcgagatcatcaatgctcgttgcgaattcctctatgaaaaatcaaacttttttcaacaaagctttttagtagaagaaggtttgatctcacccgatcgttttgccccgatgtttggcatttatggtatggctgaagcagtttctctattacttgaaaaagaaggtcatacagcaaactatggtcatagcgaagcggccaataaacttagctatattattagtgaaaaactggcccaatttgttgcacagactcctgtaaaatatggttggaaacagcgtgccatgttacatgctcaatcaggcataagttctgatattggtactacaccggcgacccgaattccttatggaacagagcctgatcctgttactcatttaatgaccgttgccccccaccatcaattttatacttcaggtattagtgatattttaaccgtggatgaaactatcaaacaaaatcctgatgccttaatgcaactgtgcttaggggcgttttcttgcggattacgtgaatttaccgctaatgtgggtggcaatgatttagtccgtgtcactggctatatggtgcggttatctgatttaaaaaaatataaagaagaaggctctcgcctaaatacaacttggttaggagatgaagcaacaaccaattgccatattgctgaacgaaaaccacgagtgattagccatgaacagcagatgcgcttcgataaataa

SEQ ID NO: 2465 - DNA, 1338 bp, Proteus mirabilis
caccaggaggttgcagtgtttcttgcccaagaaattattcgtaaaaagcgtgatggtcatcctttaactgaagaagagatccgttttttcattaatggcgtcagagataatactgtttctgaaggtcaaattgcagcacttgcaatgacaatttattttcatgatatgaccatgcctgaacgtgtggctttgacattagccatgcgtgattccggtactgtactaaactggaagagtctaaacttaaatggtcctattgttgataaacactcaacaggcggtgttggcgatgttacatcactgatgttagggccaatggtcgctgcttgtggtggttatgttccgatgatttctggtcgtggattaggtcatactggtggaactcttgataagcttgaggctattcccggctttgatattttccctgatgatgaaaaattccgcgatattattcgtcatgttggtgtagcaattattgggcaaaccaattcattagcacctgctgataaacgcttttacgctacacgtgatattactgctaccgttgattcaattccgcttatcactgcatctattttaggtaaaaaattagctgaaggtttggatgcattagtgatggacgttaaagttggctcaggtgcctttatgccaacatatcagaaatcggaagagctagcagaatcaattgtacaagtagcaaatggcgccggatgccaaactacagcattactgactgatatgaatgaagtattagcatcaagtgcaggtaatgcagtagaagtccgtgaagcagtacaattcttaacgggtgaataccgtaatccacgcttatttgaagttacgatggcactgtgtgtagaaatgttagtgtcaggtcgtttagctgactcacgtcaacaagctcgccaaaaactgcaagatgtgctggataacggtaaagcagcggaagtctttgctcgtatggttgcagcccaaaatggtcctacagattttgttgaaaactacaataaatacctgccaacggcggtattaagtaagcctgtatttgctgagaaagccggttttgtcacagaaatggatacccgtgctttaggtatgtcagttgtgactttaggcggtggtcgccgtaaagcaactgatgctattgattacagtgttggattaagtgaaatcgcggcactaggaacagaaatcaatacagatacaccactcgcgatgatccatgccaatagtgaaaaatcatggcaagaagctgcggcagaagtccgtaaagcgatggtaattggtgagacaaaacgtgaaacgtcaccaatggtgtatcgccaagtcagcgaataa

SEQ ID NO: 2466 - DNA, 1941 bp, Proteus mirabilis
acgcgctgggtgagaacaattcaaatgattaaattattagaacaagcaattgcacaaaacctattgcgcccattagatttacgttttgctcaaatgctggtggcagatgaaaatcctatcctactgtttatttttgcctatctcagtgctcaaacaggggcgggccatgtttgcttaccgttaaatatcatacaacaagataaattgtttgatggacgacacaccgagctttcacaagccatttggcagaaaatggcgcaaccatcagcgaaagaaatactggcagagcttaatcagagcgagtgtgttaatcaaggccatagtgacttaccttcacctattattctcgataacggattactttatctacaaagaatgtggcgttatgaagagcaaattgcgcaattttttcgccaagagcaacgagtggttgatatcgatgaaaatcaattaacaaacgtattaaatcaacttttcccaagcgttaaaacccatgctgaaactaactggcaaaaagtcgccgcagcggttgctattacaagccctatttcgattatttcgggtggcccaggaacagggaaaaccacgacagtagcaaagattttagctgcttttgttatgctaacggcgaatgaaaaacccattattcaactagccgcacccacgggaaaagcggcagctagattgaccgaatcattaggtaaagcattagcgcaattggcactaagtgaagaagagttaaaatggatgcccgatcaagcgcaaaccattcatcgcttattaggtgcccaaccggaaagtcagcaagttcgttatcatcgcgataatccgctacaacttgatatcttggttatagatgaagcttctatggtggatttaccgatgatggcgcgtttaattgaggccttaccggaacattgccatgttatttttctgggagataaagatcagctcgcttcggtagaggcaggagccgttttaggggatatttgtcgttttgcggatcaggggtttagccaacgccgttttgagcagattgatcgcttaacacaaggtgaattacagaaagatcccgcttctatgacgacttctactaagccagtttcggtggtcagtgattcactatgtttattgcgtaaaagttatcgttttggctcacattcaggtattggtcaattagcttttgcggttaatcaaggacaagtgaagagtgctatgacgttactgaaaaaagcgacagtaacacaagagagcactgagcgagaaaaacataccgatccgcaggacatcgaatttatctcattagacaccgatgagagctatatgaagatgcttcaagatgttgctaaggcttatcatcactatctatcgttagtcgcgcaaaaagcagcaccagagactattcttcatagctttaatcaatatcgtttattgtgcgctttgcgagaagggccttttggtgtcacaggactaaatgaacgtattgagatgctgttacatcgccaacgcttgatacgacgacctataaatagttatcagcgggagtatattggacgaccaattatgatccagcgtaatgacagcacattggggctatttaatggtgatatcggcattatgcttaataacgatgaaggagaaatgaaagctttctttcagttgcctgatggcacattgaaagctatccaacctagtcgtttaccgcaacatgagactgcttatgtgatgacagtacataaatcacaaggttcggaatttacccatacggcactggtgttgccaacacaattttctcctattgttagccgagaattactctatacggcgataacgcgagccaagcagaagctatcactttattcttctgaatatatggtgaaaatggcgatccagacacgtattcaacgccgcagtggattagttgaaaaactgcgttactga

SEQ ID NO: 2467 - DNA, 345 bp, Proteus mirabilis
gaggtgagggttctttttacggctaaatactgtaagcgaatgcgaggtatattcatggatgaatatgatcacacactagtatcattggtagttgttggcgcttttattgcattagggaagatgctagttgctaatgaagttatcacattacgactatttattggcaggatcatcctaggatcagcggtttctgttgtggcaggtgctctgttgattttatggccgggtattcatcctattgcggttatggggatcggctctgccctggggatcgccggttatcaacttgtcgaaatttggctaaggaaaaaaggaaatgagctattttcacggaagaaaaactaa

SEQ ID NO: 2468 - DNA, 252 bp, Proteus mirabilis
ttgtttttatttatagatattgttatattagtttctttatttatactgaaaattgaagatgtcttatttaagacacttatatcttttaataagcataatgattttactatagatgttttccctattccattccggccagttatacaaattaaattcctattggaaaaatcgaaatctaataaaacattattaatgtgttgtaatgatttaatgtttagtgatataaacatcacaaatcacctttatttttaa

SEQ ID NO: 2469 - DNA, 243 bp, Proteus mirabilis
ctaattttattattttttatgtcattagcactaacagaactagccccttcaccactagtgaaagtaatattatctggaacaacaatttcacacgttttagcgagaaaaacgactgaaaaattatatttcactgattgcgctgcaactgaagcccaactcgtcaataataaacaaagactaactattaatattgacactttttttgtctgcataattaatcctgaatatattcaaataaaatag

SEQ ID NO: 2470 - DNA, 228 bp, Proteus mirabilis
gcacccatattctcgaatttatcttctaattcgatttcacgggcaacagaaacaccgtctttagtgataacaggtgcaccgaaagatttatctaaaacaacgttacgacctttagggcctaaagttactttaactgcatctgcaagaacattaacaccacgtaacattttattacgagcgtctataccgaatttgacgtctttagctgccatcgtatatttcctttga

SEQ ID NO: 2471 - DNA, 630 bp, Proteus mirabilis
aaaaatgtattgttactttctattggcactatcagtggatattcagtttacgctattggtgcgttagagccgggaaattatagtctagccagagatcattctttgcaatttaatgtagctattagttctggattttcaattgatgctaggccttatttttcagattctagtacaaagataacagtccatacattaaaagcctgcgatgtgacgccacaaacagcaacatcgattaattaccgtagtcaaatagcacaaaattttgctacaccgactaaactcgatgagaatattgccagtataaatgttgattgtccctatgctgggaatgtacatatcacattaagaccgtttaataccttagtcaaaggcagtaatacgggaatggaattaaccggcactaaagcgcaggaaagcggttatgtggtgacttcgctaactagccaacaacaaaatactatttgtgaacctaattccagtgatgcgttaagttatgtcggtagtaataaattagttaatgctatgcccaaagtttttaatcaaacgttatattttaatctttgtgcaaatagtaatattcccgcagatagatactcgggcagtgtcgatgtagcgattttagtcgagtaa

SEQ ID NO: 2472 - DNA, 816 bp, Proteus mirabilis
atgttatcttttttaagaggtagaaaaaaaaatattatccagatagtcatattctgcctattttttctatcttattcagtcacatcgaaagcagttgaaaaaatagaaaacgatactgtggatctaacagatttcgggaaaaatggtttttcttttgtagtaaaaagatatatctatctggaaagtgatataaaaggtatctctatctctttaaaaaataataacaatagtgcttatttaattaatagctctattttatttaatgatgatgataaaaatgtacctatagtgaataaagatcgtgaaagaacaccttttatgattttaccacctttgtatcgtttagaaccctctagtgaatatagctggaatattcgtcgtattagtgaaggttctaatgatatggcgttaccaaaagacagagaaagcttattttggattgcatttagagcagttcctcttaaggatagtaaaattgaggaaaagaaatctgtgtcactaacgataacacctactttctttttcaaattaatttatagacctgagtcaataatggcattggaaaataaagatgttattgatgatgttattgttgaaaaggtaaatgagaacatagttataaataataaatcaccactttatatgacttttgaatatttaaaagtgggcgaggttgaaataaaaaatgatggtagagcaataacggtaaaaccattctctacagtatcagttgaagcacctaaaaatgttcaaggaaagctgagttggagattcaatgatgaaaatttctttataataaaagataaagaatattaa

SEQ ID NO: 2473 - DNA, 1362 bp, Proteus mirabilis
cataacccattgaattcctcgataactgataatgctatggaactgaaaaattgtcctcttattaacgaaattaaacgacaaattggctctcattctcatattttagtgggttttagtggtggagttgattcaaccgttttattgcatgggttggtttgcttacgtgataaatatcaacttcctttagaattaacggcaatttatgttcatcatggattgaactcaaaagccgatgattggctcacgcattgcgaacatttttgtcacaactggcaggtcagttttatcagtgaaagagtacaagtcaatgggaaagaagggggaattgagcagggtgccagagaagcgcgctatcaagcttatcgccaatatttacagcctaatcaagttttagtgacggcacaacatcaagatgatcaagcggaaactttcctattagcgcttaaacgcggtagtggaccggctgggttgtcttcaatgcctgcaaaaatgccttttgaacaagggtatttattacgaccattacttaatatcacacgtgagcaaatcgaagcttatgcacatgagcacggtttattatggattgaggatgatagtaatcaagatgatcgctatgatcgcaatttcttacgtttacatgttatgcctctattgactcagcgctggccacatttttctcaagcagttactcgtagtgccgcactgtgtggtgaacaagaagcgctcttagatgagttactcgatgtagaattgcagcaattgattgatgagcatcagagtttagatatcaatttattgtcccgctgtagcgaaataaaacgtaatgcattgttgcgtcgttggtttgctaaatgtaataaaagcatgccatcaagatctcaattgtcgcggctatggcaagaagttgctttagctaaagcagatgcagagccacggttacgttttttccaagatgaagttaggcgttatcaacaacgcctctatcttgtgccagttatggaagaactaacggatagggttatcgaatggtcattatcacaacctttaattttgcctaatcagttagggatattagcggtgagtcgtgatagcggtaaaacaatctgcagagcaccgttagcagatgaaaaagtgacggttcgttttggcttaacggcttcatctttacgtattgttgggcgagatttggccagatcaagcaagaaaatttggcaagagcttaatattgccccatggcaaagaactcgtatcccattgatttattataacgatacattaattgcagcggttaatacttttgtgactttagagggaaatgcaacaacagaacaaagtataacaattgagtggcaagcgtcgtaa

SEQ ID NO: 2474 - DNA, 825 bp, Proteus mirabilis
atgcaagcattacaatctattattgataacgcctttgaacaacgcgctgaaatcacaccagataatgttgaaccacaggtacgcgatgcaattaataacgttatcgctcaactagacagtggaaaattgcgagttgctgaaaaaattaatggtcagtgggttactcatcaatggctaaaaaaagcggttctactctcttttcgtatcagtcacaatcaagtgatcgacggtagcgaaagccgttattttgataaagtgccaatgaaatttgcaaattacgatcaagctcgttttgaaaaagagggatttcgtgttgtgccacctgctgccgtcagacaaggggcctatattgctcgtaatacagttctaatgccttcttatgtcaatattggtgcttatgtggatgaaggaagtatggtggatacatgggcaaccgttggttcatgtgcgcaaattggtaaaaatgtccatttatccggtggcgttgggatcggtggcgtattagaacctttacaagctaacccaaccattattgaagataactgctttattggagcacgttctgaaattgttgaaggtgtgattgttgaagaaggctctgtcatttcaatgggtgtttatattggacaaagtaccaaaatttatgacagagaaactggcgaaatccattacggtcgtgttcctgctggttcagtggtggtttctggtaatctaccttcaaaagatggtcgttacagtttgtactgtgctgtgattgtaaaaaaagtcgatgctaaaacacgtggaaaagtgggtattaatgaattgttaagaactatcgactaa

SEQ ID NO: 2475 - DNA, 1245 bp, Proteus mirabilis
tccttacaattatatttatgttgtctcctgatggggttccgggatttatttatgccagcttttgatttcagttcaaatttaaaaaagaccgtaaaagtggctttaatggtgctcttcagcacactatttcttatttggctaaaccaaacatcattagagcgcttttggcaacaacaataccatcgcccagccccttggtcgggtttatcacaatattatgcttggcaagtgggaggtcagttgcgagatggcgtatttgtcgcagtaacaagctatagtgattatttgcgagttaatcacccggataatcaggctaaaccaataacgcctcgtcaagaacaaaccgcctttccagaaggatttgcagtagggctacattttatcaatggctatactcgccccgcttcgcaattaacacaacagtttccacaactcctacaacgtcaatatgcacaaggtacattagcaaatgcatcaactattgatctgacaaaagccgctgctgaagcccaaaaacctattgtgcaaaaaacagatgtcatattatctcccaaagacaaagtgctgtttgctggagattcaatgatgcaaggcgttgcccccttattaaaacgtcaattgcaaacagattataatataagcagtattgatttgagcaaacagagcacaggattagcctatcctaagttttttaattggcctcaaactattgctaatcggttagctagcgatgattccattaagttactggttgtttttttagggcctaatgatccttgggacatgcccccagatggtggcggacgttatttaaaatttgccagtgaagcgtggggtaccttatatcgcgcacgtatcgccagcattattgataatgcgcgccaacataatgtgagtgtgatttggattggtcctccgaatatgcgtaagcaaaaattatctcaaggtatggcttatctaaatcaactttaccgggaagaagcagaaaaaacgggagaaatttacctttctgtcaatgatatgtttaaatatgaaaaagatatttattctgattatatcggtgatggtagcagccgcgtgaagctaagagcaggcgacggtattcactttagtttaaaagggcaacaaatcattgctcagcaggtattctcgcgtatccatctgcaaaaagttgatgatgtgccagatgatgtaacagacaaaaatatggtcacgccaaatgaaacaattaacgcacatccttaa

SEQ ID NO: 2476 - DNA, 639 bp, Proteus mirabilis
aatcacaaattactggcagttattcctaattgtcagtttattcaacacagtaggagctttgatatggctgtttcccttgttaaaggtggtaatgtttcgctaactaaagaagcaccaaccatgacggtggctatggttggtttaggatgggatgcccgcgtgacagatggcgctgaatttgatttagatgcgtcagtattcatggtcggtgaagatggaaaagtgctttcagatgcaagttttatcttctttaataataaagtgagccaatgtggtagtgttgaacaccaaggcgataatcgtactggagaaggcgaaggtgatgatgaacaagtcaaaatcactttatccaaagttcctgctgaagtgaaaaaactggtttttgctgtcactatttacgatgctgaaaaccgcaaacaaaactttggtatggtgagcaacagttttatgcgcgtttataataacgacaataacactgaaatagcacgttttgatctttctgaagatgcctctacggagacggggatgatctttggtgaactctatcgtcatggttcagattggaaatttaaagcagtaggccaaggttttgcgggtggtttaggcgcactagccgcacaacatggcgtcaatatttaa

SEQ ID NO: 2477 - DNA, 183 bp, Proteus mirabilis
gcgttttcttcgttgtgtcgaattagtcagggaattgttgatgatgcaatcaaagcatatcgaataagtatttttaaaaacgccattaattggcgttttttatttattgctagctatatagtcacaataagaatgaaatttttgtttaaacctaaaatatggataaaaacggctgttcattaa

SEQ ID NO: 2478 - DNA, 2361 bp, Proteus mirabilis
ccactcctctcggtaggtaaatatattatgaatgaatcattaagccgaattattgcacaagagctatcagtaaagccccagcaagtactttcggccattacgttactggatgaagggaatacggtgccttttgtggcccgttaccgaaaagaggtaactggtgggttagatgatactcagcttcgtcaattggaaacccgcctgagttacttacgggaactcaatgatcgtcgccaaactattttaaaatcaattgaagagcaggggaaactcacagaagaattacgctcttcgattaatgagacgcaaagtaaaacagaacttgaagatctctaccttccttataaaccgaaacgtcgtactcgtgggcaaattgcaattgaaaatggcttagagccattagctgatttgttatggaatgaaccacaacatactcctgaagacgcagcaagtgcatatatcaaccctgaaaaaggaatagatgatagtaaagcagccttagatggggctcgctatatcttaatggaacgctttgcagaagatgctggattattagctaaagttcgccaatatttatggaaaaatgcgcatcttgttagcaaagttgttgacggaaaagaagcagaaggcgctaaatttagcgattattttgatactcatgagccgattgctcatgtaccttctcaccgtgcattagcgatgtttcgtggtcgtaatgaaggtattttgcagttatcacttaatcctgatccacaattcgaagaagcccccaaagagagctatggcgaacagttgattacggagcatttaggtttacgtcttaataatcaacccgcggatagttggcgtaaagccgttgtcagttggacttggcgtataaaagtgttaatgcatcttgaaactgagttaatgggtcagttacgtgagaaagcggaagatgaagccattaatgtgtttgcacgtaacctaaaagatctcttaatggccgcacctgcaggtatgcgagctacgatggggctagatcctggtttacgtactggggttaaagtcgcggtggtggatagtaccggtaagctgattgcgacagatactatttatcctcataccggacaagcggataaagccgctgctagtgtagcggcattatgtattaagcataatgtagaattagtggcgattggtaacggtactgcatcacgtgaaacagagcgcttttttgctgatacagtaaaacgctacccagaagttaaagcacaaaaagtgatcgtgagcgaagcgggggcatcggtttattcggcatcagagctggcagcgaaagaatttccggatctggatgtttctcttcgtggcgctgtttctatcgctcgtcgcttacaagatccattggcggaattggtaaaaattgaccctaaatctatcggggtgggtcaatatcagcatgatgtgagccaaatattattggcaaaaaaattagacactgttgttgaagactgtgtaaatggtgtcggtgttgatttaaatacagcttctgtaccgctattgacgcgagtggcggggcttagccaatctattgctcaaaatattattgcttggcgtgatgaaaatggccgttttgtggatagaaaacagttactcaaagtggcgcgcttagggcctaaagcgtttgagcagtgtgcgggatttttacgtattcgtgatggtaaaaatccacttgatgcctcaacggttcaccctgaagcctatcctattgttgaaaatatcttgcaatcaatacatcaaaaaattgatcaagtcatgggcaatagtgcattactttcacaaatcaatgccagagaatttgttaccgagcagttcggtttacctaccattaatgacatcttaaaggagcttgctaaaccggggcgtgatcctcgacctgagtttaaaacagccacctttgccgaaggtgttgaaacaatgaatgatttagtcagtggtatgatattggaaggtactgtaactaatgtgactaattttggtgcctttgtggatattggggtacaccaagatgggttagtgcatatttcatcactgtcggatagatttgttgaagatccccatactgtggtaaaaaccggcgatattgtgaaggtaaaagtccttgaagtcgatttaccgcgtaaacgtattgcgttaaccatgcgtttagatgaagtggctgctgatagtgatcataaacgccagtcagtgactaaggataatgcttctaaacatagtcgcgggcaaaaaccgaccagaaaccgccaatcaaatacgggtaataatgcaggtaatagtgcgatgagtgatgcattggccgcagcatttggtaaaaaacgctaa

SEQ ID NO: 2479 - DNA, 210 bp, Proteus mirabilis
ttaatatcctcacttttcaacgttaacgcccttcttattctttctcacctatttttatgcattattttcactctttttctgctttgtcataaaactgtcacaattaagacatttaattgtcatctaactgacctattgtctgtgcgtaccgtaaccgaagttgatagatgtcgaaaagttattctacctatcccacaggagggattatga

SEQ ID NO: 2480 - DNA, 855 bp, Proteus mirabilis
ccagcaatatcctgctattgttatcagcatagtgaacatccctgtaaaataagagaagagagcataacaatgaataaattgtattggcagactttaggtgaaggaaaaacgcatcttgtgctgttgcacggatggggcttgaatgctcaggtttggcaatcaatcatcacgcgattaagctcgcattttaccctgcatctggttgatttgccgggatacggcagaagccaaggttttcctgtgctaacgcttaaagagatggctgatattgttttttcacaggcacctgaaaaaaaagccatttggctaggatggtcattagggggattagtggcaagccgtattgcacttgataatcctaataatgtacgggcgttaattaccgttgcctcttccccctgttttgctgctcatgaaacatggccaggaattaagccagacgtgttaaaaggtttcgagcaacaattgagtgataactttcatcgaacggttgagcgctttttagccttgcaaacactcggtactcaaagtgctcgtgaagatactaaggccttgaaagcggtcgtgttggcacaacctttgccttccgttgaaacattaaacggcgggctggaaattttacgtacagaagatttgcgagaacagcttactaccttatgttgtccttttattcggctttatggttatttagatggtttagtgccaagaaaagtcgcagctttattagatgctcgttatcctgactctccttcggttatttttcgccatgccgcacatgctccctttatttctcatccggatgaatttagtgagaccttgttaaagcagtgtgaggccttatcaattttggcatga

SEQ ID NO: 2481 - DNA, 840 bp, Proteus mirabilis
atatggatatcatttatgaaaacagataattatcagattggtattgaaattaatatcaatcatatcaatgccgttttagtatttcagcagaataagcaatggaagatcaatgcattttggcaattccctttacctcttaatgataatatagatgatataaatttaagaactatcttaaaacgatggcaacaatctctaccgccaatcaaccgtattgcattggcattacccgatacagtggcaagttatcataccattgccttatctaacctgatttccctgacaccagcagcctattatcgattagcacaactccgagccacatctcatcaacaagtcaccaaacaagcggtacaattcgattatcggcaacataaccaacatctcgccatccatttacataacaagacactgatagagacttatattgccttattcgccaaaataaacttaaccatcactgcgattgatattccagcttgtgcgttgcgttatgttgccacacatctcaacatatcgcctcacagcatattaattttttgtcaaaataatcaaatgctttgggtttgtgcagataaagagatgccccattacggtactctttcttatcaagaccaccaagagcaagaaaaacaattacagcaattactcatcaagcatcattggccacaggagcaatgttatttctcaggtgacaatgcagaatactttcgccaacaaatgcctatttggccaacccaaaaagagcggctatttatgtctataccgcccaaaaagacgctacctctaattgccattggtttagctttgcgtccttgggagacagcatgtatcaaataa

SEQ ID NO: 2482 - DNA, 675 bp, Proteus mirabilis
agagataaatcacatggcgtgatcgaatataaaacagcactggagattaatatgagctatacattacctgcactcccttatgcttatgatgcgctagaacctcattttgatgagcgcacaatggaaattcaccatactaagcatcatcaaacttatgtgaacaataccaatactgcgttagaaaaactgcctgaattagcgggtttagaaattgatgaactcgttaaaaatttacataaagtacctgctgatcaacgtacctttgtacgtaacaatgcgggtggtcattctaaccatactttcttctggaaaggattaaagctaggcactcaattacatggttcattaaaagatgccattgaacgtgattttggtagtgttgatgcatttaaagagttgtttgaaaaagccgctgctagccgttttggttcaggttgggcatggttagtattaaaagatgatggaaaattagctgttgtttctaccgcaaaccaagatagcccattaatgggtgaagagttagcaggtgcatctggctatccaattattggcttagatgtatgggaacatgcgtattacttgaaatatcaaaaccgtcgtcctgattatatcaaagcattctggtctgtagttaactgggatgaggcgcaaaaacgctatcagagcaaagcataa

SEQ ID NO: 2483 - DNA, 306 bp, Proteus mirabilis
agcatgaaatcacgttggggcattagcacattacttttattcgtcaccacattttcagtccaagcgactacatcacaaacttgtcgggtttactttaaagaagccgataaattcttacaatatattgctacaagagatgacttaaaacagaacatgcctgaaataaaaggtaattttgaacaaaataaaaagttgatcagttcttccaccctaaaagagcaaaaagcaatttgtgaaaaaggaatgcaagagcttgataaccttaacaagatgtttggtccaaaagaagctacagcaaaaaaataa

SEQ ID NO: 2484 - DNA, 324 bp, Proteus mirabilis
ttaatgaaatctaatatgattagtggtcatgttggtatttttttaagaaaagcacgtaaagaaaaaaatatgacaggaaagcagttggcaagattaatgaatgttagccaacaacaaatttcacgatatgaaataggagctactgcaattaccgttgatcaattagcaaattttttattaattttagataaaaaatgggtagatgtatttaaatatcttgaaaatgagttttccgatgagagagaaataaacaaagtcgataataaaaagaaatatattttatggaaaggttgtcaaacaaaaaacttcataaataacttttaa

SEQ ID NO: 2485 - DNA, 1341 bp, Proteus mirabilis
atgaatagatctggctcattatcttcgtttttagaagaggtagaaaaatataacgctcatcaacctgaataccatcaggcggtacgtgaagtttttaccactctgtggccttttttagagaaaaatccacaatatcgtgaacaatcattacttgagcgcttagttgagcctgaacgtattattcagtttcgcgtctgttggttagatgataaaggacaagttcaagttaatcgcgcatggcgagtacaatttaactctgctattggtccctacaaaggtggaatgcgttttcatccatcggtaaacctctctattttaaaatttttaggttttgaacagacctttaaaaatgcactgacaacactgccgatgggaggcgctaaagggggatctgattttaatcccaaggggagaagccacgcagaggtgatgcgtttttgtcaggcgttaatgactgagctctatcgtcatttaggggctgatactgatgtccccgcgggagatattggtgtgggggcaagggaagttggctttatggccggaatgatgaaaaagctctcgaatagcaatgaatgtgtctttacgggtaaaggtttatcatttggtggcagtttgatccgcccagaagccacagggtacggtttagtctattttactaacgcaatgcttaaacgtcacggcatgtcccttgacggaatgcgtgtagccgtttctggtgctggcaatgtggcacaattcaccattgaaaaatgccttgagctgggtgcgaaagtggtcacggcttcagattctggcggaaccgtggtggatgaagctggatttacaaccgaaaaactggctcgcttaactgaaattaaaaataattatggtcgtattgaagagtacgccaaagagtttggtttaacttatcttgaagggcaacagccttgggctgtcgctgttgatattgcgctaccttgtgctacacaaaatgaattagatttagacgccgcaaaagtgttaattaaaaacggtgttaaagctgttgccgaaggcgcaaatatgccaacgaccattgcggcaaccgatgcttttattgaggcgggagtcttgtttgcaccgggtaaagccgctaacgctggaggggtagcaacttcgggattagaaatggcgcaaaacgcagcacgcttgagttggaaagctgagaaagttgatgctcgcttacatcatattatgctggatattcatcacgcttgtgtaaactatggcggtgaaggtaaacaaactaattatattcaaggggccaatattgcaggttttgttaaagttgctgatgcaatgttagcgcaaggcgtgctgtaa

SEQ ID NO: 2486 - DNA, 495 bp, Proteus mirabilis
ttgaatttgttatcctttttttataaacacatattcggtgttaatcaggaatacagtatgattgcgttaatccaaagagtgacacaagcgaaagtcgatattgccggtgtgactgttggcgccattaatcacggcttactcgtgctattaggagtagaaaaagacgataaccaacagaaagcaaaaagattgtgtgaaaaagtgtgtggttatcgtattttcagtgatgaaaatgacaaaatgaatctgaatgtacaacaagcaggtggtagcctattagtcgtatcgcaatttacactcgctgccgaaacccaaaaagggatgagaccgggtttttctaacggtgcgccccctgaaatggctgaaaatttatatcactattttgttgagcagtgtaagcaacaaggtttagaaacccaaacagggcaatttgctgctgatatgcaggtcaccctgactaatgatggcccagtaacattctggttgcaggtctag

SEQ ID NO: 2487 - DNA, 267 bp, Proteus mirabilis
aaaacgtatccccgactggctatcgacctatttggagaaagtaaaatgatcatcccttggcaagaactatcaaccgaaacgctagataacttgattgaaagtttcgttttacgagaagggactgattatggtatgcaagagaaaacgcttgaacaaaaagttgccgacgtaaaaaaacaactcgtctcgggtgaggccgtgttagtgtggtctgagcttcatgaaagcgtcaacattatgccagctgcacagtttcgccctgattga

SEQ ID NO: 2488 - DNA, 258 bp, Proteus mirabilis
actttgcatccaacgttgtgctctgacttgggctgttgtccccggctgctcaccttgctctttataagcccaatgggccgcaacgcccatttcagccatttgatccatatcttcggtacgaatttgtacttcaacagggacaccatgaggaccaatgagcgaagtgtgaagggattgataaccattagctttggggatagcaatatagtctttaacgcggccagggcgaggtttataaaggctatgcatttggcctaa

SEQ ID NO: 2489 - DNA, 201 bp, Proteus mirabilis
ctgactaatcctagatcatgggagataaaaattaaggtggtgtttttagatatcgtgatacgttgcaatagctgtaatatttctctgcgcaagggagcgtctaatgcggtagtaggttcatcagcaattaataaccttggtgataacgccaaagccatggcaatcatcacacgttgtaattgccccccacttaattggtga

SEQ ID NO: 2490 - DNA, 603 bp, Proteus mirabilis
aagcattgtcctttaagttacggtagatatttatataatcacttaaaaacaaaggaaaatacaatgttgaccccaactaaaaattctgcactcgaatacttaaaaagtcatccatctactaaagaatttcatatagaaactattgggcaattttttacttatctcaaagattctattctttcattgtttaatagtgatcataaatttagctatttaggaaagatgtctgttgcagatttcaacttaatgtatattagaaaagacttgcatacttttttaactaatccatttctcaataaatcggaacataaagacaaagtaggcgctcttcagtactcatttgattacttgcagaatcaagctcatattacacctaacctttacaatgtttatcgctctggaaattttgagcctaacgaattgatttcacaattaattaattacggcaataagcttatcaaaaataatttaagcaccgaagaagcacaacatggtaaatatgttatagaaacattaaaagaggtattgaataatttagaaaaattatccaatacagaaaaaatgagactcagaatattaagtatcgttaatgaacggaagtaa

SEQ ID NO: 2491 - DNA, 300 bp, Proteus mirabilis
acggttatgttgtatacttactccgtctctatttaccaaagtgatttggacgcatttttgtctttattgacaaagcatgatgaagttttattaatccaagatggtgtactagccgttcttgaagataatcctttattaatttattgtctggctcagcaaatttctgtttatgcattaattgatgatgttctcgcgcgaggcctaaaagatcaggtttctcatcagattaaacttatcaattatggtgattttgtcgatttaacggtaaaacacccccaacaaattcactggggcgcgtag

SEQ ID NO: 2492 - DNA, 624 bp, Proteus mirabilis
aaaatcatgttacttagtgttctttatattattggtattaccgcagaagccatgacaggggcacttgccgctggtcgccgtaaaatggatgtttttggcgttatcatcattgcatcagccactgctattggtggtggttcagtaagagatattcttcttggtcactaccctttaggttgggtcaaacaccctgagtatattgtcacagtagcttgtgccgcggtgatcactatttgggtcgcccccatgatgaaacacctacgacgcttatttcttattttagactccatcggattgatggttttttctattatcggtgcccaaattgcactcgatatggaatatggtcctattattgctgccattgcagccgtgatcaccggcgcttttggtggcgttttacgtgatatgctgtgtaataccattcccctcgtcttccaaaaagagatctatgcgggtgtcgcatttggcgccgcttggctctacatgggattactgttttacacgccactccctaaagatgtcgtgattattattacgcttgttgccggactcacggctcggctactcgctatccgctataagcttggcttacccgtatttaattatgaaaatcaagattag

SEQ ID NO: 2493 - DNA, 1740 bp, Proteus mirabilis
gtggagctcccactggcgaagaaaaaggccaagctaataggtagggttatgttaaaacgaattaaaatctctcaaggtttaatgtgtgtcctgactctgttttgtattattcaggtaatatctggagtacaaagcattcacgatgcctaccaaactcaaaacaaattaaaacaaatctcatacagtttcgaccagttacgcactatggataacacctacgcggcgttaaatactttacgtactgatattattgcgcaggcgtttagttatattgctgatccacaggtggaagatgccaatattactacattcatacaaacgatggatgcacgtaaggcagaggtggatacgttgatgaatgaatatgtcgaactatctgcacaaactggatttgatcagcaacgcatggctgagatcaaacaactttatcaaaaaagtcgttatgacttagatcttcttgtgcaatatttaaatgaacgtaataccaatgcaattcgtttgatcttaaaaagtccagccaacgataactttactaattcattatatgaagcaacagatttcattactgatgacgttgttaatccgtcagtgattgaagcagaagataactatcacgagatgctatggatagcctccctattcatgggcatattcctgatatttacgacattagtgctcttttggatccgtaaacatattattgtacgtattaaccaaatgattgaatatcaagaggcgattgctagtggagatttaattagtcgcattgaccatgatattacaggccgcaatgaaatagaccaacttatgttgggtttacaacaaatgcgagcgcgcttaaaagaaatggttagcgctatccgtaacagtagtacaacgatttatagtggtgttcaagaaattgccgcaggtaataacgatttatcaagtcgtaccgaagaacaagccagtgctttagaagaaacggcttccagtatggaacagcttaccgcaacagtcagaaataataccgaaagcgcacgtgaagtcactcagttagtcatgagcacagcagatattgccgttcaaggtggtgagcatagcaataagatggtgatgaccatgacagacattgccgatcgttcgcaaaaaattggtgagatcaccgcagtgattgatgatatcgcttttcaaaccaatatattagcactcaatgccgcagtagaagcagccagagccggtgagcaaggacgcggtttttctgtggtagccagtgaggtacgtaatttggcgcaacgtagtgcggaggcggcaaaagagataaaagaactcattgaatcaactattttacgagtaaaacagggtaatgatcttgtcgaacaagtcagcttatctatgggagagatcgtcacatcagttaaccatgtatcaggctcgatgaaagagattttagcagcatcagaagagcaaactcgtggcattgctcagattagccttgcagttaatgaaatggataaagcgacacaacaaaatgccgcgatggtggaacaatctacagcggcttcagcaacactaagtgaacaagcctcaatgttagatatgattgtaaataccttcaaggtagaacaagtcgcggttacatcaccacgatcaccaacattctcggctaagccagctgaaacggaaataacaaaaacagcaacgacatccacaataaaatcccatcatcatgaagccgatgacaattgggaaagtttttaa

SEQ ID NO: 2494 - DNA, 1071 bp, Proteus mirabilis
aaacaataccctacatgtgacttttacttggaacagaaaaaacattgtttatcagcagttaatagctactcaataaaaatgtggagaaagggttttatgaaaaagagtctactcgcagcgttggcgcttacgatgacattgggcatggggaatgctgtagcccaacagttaacgtatcctactaaaaatattgatgtggttatcccaaaaaacccggggggaggtactgatacttctgcacggactatcattgaatttgctaaagatgtgatgccagcagggcgtatctttgtaccggttaataaacccgcaggtaatggtttaactgggttaattgaagtggcaaatgcgcgtcctgatggcactaaattagtcatgacgacggttgaattagcgatgttcccacatcaaggtaagtcacccgtgacctataaagactttaccccgattgcgacaacgattgctgatccggttgtgctcgtggtgaatgctaattcgccttataaaacattggaagaatttattgccggggcaaaagcgaaccccggtaaattaaagattggtaactcaggtatgggggctatttatcacctcgcgggggtgaatatcgaacgtactacgggaactaagtttaatcatattccttataacgaaggtacaggcccctctattgcggcattagtgggcgatcatatcgatggcgtattaaccacacccggtgcggttaaatcacaagttgatgcgggtattttgcgcattctcggtgtgatggatgaacgtcgcttcccacttattccggatgttccaacctttaaagaagccttaaatctcgataccaacgtgaaaatgcgcgcatgggctgtattagccacaacagcaggtgtgcctgataacgttaaaaatgagttagtgggggcattttcagaagtggtgcaaaaaccagaatatcaagaagcattgaaaaaacaaggtattatgccagtatttatcgtcggtgacgatgcgtatcaaatgatgaaagaagatcatgagatgtatgctgaattaatctcagccaccctaaaaaaataa

SEQ ID NO: 2495 - DNA, 963 bp, Proteus mirabilis
atgaaaacgttccatttatcattggggataggacttatcgctatcctctcaatgatcagtctatttatcggcgcaggagatatcactcctgcttcgctttttactgatcccgatatgcgcgatatcttctttattagtcgcgtaccaagaaccctgtcattattacttgctgggggcgcaattagtgttgctggtttaatcatgcaactgctcacgcaaaaccgctttgttgagccttctcttgcaggtacaacacaatcagccagtctcggtttattagtcgtgatgttgcttttccccgcggcaggcattttcaccaaaatgatggtagccactgtttttgcacttttaggcactgtgttatttatgttgttgctacagagaattgccttaaagaccgcattaatcgtgccacttgtcggtattatgctaagtgcagtgataggtgctctaaccatctttcttgccgtctattttgatttactacaatcactagatgcgtggactagcggagacttctccagtgtcttacaaggtcgttatgagctgctatggcttgtcggtgcccttgcattaatggcgtgttgggtcgcggatagctttaccgtggcaggtatgggacgtgagttttccatcaacgttggacttaactatcgtaaagtgatgattatcggtttatctattatcgctttaattagtggtgtggtggtgtctgttgttggtgctttacctttccttggtttgatcgtgccaaatttagttagcctagtgatgggagataatattcgcaaaaccatcccgtgggtatgcttaagcggtggagccattgttttactctgtgatgtgattggtcgcctgatccgttatccatttgagatccccgcaagtgtcattttaggggcggtaggtgctgtgatcttccttttcttactactgaagcagcaacgttatgcaaaaagttaa

SEQ ID NO: 2496 - DNA, 198 bp, Proteus mirabilis
ttggacaagtttttaacaagtgctaatctatttatatgtatatcaacacctcataaaaatgaggtgttttatattatctgtaagatctttacctatttctttattcgacttttcttattatttagtgaaatacatgaatggcttttactaaataattcgtttgttctttcatttctccggaaattgatgacgctttag

SEQ ID NO: 2497 - DNA, 1878 bp, Proteus mirabilis
agggggaacacgcggatggaaggtaattggatgataaaagccgtgctgtttttcttatgtgctgccgtgattatggtccccatcgcacaacgcttaaaaattggtgcggtattaggctatttaattgctggtattgcgattggcccttggggattagggttatttaaagatgttgattacatcttacacttttctgaattaggggttgtttttttaatgttcctgattgggctggagttaaatccagctaagctttgggagttacggcgagcaatatttggtgtcggcgccatgcaggttgtctttactgcatctgttatcacagggctacttttactcttaacttctttttcgtggcaagcagcattgattggtggcctaggtatcgccatgtcatcaactgcgatggctttacaattgatgaatgaaaaaggaatgaatcataacgaaggagggcagttgggttttgcggttttactctttcaagatatggccgttattcctattcttgcggtgatccctttacttgctggcgaaacagccagtagtgattggtatcgtattgccctaaaaatagtctcattcgctgcattattaatttgtggccgctatttattgcgcccactatttcgcttaattgttaaatcgggtgtgagagaagtttttaccgccggtgcgctattagtggtattaggatcagcactctttatggaaatgattggcttttccatggcgatgggaacttttattgcaggggtattattagctgactctgaatatcgtcatgaattagaaatctcgattgaaccttttaaaggcttattgctagggttgttttttatctccgtcggcatgtccctcgatataggtatattgtggcgttatttaccgcaagtgttactgggcgttgttattttagtcttgattaaagggttggtactttatggtatcgcttggttagcgagattacgcttttcgacacgtttgcaattttcagccgtattaagccaaggcggtgaatttgcttttgtcgtcttttctacctctatggcgatgggggtattaaatagtgaacagatggcattgcttttggttgtcgtaacgctttcaatgatgactacgccacttgtgatgcaaatgacagacgccgtgttatcgcgccgttataatgatgcaaagatagacgaagagccttttgttgaaaataaccatccagaagtgatcctggtgggctttggtcgtatggggcaggtagtcgggcgcctacttatggcaaataaagtcaacgtgaccgtattagagcatgacgttggtagtttaagtaccatgcgtaaatatggttataaagtttattatggcgatgcgacagacttgaatttattacgtgctgcgggggctgaacacgcgaaagccattgtgatcaccagtaatgagcctgaagcgacaatggaaattgtccatttatgccagcgccattttcctcaattacaaattattgcgagagcaagaggacgggttgaagcacatgagctgttaaaagcaggggtaacagagtttagtcgagaaaccttctcgagtgctttagagctaggacgtaaaactttaattgaacttggtatgcatccacatcaggcctatcgtgcacaacagcattttcgtcgtctagatatgcagttattaagaaagttggtggacgaatcacccgaagaagtctcgaatgtttcacgtgttaaagaggctcgtcgtgaattagaagagctgtttaatgaagagatgagacaagagcaccaccagcctgatatttgggacgaatcgttaactgatgctatccctcaagtaaatagagaaaaaagacccattgataaacaggagaactga

SEQ ID NO: 2498 - DNA, 903 bp, Proteus mirabilis
cgattacggttgttgttactgcatttaacttttggggcgattttttacgcgatgtgttcgaccccgataatcgtcaatcagtcggggataaatatgaacaatttactgacgcttaatcaagtctcaatctatgatcctcacagcgaaaaaaagcgggtagataatctctcctttagccttaaacaggggcgaacgttagctattgtcggtgagagtggtagtggtaaaagcttaatcagtaaagccattattggcttacttccaagtacacttgcactatcgggagaaattttttttgatgaaaagccccttcatttatattcagagcaacaacggcgtgccctattagggacatcgctaggtatgattgtgcaaaacggcatgagtgcttttgatccgttgataaaaataggcaagcaagttagccaaactttaatttaccatttttcttatactaaattgcaagcattcaatgccactaaacaagcattggatgaggtgtttgagcatcaatctttaatgattatgcaggcatttcctcaccaattaagtggggggcaattacaacgtgtgatgattgccatggctttggcgttatcaccaaggttattaattgctgatgaacctactaccgcattagacgctcccttgcgcagagaaatattacagctattgcaacgtatcacgatatctaaaaacaccaccttaatttttatctcccatgatctaggattagtcagtcagattgctgatgatattttagtgatgaaagagggaaaattaatcgagtttggtgacaaaaacagcgtattagatacacctaagcaagcctatacccgttatttaattgaggctagagctaagctttcccaacgttttgcacaggtgctttatgctcggtga

SEQ ID NO: 2499 - DNA, 786 bp, Proteus mirabilis
aaaagtaggtttaatgtgagaaatgtgccgttagaaagtgttgatctccttgagagagatgtgattgcgctgggtacagattatctgcctaatacgctattagaaacgcatcgacatcgacgagcgcaatttttatatcccgctaccggattgattgaagtgagcacaaatgatggggaatgggttatccctccctcttgtggtgtgtggatccctcctcaaacggggcatgaaacacgcatgttagatgtgagtaccagaagtttatatattgagccagcggctgctcctcgtcagagtcaacagtgtgaagtgttaagagtgtcaccgcttttacgtcaattacttcttgaagccgttgatgtgcctgcgcaatatgataaaaaagggcgcgatggtattttaatgcaacttatcttatatgagttagcgaaagccgaacctttgcctttctttgttcctattccacaggacagtaaattagctaaattatgtcgcgattttattcgtcagcccaaaattgacgctctacctcagcagtgggccgagaaattacataaaagtgaacgctcgtttagccgttttttccgccaacagacgggaatggcattttcacaatggcgtcagcaagtctgtcttttaaactcactcacgcaaattttatcagggcatagcattaccgctgtggcttttgatttgggctataacagcgctagctctttttctactatgtttaaaaagcagatgggacaatcaccttctgattttgtgagaaacgcgccataa

SEQ ID NO: 2500 - DNA, 366 bp, Proteus mirabilis
aggtgtttaaccctaacggctttttataggtgctctatgagatccataatcattaacaagttaatactagcgacgtttatgctatcactgacagggtgctcaagtgttatgacgcatgcaggccctaataacgagctttattcaggaacaaaaaataacgttaatatgctttctgatgatgaaacagggtgggcaatgaaaccgttagttattcttgatcttccttttagtgcgttattagatactttattgcttccttatgattattatacacaacatgatgacaacagtgataattcacctaaagaaaggataaaaaaattaggtagcactaatgatacacttaatactggaaataaaacctaa

SEQ ID NO: 2501 - DNA, 981 bp, Proteus mirabilis
tttaagaggttacttcaatatggcactgatccggtgccatattggttaaagcagatgttacgttatctatgttggcgcctattggcgatattgccactagtgttgattatttcgtttattgcctttgttttgctgaatttagcaccgtctgatccggcagaagtggctttgcgtgttaacgaaattgtaccgacgcccgaagcgattgaaggtatgcgccgtgagcttggtttagataagccttttttcacacgctactttttatggcttttagcgggatttcaactggattttggcacctcttttttgacccgaaaaccggtgatacaagagatgttaactgctctcccccccacgctttggttagcggctaccgcattattatttacgcttattatcgcgttgcctttagccttatggtgtgtggcaaaaccacatagcttgatagacaaaagtattcggctgattgtttttgtgttaaccgcaattcctaattattggttagggttgttgttaatttgggcggtggcggttcatttagattggttacctgtcagtggtatgttgacaccacaatcggtcattttaccggcatttgcactctctttaggttatatcggcacttatttacgtttgttacggggcgcaatgcttaatcaatggcatcagccttatgtattttatgcccgaacaagaggattacctgataagctgattttgcgtcgccatatattacgtaattcactcgcttctgcgctgacggcgctaggaatgagtattccgaaacttatcgcgggcacggtcgtgatcgagaatatttttgcatggcctggggtggggcgactgtgtattagtgccatatttggacgcgattatccgatgatacaagcttatattttaatgatgtcattgttatttctcttttttaactttctgatagatatcattcagatgaaagtcgatcctcgtctaaggcggtaa

SEQ ID NO: 2502 - DNA, 351 bp, Proteus mirabilis
cccagccaaacagaaaaacaactgggtacaggcaaattatttgtcattatgctcatttctgcgctatttagtaattgggcacaatcactgtttgcaggatccaactttggtggactttctggtgttgtttacgcgctaattagctatgttggcttaacaggtttgcgggctccagaaaaagggatcggtgttcctaccggcttaaattgttttttccatatatggataatcgcgggttatatgggcgttttaggtgattctatcggaaatgctgcacattttgccggcttccttatcggcttattgatggctttgtgggataatcgacatcaattatctcgtcaatcataa

SEQ ID NO: 2503 - DNA, 735 bp, Proteus mirabilis
ttgttggaaacaataataaggtattttatgtatggaataacaaaagcacgccaattagcactattttcactaacaaatattaataaatttaatcatgataaaagtaacgctgaaataatttttaaaaatctcacattcgatattaataatgagcattttacattaataaaatatcaacaagagaatgaaaagaatgcattgattgatattatttcaggagttgatattcaatatgctggttatacttattttttaggtaattatataaatattctagatgaaaagcagcgagctttattaaggaatagaatgatcggttttgttttcaaagaaaattacttttttaatcattgtaatgtatttgataatatttattattcagtagtcgatcataaagataaaaaaaagctaaagaataatattataaatacacttaaatctatgggcatagagaaactctataataaaaccccaaaatcgttatcaacagatcaattgctaaaggttgcctttagcagagctttagtgaaaaaacctaagtgtatcattgctaattataataatgattgtttcagtcagaataactttgattattttattcaattattatcacaagtacataaagatttatctataccaatattattaatcactaattgtaatcatctaaacatgactgtagataaaattataacgattaaacatggagagttatatgatggggagaaaacttaa

SEQ ID NO: 2504 - DNA, 2247 bp, Proteus mirabilis
ttcaggtatgctagtgaaggtggaaatagaggtgaaagaagagaaatggcgacgatcaaggacattgcaaaactagcgggtgtttcgcatggtacggtatctaacgtattgaataaacgtggaaatgtaagtgttgaaaaaattgaagcagtctatcaagctgctaaacagatgggctatcaattaaatacacaagcccaactactaagaaccaatagaagccataaaattgcgatcttattaccccaactggtttctgaaaaatatgcgatcttctttaatgcttttagacagtcgatcgttaattttccagagatcagctacgatctttttttaacagatcttcttgagaccactgagcgtgatctactacaaaaaattgctgcaggtggctataagcaagtagtcaccgtaagttgtcttaaagatgctaaatactattttgacacgttaaaacttccaccttcacaaattatctttatttatcataaacccctcaatgcacaacgtttttttacgttagattttgcacaagcggcggagtcaatttgccagcaagtggcacaaacagctggcaaggtagtggggatttttggcgataatcaagatgaattaaatagtcaggtttttgctaatcaattgcaaatacggctttctcaaactgcacccgataaaaaatgtgtcatacttagcgcttctgatgaagagagttataaaattgcttttgatttcttttctatggagcaagtccccgatatctttgtcacacaagatattgagaaagctcgctatttaacacaagcaagctattttggcagttcttcagattgtcctattatctttgctctaagtgataatattccgccggtaataaaagggttatattgttttccaatgaactatgctcagcttggtttggaagtcgctgaggcactattaatcgcagagccgcatgagtacaaaaataataatgtatctgtcgcaaatcgaagttcatatctgtatacggcaacaccagcagtaatgagtgatgataaatcacaaattagtcttaatttactaacgttgccaagcccttcaacaacggcattaaaaaaactacttcctcatttttatcgtcaaactggtatcaaggtgaatttagctattcatccttatgatgaagtctatcaaattttaagccaacttcatttacacccttattatgatctgttgcgtattgatatggcgtgttttccatggtttgctgagcgaatattgcgaccattagataaaattggtgatggattaactgatttattgagtcacttttccttacctacgcaacaaaaatttggtttggttaatgatgtcgcttatgcaatgccgttcgatgctagcgctcaattactgttttatcgtaaagatctgtttgaagatactattttaaaaagaatgtattacgaaaaaacaggtaatgaattaactgtgccgacaacctttgaagagtacgataatgtgactcagttttttactgagttgcatcaagccgggcaagctcattgtccgatgggagcttcaaccacattaggaagtgcgggattaatcgcaactgaatacttattacgttattacgctaaaggtgggcgtttaatcggtagtgataatattccgcgcttagcgatgcccttggccgctgaggtattagcagattatttgcatcagttgtcgatcaccgaaaatatcaaccataaatggtggagtggctctgtcagacaatttgagcaaggtcatctggcaatgcttatctcttatatgaatttatttaatgatgtcgcacatagcgatattttacctaaaattggttttgctcccgttccgggtggtgtaccacaattagggggtggggtacttggggtgtcgcgttacagtagaaaatcatcttacgctgaactgttttatcgttggctttattctcctgttgtgatggatcacttaattttattgggtggaaatagtaaccatgaaaattttagtcataaccaagaaattagccaccgttatccatggatgacactagcttatcaggaaattaatcaaggaatacgagaatcatcagtgccgaatggtaaattatttaacttaaggcaagctgagattattattggtcagggtattactaatgtgattaatcatattatgacaatagaagaaacgattgattatattaatcaacgtctattgattgatactcagggtgaacgatga

SEQ ID NO: 2505 - DNA, 387 bp, Proteus mirabilis
tcgtgtggtgcagttttaatgaagaaaatgaattctgtggcgtttatctttactcaggcacctcatggtaatagtgctgggcgtgaaggtttagatgcgctattagcaacttccgccttaaccgaaaatataggtgttttttttctttctgatggcgtgttccaattactggaaaatcaacagcctgaaggcgttctttctcgtcatcatgcagctacatttaaagtcctccccttgtatgatgtgacaaacgtctatatatcacaagaagatctagctcatcgtggtttatcgtcacaaacaatgtttattcttgacgccaaggttataacagctcaagagattgctcagaaactgagtcactatgacgtggtattacgtttttaa

SEQ ID NO: 2506 - DNA, 963 bp, Proteus mirabilis
tattactatttaggagtatggtctatgccattgagagagaaaaagtatcaccaaaatcaagagagcattttattttttccaggtcagggtaggccttatttaggtatgggaaatagggtatatcgtgacgttccatcaataaaagaagtatggaattgtgcgagtgaaatagcagggttcgatgtaaggactgtttgtttaaaagggcccatgaataaattggtacaaacctgttatcagcaagtggcgttaacaactatcaatattgcttctctttatttactgcgtgagcattgttgtgtgaatgaggcgggttattcagggcacagcgctggagaatattcagcgttatttgcggcgaacgtactggaacttgaatctgtctttaagttaattagttatcgcgcatctatcatgcaacagctcgctaagaataacaaaggggtaatgtatgttgttaaaaattgctcttatcagacgttatcaacattgattgaccagcaagatctcgcaacaaaggtgaatatttgctgtgataacagtgaacttcaccaagttattgggggggagtatgcaagtgtacgtaaggttgttaatcaattagctaatatgaaaatagaaacgaataaattagccgttaatggtgcttggcacactgaattgatgagcgaagggaaaaatttacttgctcactttttacagacaatccctttttcaatcccagataaacccctagtgatgaatgtttctgctgagattgttagcgatattgagacaattaaacagaatttagttaatcaactcacagaaaccgtaagatggacagcaactatggcgctatggtgtcatttaggctatcacaattttattgaacttggtgatagcaagtcattgtattatttagcgaaaaattcacatacgctaaaagataaaaatatattgcatgttaatgattatatttaa

SEQ ID NO: 2507 - DNA, 201 bp, Proteus mirabilis
aaaaaatattttcttttttttttaaaagaccttaaacaatctttaatattaagcattattgctattttttttgtcctttatagtgttttgattgttcggttttttccctatttctatggtcgaatactattagtatcatttgtgattatttgcttaatattttcctttcttcctataaagaaagaagaaaagagaaaataa

SEQ ID NO: 2508 - DNA, 318 bp, Proteus mirabilis
tactggttagctcaacgtatcgctacgcttacacacccagcctatcaacgtcttagtcttaaacgttcctttaggtcgcttaaagcgacagggaagactcatctcgaggcaagtttcccgcttagatgctttcagcggttatctcttccgcacttagctaccgggcaatgccattggcatgacaacccgaacaccagtggggcgttcactccggtcctcttgtactatgagcaaccccctttaatctttcaaaccccacggcagaaagggaccgaactgccttacgacgtttttaaccccaattgggtacccatttaa

SEQ ID NO: 2509 - DNA, 2781 bp, Proteus mirabilis
gagcgcaaagcgcgtcagatggtgaaggcggtaaacgaagcgagcccacgaaacttaccggccgacgcggtggtatgcccatgtgaaaatgaacatcgccctgtttatccggtgcgttatgcatataccaacttttattgtgatttacatttttctacaattgaacaagcaccaaataaaacgttagaagcgagtattcctccttctattaatcaattattgaatgcgaaagatgttactgctagtaaaggattttctgcaagattattaagacaaggttgggtttatgtttttgaagaaggcaattaccctactagaagtaattctagtaataaaagttatcaagaacaaaatgttgatgcgacaaaaggacgcctattagtttttcaacatcaagttacaaccagtgatggcaatgaaaatttcattccatatatatttaagcaattaaaaaatgggggtgtcactttaaagaaaaacggaaatagtaatccttatttagctataccgaaagatgtgaaggaagcgactatcttattcagcgaaagtaaattatctgattacacacttaaaaaaatcatttcatcttctaagtttagatcgaaattaatgcaaaaaatcaattttattgattacaacaataacgattattgtattgagctaaataaagataatttaaatcgacttgttgaggattataaagaagaagttgataaatttaagctatttgttaaagaattcacgcattcaaatataccctcttcttttttttctgataccacaaaaatacccgacttaccacaagatgcaactgttttgattaatcaaataaatagtgttctagattataatgaaaaagcgacattgcttattttaaaagatcccgtaggataccaaaaagatgttttatcttattataatattgtaacaaaattacatttattatatcagaactattatagccatccggataaaattggccaatttattacgagtatacaagaagctagtcatcacattaaagatactgatgaaaaagaaaaaatgcaaacaatactaaaagagagtattaatcagaatgcattagataatgagtggaaaaatattcataaaacatttattttttttgagaaacatcaacgtattgtattatcattgtatgaaagctttatgaataatccggcaatcattaatgaaaacggtggcttaaaacattattttgattatgctttttcatatcacgaacgtataacgaaagaagatgtctttagtattgatttttttaaggaccttaatcaagcttttgatttatattttgatttaatatctccattaatgaattctaccgaaggacaaagaacattagataaattatattcaattaatgatgaagaaaataatagcctgtgggtgggagtgacaaagaaagtaattagtcttgttgctaattcaaaaattatggacgcacttttaaatgcacaagaatatgcagagaatatcgaaaattttgttaataagcttgcgtttatttgctcagatagcattggttttgcatttacaaaaacaagtaagatgctttctcattacgatattaaaaatagactaattaatactaagggtattgactatttagctcaaaagatacttgcgatgatactggcattctgcaacacaaaaatttcattaaccgagtttgttaaattatcgggtaatgagcttaaccagtgggtggaacaactccgtaaattaacggaacaaatagtaccaaatctgcaacatcctaaattaaataagcttttttcttggaaacaaaaaataataaatctaggcgaagagactgccattcttattccgaagattgagatcacagatattactaaaaataagatttatatttatggtaaagatgcattacaggtttccactaagctatttttaaacggtttcagcatgataaccggatcaatccaagcttatacattacaaggcatgagcttatatgaacgtaatgacccattaaaactatccccctataatctgtatacagcacagattattgcgaatttatttgtagcaagctacagtattttaaaagtctctcaagaggcgacaaaattatctcaaacagtatcgagcaccacactgaaattctttttagataaaataaaattacctatgctaacaacagaagtgggaaccaaaagaatggcagcattaggtaagattgcaggtggcgtaggggtattacttgcactccgcgacatgtcagaggcatttcatatcggaaatagggctcaagggatgtcaaatttggttattgcattaggttcaataatcttaatatgggcaactggaggatgggctttatttgctggggcacttattttggggggagttatttctagtcaactcaccagttggagtcatttggaaactttgctaaaacacagcttttggggaaatgaagaaagttctaatttttgggataatgatagaccaacaccgatagaagaacaattaaaacaatatataaaagaatttgaattctatgaacaaaaagggctaattgaattacaagagttttataatcttttttatacggctaaaatgactcaagaaaaaataccaaatggaaaactccgcttatcttttgaatttactaattttatcccagggatttcagaggtatattttcattttgttacacaggttggttatcacactggtttggccgaagaaatcaaaacacctagttcagcttatgttctaaataaacgataa

SEQ ID NO: 2510 - DNA, 576 bp, Proteus mirabilis
atgaatttggcggggcgggttatcattaacgaatatcttagtaataccaaaaacatggcagagaaacgtaatatctttctggttgggcctatgggtgccggcaaaagcactattggtcgtcagttagctcaacaacttagtatggaattttatgattccgatcaggaaattgagcgacgtacaggtgcagatgtaggttgggtatttgatgtagaaggcgaagaaggcttccgtcaacgtgaagaaaaaataatcaacgaacttactgaaaagcaaggcattgtactggcaacaggtggtggttcggtgaaatcaagagaaacccgtaaccgactatcagcacgcggtgttgttgtttatttagaaaccaacattgaaaaacaacttgctcgtactcagcgagataaaaaacgtcctttattgcaaggtgttgaacccgtacgtgatgtactggaaaccctcgcagaagaacgtaatcctctttacgaagagattgctgatatcaccattcatactgatgatcagagtgcaaaaatcgttgcaaatcaaattattgaattattagagaaaaactaa

SEQ ID NO: 2511 - DNA, 777 bp, Proteus mirabilis
atgactatggctaatgataacgctggaaacaaaatccaagttcgtgacttgaacttctactatggtaagttccatgcgctgaaaaatatctcattagatattgccaaaaataaagtaacggcatttatcggcccttctggctgtggtaaatccactttactgcgtacttttaataaaatgtatgagctttatggcgaacagcgtgctgaaggtgaaatcttgttagatggcaacaatattctgacagataagcaagatattgcgctattacgcgcaaaagtaggcatggtattccaaaaacctacaccatttccaatgtcgatttatgacaatatcgcttttggtgtacgcttatttgaaaaactgtctcgcgctgaaatggacgaacgcgttcagtgggcgctgaccaaagccgcattatggaatgaaaccaaagataaattacatcaaagtggctatagtctttctgggggacagcagcaacgtttatgtatcgcacgcggtattgctatccgtcctgaagtattattactggatgagccatgctctgcactcgatcctatctctacaggtcgtattgaagagcttatcagtgaactaaaatccgaatataccgtggtgatcgtcacccacaatatgcagcaagctgcacgttgttctgattacactgcatttatgtatttgggtgaattaatcgagttcagtgatacggatacattatttactcgtccagcgaagaagcaaactgaagattacatcactgggcgttatggctga

SEQ ID NO: 2512 - DNA, 489 bp, Proteus mirabilis
gcggtaatggcaatgaatggaacaatcacaaaatggtttgaagataaaggttttggatttatcaaagatgaaaatggggataatcgctattttcatgtgattaaggttgccaaccctgatcttattaaaaaagatgcaatagtcacgtttgaacccacgaccaatatgaaggggttatcagcctatgcagtaaaagtgatcccagacagtaaatatatctttattgccggagagcgcgttaagttaacgtcaattaagtcttatcgtgtttatagcgaacaagtacccgttaaaacgcatattgataaagaaaatacaatattatcggttggtatgctaatgaacagtattaagcctaaatctgagtcggcagcagatcaaacgcgtactttgaaaaaaattgatatcattacttatcacggcaaagtattaacctttactgatgatgaagtcgatattgatgcaacagtcaaagtgattaaggcttaa

SEQ ID NO: 2513 - DNA, 375 bp, Proteus mirabilis
ccccaattttataaggatataaaaatgtcaaaatcattgctggggttgctatttgcctcgttgttattggttgggtgccaagcgccaaagcctctttataactgggatagttatcaaacggtggtatatcaatattatcaacaaagtgaaagtgatcctcatgcgcaaatcgatgcattgaaaaaaagcatcgaggttgcccgagcaaaatcattaggcgttccaccggggttacatgcacatttgggcatgttatatgtgaccactggcgcattagacttagccatgagtgagtttgatcaggagaaaactctttatcctgaatcagcaaagtttatggattttctgatgaaaaataagggagcacaaaaatga

SEQ ID NO: 2514 - DNA, 2430 bp, Proteus mirabilis
ggtagcatttatatgagcaatcagtccgatcatcatagtattaagccaatttccggtgatataagtcgtcgccattttattcaagcgagttcggcattagtcacactgccctttttttcctccaacacgatggcagcaacacaagatcatgcaatagctgaaaaaacgattgacgccaaagagagtgagcgtgttgtctctacctgtagtagttttgactgtggcggaaaatgtgatattcgcgcgcacgttaaagatggcaaagtgacacgtattagcactcgacctgacgccgatttagatgaagagatgcctatcatgcgagcctgtgtacggggtcgtggttatcgtaaatttgtctatcatcctgatcgattaaaatatcccatgaagcgagtaggtaagcgtggtgaaggtcgatttgagcgcatcacttgggaagaagctacgacgcttattgcacaaaatatgcaacgcattaccaagcaatatggccctgcctcacgttttgtcagtttaagcaccggggtgactggtggcattttttctggtgctaatatgctacgccgtctgtttaacctaactggcggctttctggagaattatcactccgtgagtaatggtaacacccttgccgttaccccttatacttacggtacagccgctagcggaagtacattagatacattagcaaatacccctttagttattctatggggacataatcctaatgaaactatttttgggcattccaatcattacttccaaaaaatgaaaaagaacggcactaaatttattgtcgttgatccacgctattccgatactgcctcttctttagctgaccagtggatcccgctgttacctaccactgataacgcgatgatggatgccatgatgtatgtcattgtcagtgaaaacctgcatgatcaggcctttatcgacaaatacacccttggtttcgatgagcatcagatgccagaaggcgttggtgaaaatgagtctttagttgcctatttaatggggaaaaaagacgggatcaagaaaacccctgaatgggcggagcctatcactaaagtacccgcagatactattcgtcaattagcccgtgaatatgcttctacaaaaccggcagcattaatccaaggttggggaccacaacgtcatatttgtggtgaacggacggcacgcggtgcgacactgttagcgactattaccggcaacgttggtgtacgcggtggctgggcggcaggctatggcatggcattaaactctgagttacgtaaaaccattgccggcccaagtttattgaccaatcccgttaaagcaaaaatcaatatcaccaattgggtgcaagcgtgcgaagataaaaatttggtcacaccacaaaatggcttactcaatgccgagaaacttgatactgaaatcaagatgattttctcaatggcgggtaattatatggtgaatcaaaataccgatattcttcatgccgctaaagtgcttgaagatgaatcaaaagttgaatttatcgtctgtagcgacctctatttaacacctagcgccaaatatgcggatatcttactgcctgaaaccagctttttagagcgctggaatattggaggcacatggagttatggcgattatattattctgtccgaaaaagtgatagagccagagtttgaacgtcgtaccgactacgattggttacgtgaagtggctgataaactgggggtcggtgaacaatttagcgaaggtaaagccactgatcgcgactggattgaatatttagtcaatgatgccagtattaaacgtcctgaagatggtattcctacctttgatgaattattggttaaacgtcgtcatctgctaaaacatcgccctcatacccaaaatgttgcgtttgagaaaaatattcaagatatagaaaataatccatttccaaccccatcaggaaagattgagatcttctctaaacgcttatatgagatgaataatagcgagatccccgcactttctcattatgtgcctgccattgaagggcccgaagatacgttaacagataaatttccactacaactcatcacgtggaaaggacgtaaccgcgcaaactcaacacaatttgctaatccttggctgcaagaagtacaacgtcaagaattatggatcaacccattagatgccgaagatagaaatatcaaacaaggcgataaagtcaaagtctataacgaccgtgggatcaccttagttcccgtcaaactcacacaacgcattatgcctggtgtcgttgccttacaagcaggtgcttggtggcaaccagataaacaaggtatcgatcaagggggatgtgccaacgtcttaacctcatcccgtagcaccgctatggcacacggtaatgctcaccaaactttattggtcgaggtagtaaaagcatga

SEQ ID NO: 2515 - DNA, 768 bp, Proteus mirabilis
attaaaatttatcttattttattgttcgtcataggatttgcacaacaaaaatcaatgacgataggtttatttcaccgatattggatgatgaaaatgacatttaataaattatcattaggggtagttttactttctgcttcattactatcaggttgtgcctcagaatcttctcgctctttagaggttgctaaagtggctacctataatacgacttactcaggacctaagagtgccattgctattggtaagtttgataaccgttctaattacatgaatggtattttttctgatggtgtggatagattgggtaatcaatctaaaacgattttaattacacatttacaacaaacaggccgttttaatgttttagatcgcgctaacttaacggagttaacacaagaagcgaagattaaaggccaaagtcagcaattaaaaggcgcaacttacgttattactggtgatgtgacagagtttggtcgcaaagaagtaggtgatcgccaactatttggtatcttaggacgtggaaaaacccaagttgcttatgccaaagtgaacttaaatgttgtgaatgtgaatacctctgaagtggtgttctctacgcaaggtgcgggggaatatgagctttctaatcgtgagattgttggttttggtggcacagcaagttatgactcaacacttaatggtaaagtgcttgatttagccattcgtgaagcggtgaataatttagttgcagggattgaaagccatgcttggcagcctgagcagtaa

SEQ ID NO: 2516 - DNA, 2220 bp, Proteus mirabilis
gggctcgtttaccgttttagtctcctacttcccgtgaaggattattggatgtctataacaaattcaaaaaaatatcaaaggctgggtgataaggatggcaacccactgaatgggggtaagacattaacccatggcgggggcagaacatacgcgcaagatctcgctttacaagagcaacatagacaacttatagagaagatcttaagtggcgacatgcaaagtggcttagtgtttacttgtcagattggtggattacccgaagagactttccaagtcacgcaattcgatttacaagaagggatctcacaacttttcactctctccatccaagccgtcagtccactctcggaaattgattttaatgatgtgttaggcatggcttccagtttgacagtaaagcgagatggtcacattctgcgtacagtacaaggtatcttagcggcggcagagcaagggaataccgatggggtaaaaacctggtatcaatttgtgatacgtcctgaaatgtgggtaatgaccctcaaacaagatagtcgtatttttcaagataccaccgttcctcatattcttgagacattactcaatgagtctcacattaaatatgataaacagctttatcacccagaagagcatttgcagcgcgcctataccactcaaaaacgagaaacaatgtatgacttttggtgccgtttagccgcagaagaagggattaatttttggtttgaagaaggcccacagttattttatagcgaccgacatttgggcatgagagcggggatatccttaacctataacccacaatcggatacagatatcaccgatagcaccgccacaacgtggcgctatgttgaacaactctgtagcgatattcgcgttgataaagattacaatcaacttagaccttcctaccccttaagccatcaagtcacaggagaggttcatcaacaacatgaaatatttgaaagttatggacgctttgaagaagatgcacagggacaaccctttaatcagatacgttatgaacaatcacaaaatcagcgtcaagtaggctctgcgaccacaaactgcattgaattagcgccggggcgtatttttaccttgtctaaccaccccagtgcacgcatgaacaccacatggcaggtgattagtatctcacatcacggtgtgcaacctcttgccgacaacagtggcggtgaaggaacgcaattgagtaatcagctttcctttgtgccgagtactcaagagtggcgcccgccttaccgttttaaacctaccgccgatggtgatgaattagccactgtcgtcggcccgccgggcgaagaaatctataccaatgagcaaggtgccgttacggtctattttcattgggataggcgtggtaaaccagaccatagcgcatcatgctgggtaagagtcgctcaaggttggaatggggacggatttggctttatggctattcctcgtgttgggcaagaagtgattatctcttatttaaacaatgatatagataaaccgattatcaccggatgtacctataatggtcgcaatcgttcccccattgatttacctaaacataaaacccgtaccacatttcgcaccaaaacccataaaggagacgggtttaatgaattgcgctttgaggataaaaatggcgatgaggaaatttatcttcatgcgcaacgcgataataatattcatattaatcataataaaacccaatacgttgggcatgatgatagccatactgtcgccaataatcgtaagcatgaagtgtgtcatgacgaatttatccacatcgtcaatgagcaaacagtacaggttgatgtcaatcaatttgaacaaatagggaaagaccgtatcacacgcattgacaatagttggaaagaagttatccacgccagtcactttcaggaaatcggggaaaacaagcagtgtgatatccaaaatgattataccctgaaagccgcagggggtatccatacccataccaaaatccacaccttgcaagccagtgaaacggtcattatcaaaggcaaggctgggtcgattcaattggatgcacaaggtgtgactattacaggtaaaattctgctcaaaggcgatgtgtcaataacggggggcgccccagaagtggttactcagttagaagcggcggttaatgaagggttaccattagctgaggattgccgtgcgaaagcgatgaaaaaaggaacggcctaa

SEQ ID NO: 2517 - DNA, 939 bp, Proteus mirabilis
cactacgtttatctaagaatgaaggagcacgttaagatggctaaaacatcctcttcttcattacaagttcaaacagaaaaagaactgcatatacgccataaacgccaactttggcgtcgtcaaaaaaaccgtatcgcactgtttttatctgtctctaccatggcatttggtctgttctggttaatgtggatcttgttttctacagtaaccaaaggctttgatggcatgtcttgggccttattcacagaaatgacgccaccccctaacaccgatggtggcggattagctaacgccattgtgggtagtggtctacttattttatgggcgacggtcattggtactcctttggggatcttagcgggtatctaccttgctgagtatggacgtcgttcatggttagcggaagtcatacgctttatcaacgatattttattatcagccccatcgattgttgttggactgtttgtgtataccattgtggtggcacaaatgcagcacttttctggttgggcgggtattgtggcattagcgttattacaaatacctattgttattcgcaccacggaaaatatgttgaagttagtccctgatagcttacgggaagcagcttatgcattagggacgcccaagtggaagatgatcgctaaaatcacgttaaaagcctccgtatcaggtattatcacgggcgtattattagcgattgcgcgtattgcgggtgaaacagcaccactgctatttacttcactatctaaccaattctggagcacagatctaaacgaaccgatagccaacttacctgtgactatctttaaattcgccatgagccctttctcacaatggcaagagcttgcttgggctggcgtattactgatcaccctctgtgttctatttatcaatattatcgcgcgcgtgctgtttgctaaaaataagcatggctaa

SEQ ID NO: 2518 - DNA, 2184 bp, Proteus mirabilis
gaattgccttatgttaggtggcatttcaaatttgttattgttactaagcaacaccagcatgagtatggggaaaaaatgagattatcagtcattatattggctatcttcatgattagcctatttataatggccgcctttctattctttaaaagaaggcggcttgatggctcatatcatcttccatccctcgccaaaccgacttaccgtaaactaacacaagatgattatggggtaattagtgactatttgtcctattttggcacctctaagttttcttctgggtattcgttacaaaactttcctgaaatacccactaaaggtgaagtcgttacgacactgcgtaatattgttaaccggtttgcgggatcatcagaggggctcaatcattggcgctattacattgatgcggtagagatccatattcctccattactggtgccttatctgcaacaagaaaatgtcctcgatgtcgtttgtactccttctatccccattgtcattggtgtgaatggccattttcttaaagatgaaaaatcacatttttctgcgttaagtttaaaacaactttctgaacccatactgtcaaatggcacttccactatccagaaaaatgaaggtgatgcggcgcatttattacatattcgccaagaaaccaacgaagagtatcggttacatcattcttcaggtttttggaatggctcgttaatttgcttagggttaatcttatggttaacggcattaatgatgccacaagtctttctcccttggataatggctgcaggagggacttttcttgttttaggcttgtttcttatttatcgacccatcatcaaatcacgaaaacaagaagtacaatgttttaaagggcgtttaaaacgctggggactgtttggtaattttgatcatgggcaggtaaaaaatatttcgttggggggaattgatttagtttatcctccacattgggaaccttatattcaaaatgatattgataaggtgacctatttagaaatgtatcctaatcatcatgttatcaagcaagggccttatttatcattgcatgatgaagaaaaaaactatccgtataagcgttacattaaaaatattatctttgttgtttgtagcctatttgttataggtatgctgtatctctatcaaccgttatcattatcaatgaagttaactttttcatggataaaagagagtgaacctcatttagtgactaactttacggagttagaaacggccaagttgcatgtaggggatattattcaggccaaaggtgtcggaatgtgttatatgcctccaaacctttccagtaagaataataaaacaatatttgcaccttttgattgttcggggatttattggaacaacagcaacccaatgccaatgcctgagtctagtacgattgaaaaagcggcagcattattatatttggttgaagagcagctacaccccgtttctaacaaccgtgtaaacccaagcttaggtcaagctattactaaatctggcatgaatcttttggataattttgatggcattatcttgaaaacacaagatttatgcccgagagaaaatgaatgtattcggcttaaaatggccttggtaaacctaagtaatgtcaatgattggccatcattagttcaacgtgcagaaagtggcaaattaacaggaaccaatgttttattacgtgctgttagtgctgaggccttggaaaagctcgttgacaccaccacatcatcttttatctaccgagaaatagataaggccgcaatactgttaaatagtccaccaccgggtggtgtgcttttaatcagtgatgaaagaaaacagctcgttgattatgcttcaaataccaattctgtatttgaacctacaccattagagcaatggcgagaattacagcgattatctgatattttattacacacaccttttaatactggaggtgtaataacggggatggtaattgatgcgaatggcacgttacaaatctttttgcatagcatgcctgactcaatgaccctgttatattatatcggtaatacgttattattattctttgctattggatttttgatcctgaatttattttttatcatccggcgccggcgacaaaataatcaacgcatgcataaaatcagtcaatattacgagcactgtttttatcgccctcctcagtaa

SEQ ID NO: 2519 - DNA, 1131 bp, Proteus mirabilis
tcattggattattatcttattcactttatttatggcactggccccttatttgctattgcgcgttatataggcgtatttaacaccgagatacaaaaagggttatttttagcattaacatttttactctctattttttcttaccttcttattgaaaaaccgtttagaagaaagcgtttgaactttaaatattcgataacattattgtttgttatacctattttattggctttaggattaaatgcattaaatgaaaagtatcatggatttggagtaaggcttgggcaaaattacgttaatttagaaaacaaactcaatcaattcgattatcccaatcgaggtaattgtatgaattttcaagcctctgatcctgataagatgtgtcatattggtaaagtgggtagccagaaaaaagcctttttattaggggattcccatgctaatcatttttggggatttatggatattttaggtaaagatgctgagcttgatgtctatgcgcaagcaacttcatcatgcattactattcctaatatttatctttatgattggtctaatcataagaatacggtttatcaacgttgttatgatcaaacagcaaaatattaccagattattaaacataatcggtttgattatgtgatttttggacaggtttggaataattacgcctcaaatcatgttattaataaaataggtgataaaagaacggttgaggcatctcgtcaacgtgtggaaaaatcgatgcgtgaagcgcttgatatcattgttgctactggagccaaacctgtttttataaaaaccgtttattcaatgcctagtggttttatgacctgtttttatgaaaatgccaagttaagaaaagattttgctgataacaactgtaatcccaaaaactataaaggtgaggggaatacatggatgaaccaattatttgctaaattaaaacaggactatccaagcttaattattatcgatcctaaagatgtacaatgcgataaagatacctgcttaacagatattgaaggagtgccggtttatcgtgatgtaggacatattactgattatgcatcaacgatttttggcatgatgtatattaataagatgggtaatccatttaaagagaaccaataa

SEQ ID NO: 2520 - DNA, 210 bp, Proteus mirabilis
tcatcatgttatttcatacaaataatcctatatggaagatcatcgtccccggtggggcggctggacttcaaatccagatggggccgccagcggtccttggcaggttcgactcctgtgatcttccgccaattaagttcattacacctcccaaaactcaatcaatcccttaattatcaattattaagctattttcaattcaacaaatgttaa

SEQ ID NO: 2521 - DNA, 762 bp, Proteus mirabilis
gctggaggttatatggctacgcaaattgattttactctctcgaataaagtggctgttattactggtggtgcggctggaattggcttatctatcgcacagatgtttatcgaaaaaggggctaaagtcgctttgttggatagatcagagcaggttgagcaagtggcgcatcgtttaaatagtgcggtggggatctggtgtgatgtttcaagtgaagagtccgtaaaacaagcggtacattcagtcattgaagagttcgatcgcattgatattcttgttaattgtgcaggtattgtcgctttagctcccgccgaatcgttatctcttgaagattggaataaaaccttatcagttaatttaacggggacttttttactgtgtcagcaagtggggcagcatatgctacaacgcgggcaaggtaagataattaacctcgcctctcaagcaggtattatcgctttaccagaacatattgcctattgtgcaagtaaagccgctattatcaatatgacaaaggtgatggcgctagagtggggacccaaaggcctacaaatcaatgcgatatcccctactattgtgatgaccgatttaggtaaaaaggcttgggaaggtgaaaaaggtgaacagatgaaagcgcaaataccggcaaggcgatttgctgagccagaagagattgctgccgcggctgtatttttagcaagcggtgcagcggatatgatcaatggccataatctggtgattgatggtggatatactattcaatag

SEQ ID NO: 2522 - DNA, 1494 bp, Proteus mirabilis
cttaacattctgtttattatgacattatcatttgctcgattacgcaaaccagtttattggtggataattggttatgcggttttatggattatcgtcagctatttatttgatcccaccgtaccttatgatgccgtagaagcggttaactggggtactaatggcggttggggctcacctaaaaacccttggtttgttggttttattatgtggccagccatttatggtggtattgattttagcttttattggtattttatccactttgtgatgatagccatcggcttattaggtgtttggaatttagcctataagttaaccaaaaattatcacctagcttggtttgccatgttaggtttaaatttatcaggaattattaatttcgatatcattccttataacgataattatattttagtgggttgctggccttgggcgctctatttctttttatgcgctatcaatgacaaccccaaatattggtgtggattcgctgcagtgatgggggtggctactatggggaaatactcctcattagccctgattggtgcggtattcttattaagcgtattagtacctaaagttcgtcaaagttatcgctccccttatttttactttgcgatagctatctggttggcgtttgtcatacctaattttatttggttgtggcaaaacgactttgccgcctttaaatgggtcgactcacaaatagaagcacgttttaatttacgtacgttacgtgccgctttaacggttttctatccagtgctgctaatgtggggaattgtacgtctttatggtgggcgagttagttggcgtacttctcaagatagtcaattattgaattttattttgctattcccattagcgattatttttatttggtttagtttccatgaagggggacgtatcactgagtggttacaaccttttatgtcagtggctactgctctttttgtcggctcaattagcgtcatacctaagcgttcattacgtggtgtgttatatggtttagcggtttttggtatgttagtggtatctggttatacggtggtacaagctgctaatgtgcgtaatgcgggtcaaaagtttattggtgttaaaacctttgtacaagatgtcgagaatgcttggcatcagcattatcatcagcctttatcttatgtagggggtgagtatatgcatgagtggatcactttttatggcaaagatagaccgctatcagcccaaccctggattgtcgagaaagatgttcagccccctaatatttataaccgtcatattacgttggcgcaattagaggacaaaggtgtcttattgattggcccggtggggtattactgtgataaagcccatttcgatgcgggattacaatattggccgagtttaaaaatagcagatactcaagaagtcatgtttcgctctgagcccgatgcactggcagagccggtatgtatcgcttttgtctcgcctaaacagcaatcagagaagttgtaa

SEQ ID NO: 2523 - DNA, 267 bp, Proteus mirabilis
cataaaatctacattcttcattattctaagaggttaactatattaacatttccaaatactaagcaattacacttagcaacggaaaataataaactaaaatataacaagttattgcttctttacctaaaaaaattagcgcaacacaaccataaacaaggaaccaaaagagtcagttcgttaatatttatttacagtaatattacagactatttccctgacattacattgtttgcgttattcatgaatatcctgtggataactctgtga

SEQ ID NO: 2524 - DNA, 963 bp, Proteus mirabilis
tggatgtgctatatggcattgttaacccacgtatccgtcataagaaataaggagtgcatcatggctgaaaataacgtaacaccggtcattagtgcaccggtgccaatgaccccctttcaagagttttggcactatttcaaacaaaataaaggggcggttgttggcttaatttatattgtcattatgctgttgatagctgcccttgcaggcgttttagcgcctcatgcacctaatgagcagtttcgtgagtttcttctaacgccccctgtatggcaagaaggaggaagctggagttttattttaggtactgatgatgttgggcgggatattctctctcgcttaatgtatggtgcgcgtctttcattactcgttggttgcattgtcgttatactttcactgattttaggcattattttaggtttaatggccggctattttggtggcatcgttgatatcgccattatgcgcgtagtcgatattatgctggcattacccagtcttttattagcattagtgttagtggctatttttgggccttcgattattaatgcttcaatcgctttaacctttgttgccctacctcattatgttcgactgacgcgtgcggcagtgttaacagaaattaaccgtgattatgttgtggcgtctcgtgttgcgggagcaggctctatacgccaaatgtttatcaatatcttgcctaactgccttgctcctttaattgtgcaagcctctttaggtttttctaatgccatcttagatatggctgccttaggttttttgggaatgggcgcacagccaccgacaccagaatggggaaccatgttatctgatgtactgcaatttacccaaagtgcatggtgggtagtgacttttccggggttagctattttgttgacggttttagcctttaacttaatgggtgacggtctacgagatgcactcgatccaaaattaaagcagtaa

SEQ ID NO: 2525 - DNA, 678 bp, Proteus mirabilis
gttatgcgctatttccccagtgtttttattggcaatattacgacgactgcaaatggatttaccagtgcgatcaccaaaaggctggtggatgggcatattaaactaacatcactgggcttagcaggtgatgagcaagcagaaaaagggtttcatggtgggcctgatcgcgctttgtgccattatcctcaagaacattatcattactggtctgagcaatttcctcaactggctgacttatttaatgctcctgcgtttggtgaaaatatttcgactaccggtctgacagaagagaatgtttttattggtgatatatatcaatggggtgacgctttaattcaagtgacccagcctcgttcaccttgttataagttaaacacggtgactgatatcagcgatttttcacaactgatgcaagatagcggtttttgtggctggttatatcgcgtgataagtcccggcgaagtaggctgtcatcatcctttggttctacgctcaagaaatagcgatatctcggtcaaagaagcaattgctattgcttttcatatgccatttgatgaggagtcgtatcgtcgcttattaacagcggcaggactatccgctagttggtgtaaaaccatgcagttaagattgcaaaaacaaactattgaaagttttgatagaaggctatttaagaaatag

SEQ ID NO: 2526 - DNA, 768 bp, Proteus mirabilis
tcgaaaaaatacagtataatcaccgttgttcaagcatggttactggaaatagcactgatgaaacctcatctcaaacgttcactaacaatcaaacagatggcagctgttgcaggtgtcacgttggtgactattgctatttttattagtattcagcttgtttatttgattgatcaacgccgagaagattatcaaaatcagctatttaatgcggcagtcagtatacaacagccgctagctgatgcgctattgcgttcagatttaaatgatgccaaacaactgatcattagtttaaaaacgaccgggatactgggtaaagcgattgtgacacaacccgaaaatgttcaggtgatgaacttagattttgcaccgaaaaaatcagtttctcaattttcacgttggctgtttggcatccctgttgaagtgactatccctttacagcctttaggtattacctccgctgacgataaagcctataccagtcatcttattttacaggcagatactaaccgtttttatcgttttgcgagtaatactgtcgcactgatgttgacgacttatttattaatgggtcttatcctcactattgcaattagctggtgtattaatcgtattatggtaaaaccgttgcgccacattgctgtgactcttaataaaagtaatcaggtttcgatgttgtcgtgttcagaatctcatcgtgatgatgagattggtttgctgattaaaggatataatcaacaaaaatctgatcaaaaagagtcagatatctga

SEQ ID NO: 2527 - DNA, 222 bp, Proteus mirabilis
aaaaagcctctgtcattatcaataacagaggcaaattatttcacagacacactctgggatatttttaaaatacgagataatattattaaattaaatcttgataagtacctaattgatatccacgctcagcaatcgcttgttttaacgatgattgcgtcaacacctctaattccgttaaacgttggaaacagtaaccactcgcacgtaaaggattatcaataa

SEQ ID NO: 2528 - DNA, 498 bp, Proteus mirabilis
tgtaaaggatataggcgtaatagcctttccgaccgattaatcagcttatggaaggagtttacgatggcttataagcatattctagttgcagttgatttatcccctgagagcaacgtcttggtgcagaaagctgtatctatggcaaaaccctataatgccaaagtttccttaattcacgttgatgttaactactctgatctgtataccggtttaattgatgttaaccttggtgatatgcaacaacgcatcactgatgaaacacgtaatgcactaaaagatctctctgataactcaggttatgagatccaagaaacactcagtggtagcggggatttaggccaagttcttgttgatgcgattaaaaaatacgatatggacttagtggtttgtggtcatcaccaagatttctggagcaaattgatgtcatcagcacgtcaactaattaataccgttcatgttgatatgttaattgttcctctgaaagatgatgaagagtaa

SEQ ID NO: 2529 - DNA, 2184 bp, Proteus mirabilis
gggaaaggatatcaaatgaacaaaatcaactccgtctgtccttattgtggcgctggctgcaaaatcaatctctgtgtcgaaaatggtcgaataatcaaagctgaaggtgccaatggtgtcactaatcaaggcgagctttgtttaaaaggtctctatggatgggattttttaaatgacaataaattactgacagccagaattcatcaaccgatgatccgccgacaaaaaggggctgattttgaaattgtcagttgggatgaagcgattgagtttacggctaaaaagttactcgcaattaaagagaaatacggtgctaaatctattatgtgcaccggctcctctcggggtacaggtaacgaaaccaattttgtgatgcaaaaatttgctcgtgctgtactgggtaataataatgttgattgctgtgcccgtgtttgtcatggcccttctgttgctggtttacaagaaacactaggcaatggggcaatgagtaattccattgctgatattgaagattcagattgtttgttggtgtttggttataactgtgccgattctcaccctattgtggcgcgccgtgtggtgaaagcgaaacaaaaaggggccaaaattattgtttgtgatccccgaaaaatagaaacagcgaagattgctaatcaatatcttcccttaaagaatggcaccaatatggcgttagttaatgcatttgcctatacgctgattgatgaagatctttatgacaaagaatatgtgagtcgttacaccgaaggttttgaagaatataaaaaacagctggtggattatagccctgaagcagtagaacgtattgttggggtttctgcaagcgagatccgccaagctatgcgcacttatgcagccgcaaaaacagccaccattatgtggggaatgggagtaacacaatttggtcaagcggtagatgttgtgaaagggctagcgagtttagcgttattgacgggtaatttaggcaaaccacatgcaggtgttgcccctgttcgcgggcaaaataatgtacaaggtgcttgtgatatgggggttttacccaatatgttccccggctatcaaagtgtgacagatgaaggtattcgtcaaaaatttgctcaagcttggcatattccggttgaaaaactcgatccgcaagtgggttatcgcattactgaagtccctcatttagccattgaaggtaaagtgaaagcttattacatcatgggagaagatccacttcaaactgaggcagatttaggtctggttagaaaaggttttcaagcgctcgattttattgtggttcaagatatctttatgacgaaaacggccgagcaagcagatgtcattttaccttctaccagttggggtgagcacggtggtatttttacttgtgctgatagaggttttcaacgttttgaacaggcagtacaagcacgtggtaacgttaaacgtgattgggaaatcattagtttattagccacggctatgggctatccaatgtcttatacagataatgaagaaatttggcatgaggtaagagcattatgtccgctatttttcggtgcgacctatgaaaaattagcgggattagcccatatacaatggccttgtcctgagctcgatcatccgggaacaccctatttatattcagataatcgatttacaacgccatcaggtaaagggcagctttttgctaccgcatggcgcgcccccgcagagttgcctgatgatgagtatccaatgattttatcaacggtacgtgaggtagggcactactcttgtcgctcaatgacgggtaattgtaaagcattagcatcattagcagatgaaccggggtatgtgcaaattcaccctgatattgctaaagcggcaggtattgctgatcaagaaattgtttgggttgcatctcgtcgaggtaaggtgttgtcacggtgtaatctaaacgaaaccgttaataaacaagctatttatatgacttatcaatggtggattggtgcatgtaacgaactgacacaagataatctcgatcctgtctcaaaaactccagaaactaaatattgtgctgcacgagtggtgaagattgacgatcaaaaatgggcagaaagccaagtcgctcaagataatcacgccatgagaagtcgtttaattaatttagtcgagcaagcaaaaacagcgacacactaa

SEQ ID NO: 2530 - DNA, 1215 bp, Proteus mirabilis
atgtatcatctcgatgtttatggcacgctagtcgcggccactttggttcttttactcggacgtaatttagtgaaatctgttccttttttagaacggtatacgatcccagaacccgttgcaggtgggttacttgttgcagctcttttacttgcattaaaatcatttatggactgggaaattagctttgatctctccttaaaagatccactgatgctcgctttttttgcaacaattggtttaaacgcgaaccttgccagcttaaaagcgggaggaaaagcgctatttatttttgtgtttgtggtcgttggattacttttagttcaaaacacagtaggtattgcattagcagaaatgctaggccttgatcctcttatgggattattagccggttctatcaccttatcaggtggtcatggaacgggtgccgcttgggggaaaacattcgttgaaagctacggctttatgagtgcctctgaagtggctatggcttgtgcaacctttggtttagtgttaggtggattaattggtggccctgttgcgcgttatttaattcgtaacattccaacccctggcgcaggcagtgatgatcatgaaatgcctacagcctttgagaaacccgctacggggagaatgatcacttcaatggtgttattggaaaccattgcgatgatctctatctgtttaatggcagggactttcttatctcagttactagaaggtacggctttctcattacctacctttgtgtgtgtactgttcattggcgttattttaagtaatagtctatcaatgctcggtttttatcgtgtatttgatagagccgtttctgttttaggtaacgttagcttatcgttatttttagcgatggcgctgatgagcttaaaattatgggagctggcatcactggcaatacctatgttggttattctcggtgttcaagcggcagtaatggcattgtatgcaatttttgtcacttttcgtgttatgggtaaaaattatgatgcggcaattttggcagcgggtcactgtggtttcggtttaggcgctacgccaacggctatcgctaatatgcaagctgtgacagatcgttttggtccttctcatcttgcattcttagttgttccgatggtcggtgcattctttattgatatagtgaatgcgatagtgatcaaattgtatctgatgctaccattctttacgcctatagcagggtga

SEQ ID NO: 2531 - DNA, 1260 bp, Proteus mirabilis
ttatattttcattgtatagctaaatgtcggtcaggtggggtaatgataaatcaacgtattaatcgggcaacttacgatcaggtaatgttgccaatttattcaccagcagattttattcctgttaaagggcaaggtagccgtgtttgggatcaacagggaaaatcctatattgattttgctggtggtattgctgttttagcgcttgggcatgcgcatccactattgaataaagcactgcaagagcaaagtgagaagctttggcatgtaagtaatgtgtttactaatgagccggcattatgtttagctcagaaattaatccaacatacttttgctgagcgtgtcttttttgccaattctggggcagaagcgaatgaagccgcacttaaattagcacgacattacgctattacccgtcataatccttataaaacgaagataattgccttccaccacgcctttcatggtagaacattttttacagtctctgtagggggacaacctaaatatgcggatggttttggtcctaaacctgcggatattatacatgtcccttttaactctcttgatgctgtaaaagccgtgattgactctcatacttgtgccgtaatactggagcctatccaaggtgagggcggagtgacaccggcgacagcggagtttatgcatggcttacgtacactatgtgataagcatcaagcgctattaattcttgatgaagtacaaacgggtatggggcgaaccggcaaactatttgcttatatgcactatgatatacagcccgatattattaccagtgccaaagcattaggtagtggttttcctctcagtgcgatgttaaccaccgaggatatcgcttcggtaatgggggtaggaacacatggtacgacttatggggggaacccattagcctgtgcagtaggcaatgctgcttttgatttaatcaacactcaggcggtattagaaggtgtcagtgagcgtcatcgttggatagtggatgaattgcaggcgataaaccaaacttatgctgtattttcccaaattcgtggacaaggcttattaattggcgcgcagttagcaccactgtatgcaggtaaagcaaaagagttacttgcactggcctctaagcatggcttaatgatgttaaatgccggggctgatgtaatacgctttacgccagcgttgattattaccctcgaagagttacaagagggcatgaatgcgttacgaaaagcgcttgatgagtttgtaaaagcagagtga

SEQ ID NO: 2532 - DNA, 744 bp, Proteus mirabilis
aggcactctcatatggatctcatttcacgattaacaaccaataccactcgtgctgattttgccttagctcatcaacagcaattaatacagttactgatacaacactttcctgctaaatatcacaccttgtttgcaaccccgcaaaaaaccgcagaagatactattgaatggtatggtgaattatccggtcagccagtggcattaaatgcattgtcagagcaacaacgccaagagataagagatgctctcgatgatgatttaaaaaatcttaaagagcaaacggcattacttgcttcacagcaacgcattaccgatgaagagcgccatctgcttgataccgcctcaaccctacccgatgcagagagcatctatatcattaatggaaaacccattattacttggtggcctcgtaccacacctttagcgccgactgttgcacaagtcactgctggctctagtgcagcggctgccggagcggcgcttgcaaaaatatcaccaaaaactcgccaccgttggttacgttggttactggtattattattggttttaattgccttagtctcatggttaagaggatgttttgatatcaatacaacgccttctatcaataatacttcagcgaccgctgtcgcaactcactctacctcaacgatgacagctacaactaatacgactaatacgactaatacgactaatacgactaatacgactaataagcaagataacctaacaacaaataaataa

SEQ ID NO: 2533 - DNA, 954 bp, Proteus mirabilis
ttctcctatcagaatgacataaccgttatctcgacattactgctgtttctacacacttttacaggtttacttatgtttttaggtcaatattgggcaaagtttgcccctactacgctttttgttctactttggagtagtggtgctattttttctcgttggggtttagataatggcagttcatttgccattttgacttggcgttttgttattgcattactgtttcttaccctactttgtctccaacgtcgccaatttcttccccctaaaggaagccgtttaaaaacagcatgggttggattgctcattatcggtggttactctatttgttacttgttagcgctcgctaacagtattacaccagggatgctcgccactattatgggtattcagccgatcctcactttatggatcattgaacgacactttactgcgagtcggttattaggactatttattgctttgataggattagtattagtggttgcgcagagtttatttaatatttcactctcattaacaggaatgatttatgcactcattgcactcctctgtatgagctttggcgcaatttcccaaaagaaattacaattagcgcctatggaggcattgccgatacaatatgtggttagtttaacgctatgcttattatttattccatttcaacctatgcagcaatcttgggatattggttttattgttcccgtactttggctagcaattattatttctgtcgtggcacaattactactctaccgactgttaactgcaggtaatctggttaatgtgactagcttattctatttagtaccgggagtaactgcgttaatggattatatcttcttaggcaataaaatgtcttggcttagcttagcggggatgggcgccattattattggtcttatttttgtatttaaaaagtctaactcgatgattgttgaagaaaaaataaaataa

SEQ ID NO: 2534 - DNA, 777 bp, Proteus mirabilis
agattacatcactgggcgttatggctgataacgaggcaaatcatggataatttaaaccacaataaacatatttctggtcaatttaacgctgagttagagcatatccgtacagaactgatggtcatgggtggcttagttgaagagcaattaaaaaaagccattaccgcaatgcataaccaagaccaagcattagccaatgaagtgattgaaggtgatcaaaaagtcaatatgatggaggttgccattgatgatgcctgtatgcgtatcattgccaaacgtcagcccaccgccagtgatttacgccttattatggcgatttctaaaactatcgccgaattagagcgtattggtgatgtggcagaaaaaatctgtaaaacggcccttgagaaattttcacatcaacatcaaccactgctagtaagtttagagtccttaggccaacatgcgatacaaatgctccatgatgttcttgatgctttcgctcgtatggacttagaagaagctattcgagtctatcgtgaagatgcaaaaattgataacgaatatgaaggtattgttcgtcaattaatgacttatatgatggaagatcctcgcactatcccgagcgtactgacggcattattctgtgctcgttctatcgaacgtattggcgatcgttgccagaatatctgtgagtttatcttctactacgtcaagggtcatgacttccgtcatttagggggtgaccaagtagaaagaatgctgacaaaaaatgatgatagtcattctgctaattaa

SEQ ID NO: 2535 - DNA, 1086 bp, Proteus mirabilis
ctcactaatcattattatttaataaaacgctttatttctcatgtatcagttagttggagttatagtgatactgagaataaggcgttttgttattatcacattattgtcttaacaaggctttttttaacctgttggaattggtactcttgtgggcaaaattctattctcgtgtatttgctgcaagcaaggataatgtccatgacagaacaggcaacaactcgattaaagccgggtaaaatacttgatacgctaggcgctatgaaaaatagtttaactcgcgtatcgcaacgtattgcagactatatcctgttccatcctacggaagtgactcagttgtctattgctcaactctctcaagcaaccaaagcaggtgaagcgacggttgtccgcttttgtcggacattgggttataaaggttttcaagactttaaaatggatttggcgattgaaatggcaacatcagataatgatgaatcgccaatccttgatgcagaagtcagtcaccaagatgatatccatactattggcctaaaattgcaagcaacaataaataatgtgttatcagaaacattaaatttactcgatatgcagcaagtgcaaggggcggtcaatgcactattatcagcaaactatgtttttatctgcggcgttggctcttcggggatcactgcggaagatctgaaaaataaacttatgcgtattggttatcgtgttgatgccgtaactaataaccactttatgtatatgcaagcctcattattaaaatctggtgatgtcgctattggtattagtcattcgggtaattcattagaaacggttcatgcattgaaattggctaaagaagcgggcgcaagcacgattgcattgacgcataatttaggctcacaaattatggaatatgcagatcatcatttaattaatggtaatcgacaagggaaattacaaggcgattctattggcacaaaaacagcacaactttttgttttagatttgctttataccttgttagttcaggctaagcctgaaacagtaaaagagcagaaattacgtactctcaatgcgttaaaacagacgcattcagcataa

SEQ ID NO: 2536 - DNA, 636 bp, Proteus mirabilis
aacatctgtcacatctttgagcatttcactatgacaaatagcctagttgtttcgttgagcgttttcctttttattgcagccattacgcccggacctaataatttactattaacctcttcgggggctcatgttggtttaaaacgctctttaacgttgatggcaggcattatcgtcggaatgcaatgtgtattacttagctctgcgtttggtattgcgacattattgattatttatcctgcattgcatatcggtttaaagattattggtagcatttatctttgttggttagcttggaaaacagcaaccgcttcttatcaacgattagatatttcaagtaaagtgtcccaaacagtgacggcgtttcaaggtggattattgcaatttttaaatccaaaagcttggatgatggggctaggcgccgtaggaagttttagtttagccggtgatggttatttgggatcgattggtgtgattagtgttgtgatgttgttggttaattttatcgctggtatggtatggattttaggtggaacatttatcagtcgttttttacaaagcagacgagcatggttcttatttaatattataatggggatattaaccgccatgtgtattccattgatttggattgaataa

SEQ ID NO: 2537 - DNA, 651 bp, Proteus mirabilis
ttctccagtcaaattcagaaagtcatcatgatccaaggaacactttatattgtttccgctccaagcggtgcgggtaaatcaagtcttattcaggctttattaaaaacacagcctttatatgacacacaggtttctgtctctcatactacccgcccaatgagaccaggagaaaaccatggtgagcattacttctttgtcactgaagaagaatttaaaagtatgatagcaagtggagattttatcgaacacgcttgtgtgtttggtaactattacggtacatcgggtaaagttatcaaacagatcttagccagtggcgttgatgtctttttagatatcgattggcaaggtgcgcagcaggtacgtaaaaagatgcctgaagctcgcagtatttttattctgccaccgtctaaagaagagctttaccgccgacttcgcggacgtgggcaagatagtgaagaagtgattgctaaacgtatgtcacaagctgtgtctgaaatggaacattttaatgagtatgactatttgctcatcaatgatgatttcaatactgcgcttgctgatttacaatcaatcattcgctcagaaaaattacgccttgatcgtcaaacactacgacatggtgatttaatcagcaaattattggcagactga

SEQ ID NO: 2538 - DNA, 219 bp, Proteus mirabilis
tactcagcccatgtggcagcttgggcatcattaagtaaccaacaaggtgatccggtaagggttgatagtgtttccattaaaggaaaatcgtttaatccacctaaattatcggggtttaatgcggttaaaatgccattacaaatgatccctgttgatgctacggcaacactatcggcatggttttttaatggtgtaataatgctaactaatgcttcataa

SEQ ID NO: 2539 - DNA, 552 bp, Proteus mirabilis
atgggacgccaaagaacgattgatagagaaaagttacttgaggctatttttgacatcgtgatggagcaaggggctgccgctctgactatcgatacggtggccaaaaaaatggggatttccaaaggtggtgtccaatattgctttaatagtaaagaagcgatgattgatgccatgtttgaacattgggaaggaggatatgaagcgcgatttaatcaggtggttgccaatgataactcagccaataatcgcgttagagcacatattcatgcaactcatgatcacgataagctctcttttgccaaaggagccagcttaatggctgcgttactgcaaacgccagaatatttgcaaagtactaaagcgtggtatcagcaaagattagcgggtgtcgataccacaacagtagaggggaaacgggcgagactggcttttttagccaccgagggagctttcttgctacggtattttggtttaatggatattgatgataatgagtgggaagagatttttagcgatatcgattctgaactggttacagtgactacgaagtaa

SEQ ID NO: 2540 - DNA, 741 bp, Proteus mirabilis
aaaataagccaacgtcaggagcaaaccatggatgcattaatacagtttgttgacactattggcccattatcactatcaagtattgctaaattactggccgcctttatcttaggcggtcttattggcttagagcgtgaatcaaagggaaaaccagttggttttaaaacttgtgtcattattgctgttgccagttgtttattaaccattgtctctatccaatcagccgaatattacgccaatatttctgacaatattcgcagtgatcccatgcggttagctgcacaaattatcagtggggtcggctttctgggcgccggtgttattttacatcgacgagatgacgccatttcaggattaacgactgcggccattgtttgggcatctgcgggagtgggtatcgcctgtggctccggcttttattggcatgctatcgttgtgactttcctcttttttatggctattaaactaagcccacaagtagtgctgtttcaaatgaataatcaacgcttaggtaaaattaaagtgcgaatgctatttactcatgaaagtggtgttcctcttttaattgactatttaaaaagcaacaaaaacgttattgaaaacctgactattcgtgatattaaaaaggagcgcgttgaagttaacttaaaactacttgtgcgacaaaaaataaccttaccagagttttattgctcattaaaacaattacagcatgtacattctgtttcgctagatcattaa

SEQ ID NO: 2541 - DNA, 1050 bp, Proteus mirabilis
agcggaggccatgtaatgagtgataatcttcctgaagcaccacagggtgaatttattttgttccgcagtgaagatggtcaaactcgtgtcgaatgccgctttgagtctgatacgttgtggttatctcaatcatcaattgctgagctgtatggaaaagacgttcgtacaattaacgagcaccttgttaatattttctctgaaggggaacttgctcaaaacgcaaccatccggaaattccggatagttcgattagagggaaatcgtcaggtttccagagagatagaccactatagtttacctgccattattgctgttggttaccgtgtccgctctgtccgtggtactcagtttcgtcagtgggcaacgcaaacgctggaacagtatctgatcaaagggtttgtgatggacgatgaacggctgaaaaacccgcctatcggtcagtcagtcgtgccggattactttgatgagatgctcgaacgcatccgtgatattcgcgccagtgagcggcgggtgtatttacgggtgaaagagatcttcaccatggcagcggattacgaaccatccaataaagaaacaactcgtttcttccaatctatccaaaacaaattacattttgcttgtaccggcatgactgccgctgagcttatagctagtcgcgcagatgccagtcagccggatatgggcttaaccaactataaatttgatgaggtgcgtaaaaccgatgtcacgattgcgaagaattatctacgcgaaaatgagctgaaagaattaaaccgtatcgtcaatatgtggctggattttgctgaagaccaagcgctgcgccgtaagcaagtttttttacaagattgggatactaagctagatcagtttttaagtttcaatgaccgtgatgtattacaaggcgcaggtggaattagtaagaaagccgctgatgaaaaagccagagaagtatttgatatttatgctcaaaaacgtcgacaattaaaagaagctgaaggggcgagggcgaatattgcagcattgaaagatttgctgaaaaaaggtaagtaa

SEQ ID NO: 2542 - DNA, 201 bp, Proteus mirabilis
cacgttttacacaaaattatatcctcaccttgtacgcaattatccaatttaaatagttatctatcatttatttacccattatttgtattaagtaagggaaatactcattttctagctaaagtttttaatctaccagccgaattaatcattctgctaagtggagctcccactggcgaagaaaaaggccaagctaataggtag

SEQ ID NO: 2543 - DNA, 1422 bp, Proteus mirabilis
actttattacatgaaagaattagcctgttaggtacctatttttctacagataaatggattagatcaattatgagcaaacattacgattatatcgccatcggtggcggtagtggtggcatcgcatcaatcaatagagcggctatgtatggccaaaaatgtgcattaattgaagcgaaagcgctaggtggcacttgcgttaatgtcggttgtgtcccgaaaaaagtgatgtggcatgctgcgcaaattgccgaagcaattcatcaatacggtcctgattatggttttgatactacagtaaaccgttttgattgggatacattaatcagtagccgtactgcttatattgatcgtatccaccaatcttatgaacgtgtattaggtaataataaagttgatgttatccaaggctttgcccgttttgttgatgcgcatactattgaagtaaacggtgaaaaaattaccgcagataatatacttatcgccacgggaggccgtcctattcagccaaacattccaggggctgaatatggtattaactctgatggtttcttcgaacttagcgcattaccaaaacgtgttgctgttgtgggtgccggctatattgctgttgaattagcgggtgtattaaatgcgttagggagtgaaacacacttatttgtgcgtaaacatgcaccattacgtagttttgatccactaatcgtcgatacgctggtggaagtaatggaagcggaagggcctaaattacacacccatgcagttcctaaagctgtggttaaaaatgccgacggtagcttaacgttacaacttgaaaatggcttagagcagacggtagatactttaatttgggcgattggtcgtgaacctgctacagataatatcaatttagcggctacgggtgttaagctaaatgaaaaagggtatattcaggttgataaattccaaaataccaatgtgcccggtatttatgccgtaggtgataacacaggtgcggtagaattaacccctgttgcggtagccgctggacgtcgtttatcagagcgattatttaataataaacctaatgaacatttagattataccaatattccaacagtggtatttagtcacccagctattggtactgtgggtttaacggaacctcaagctattgagcaatatggcgctgagcaagtgaaagtctataaatcttcttttactgccatgtatagtgcagtgacacgccatcgtcagccttgtcggatgaaattagtctgtgtgggtgctgaagaaaaaattgtcggaatccacggtattggttttggcatggatgaaatgttgcaaggttttgcagtggcattaaaaatgggtgccacgaagaaagattttgatgatactgttgctatccacccaacggcggcggaagaatttgtgacaatgcgttaa

SEQ ID NO: 2544 - DNA, 1041 bp, Proteus mirabilis
aatgtcatacaccattggatgatacagggagaccaacatatggctaatgttaatccgaatactgcagtgcctttattaaaagcggttaatcttgccaaatattacagcgttaaaggtggactttttacgaaggaaaaaaccgttaaggcactagatggcgtctcttttgagctcgagcgaggaaaaacgttagccgtggttggagagtctggctgtggtaagtctactttaggtcgattattaacgatgattgaagtaccaacctcaggagagctttcatatcaagggcaaaatttattagttaaagataaatctgcggaaaaattacggcgccaaaagatccaaattgtctttcaaaatccttatggatcattaaatccacgtaagaaagtggggcaaatattagaagagcctctattaattaataccacgttaagtgcacaagatcgtaaagaaaaagtactttctatgatggcgaaagtaggtttaaaggctgagcactatagtcgttacccgcatatgttttcaggaggacaacgccaacgtattgctatcgcccgtggtttaatgcttgaacctgatattgtggttgctgatgagcctgtatctgccctagacgtttctgtgcgagctcaggtgcttaatttaatgatggatctccagcaagagatgggactttcttatgtttttatttcccatgatctttccgttgttgaacatattgcagatgaagtggtggtgatgtatttagggcgctgtgttgaaaagggcactaaaacacagatatttgaaaacccacaacatccttacacccaagcgttattatcggcaacaccaagattaacaccgacattaaggcgagagagaattaaattaacgggtgaattacctagtccgttaaatccaccaccaggatgtgcttttgctgctcgttgtcggcgcgcatttggaatgtgtacacaattacaaccgactttaaaagagtatcatgggcagttgattgcttgttttgccgtagagcaagatcacggcgagttttaa

SEQ ID NO: 2545 - DNA, 864 bp, Proteus mirabilis
aacagagtacaatcggcgactctgaaacgattgagaaatttggacggcatgaaaaaaaaacgcgcattcctaaaatgggctggtggtaaataccctttggtagatgacattaagcgtcatctacctcaaggtaactgtttaattgaaccttttatgggtgctggctctgtatttttaaatacagaatatgattcatatattcttgccgatataaatagcgatctcatccatctctataatacggtaaaactgtatcctgaaaaatttatgaaggatgctcaactattattcacccctcagatgaataatgcagaagagttttatcaactacgacaagactttaatcaatcaacagatccataccaacgcagtgtgctttttctctacttaaaccgtcattgctacaatggattatgccgttacaactccaaaggtgaatataatgttccttttggtcgctacaaaaaaccttattttccagaagacgaattgatttggttttcagaaaaagcgcaaaaagccttatttgtctgccaaagctattcatcaaccatgacaaatgccaccaaaggttctgttgtatactgtgatccaccttatgcaccgttatcaccgacggcaaattttacctcataccatacaaatagctttagtttccaagaacaacagcatctagctcaacttgcctcaatgttggcttacgagagacagatacccgtgttaatatcaaatcatgaaactgcgttaacaaaagagtggtatgtagacgcgaaagagctacatagtgtgaaagtcagaagaacaattagtagcaacacactaggtcgtagcaaagtgaacgaattactagccttatataaataa

SEQ ID NO: 2546 - DNA, 483 bp, Proteus mirabilis
ccattgggtcttaactggaatttaaaggcttgtagacgtttcatattacctattataccttggtctatgaaaaatgaaactaatatttgccgtggcagacattgtgtgttcctgatgcacatcaatttggtctttgtcacaaaataccggcgaaaaatatttgatcaggatgcaattgaaaaattgcgaggctactttgccagtgtttgtgctgattttgatgttgaactggttgaaatggatggggaacgggatcacgttcatttactgattaattacccgccaaaactggcgatatctaatctggttaacagccttaaaggggtatcgagtcgattacttcgacgtgatcgtccagatattgcccaacgttattactacaagggggttctttggtcgccaagttatttcgcggggagttgtggtggcgcaccaatatcccttatccgccagtacattgagcaacaggaaacacctagttag

SEQ ID NO: 2547 - DNA, 483 bp, Proteus mirabilis
ccattgggtcttaactggaatttaaaggcttgtagacgtttcatattatctattatactttggtctatgaaaaatgaaactaatattcgccgtggcagacattgtgtattcctgatgcacgtccatttggtctttgtcacaaaataccggcgaaaaatatttgatcaggatgccattgaaaaattgcgaggctactttgccagtgtttgtgctgattttgatgttgaactggttgaaatggatggggaacgggatcacgttcatttactgattaattacccgccaaaactggcgatatctaatctggttaacagccttaaaggggtatcgagtcgattacttcgacgtgatcgtcctgatattgcccaacgtgattactacaagggggttctttggtcgccgagttatttcgcggggagttgtggtggcgcaccaatatccattatccaccagtacattgagcaacaggaaacacctcgttag

SEQ ID NO: 2548 - DNA, 717 bp, Proteus mirabilis
agaaggaaacacattatgatttatttacgcaaagcaaatgaaagaggccacgctaatcatggttggctagatagctggcataccttctctttcgcaagctattacgatgctaactttatgggattttccgccttacgcgtcattaatgaagatagagtgatgcccggtgagggttttggtacccatcctcataaagatatggaaattttaacctatgtgcttgaaggtaatattgagcataaagatagtatgggtaataaagaaaatgtacccgccggtgaatttcaaataatgagcgcaggtacaggtatcactcattccgagtacaacccaaatagtgataaaggcctgcatttttatcaaatttggatcatgcctgataccaccggtattacaccacgttacgatcaacgtcgttttaataccacagagagtaaacagcttattttgtcaccagatgcacgtgatggctcgttaaaagtgttccaagatatgacgctgtggcgttggaacctaaaaaaaggagaagaggcacaatatcagccagaagcaggaagaaatatttggttgcaagtcgttaaaggaaagatagcaattaatgacattattgcgaccaccagtgatggcatcgccatcgcgaatgaagatattatctatttcgttggtgatgaagacagtgaagtcttgctgtttgacttacctcctgtaacagcatag

SEQ ID NO: 2549 - DNA, 750 bp, Proteus mirabilis
aagcatttgcacttcgggagcttaaagatgcaagacagttataaagtgctgattgtggatgatgatttacgtctacgttcactattagagcgctatttgacagagcagggttttcaaatccgcaccgcggcaaactccgatcaaatggatcgtttacttactcgcgaatctatccatcttattgtcctcgacttaatgcttcctggcgaagatggcttatctatttgtcgtcgcttgagaagccaaaacaatcctatccctattattatggtgactgccaaaggggaagaagttgacagaattgtcggacttgaaattggtgctgatgattatatctcaaaaccatttaacccaagagagctattagcccgtattcgtgcggtgcttcgtcgccaagccaacgaactaccgggagcaccttcacaagacaatgcgattgtctcatttggtaaatttaagcttaacctcggtacgcgggaaatgttccacgaagatcaacatatgcctttgaccagtggtgaatttgccgtattaaaagtccttgtttcacatccccgagagccattatcacgtgataaattaatgagtctggcgcgaggtcgtgaatatagtgcgatggagcgttctattgatgtgcaaatttctcgtttacgtcgcatgattgaagaagatcccacccatcctcgctatattcaaacggtttggggactgggttatgtctttgtacctgatggaacgagcgtatcataa

SEQ ID NO: 2550 - DNA, 1023 bp, Proteus mirabilis
gatatgctgcaatttatccttcagcgtttggggctcgtgatcccaacgtttatcggaattacgttattaacctttatttttgtccatcttattccgggtgatccggtcatgattatggcgggagagcgtggattatcaccagagcgtcacgcttatttaatggcggaattaggactagataaaccgctatggcaacaatatttaaattaccttaacggcattatgcacggtgatttaggtatttcactaaaaagtcgtattcctgtctgggatgaatttttgccacgatttaaagcaaccttagagctaggtatttgtgccatgatttttgctgtttcagtgggcattcctgttggggtgcttgcggcagtaaaacgaggttctatttttgatcatacggcaattagtgtgtcacttgcaggatattctatgcctatcttctggtgggggatcatgctgattatgctcgtttcagtgaagcttgatctaacacctgtatcaggccgattggcggatagtgtctttctagatgatagctatccactaacgggatttatgttgattgatacgctcttttggggggaagaaggtgattttcttgatgcgctacaccatattattttaccggccattgtgcttgggactattccattagcggttattgtgcgcatgacgcgttcggcaatgttggaagtattgggagaagattatattcgcactgccagagcaaaaggattaagtcgtgcacgagtgattttgatccatgcattacgtaacgcaatgttacctgttgtgacggtgattggtttacaagttggtacgatgctagccggagcgatactgacagaaactattttttcatggccgggtttaggtcgctggttaattgatgctctacaacgtcgagactaccctgttgttcaagggggagtattgctcattgccactatgatcattttcgtgaatctattagtggatgtgctatatggcattgttaacccacgtatccgtcataagaaataa

SEQ ID NO: 2551 - DNA, 708 bp, Proteus mirabilis
gattttaagcacgctgtatcaaaagggtgtcaatccgttttgaaaggctgcattaacgtacagaggataacgcgaatggttctcggcaagccgcaaacagacccgactcttgaatggtttttgtcacactgccatattcacaaatatccatccaagagcacgctgatccaccaaggtgaaaaagcggaaacactttattatattgttaaaggttccgtggctgttcttattaaagatgaagaaggaaaagagatgatcctttcctacctaaaccaaggtgacttcatcggtgaacttggattatttgaagaagatcaagaacgtagtgcatgggttagagcaaaaacagcctgtgaagtagcagaaatttcctataaaaaattccgccaattaattcaggtcaatcctgacattctgatgcgcctttccgctcaaatggcgaatagattacaaaccacatcagaaaaagtaggtaaccttgctttccttgatgtaacaggtcgtattgcacaaactttattaaatttagctaaacaacctgatgcaatgacgcatcctgatggcatgcaaattaaaattacacgtcaggaaatcggtcaaattgtaggttgttcacgtgaaactgtaggccgtattttaaaaatgctggaagatcaaaacctcatttcagcacacggtaaaactatcgttgtttacggtactcgttaa

SEQ ID NO: 2552 - DNA, 279 bp, Proteus mirabilis
gactgtaggcaagaacaaaaaaggagcgttatcacgctcctttttcaatggtttcacaagattaatgttggcaaccacaaccgccatggccgtgaccaccttttccatgaccgccaccacaacatccaccttcttcaccgtgatcgtgatcatgaccatgaccaccaccacagcatccgccttcttcaccgtggccatgtccgccacaacactcatgaccttcatcttcaccatgaacatgaccatgagctaattcttcttccgtggcttcacggatag

SEQ ID NO: 2553 - DNA, 1110 bp, Proteus mirabilis
acctattttaaaaatcggcttaggtatggatggctctattattgccatgttattaatcgcaaatggagagcaaggatgaggcgattattaccctatgatgctattaacttggccgcttatgctttttttgagccacaggagccactgatcccttttattccttcatggtataacgtatgggaatctcatatgttacgtttagcgggtaaaaaaagcgcaggaaaaagttggagttttcaacgctatggggtcaatcatgatatgtatctacgtgaaggaataagaaaaacaaattgtcgtccttacctatctgcaatagagcatgtggtcgatcatgctgttggtcaattagatacaaaatcacaattcctcttaaaaaaagagcgaaatggactgatttatattgatgcatggggagagctaacggctttcgaacagatagatagtttaagggatgtgtttactcttaatattattcctagaaatatcataaaaaaatacagtataaaaaatttctcttgcaaaataagaggcgaacgtaatggtatgatgtcggcactattattagcacaaaagctcattaatagtgatttacttgataatatatttatttgtggtggttttcgggctgtaccaattttatcttttagtgaaatagaaagacaaccgataaccctttttttcaagcctaatacattggaaaatataaatagtattgaaagagtcgcctgcatcattatcaataaaaaacagtgttcagatatttcgatttctatcaatcattatttttctatgaatcaaaatagaaaaaaggcaataaagcaattagttaaaaattggcaccgttgtattaataaacagacgggttcaatttatataactgcgttactgacttataaatatatttctatgcttgaaaccgcattcacagcattacctgttaatcttaattgctattttttaaatcgtctttatggtgatagtgggtttatcacaccggctcttatgttcgatcatttacaaaaagcagcagatagtgcctctcattaccttttgagtgcgtttgatggagaaaatggtgtttggctggttgattgttggaaacaataa

SEQ ID NO: 2554 - DNA, 753 bp, Proteus mirabilis
cttgattttaagtaccattcaattcaatgtattaataacaatcttcgttaccgaggtttatcgatggcctattcatttttaacccaagcaacagttaaaaaattatcgcgcaatgaaaagtggttacaacagattaataatgaagatattatcgatttgagtttaaatgcggggcagctcattattgataaaccaaaggtggatgagaattttatcccttttagccaacaattagatgtttattgtcagcaaattgctcagcaatttccttttatagcggtgactccacaattacaacttcattgcactttgttgaccatttttaatcaacctatagcgttatttgagcctcagaaattaatgttactggcttggtgtcaaaaaataacgaatatctttaataagataggaaagatcgagatcctatttaatgatattattttaacggctaatggaagcgtgatattaataggtgtatcaaaaacattaacgcagtttagacaacaggtttaccagcaaatccccattgatcatcatctgcataaaaatattattcacattacgcttgggcgcttacaggaaagtgtgtcatcagaaaaaataacaccactttttcaatttttagcacataatcgattatcacttccaatcaatattaaaaccagcattaactatcctaaatttgtggtgagcaaaggctcactatcatctgaaatattgttgaataagacgatagagtttaatcaacagtaa

SEQ ID NO: 2555 - DNA, 768 bp, Proteus mirabilis
gaagactttaatatgattgaaatcagtaagatatcaaaacgttatcaagacacaacggtgcttgataatattacaacaaccattcaacgtggcggtattacttcaatcatcggacctaatggtgcgggtaaatccaccttactttctgtaataggccgtctactgatgccagaaagcggtatggtcagtgtaaatggcatggatgttgcggccacagagagtgatgtattagccaaaaacctttccatactacgccaagaaaatcagtttgtgagtcgcttaactgttgaagagttagtcggttttggtcgctacccttatagtaaaggacgcttaacgctagaagataagaaagtgattgatgaatcactcgattttcttaatttgactgaatttcgtcaccgttatcttgatgaattatctggtgggcaacgccagcgtacttatgttgcaatggtattatgtcaagatactgaatacgtgatgcttgatgaaccgcttaacaatcttgatatgaaacacgcggtcattatgatgaaattactgcgtaaagccgccgatgagctaggaaaaaccattatcatcgtcattcatgatatcaatttcgcctctgtgtattccgactacattttagctatgcgcaacgggcaactttactatcatggctcacctaaagagatcatgaagtccgatattatcgaagatattttcgatactcccgtcgacgttaaagagttggatgataagcttatcgcgatgtattactaa

SEQ ID NO: 2556 - DNA, 1272 bp, Proteus mirabilis
aaaccaattaagaggggtacgacaatggatatgaaaataacttctcgcctacttattatgatgtttgtgcaatatttcatgcaaggagcatggaatatgaccatgggactcgtattaagtagttatggtatggcaagtattatcggcaatgcttatgccttattaggtgtcgcgacaattatctcccccttatttattggtatggtcgcagatcgtttctttgcttcacaaaaagtcatggggatacttcatttaattaatgccgtcgttattctctgtgttccccaatttattgaagcacaaaacagtggcatgacattatttttaatttttattattggcttattgttttatccaaccactgcgctatctaatagcattagtttctcccatattaatggggttaaatatttcccaattattcgcgtatttggtacgtttggttttatggcaattggttttatattgggtgaaatgggcttctctggtagcacaatgacttggtatatcgcttctgcagttggtgtattactcggtttctattgttttacattacctaatacgccacctaaagcgaaaggccagcctttctcactacgcgatattttatgtttagatgcattgtctttatttaaagatcgctactttgctattttgatgtttagcatctttattttaatgatccccaaaacagcttattctgcttatattcctgtctttattaaagcattaggctttgataatgcagcttctattatgcaaatagggatcgcttgcgaagttctgtttatgtttgttttgtcattcttcttaatgaaatttggcttcaaaattacactactgctaggagccgtgagctggatcatacgctctatgtttttctcttatgctgcagtaaatacagagctttactttatcgtcatcggattaatgctacagggattatgttgggatttcttctttactgcaggagatatctatgtcgatcgcaaagcaaaacctgaaattcgtgcacaagcacaaggtctgcgctttattgtctctaatggtttcggcttactatttgcttccactatttgtggtcaaatctttaacacaaccgtaactgaaacaggtgatgcagcattaccacaatggtcaacattctgggtctatcctgccattgtagcggcggtggtaaccctattctttattttcttctttaaagatgatgtttctaaaaaaagaaatagtgaaaataaagaaacatcacgaggaattacagcaccttaa

SEQ ID NO: 2557 - DNA, 723 bp, Proteus mirabilis
ataatcgttaacacttcccgacaatgggagtgttgtcaggagaacgcgatgaaagattttctgattgccccttctattttatctgcagatttcgcccgccttggtgaagatacggagaaagtgctcgctgcaggtgctgatgtggttcattttgatgtgatggataatcactatgtccctaacttaacgttcggtgcaccaatttgtaaagcgctacgcaactacgggatcacagcacctattgatgtccacttaatggtaaaaccggttgatcgtattattcctgattttgcacaagcaggagcaacctatatttcatttcatgctgaagccagtgagcatgttgatcgcactattcaattaatcaaagattgtggctgtaaagcaggtttagtccttaatcctgccacgcctctcaattatctcgattatgtaatggataaattagatcttattcttctgatgtcagtaaaccctggcttcggtggtcaatcatttataccaaagacactcgataaattacgtcaagttcgcaagatgattgatgatggtggctatgacattcgtttagaaattgatggcggtgtcaaagttgataatattgccgaaattgctcaagcaggtgcggatatgtttgttgctggctctgctattttcaatcagccagattataaacaggttatcgacaatatgcgccgagaattagataaggtatcgaaatga

SEQ ID NO: 2558 - DNA, 582 bp, Proteus mirabilis
tctctattcctatcaggggctgttatgaaagaactaaaaaaaccgaatatactcaatattgataacattgcccgttctcggttatttcagatccaatccgttaatctggaatttagcaacggcgaaaaacgtatttatgaacgaatgaaacccgctaaccgggaagcggtaatgatagtccctatcatcaatgatgacctgatccttattcgtgaatatgctgttggcatcgaaaattatgactttggctttcccaaaggggctattgatgcgggtgaaaccccattacaagcggccaatcgtgaattaaaagaagaaattggctacggtgccggctctttaaccgagatagctaaactgtctatggcgccctcctatttttccagcaaaatgaacattgttattgctcaagatctctatcctgaacaattagaaggcgatgagcctgagccgttagttcaaatacgttggcctatcgccaagatgatggacttattagatcatcccgactttaccgaagctcgtaatgtcagtgcactctttttagcacaacgttatttgcaacaagtttgtccaaaataa

SEQ ID NO: 2559 - DNA, 720 bp, Proteus mirabilis
ggattatataatcaaatgtctagcccgttattctatggtgacagcaacgagtttgaaaaattagatagccgaccttttactcaaactgatcacgaaattttaaagtcatatgaggctgcagtagatggtttagccatgttaattggtcatcactgcgaaatcgtattgcactctctggaagatttgaaatgttcagcggttaaaattgcgaatggggaacatacaggccgtaagattggttcacctattaccgatttagcattacaaatgttgcatgatattacagatgaagattcaagtttttcaaaagcttattttacccgtgcaaaaagtggcgctttgatgaaatcaattacgatcgctattcgtaatcgtgagcgccgtgttattggtttattatgtattaatatgaaccttgatgtcccattctctgagattattaaaacctttattcctgaagaaacgcatgaagtggcttctgatgtgaattttgcttcttctgtcgatgatctcgtggcacaaacacttgaatttacgattgaagaagtgaataacgatcgtgaagtggctaataatgcgaaaaataaacaagtggtgttaaatctttatgagaaagggatctttgatatcaaagacgcgataaatcaagttgctgatagactgaatatttctaaacatactgtgtatctctatatccgccaatttaaaaatggagagtag

SEQ ID NO: 2560 - DNA, 420 bp, Proteus mirabilis
gggaaaaataaaatggaagcacgtgttaaatgggttgaagatttatcttttgttggcgaatcatcttccggccatcaagttatgatggatggtaattcaggtgataaagcgcctagtccgatggaaatggtattaattgctgcgggtggttgtagtgctattgatgtggtgagtatcttacgtaaaggtcgccaccaagtcactgattgtgaagtgaaattaacatcaaaacgtcgtgaagaggcacctcgtttatttaccgatattaatttacatttcattgtttccggcaaagcgttgacagataaaattgttgagcgagctgtacaattatcagcagaaaaatattgctctgtttctttaatgttaggaaaagcggccaatattacgcactcttttgaaattaaagatcctgaataa

SEQ ID NO: 2561 - DNA, 1590 bp, Proteus mirabilis
aaggaaaataatgtgaaacctctatttacagttattcctacactattattaacattggcgtgcgtatttcctgcttttgccaatcaaagtaataatatattggattatgccagtacaaaagatatccgtgatattaacccccatctttattccggtgaaatggccgcacaaaacatggtatttgaacctttggttttaaataccgataagggggttgcaccttatttagcacaacgctgggaaatttctcctgatggtaaaagttatacctttttcttgcgccaagacgttacatttagtgatggcgaaccttttaatgcgcaagcggtaaaacttaatattgaggctgtattagataattatcagcgtcatgcatggctagaattggtccgtcaaatcgacagtgttgaggttatcgatcagtatactgttaagctaaatttaaaaaatccctattatccaaccttaactgaacttggcttaactcgcccatttcgttttatttcacctaaatcatttattaacggtaaaactaaaacaggggtgagtcattatattggtacggggccttgggtactcacggaacataagaaagatcaatatgctgaatttaaggttaaccctcattattgggggcaaaaaccagcattaactggggtgatgtggcgagtgatccccgatagacaaacaatgctattatccttacaaaaaggagatattcagctaatttttggtgcagatggcgacatgttagatatggactcttttgacgcattaatggcatctgataaatttaaaacacaaatgagtgcacctattgcttctcgtgctattgtgctcaacagtagtcgccctattacttcaagccaaaaagtacgccaagcattagagtatgccgttgataaagaagggattgctcaaggtattttagcgggaagtgaaaaagtcgctgatacattaatggcaagaagtgtaccttattgcgattttgattcaccaacttatatttatcaaccggaaaaagctgcctcgttattagaagaggaaggctggctattacctgcgggtaaaacagtgcgtgaaaaacagggaaaaccgttgcagttattgctctcttataatgtgaataatgcggttgaaaaagagatagccgaactattgcaagatgattttaagaaaattggcgttgcactgacggtattaggggaagagaaacaggcctttttagatagacagaaaagtggtgatttcgatttacagtattctctttcgtggggaacaccttacgatcctgcctcttttgtctcatcctttagaattccagctcatgctgattaccagggacagaaagggttagccaataaagcacaattagatgcgatgattggcgagttgttgattacgccagatgaacatcgccgtcaggcattatatcaacgcttatttacctcattagcggagcaagccgtctatataccattaacctattcgcgtactaaagcgatttaccgtagtgaattggaaaacgttggttttaatccatctcaatatgaaataccttttgaaaagatgcgttttaaagccgaataa

SEQ ID NO: 2562 - DNA, 969 bp, Proteus mirabilis
aggagaaataaaatgaatgaatggtcattattgattttcacctttatgatgaatgccactattggcttaacactcataacaggcctttttgcacgccgtcttgcacattatctcagtgctgaaagctattatcgctttatgttactaaccttattggtgatttgtggattagccggtttaggctctattgcctccattactcacttaggcgtaccgttaaatgctccgaatgccattagaaatgtcttttcagcttggttaagtcgcgaagttgctgtcactgccatttttgtaggatgtttagggatcacctttttatggctatggcgtaccggtaaattttcgatgctgctatttagtgcaagccttctgattggtctgtttgacatttattgcatggcatccatttatcgccatacttccattttaacatggatggataacaacacttatgtgatgttttttggcgcgatgctcacattaggggcaacaatattctttttgctgctaaagatattgcagcgtataggcaataaattagggatagaaataccatcagcccctttccctatccgttggaaatggcaattgtgggggatcatggcatttagtttaattggccgattactctatcaacctttttatgaacactatttaactcgtacgctctatagccaaacatcggtaacctttccgttatcacccattgaagtctattactccattggcccattacgtatgaccagttggatcttagcaactttggctgtattggtatgtggctatagtttagtaaaatatttgatgggccaaactcagcaaaaatcaacggagtccatttttgtctatggcggtatcatggcaattattgcagaatttgctttgcgttatgtgttttattcaattcactatatcacgatcagccagttattgaagatgacaattatcaggggaattattagcccctga

SEQ ID NO: 2563 - DNA, 585 bp, Proteus mirabilis
caaatgaataaacaacgttgtgattgggtaactcaagatcctgaatatctcgcataccatgataatgaatggggaaaaccacagcgagataaatacaaactttttgagatgatctgccttgaaggacaacaggcaggtttgtcgtggtataccgtattaaagaaaagagcgggatttcgtcgttgcttttttgattttcgtcctgaaaaaatagcactaatgactgaaaaagatgtggaaacactactacaagatccgtctattattcgtcatcgtggcaaaattaacgccattatcaataatgcgcgtgcctttttagcgatggaagctcagggtgaagatttcagtgaatttatttggcaatttgttgatggaaaacccattgataaccaatggcagactatttcacaggttcctgcttttactgaaatttcagatgatatggctaaggcgttaaagaaaaaagggtttaaatttgttggtaccaccacctgttatgcatttatgcaagcagtaggcatggttaacgatcatatactctgttgtttttgccggcaatctcagccggaaagtagtattaaatag

SEQ ID NO: 2564 - DNA, 780 bp, Proteus mirabilis
aacggcgataaacaacaagaggatcgaatgctattacgagtagacaacgtcagtaaatattattatcaaaaaggggcgcgcttttttaaagaaaaagtgactattctcgatgcgctctcttttaatatacaaaagggtgaagctttcgggttagttggagaaagtggcagtggaaaaagtacccttgcacggttaatcagtggcttagaattacctgatcaaggggctatttatttaaatgataagccagtgacgaaacgatgttatcgacaaggtgtaataagtattgtgtttcaggatcatatcgcttcagtcaatccgacttttacagtgggtgaaatgattgctgaacctattaaactgattaatccgactctccgtcataacgagttagaaacaattattttttcttttttagagaaggtgcaattacctaaaagttgttatcagcgttatatttttgaattgtctggtgggcaagctcaacgagtttgcttatgtcgtgcgttagcatcttacccacaactaattattttagatgaggcaataagctctctcgatatacctacacaagttgaaatattggatttattaaaattattaaaagaggaactccaattatcctatctttttattagtcatgatattcaaacagtgacttatttttgcgataaagtcatgtttattttacaaggtcaacaaattgaattatgcgagataaataaattaagtactgttactcatccttatgctaaaaaattaattcaatctgttatttaa

SEQ ID NO: 2565 - DNA, 696 bp, Proteus mirabilis
gagatggataacaataaagaacgctttttatcaaatcttgcttctcaattaggtaggccgttaaaaacgcaacctgaagctttacctgaaccagtaaatttatatccagaacaacgattaacggagctttctgatgatgaactttatcaatattttctcaatacagctcagttagcaggaagtacttatgaaacgacaacattgtcatctttacctaagcatttagagactctttgtgaacagtatggtttaccagtgatattaacgggtgatccacgattacaggaaagtggggtgattgattatttatcagaacactgtcatgccaatatttgggatcatactgagggtaaaaaaaatattgaacgggtaaaagaggcaaaagtcggaattgtatttgctgaatatggacttgcagaatctggcggtgttgttttattttctggggctgacaaaggaagaagtgttggattgatccctgaaaccacgatttttgtactaaaacgcagtacgattttacctcgagttgctcagttagcagaaagattacatcaaatggcattaaaaaatataagaatgccttcttgtattaatattattagtggtcctagttgcacatcagatattgaattaattaaagttgttggtgttcatggctctttaaatgcgatttatgtgattattgaagattgttaa

SEQ ID NO: 2566 - DNA, 2499 bp, Proteus mirabilis
atcatgcgtaagagtattatcgctttatcaatattaggtattattttttcgaatacgattaatgctaatgaaataaaaagaattaaagtgggcggatatattattcctccggcatttgttaatgctttagaggaaggtatgtcggtgcccgttttcttacgacttaatgatgcaaataaacaaaaccaaagtgaaaagaaaattgcagatgcgattattgttatcgataatgataaaataaaactatcaagtattcaattaatcgaaaataatcaaggcgcaacactaaatcagttattagttgataaaattgaaaataaaaaaaatgctatctttaatgaaaataatagtataactattgatagtaatgctgttcttcaattaaatgtctcttcatttaatttatcattagatgttgataagtcagcttttgcacccaaagaacatgctagacaatccatattaggaaattcatctgttaattcattttctgctgtggccaactatgatttgggcgtctttcaaagtcgtgttaaaaacgcccaagattcatccagtagctactttaatttagacacattattagctaaagctgaacaccattttaatattaatgcatctgcctacagtataggtaaatccaattccaatattgaactctatagagcaatgtatgaacgtgattttaatggattgcgttttgctatcgggttaatgagcacttggaatttacagtccttagccagcttaacagtattgagcagcagtaaaatttatgcagcatcaatcgggaataattcatcaagtagggtggtgaataaacagcaatcattaactccgatttatgcttttttaaatagtccaggtgaagttcgtatttatcgccaaggtaaattattaaatattcaaaatttcccgatgggtaattttgaagttgataccagcatgttgccttatggtatttatgaagtaacgattgaaaccgttattgatggcaaggtagtgacaacacaacatcaaaccattaataagtcttttggtaccgctaacggtaattttgaccaattaaattgggaaatttatggtggctatattgattttgataaacgtcattatatcaaagaggggggcgcttataaccaaactcccgaaaaaagttatttaatcggtagctcttttgcttataactttcctgtgttatccggtattcgttttcaaatgtctaactatggatttgataaatttattgtacaggagacgaatatcagtgtagcggtaaataactatctttctattgcttggcaaggaatgttagagaatcatggtagtcaccgtaatattagtacgctttctattaatatcccagaaggctatggttcattatgggcatctaaagagaaaactatcgtaagaggtgatttaccgctatatgaggctgacagttactcttatggaggaactgtcaatttcgataagataatggatagaacgggttcatttactatcagcaataccaaagataagcgagttggtagtgattctattaattatgaatatgcaaatacattattttcgggacgttatggcacggtaggattaagagctggggttcagcgttatcattatgataatcaaaatagcactaatgaaaaatttattaatcttgatttctctttacctctttcaacgtggttaagtactgggatctcttcaaccaatggcaatgtaaaagccaatatttatgtgaataagaattttgaaaactccgtgatcactaatgcgggcgtttctgtttctaagttagtacatgataaagataatggtgaatctgacttctcaacactaggttacgcttcttatgatacgaagtataactctggtacggtgaccattaatcgccctgataataaacgactcaatggtaatttaacttctcgtggctctatagcttatagtgaagggatgatcacacccagtggtcaacaaggtaaatctggcattattatcaattcagatattaaaggtagtggcagtatgctcgctaaagttaacgggcaaaattacccgattagtggaaaaaatacctttattccattatctccttattcagattatgacatccaattaatgaatgatggcaaatcgaaagacagctttgacattatttctggccgaaataaatccgtcacattgtatccaggaaatattgccttttatcaaccggaagtgaggcaattagtcacggttttcggacgtctgaaatcccctaatggtgaacttttaaaatatgcttcaattcgaaaccatattggtcgaactaaaacagatcaaaatggtgagttttcaatggatgtagatgtccgttatccggtgatctcgttacaacaagaagatcagcaaacaatctgtgaagcagacttagatcttaaaggggcacaaggagcaatgtgggttggagaggtaacttgtcaacctcagtctagtttcgtaaaaagataa

SEQ ID NO: 2567 - DNA, 1548 bp, Proteus mirabilis
ctaatgcgtaacaatcaaccggtgacacagcgagaatatccggtagctgaaaacgcaacactgatgtcaacaaccgatgttaatggcaatattatttatgctaatgaggattttgttgaagtcagtggtttttcagcacaagagttaatggggcaaccccataatattgtcagacatccagatattcctgctgatgtatttagagacatgtggaaaacattaaaacagggggaggtttggacgggaatagttaaaaataggcgcaaaaatggcgatcattattgggtaagggctaatgtcacccctattattcgtcaaggtaaaattcaaagttttatgtcagtgaggacggcggcaaaaaaagaagaagtagaacaagccgcagcactgtatgccgcttttaaccaaggtaaatatccctctcacactttttctaagggggctttcatttataagggctggaaaagttggcgctcatggaaacaaacactctcactaaagcagcgtgtacgcttacttctcttattaccatttccttttatattattaagtgtttggtttgctggtttaaatggttggggtttattcattcataccgctatcttactttcactattgatagccaatgagcgaattttttattttcaaatagtgaagccgatcatgatccttaataagcacgctaatcgggtggctacaggtgatgaacacaacgttgattatcttgatcgtattgatgaaattggtatgactcaacgttctgtaaatcaattagggaggatgtttcgttggcttgtgaacgatgtcagtcatcaaatccatcaagttgctttttcttgtgatcaattagcagcggggaatcgtgatctctatacgaggactgaacaaactgcaagtcatgttgagactactgcgtcaaccatgaatcaattaaccacagcggtcagtaataatagtgaaacggcagggcaggctaataatttatctaatatgacttgcaaggcagcaatacaaggaggaactgcaatggataccattgtgcatacgatggacgatattgcgaaaagttctgagcgtatcagtaatattattggtgtcattgacagtattgcatttcaaaccaacatattggcattaaacgcttcggtggaagccgccagagcaggagagcaaggacgcggtttttctgtggtagccagcgaggtgcgtaatttagcgcaacgcagtgctgaggcggcaaaagagatcaaagcattgattaatacatcaagtaacaatattaagattggctcaaagcaagtgaatgagacggtggaaacaatggaaaatattgtggttcatgtaaaaaatgtcacgagtcttattggtgaaatcagccttgcatcatcagaacaaagtgcaggattaaaagagcttggtcgagctgtagagcagttagaatcaataacacatgaaaatgcagattatgtctctaaagcgtcatcaatttccggagaaatgaaagaacaaacgaattatttagtaaaagccattcatgtatttcactaa

SEQ ID NO: 2568 - DNA, 1131 bp, Proteus mirabilis
gatgaaagtaaagactacttgaagaaagccgttgctatggaaaaaatcactgtgactttaggtgaaagaagctatcccattaccattgcttctggcctttttcaccagcctgaaacctttttacctttaaaaaaagggcaacaagtgatgattgtcacaaatgtgacacttgcgccgctctatctagacaaggtaacaaacaccttagaacaacaaggtgttttggttgatagcgtgattttacctgatggggaacagtataaatccctaacggtaatgaatgatgtctttactgcattattagaaaaaaatcacaatcgagatacaacactgctcgcactagggggtggtgttattggtgacttaacaggctttgcggctgcaagttatcaacgtggtgtacgttttattcaagttcctactacgttattatcacaggtcgattcttctgtcggtggaaaaacagcagttaaccatccactgggtaagaatatgattggtgctttctatcagccggcatctgttgttatcgatctcgattgtcttgcaacgcttcctcctcgtgagttgtcatcaggcttagcggaggtgattaaatatggcattattttagataaagacttctttatctggcttgaaaacaatattgacaaactgatagcgcttgaacctaaagccatggcttactgtattcgccgttgctgtgaacttaaggcacaagtagtcgcagcagacgaaaaagagacgagtggtctacgagctttacttaatttaggtcatacttatggtcacgcaattgaagcacatatgggatatggtgtgtggctacatggtgaagctgtcgctgcgggtatggttatggcggctaaaaccgcacaagatttgggtcaatttactcaggcagaaactcagcgagtgatccaattacttaaaaaagcaaatcttcccgtcaatggccctgatgagatgcaacctgaagactatttacctcatatgatgcgagataaaaaagtttccgcgggtaaattgcaccttgtattaccaaaaggtatcggtcaatcagaactacgtgcggatatctctcgcgaacaagtgtataaagcgataacatcatgcattaatgcaaattaa

SEQ ID NO: 2569 - DNA, 294 bp, Proteus mirabilis
tggtggagtaacacaaatatggcacgcgtaaccgttcaagacgctgtagagaaaattggtaaccgttttgacctcgttctggtcgcagcacgtcgtgcgcgccagttacaagttggcgctaaagatcctttagtaccagaagaaaatgataaaatgacggttatcgcactacgcgaaatcgaagaaggtttgattaacggtaaaattcttgatgctcgtgaacgtcaagagcaacaagagcaagaagccgcagaattacaagcggtttcagcgattgcggaaggtcgtcgttaa

SEQ ID NO: 2570 - DNA, 651 bp, Proteus mirabilis
cagatactcaagaagtcatgtttcgctctgagcccgatgcactggcagagccggtatgtatcgcttttgtctcgcctaaacagcaatcagagaagttgtaaaatgcgttatgctgatattcgtattgaaacagagcgattattattacgctcttttgctatgaaggatgctcaagagtggttccagattatgagctctcctgaggttactcgttattggagccatcttccttggcaaaatatacaacaagcgaaggaagatattattcaggatattacgcatatggagcgtaaggaatatctgcgtttagccattattgataaagcaacagataaacttattggcatgtgtgtattcttcaatcatcatctccattcttgccgtggtgaaattggttattgtcttgataacgcctttcaaggaaaagggttgatgtatgaggcaatgattgcttttattgattatttaagaacacatctatcaatacgccgtttagaagcggatatacatcccgataaccaagcctctagggcattattaaccaagcttggttttgagcaagaaggctatttaaagcaacgctggattgttggtgatgaagtgtctgattccgctatttttggtttgttgctaccaacttatatcaagtaa

SEQ ID NO: 2571 - DNA, 639 bp, Proteus mirabilis
ttaaccgtcaattgggcgtatgataaccaaccagaacagtcaactattgagcaagacgatatgattactattactgatgccgcacaggcacacttcgccaaactattggctaatcaagaacccaatactcaaatccgtgtttttgtcattaacccaggaacacctaacgctgagtgtggcgtttcttactgtccacccgatgcagtagagccgaacgacacagaaattaaatttgaaaaactttctgcttatgttgatgacatcagtgcacctttcttagaagatgcagaaattgactttgtcacagaccaattaggctcacaattaacattaaaagcacctaatgcaaaaatgcgtaaagtggctgacgatgcgcctttaattgaacgtgttgaatatgtactgcaatcacaaatcaacccacagttagcgagtcacggtggccgcgtaagcttgatggaaatcactgaagatggctatgctatcttacaattcggtggtggttgtaatggctgctccatgattgatgtcactttaaaagatggtatcgaaaaagagctacttaacctgttcccagaagagttaaaaggcgtgaaagatttaaccgaacaccaacgtggtgatcactcctactactga

SEQ ID NO: 2572 - DNA, 1866 bp, Proteus mirabilis
agcgtgtacaataacacgcttatttctacaatgcctgaggcaaattttgtgatcgaaaacttgcgtaatatcgccatcatcgcccacgttgaccatggtaaaactactattgtcgataaattactacagcaatctggcacgttcggtgaacgtgaaaccgttgctgagcgcgtgatggactctaatgatctcgaaagagagcgcggaattactattcttgcgaaaaatacagcgattaaatggaatgactatcgtattaatatcgtagataccccaggacacgccgacttcggtggtgaggtagagcgcgttatgtctatggtagacagcgttctattgctggttgacgcgatggatggcccaatgccacaaactcgctttgtgacacaaaaagcgtttgctaacaacttaaaacctatcgttgttatcaacaaagttgaccgtccaggtgcacgccctgattgggttgttgatcaggtctttgatctgtttgttaacttaggtgcgactgacgaacaactggatttcccaattatctatgcatcagcattaaatggtattgcgggaacagattataatgacatggctgatgatatgactccattatatgaagctatcgtcaaatatgtagagccgccaaaagtcgatctggaggggaccttccagatgcagatttctcagttagattataataactatctgggtgttatcggtattggccgtattaagcgcggtaaagtaaaacctaatcaacaagtgactatcatcgatagcgaaggtaatacccgcaacggtaaagtaggtaaagtattaggtcatttaggcttagagcgtatcgatgttgacgttgcagaagctggcgacatcattgcgattacaggtttaggtgaattaaatatttctgatacgatttgcgaagtaggtgctgtggaagcattacctgcattagccgttgatgagcctactgttagcatgtatttctgtgttaatacatcaccattctgtggtcgtgaaggtaagtttgttacttctcgtcagatcttagatcgtctgaaaaaagagttagttcataacgtagcactgcgtgttgaagagactgaagatccagatgcattccgtgtatcaggtcgtggtgaattacacctatcagtactgattgaaaatatgcgccgtgaaggttacgaattagccgtatctcgtccgaaagttatcttccgcgagattgatggtcgtaaacaagagcctttcgaacaagtcactatcgatattgaagagcagcaccaaggtgatgtgatgcaagcgatgggtgagcgtaaaggtgaaatgcgcgacatgcaaccagatggtaaaggacgtgtacgtttagactacattatccctagccgtggtttaattggcttccgtactgagtttatgacgatgacatcaggtactggtttactgtacgcaacattcagtcattatgacgatgtgcgcccaggtgaaatcggtcgtcgtaataatggtgtgatgatctctaatggtcagggtaaagctgttgcttacgcgctgtatagcttacaagatcgtggtaagttatttgttactcatggtgcagaagtttatgaaggccaagttattggtattcatactcgctctaatgacttaacagtaaactgcttaacaggtaaaaaactgacaaatatgcgtgcttctggtacggatgaagcgacaacgctgacgccacatatcaagcaaacattagaacaagcattagagtttattgatgatgatgaattagtggaagtgactccacaatctattcgtttacgtaaacgtcatctctcagaaaacgatcgtcgtcgtgcttatcgtagcaaagactaa

SEQ ID NO: 2573 - DNA, 1392 bp, Proteus mirabilis
agaaataacaaaggatacaaaatgagagcgttatacgattctaaaagtaaaacaatcgatgatcgcggtattaaagcgctgttatccaatgaagctaaatattcaacttggttgatgtttgaggcgatgctcgctcaagctcaagctgaacacggttttattccacagtcagcggctgatgaaattaaagaaaaagcgggcattgagaatatcgattttgaagaaatgaaccgcatttaccaaaaaatcggtcatggtttcctgccctttttaaaagtgttagttaaggcatgttcccaagagagtggtaaatatgtgcactacggcattaccacgcagaatattcagcaaagttcacagctttatatgatgaagacagtgcaccataaatttatgttgctacttggggagatcatcgaaaatttagctaacttggcagaaaaaaccaaacatatggtcatgcccggtagaacacatggccgccatgctattcctattacttacggctataaagtatcggtctggatcagtgattttatcgactgttatcagcgcatgagagagtgtgaaaaacgcgtctttactatcatgatgggcggtgctgtgggtgcatttaactcaatgccagaagtgggtatgaaggtgcaaaaacgtgtggctgaattagttggcatggaagcgatggaggtgccttctcgtaaccttagtacacataaattagagtatatggctaatttggcattgatggctaatatctgccataaaattggtgaagaagtttatagtacgacacttgaggaaattgcggaagtttcggaagggtttaccaaaggtacagttggcagtagcactatgccgcataaaattaaccctaaactggctaaagggatcatcgctaactcacaaaaactgtattctttacccagtgtgggtatgtattctgcggtaagaccttatgaaggggatagtagctcctatatgttatttgatgggttactggaagaggcattagagctgacaacagaaattctattaagaacagaagagctttccagaacaatagtaccgcatgaagagagaatgctacataacgtcatgagaaataaaggattagataatacagagtacgttatgatgaaaatggcagaaaaactaggcaaagataaagcacactctttattgtatgaagaggcgatcaaaacagcggcagatggcgaagatttctatactaacttgattaaaaatcccgttatctctgcggcatttagcccagaagaaattaaagcaatgcttgatccaagagcctatatcggtttatcggtggaaattgcggagaaagaagctaaacgcgggcatgtggctagccaagaaattaaacaaaactatcaataa

SEQ ID NO: 2574 - DNA, 1248 bp, Proteus mirabilis
ccactatgcaattatcatcaggaaaccgttatgaaaaatgttgcgataagtggatgggaacttaatttaccttcaatagtaaattttgaacaactttctgaacaactcttattaaaaagaacaattaaaacagagaaatacttctctgatgattattttgtagaatattttaaatttaatcataatccggcggtgatcccctatcaaaatattcccaatgatcattttgaaatattaacgcgattaattgataacagtttaaaacgggctaatatcaccctagaaaagcttcgcgcttcacgtaccataatgtatcttgcaggtcacgggcctagagctgattttatggattaccaagggttttatgataaaaacgatgccgaagacgttcaatattctccacagataaaatcactccatgcagcctcttttgcacaggatgaattagcgaataaattgtgggctgaatatcagttagatttcccacctattcctatctattgtgctagtaattctgcgttaatggctgtgcatataggacataatgaaataagccaagatatggcggatattgtaatagtattgtcgtggaatagcttacttttacaagatatagcttttatggatagccaaggcatgttagttgaagcgcacgctcaacctttgagtaaatacagtgatggggtcaccttatcagatggttatgccgtgatgattttagaaagccaacaacagataaactcgagacaatatcttgcacctgcttatatctatcattccgtttttatgcaaagtaatgctgaacggacaatgggaggcacattatttaacttttatacgatatcaaaagtgatttctcagcttctcgatcttagtcattatttaccaagtgatattggtgctatttttattcatggtaatggttcgattattagtgataaagctgagacggtagctattactaacatctttaaacaacccattcctattattagctataaagggcagataggttatatttctaattgctctggtattattgatttaatgattatagctgattcattaaaaaataatcgattgatcccctcaactacacattatccaatagatgatggaatggaggttaatttcctcactaatcaagagtgtgtgaactatagcgctaaacctattttaaaaatcggcttaggtatggatggctctattattgccatgttattaatcgcaaatggagagcaaggatga

SEQ ID NO: 2575 - DNA, 564 bp, Proteus mirabilis
agatatagcaaacgccaatcacatagcaaaataggagctcataagatgacacaaaatcagttaccgctattagggatcaccgcttggagtggtacaggtaaaacaaccttactaaaaaaacttattcctttgttgcgtaacagaaatattcgggttggtatgataaaacatacccatcatgatatggatgtcgataaaccaggcaaagacagctatgaacttagaaaagccggagccgaacaaacattagtcgctagtcaacaacgttgggcattaatgaccgaaacccctgatttagctgagctggatttgtactatctcgcttctcgttttgatgcaagtaaactcgatatgattttagtggaaggtttcaaaacagaggctatccctaaaattgcactttaccgtcatatcaatgagcgaagtgttaatgagttactggatgaacatgtgattgcactagctagtgatagtgatttagacacatccctcccactgctagatattaattcgccagaagctattgctgattttattattcagtggctaacggaaaaaaaatag

SEQ ID NO: 2576 - DNA, 363 bp, Proteus mirabilis
acacctctaaatcatgtaataaaccaaataattattttgaggagaactctgatgaatcccaatatttatcaagagatagaaaataaccctcgctttaaagaactggttaaaaaacgtagtcgtttctcatggggactttcgattattacacttgttatgtatgtctcatttatattgctgattgctttttatccacaatggttaggtacaccgctctatgaaggcagttacattacacgaggtattcctatcggtattggcttaattatcgcctcttttctactaacagggatttacgttattagagcaaatacagagtttgacaaattaacggcagaaattcttggtgaggtagaaaaatga

SEQ ID NO: 2577 - DNA, 1347 bp, Proteus mirabilis
tgccaggtaaaatcaattagtttttataatgtggaaatttatttcccgataaggataactatgtcttttcaggaacaacagattacatttgatagtcgtcatcatcagttaaccaatataaatgtttggacaccagatagccagtggttagtttatgatgtacgtcccaatggtggatcttttacaggattaaccatagaaaaaattcatgcgaaaacaaaacagcaacagataatttacaccgccactcaaggcgctcatgttggggttgccacaatcagccctgtggcaccggtacgttatgcttttattcatggcccagaaaatcccgatgatttatggcattatgattttcatcaccgtcgcggtgtgattgttaatgagcaggaagatcttggtgcagttaatattgatgcttgttccctgacatcgccttatcaagctggcgcgttacgtggtggaacccatgtgcatgtgtttagccctgatggtacacgtttaagctttacttataatgatcacataatgcatgagttagggcgcgagttcgatcaacgtaatgttgcaatcgcagtgccactcaaagccgttaaagttgcgaaaaagcacccccgtgagtatgacggtgaatatttctgtaccctcataagccaaacagtcgcttatccacaaaagggcagtgatgaaattaataaagcctatgaagagtgttggataggtaaacaaggttataccaaagctgatggctcacaacagcgttgggctattgcttttattggtgatacggtcagtgaaagtggtgagaaggtcgctgatatcttcttagttgatttgccagatgatgatcatgctttcagtctagaaggtgataaacctctggcaggaacagagacgacgatgccagctcctgcacaagggattgaacaaattcgcttgacgaatacccaccatagaaaatatcccggtgttttaaatcaacctcgtcattggttaagaagttcaccgcaaggagatgcgattgcttttctgatgaaagatgatgatggtgttgtccagctatataccgtttcgccaactaccaaagcgattagacaggtcactttacagcaatgggatattcaatctgcattcacttggagccatagaggagaatatctcacctttatttgtgataatagtgtgatgttatgtaatgctaaaacaggtgaattaacgcgattaactgataaaacagcacaagcaccaagtggtgacgcagtcgtattttcacctaatgatcagtatattgcttttatgcgtgatattgatggttatcggcaaatatttacggtagaaagtgggttataa

SEQ ID NO: 2578 - DNA, 678 bp, Proteus mirabilis
tgctcaccaaactttattggtcgaggtagtaaaagcatgagtaaatttatcgtttatcccgcagtaagcagtaaacagctagggttttatatcgacagtgctcgctgttcgggctgcaaggcgtgtcaggttgcttgtaaagataaaaataacctcgatgttggccgcaaatttcgccgtgtatatgaaatcactggtggtggttatagccgtaatactaacggtgcattaattaataatgtctttgcttacactttatctatctcttgcaatcattgcgatgatcccatttgtgttaaaaactgcccaactaccgcaatgcataaacgcgaaggtgatggcattgtgatggtagatactgacaaatgtgttggttgtggcgcctgtgcgtggtcttgtccttatggcgcaccgcaaatggatcctgaaaccaagcagatgtcaaaatgcgatttttgtatcgacttacaacaaaaaggtgaacagcctgtttgcgttgcgacctgcccacttggggccattcaatttggtccaattgatgaactacgtgaacgctatggtgaagttaattatgtcactggtttgccttctcctgaaataactcatccaaacctagtgatcaaccctcaccaaggggcaaataatgacactataaataataaaggagaaataaaatga

SEQ ID NO: 2579 - DNA, 669 bp, Proteus mirabilis
gggagcacaaaaatgaatcgcattttaacgttagtttttgtggcatttgcttttgtgttatcaggatgtgcagagccagtcaaaacagactataccgcctttaaagcaagtaaaccaaaaagcattttagtgctgttacctaaaaatcagactccagaagtagaagctgcccatagttttttatctcaagtgacttatcctttggcggaagctggctattatgtttttcctgtcgccgttgttgaagagacctttaaacaaaatggtttgtcaacgggaagcgatatccaagcggtgagtcctagtaagttacgtgagatttttggtgcggattctgtgctctatttggatgtcacccaatatggtacttcttatcaagtgatcgccagtgagacgcgtgtcagtgccagtgctaaattggttgatttacgtaatggtgctttactgtggagtggacatgccagtgcatcgagtgcagaaggggatacagcatcgaatggtttggtgggcatgttagtttctgcagtagtgactcaaattgttgatactattgcagataaaagtcatgaaattgcaggagtagcaagtgtgcgtttactttctgctggacatgccaatgggatcttatatggtcctcgctctccccactatgaaaaagagggacaataa

SEQ ID NO: 2580 - DNA, 1425 bp, Proteus mirabilis
ccaatgcaaaaaggaaatatatgggttgtcgatgatgatagctctattcgctgggtacttgagcgagccattacacgagaaggccttacatgtaaaaccttcgaacacgctaatgacgtcctcagtgcactcaatagtgaacttcccgatgtattattatcagatattcgtatgcctgatattgatggtttatctctattaaaaagcgttaaagagcaacaccctacgttgccggttattatcatgacagcgcattctgatcttgatgccgcggtaaatgcttatcagcaaggggcatttgattatctccccaagccttttgatattgatgatacacttgcactcattcatcgtgctattacgcactatcgagagcaaaaacaacctaatacaacagaaactaaccttcaatctgtctctgacatgattggcgaagcccctgcgatgcaagaggtttatcgcattattggccgcctttctcgctcatcaattagtgtgcttatcaatggcgagtcgggtactggtaaagaattagttgcacatgctcttcatcgccatagtccgagagcacaagccccttttattgcactcaatatggcggctattcccaaagacttaattgaatcagaactttttggtcatgaaaaaggggcatttactggtgcatctcaagtacgccaaggccgttttgaacaagcaaatggcggttccctctttcttgatgaaattggcgatatgccactggatattcaaacccgcttattacgcgtcttggctgaaggacaattttatcgtgttggcggttatgcccctgtgaaagtcgatgtgcgtattattgccgcgactcatcaagacttagaaaaacgcgtaatggaaggtgattttcgtgaagatctctaccatcgactcaatgtaatacgtattcaattgcccccactgcgtgatagaacagaagatattccaagcttagcgcgttattttctccaaaaaaccgctcgagagcttggtgttgaaaccaaagtgctccaccagcaaagtttacattgcatgatggaataccactggtcaggtaacgtcagacaattagaaaacgtatgtcgttggttaacggttatgaccgctagccaagagattatgccgcaagatttacctcaagagatccgccaatcagatgagaagagcaaatcgatacctcgagtctcctctcaacattggtcacaacatctttcattatgggcggatgaggtattcagtgaaggcaaagaaaatattcttaatgacgctctaccgcaatttgagcgcaccttactactcagtgcgctttcctatacaaaaggccataaacaagatgctgctcgtttattaggatggggaagaaatacgctgacacgtaaattaaaagagttaggtatagaggagttttaa

SEQ ID NO: 2581 - DNA, 198 bp, Proteus mirabilis
tatgttaaaaataaccatttttctatttttatcatattcaatcattttatttttaatagactaatctttatttatatattcatttttggagtattaaattatgttgaaaaatattgctatcagtctttctttacttcttatcacttcttcggctttttcagccacactggcagaaagagaattacaacagaaatttga

SEQ ID NO: 2582 - DNA, 1482 bp, Proteus mirabilis
gtgagcaaaaaattcaccaaaaaatgtgtaaggccactgcacttaataaaaccattcgccaggagagttactatgtcccttgaacatgtgttatccatgattgaagaacataaagttagatatattgacttacgtttcactgatacccgcggtaaagaacaacatattactattccggcgcatcaagttaacgatgatttctttgaagaaggaaaaatgttcgacggctcctctattggtggttggaaaggcattaatgaatcagatatggtgctaatgcctgatgctacaacagcgatgcttgacccatttttccaagatccaacattaattattcgttgtgatgttttagagccaggcactatgcaaggttacgatcgtgacccgcgctctatctcaaaacgtgcagaagactacttaaaatcaagtggtatcgctgacaccgtcctatttggccctgaacctgaattcttcctttttgatgatattcgttttaaaaatgatatctctggtgcttcttatgccatcaatgatattgaagcagcatggaataccaatacacaatatgaagaaggtaacaaaggtcatcgcccaatggtaaaaggaggttacttccctctccctccggttgattcctcacaagatattcgctcgaccatgtgtaatatcatggaagagatgggcttagtggttgaagcacaccaccacgaagtcgcaactgcaggtcaaaatgaagtggcaacccgctttaataccatgaccaaaaaagcagatgaaactcaaatttataaatacgtagtacaaaacgtcgctaacgtatttggtaaaaccgcgacctttatgccaaaacctttagtgggtgataatggctcaggtatgcactgccacatgtcactgtctaaaaatggtgtcaatttatttgctggtgataaatatggcggattatctgaaatggcgctgtattacattggtggtattatcaaacatgctcgtgcattaaacgcatttactaacccaaccactaactcatataaacgcttagtgccgggatttgaagcccctgttatgctggcttattctgcccgtaaccgctcagcatccattcgtattccggtagtcgctagcatgaaagcacgccgtatcgaagtgcgtttcccagatcctttagctaacccttaccttgcatttgcagctcaattaatggcaggtcttgatggtattatcaataaaattcacccaggtgatgccatggataaaaacctctatgacttacccccagaagaagctaaagagatcccaacagtggcaggttcattagaagaggcgctcaatgcccttgataatgaccgtgaattcttaacccgtggcggtgtattcactgatgatgctttagacgcttatcttgagctattacgtactgatgtgcagcgtgttcgtatggcaccacatccacttgaatttgaaatgtattacagtgcgtaa

SEQ ID NO: 2583 - DNA, 588 bp, Proteus mirabilis
ctattaaaaaaccagaatatcacagccggtatactcgccggtggccaagctactagaatgggaggcgctgataaagggcttcaactcttacatgggctacctttatacctccatattgcccaaaagttatcaccacaggttgcctctattctgattagtgcaaaccgtaatctggaacgctatcgccaaagccagtatcctgttatcaccgatgaaaccagcgatttttccggtcctttagctggaatgctggcattattaaaacaagctcaaaccccttgggttgtgtttgttccttgtgatgtcccctattttcctagcaacttggttgaaacgctctatcgtcacaaaggggatgccttagccgtctatgccgacgatgggcagcgagagcacccaacactggcactgttaaatcgttgtcttattccaacacttgaggcttatctcgctcaaggtgaccgtaaattaatgctatttatgcgccaaatcgccgctaaaccggttttatttgctaatcaggccgcagcctttattaatttaaacacacctgaagatatagcaaacgccaatcacatagcaaaatag

SEQ ID NO: 2584 - DNA, 246 bp, Proteus mirabilis
atagagaaaaaagacccattgataaacaggagaactgaccccatgtctgcaacccgtaagcgttttattgctggcgcagtatgtccccactgtcaagcccaagatacactcaaaatgtggcgagaagataaagtggatattgtggaatgcgctcaatgtggtcatcagcaaaggcaaacagacggtgaggttagtgcacttgtgcgtgaaaatgaacaggtcatcgggatctttacaccacaataa

SEQ ID NO: 2585 - DNA, 411 bp, Proteus mirabilis
ataagagaaaaattaacctttccatgtaaatgcaaaaggttttctcatctcagaatcagctattctagggaggggattatgtttagtgtcattgttatcttttgggcgttgtgtattctttgcctgattaatatgatgcgttatttctcatcaattcgggtattactcaccatattgcgccaatctgatccattactttaccaatctgtcgatgggaatggatttttcactatgcatggtcaattttcaaaacagttaagacttattcgatatataaatcaacgccaatatactaaccaccatgatcctgaagtgattatgcgttgtgaacggatttatcgacaattctacctagtaagtcgcttttgtattcttgctgtagcaagcttgatcgccatgattatttggtag

SEQ ID NO: 2586 - DNA, 1005 bp, Proteus mirabilis
tcaagagaaaattgcccgtattccttgctgtatatctttcgtctagaaggtatactgaaacctttctttttattctatgtatcgccatgcggatataacatgcaaaagtttgataccaaaacctttcaggggctgatcctgacattacaggattattgggctcgtcagggctgtaccattgttcaaccattagatatggaagtaggagcaggtacctcacacccaatgacctgtttacgagcattaggtccagagcctattgcagcggcttatgttcaaccatcacgccgtccaactgacggacgttacggtgaaaaccctaaccgtctacagcactattaccaattccaagttatcatcaagccatcaccggataacatccaagagctttatcttggctctttaagagaattaggattagatcctactatccatgatattcgttttgttgaagataactgggaaaacccaacattaggtgcttggggattaggctgggaagtttggctcaacggcatggaagtgacgcaatttacctatttccaacaagttggcggattagagtgtaaacccgtcactggcgaaattacttacggtttagagcgtctggcaatgtacattcaaggcgttgatagcgtttatgacttagtttggtgtgatggcccattaggtaaaaccacctacggcgatatttatcaccaaaatgaagtggaacaatcaacttataactttgaatatgcagatgttgacttcttattctcttgtttcgaacaatatgaaaaagaagctcgtgagttgttagagttagaaaaacctctgcctttacctgcttacgaacgtatcttaaaagcaggtcacacttttaacttattggatgcacgtaaagcgatttctgttacagagcgtcaacgctatattttacgtatccgtactttaaccaaagccgtcgctgaagcttattatgcttcccgtgaggcgcttggtttccctatgtgtaaaaagtaa

SEQ ID NO: 2587 - DNA, 234 bp, Proteus mirabilis
caaggagaaaaaaccatggacattaaggaaatagaagagttacttattcaattagagagtaaaattgctttccaagatgccaccatcgaagagttaaatcaggtggtcacacaacaacaaattgaaattagtcgttttaaagaggccttaaaaatcgtcaccgaacgattgaagtcatcccaatcgtcaatgctcgctcgccctgaagatgagaccccaccacctcattattaa

SEQ ID NO: 2588 - DNA, 1311 bp, Proteus mirabilis
ttaatggaaaatattattatattcatctcaatatttattttgatagtattactttctagttcattatcttggttttatatcaaatacacattatggttactttatataacccttagccatttttatcgaaatttatgttttatcgttttactctgtgtcgccatctcgattttggagggtttttatcatcacctcacgctactgctcaaagagcaagtagcatattccaatttagggcatatcgaaatttataaaaaagataataaacaggatattactgataagaaagattatttggaaataaccaatgctgaagaaatcatccatttattaacttatgataagcagttattagaaaaaattcaggtcatttcaccacaaattattttttcaggcatgatagaaaatgttatcaataaaaaagcagtattgttttctggcctagctatcgagcctaagtcattattaactataggagcatacgatctaactgtttcagggagtgaattgtctcatgtcagaagaacagaaatcacgatagataagtttattgctgatgctataaatataaactatggggatttagttaatgttgtatttattcataataatgaaaaaatggtattaccaacttatgtacgtggtatttttaacacacaaataaatagttatccttatgccatgatcaaaattccattagaaacactacaatatataaaaaaaagtaaaagtgtctcaaaaataaatattctattaaaaaatgtgcatgatattgatagcgtaatagctaaaataacaaggattaataaagaaaaatctttaaatttgcaagtgatccctgttattgagagacaaagttatattatttctattgtgacattctttaagtggtcaatgctattattgtatagcattattgctatttattattattttttagtgaataaaatcattatcatcactatcaaaaaagctattggtgatctgttcgaatttaatcgattaggtatttggcgaggtagtttttctcgattatttattttattggctatttttatgactataacaatttctataacgatattattaattcatcagttattatcttggttgattaatttgaaacaaatcaatatttctttatctgataataatagctattcattaatgctcccttggctatggcaatatgatgctatgtttaaaatccctctattattatttttttccgcaacaatcgcttcgtgtatctctatttttaaagttagccactatttacaaaaatatcaaaaaaataatattactatttag

SEQ ID NO: 2589 - DNA, 1704 bp, Proteus mirabilis
aacaggagaaaggttatgcgctggctgataaaaagtttggtatctctgatacttatcgttattttatttattattgtgatttatgcctttcttcaaacacaatggggtgcgcaaaaaaccagtgaatggttaacacagtatagtgattatgacattcgcttttccggtattgaacatgatttaactcaaccagaacaaattgttgtttatgatctgtccattaaccccaaacaagataaaaccgccgtattagctcaatcagcacaacttagatttaactggcaattttttactatgccgtcccatctgcaaaaaattactttagagaatggtaaaattattttagctaataaaatagctccccttcctgttagtgcagatattctccagtttaaaaatatgcagttagatagcatgccaacatctagcacaacattcacctttagcgctaacaaaataacgggaggtatcacaccttggaaacctacctcgaccgatcctattggtgcggggcattttcagttttccattgctgatggcatgataggaaaaaatagctttaataattttattgttgctggcgaatatcaaccaaatcgtattttgattgaaaaattagccacccagttccttaatggctcactctctttatcaggccaatatcaagataaccaatggcaacttaatgatgtttacttaaccggactgcgttggcaatccacaaaaaccttagaagagttacaacaatcattaagtcaatctccagcaatgactatcaagcaattgaacattgttgattttactgccgaagggaaacagtgggcaataagtggatttgctgggcagttttctcaaattgcgtggaataatagcctatcactgacatccggtgagctaaacaccgatgatattgtgtataaaaatcaacatgtcactgatgtgatcgctaagttaaatcagcaagataatttatttaacatagataatttaagcttacgctatgaaaaagggctaataaaactagcaggacaatggaacagcgagacaaagactttaaatattgaagatgcaacactctcaggtattttatataccctacctgagcaatggctctccttctttgctaaacctattgagcaagatgtgaagagtatcaatattaagcagctatcattaaaccaatctatcctcattgatattaatcccctctttccttttcaatttaccggcctaacaggccaactgaaaaatttaatcatcgccaaagatgggcaatggggattatggcaaggcgccgcgacgttaagtgctgatagtggcacattaaatggcgtagagcttcgccgccctgacctaacattaatgacacaacaagatactgccattatcccacagttttctgctttcgtagataaaggcatcgtgcgtggctctgctgcattagaacaaaacaataaccaaagactattttctcttatcgtcaatgggctgaatgtgcccctctctttgcctaataatatgggttggaaattatcgcaacctaccgatggaacaggacaatttaccttaaagcttaaaggcaacttagccgctgacgctgttataccgaccttaaatggtacattaataggtaaaaaagatgaccaaacgcctatcgatgacaggatgcaagacggcgaaataataaataatttatccttttga

SEQ ID NO: 2590 - DNA, 591 bp, Proteus mirabilis
gaggtaacccttatgagtctctataatcaatcgttattgcctcctacactatttttaaaattaggtgcatggcgacaaccgaccattatggttgataggattgtcgattttgtccctagtgaaaaacctattatcaaaacgattaaacatgtcacctttaatgatccctatttattaggacattttccaaccgatcctgttatgccaggggttatggtggcggaaatctttggtcaaacaagtgagtatttatcttttattgatgacttttgttcaatttataaaatagaacacaatattgaattaactacatttaaagaaatagccaaagcccttaatgagccgagatcagaacgaattttaattcagcatcgaagaaaggtttccggtgtattggcctcacaaaatttaaggtataaaaatgctgcttacccaggggataccatagagataacaagcattctattattttctgataaaagcaattttaaacactattctgttgaggcaagagtgggaaagaaaatcattgctaatggcaccatagttaatttcagagaatataatcactctgaacaaaataaaaattag

SEQ ID NO: 2591 - DNA, 432 bp, Proteus mirabilis
attatgttgaaaaatattgctatcagtctttctttacttcttatcacttcttcggctttttcagccacactggcagaaagagaattacaacagaaatttgaagaaaatattcaatctcgtgttgttgacttaaataaaagctgtgatgctaatataaaagttgcgtttgattggtcggcatttactgttgaggatctaaaaacaacaggtattgatggttattgcagtgaagggttaaaaggtgtcattaatacctgtgaaagctcgaaaatagcacaagaaaccgtaaaagagaaaatacagaatattacctgctctaaagcgtcacctcgtagtattgaacttaaagatgggacactgaattttggtattgattttaatgctgcaaatgatgccaacgctattcaaacgcatttaatgaataatctctaa

SEQ ID NO: 2592 - DNA, 1122 bp, Proteus mirabilis
aatattatgaaaagcgtctttttttatttgctgttactactatctattttgtgctttgctggttttgctcaatccagagatcctttttatccagaacaacctattgatagtaataacactcaccatttcattgataaaacagataatagtgaaactcttcaacaccaaaacagcacattacaccatcgtatctacccactacagtatgctgatgtaaccaccgtggcacagcagttaacgaactatggaatttcattactcagtgatcatggacgaatagccatagataaagattcaaatagcttatccattattgatacagaaaaagcacatactgaaatttctgattggttaaaaattaaagaaacaccacagcaacaggtgcatattaccgcacatatcatcagtagcagtcaggatgcgttaaatgagttaggaacgcagtggggattactcaatatgaaatcggcaaatttagaaggtacatcaaacaatactacaacaccccataacatagcatcagcaccgctcacagcaccttctcttgccgcattggcactgcatcaaaaaacaaaaaaccccttacattacatagcctttaatatcgccagaattaatagtcgccttttagaattagaactaagcgccttagaacaagagaaacaactcgccatcattgccagtcctcgattaacggctgcacatgaaaaaacggcatctatcaagcaaggaaccgaaattccctatgtcagcagagataacgacaccatccgagttgaatttaaagaggctgttttggggatggaggtaacgccgatcattcaaagaagcaataaaattagattgctattaaaaattagtcaaaacacaccaggtattgccttagtacaaggaggtagtgaacacctttcaatagataaacaagaaataatgacagaagttactattcatgatggtgagactctgatgttaggaggaatatttcaacaaaagcagcaacagcatgcagcaaaaattccttttttatcttcactgccattactagggatactttttagccataagcgtgaccaacatagtcgtcatgaattggttatttttattacacccaaattaatctaa

SEQ ID NO: 2593 - DNA, 630 bp, Proteus mirabilis
tacgaaatgaaaaaaatttggctggcgttagcaagtatggtgttagcatttggtgtttcagctgccgatatttctgaaggtaagcagtatacaaacctttctaagcctgttgcaggtgctccacaagtggttgaatttttctctttttattgccctcattgctatcagttttctgaagtgtataaggtcaatagcacagttgaaaaaaatgtaccagaaaacaccaaaatggctcgttaccacgttgacttcttagggccgttaggtaaagagatgacccgtgcatgggcggttgctattgcattaggtgttgaagaccaagtctctccagccttatttaaaggaatacaagaaacacaatctattcgctctgttgatgatattcgcactacctttattaatgcaggggtaaaagcggaagattatgatgcagcaattaatagttttgtggttaactcattggtaagccaacaacaaaatgcggtaactgatttccaaattaatggtgtaccggcaatggttattgatggtaaatataaaatgaaaaatgatggcattagtgctaaatcaccagaagagtatgcaaaagcttattctgatgtcgtcaatcaattactgatgaaaaaataa

SEQ ID NO: 2594 - DNA, 597 bp, Proteus mirabilis
agaaagatgaacgatgatgttgaccgatgtcctgagtgtcaagtaagggcatattatacggatgattttgtccgtgtttaccaagcctattctactactatcgctcagagcgcagtcgcaaatggtacttttgtttctcccccttttagtatgacccgtatgacttgggtaaaaccctcctttctttggatgatgtatcgctcagggtgggggcgcaaagatcccaatcaagcgtctattttggctgttgatattacccatgaaggctttcaacagatgctaacacaaggtgtggtcagtcatttcgatccagaccactatgtgagtgccaaagaatggcaagaagcaacagaaaccagtgatattcgtattcagtgggatcctgaacgagatatttatcttaatcgcttaagttatcgcactattcaaatagggttacgtaatcaagcagtagaaaaatattgcaatgagtggattgttaatattaccgatattactgataaagtgcgtaaaatagatacttgtattactaatggcgatctagatactgcatatagcttacttcctatcgagcaaccttatcattttgcaaaataa

SEQ ID NO: 2595 - DNA, 2412 bp, Proteus mirabilis
atcttagcgaaatcgctcataacgaaaaataacagcttatttatcaactactcaggcaatacaactactggcatcactattatgactcctcttactattggtcttatcggtaatcctaatgcgggtaaaacaacgctttttaatcagttaacaggctctcgtcaacgtgtcggtaactgggcgggtgttactgttgaacgtaaggtaggtcgctttacaaccaaaaatcataaaattgaattagttgacttaccgggcacttattctttaacaacaatttcagaacagacctctctggatgagcaaattgcttgtcacttcatcttaagtaatgaagcggatatgttgattaacgttgtagatgcttccaatcttgaacgtaatctttatctcacattacaactgcttgaactcggtattccctgtatcgtggcactgaatatgcttgatattgctgaacaccaaaatatgcaaattgatattcaagcactttctgaacaactcggttgtccggtgatccctatggtatcaaccaaggcatcagggattgataaactgaaagacactattgatagctttccagccaccaaaagaaaacccgaagagttactaacttcttatccaacatggttattaaacgaagttgaatctttagctgaaaaaattaatcacgatgaattcaatttacagcaacgccgttggatggcattacaatgtttagaaggggatatctatactcatcaacgtgctgaaattacctcacaagagataaaagccattcgtcagcgcattcaaactgagcatagtaatgagccagaattagtgattgccgatgcacgttatcaaaacattgagcgtatttgccatgcagtcattaatatggagtccattaagcccaatcagctcacacaaaatatcgataaagtgatattaaatcgctggttaggtgttcctatcttcttgtttgtcatgtatttaatgtttgtgcttgccatcaatattggtggagcattgcagcccgcttttgaaggtggctctgaagctatctttatacatgggatccaatggctaggtgcaacattcaatttccctgaatggttaactattttccttgctcaaggtgttggtggtggtattaatactgtactccctctggtaccacaaatcggcatgatgtatctctttttatctatccttgaagactctggctatatggcacgtgctgctttcgtgatggatagattaatgcaagcgctaggattgcccggtaaatcctttgtaccgctgattgttggatttggttgtaacgtcccatctattatgggggcacgtactctagacgccccaagagagcgattaattactatcttaatggctccctttatgtcttgtggtgcacgtttagccatatttgctgtttttgctgccgcattctttggtaaaaatggcgccagcgtggttttttcactttatttattagggatccttgttgctattttgacgggtttactactcaaacataccattatgcgaggtgaagcttctccttttgtcatggagttgccggtttatcacgttccccatatcaaaaccttattaatacaaacttggcaacgtttaaaaggctttgttatccgcgcgggtaaagtgattatcatcgccagtatgtttattggtgcactaaatagcttcactttttccggtaaagcggctgatagtattaatgattctgccctcgcttccgtcagtaaagtaatcactccgttattgcaacctattggtgtgcataacgataactggcaagctaccgttggtttagtcactggggcaatggcaaaagaagtggttgtgggaacattaaatacactgtacaccgcagaaagtattgttaatgaacctttcgttcctgaagagtttgatctatggggcgaaattggtgacgcctttgctgaaacttgggatagcttaaaagaaacctttacattcgccgcactttccaatcctattgaggcaagtaaaggtgatggtgaaatggatacggggactatgggtaccatgggcagcaaatttggtagtgcaatagcggcctatagctacttaattttcgttctactatatgtgccttgtgtctccgtaatgggggctattgctcgtgaaaccagtcgtggttggatgacattctctattctttggggattaaatattgcttactcacttgccgcgttattctaccaaacagcgacatttagcgaacatccacaaagtagtaccatcaccattgctgctgtattgatatttaacttaattgtctttgtactattacgtaaatctcgtcatcgtctcagttttaatttaagtaacaaacgctcattagcgaaacagtgctgtggtaaacaaggtagctgtcactaa

SEQ ID NO: 2596 - DNA, 1398 bp, Proteus mirabilis
gataaagcgaaaaacatttttttttgggatcttttgtctatgagcatgtcatcaccaaattctgctccgcagagtttgctccaacgcctgtttaaacttcaggaacacggcaccacggttcgcacagaactgatcgccggtgtcaccacctttttaaccatggtttacattatctttgttaacccacaaattcttgctgcagcccatatggatattaaagcagtgtttgttactacctgcttaattgccgcgttcggtagtattttaatgggactggtggctaatctacctatcgccgtcgcacccgcgatgggtctaaatgccttttttgcctttgtcgtagtaggagcgatggggtattcatggcaagtggccatgggcgctattttttggggcgcagtaggtctctttttgcttactctctttcgtatacgctattggataatagcgcatattccgcttagtttacgtgttgggatcaccagcggtatcggtctgtttattgccatgatgggcctaaaaaactctgggatcattattcctaacaacgacaccattgtgactatcggtaattttgcctcccacaatgtgttattaggtgctctaggcttttttattatcgccatccttgcggctcgtaatattcatgcggcaatcttaatatcgattattatcactacggttattggcctgttattaggggatgttcaatatcaaggtatctttgatattcccccatctattgctcccgttgtagggcaggttgatattgttggcgcattagatattggcttgtctggggttatctttgcttttatgttggttaacttatttgactcatccggtacattaattggtgtcaccgataaggcgggtttaacagacgataaaggtaaattcccacggatgaaacaagcgctctatgtagatagtttaagttctgtcgcaggctccgccatggggacatcatctgttaccgcatttattgaaagtacctcgggtgtttctgttggtggtcgtaccggattaactgcagttgtggtcggtattcttttcttactcgccattttcttatcaccactggctggaatggtgccaagctacgctaccgcaggggcattaatttacgtcggggtgctgatgacctccagcttaacgcgcgtaaaatgggatgatttaactgaatccgtaccagcgtttattaccgccgtgatgatgccatttagcttttctatcaccgaaggtatcgcccttggctttatcgcctattgtgtgatgaaagtgggtactctacgctggaaagaaattaatctctgtgtggtgatcgtttcactgttatttattctaaaaatattattaattgatactcatgttattgatttaaataatttattttaa

SEQ ID NO: 2597 - DNA, 1050 bp, Proteus mirabilis
caacagtggaacagaactaacatgacgacttcagtagaaaaaaaggctcaaaagcctattgtattcagtggtgcacaaccttctggtgagttaactatcgggaactatatgggagcactacgtcagtgggtacaaatgcaagatgactacgattgcatttactgtatcgttgaccaacatgccatcactgtacgccaagatcctaccgaactgcgaaaaagaaccttagatacactggctctttatctcgcttgtggcattgatcctgaaaagagcacaatctttgtacaatctcatgttccacaacatgcacaattaggctgggcgctaaactgctacacctactttggtgaattaagccgtatgacccaatttaaagataaatcagctcgtcatgctgaaaatatcaatgcaggattatttgattatccggtcttaatggcagccgatatcctcctttatcaaaccaaccaagtacccgttggtattgaccaaaaacaacatcttgaattaagccgtgatatcgcccaacgctttaatgccatctatggggacattttcaccgtacccgatccttttattccaaaaggtggcgcacgcgtgatggcattacaagatcccgctaagaaaatgtctaaatctgatgataaccgcaataatgttatcgctttacttgaagatcccaaagcggcggcgaaaaaaataaaacgtgctgttacagactcagaagagccacctcgcgttgcgtatgatctagaaaacaaagctggtgtttctaacttattagatattttagcgggtgtaacaggtaaaactatccctgaactcgaagctgaatttgaaggcaaaatgtacggtcatctaaaaggcgcggttgctgaggctgtatcagatatgctgacaaatattcaagaacgctttaacaccttccgtaatgatgaagcactattaaataaaatcatgaaagaaggtgccgataaggcaaaagcgcgcgctcaaacaaccttagataaggtttatgaggctattgggtttattgctcacccataa

SEQ ID NO: 2598 - DNA, 2001 bp, Proteus mirabilis
caactttttgacatagtattaacaacagtaaggagaacaattatgacaaaaataaaccaacatcacattcctgcaaacattgcagagcacgccctgattaataaagagcaataccaaaaagattatgcattatccatcgaaaaccctgaggccttttgggcagataaagggaaaattgttgattggataaccccctatactatcgtgaaaaatacctcctttgatccaggccatgtccgtattcgctggtttgaagatgggcaacttaacattagccaaaactgtcttgatcgccatttagaaaaacgcgcggatcaagttgctattatttgggaaggtgattcccctaatgaatcgaaaagcattacctatcgccaacttcatcaagatgtttgtcaattcgccaatgtattaaaaaaactgggtatcaaaaaaggcgatgtggtggctatttatatgccaatggttcctgaagcggctgttgcgatgttggcttgtactcgtattggggctattcattctgtcatttttggtggtttctcaccagaagcagtggcagggcgcattattgactctaaagcaaaattagtgatcaccgcagatgaaggcttacgtgctggtagagcaatccccttaaagaaaaatgttgatgatgccctcactcatgtggatatcccgcctattgaacatgttgtggtcttacgtcgaacagggcaaacagaacaatggattgaaggacgcgatttatggtgggatgaaattgttcaaggcgtcagtacagaatgtgatgtggaagtcatgaacgcagaagatccactctttattctctacacatcaggctctacggggaaacccaaaggcgtattgcacaccactggcggttatcttgtttatgcctcaatgacctttaaatacacctttgactatcatgatggtgagatttattggtgtacagcggatgtcggttgggtaactggccatagctacttgttatatggcccgctatcaaatggtgccacaacagtgatgtttgagggcgtccccaattacccctccgtcaatcgtatggcccagattgttgataaacaccaagttaatattctctataccgcacctactgcgatccgcgcattaatggcggaaggagacaaagccattgaaggtacgcaacgaacctctttacgtattttaggctcagtaggagagcctattaacccagaagcttgggaatggttttatcaaaaaatgggacgtagccaatgccctattgttgatacatggtggcaaacagaaacaggaggtttcatgataaccccattgccgggagcaatggatctaaaaccaggctcagcgactcgtccattctttggtgtacaacctgcaattgttgacaatatgggggaaatacaagacggtgcttgtgaaggtaatttggtgatcgtagattcatggccgggccaagcaagaacattatttggcgatcatgaccgttttgaacagacttacttttcgacctttaaaggcatgtacttttcaggtgacggtgcccgccgtgatgaggacggtgattattggataacaggccgtgttgatgatgttttaaatatctctggtcaccgtttaggtaccgctgaaattgaatccgcacttgtcgcccatcctaaaattgcagaagcggctgttgttggtattccccataatataaaaggacaagctatttatgcttatgtcacgctaaatcatggtgaagagcctacggcagagctttatacagaagtgcgcaattgggtacgtaaagagataggcccaatagcaacacctgatatccttcattggacagatgccttacctaaaacacgctcagggaaaattatgcgtcgtatcttgcgtaaaattgcctctggcgacacaactaaccttggagatacctcaacactcgccgatccaggcgttgtagaaaaactgttagaagaaaaacagtctctatcactgaccatttaa

SEQ ID NO: 2599 - DNA, 1683 bp, Proteus mirabilis
atgcgtattgagttgtctattttaatctattgtattttatggtgttgtgcttttttttctgtagcgaatgaaagtcatatcgatccccctgtaccagtagatttaccgacagaaacacaacttagagatcaattactacaacaaaatgacaatgtctctttagtgaacttagcaccacaaaataaaagggaatttatcacaccttctgtacattgtttttcaatcaaacaggtaaaactccatcatctcgatgagttttcttcctcatcactgcaacgccaagtggcaaaatggcaagctgaattagttgggcattgtcagtcacaggcattgttagaacaagatatcaatattctgaatgcgctgctttatgatgcaggttatgtgaccagtgaggtgggtaaagttgatctttatgccgatgacgaggtattggatatcacattaaatgtcgggagagtgcaagacattgtttccgaagccccgacagataaacgctatttgatttcacaggcagtgcctgtcaaaaaaggtgatgttttaaacgttaaagatattgaacagggggctgacaatttcagatcccgtcctaatagtaatgtcaaaattcagatagaaccctcgtcaaaagaacatgagtcaattatttctctttctcaagtggggaaaaggacaatggcaggctcggtatcgattgataataaggagcagaaaatttacggagatctatttggtactacaagactaagctttggtaatctagcgcaacttaatgatactttaatggttattctttctagtcaactcgataccttaaaatcaagaggcatcaaaaagcagatctttttatggcaagtaccttatcattattggcgtgtgacattatttggttatgatattggttcaaaaatgagagtctctgaagtgacaaaagagttacaaaaaacgcgtcaacagcttctttcttttgagatccagcgccaatttagaccttcaacacagcgtacggtgactttaagtggtggaatacaatattacacttatcgcaatgaagtgtcaggctatcgcttatcagtccatgagcgtcgcagtccttatattaatgcgggtattgagcaaaattatcgctttatgagagggggtttccttaatacaaaatttcattataagcagagtgtttttattcctggcgcaagactatcaccgatagattcacttaatggtgtacccatttttaatcttaattttgatgcattaattccctttaaaatcacttcacagcaatttttttatcaaccagaaatgatatttcaactgactcgctcagatattgatggattacttgataaagcaaccattggtggtctgtatagcgtgtatggttttgagtccggcaaaggttattctgatgccaatcagtttgtttcccgacataaagttacttggcttacacccttgaataaccaaatgctattttccgccatagattatggttccgtttcagaagatagaaaaaaaattttttataataaaaataaatatttagttggtgcggcaataggattagaaggtagctttaagaaactaagttatcagttagtatggagcataccgttatcagccccttctagtcgagaagcaacaggatcgcagtttaattttaatacccaatttaacttctga

SEQ ID NO: 2600 - DNA, 267 bp, Proteus mirabilis
gtcgtacctgaggtaaatagttgggggttaaatccttccggtgagccttctgaacagtacactaatgttttcgcttgcacacctgctgaaatagccaaagcgagtaagccgattgtagcggttagcaaccctgtctgttttttggagcttctcatcattattctccgtcattattctgttgtgttttttggtttcctgtttaaaaacggaatacctttttattttgtcattgttcaattaaccaactgtattcgtttccgtcaataa

SEQ ID NO: 2601 - DNA, 978 bp, Proteus mirabilis
ctttcgctttttgacgctctgacggagggcataatggacgagttcaaacctgaaaatgaaattaagagtggcgataactcactcaaacctgatacttcggatagacccgaacgtcgcactaatcgacctcgtaataacccattaaaaaatgctcgtttctctgtatcccgtcaacagatgatgataggtgttggggtactggttctcattcttttaattattgcgataagctctgcgctgaaatcaccagacagtgataaagaaacaacggcctcaacaacaggaacagaaaagaatattgaactgtctcagccttcggtaacatcaacagacaatcaaacatccacacctcaggagctgacgggccaacaaatacagcagcctacaacgcagccatctcaaaatctccccccaatgattgactctcaaggtcaacgtgttgagatcccaggagatattgttgattcactcaatcaacaacaagcaggtgttaaccaagctgttaatcaacaacagcaaaatacacaaaaccaaccgacaacgccacaaactccggtgaccaaaccgcaaccggcaccaacacaaaaaccagaggtcaaacctacaccaaccaagccggtaacacctcctgcaaccacacagactaagcctgtggcaaaaccaaccacaaaacccgttgcatcaggagctttatcagcaaataacctagcagccattcctgcaacaaattatactttgcagttaagtggtgcgagtcgccaagatacgttagaggctttcgctaaaaaaaatcttaatggaaactacgctatttataaaacccagcgtaatggtaatccttggtatgtactcatctatggtaactatcgtaatataagcgaagcaaaacaggccgtggcttcattaccggcggctgtgcaagctaaaaaaccttgggttagacctatgaaacatgttcatcaggatctaaaaaaataa

SEQ ID NO: 2602 - DNA, 702 bp, Proteus mirabilis
tcgattttcgattctctatgcaaaactcatcttagtatgcatgaggaagcgcattatttcagagaggcttataccataatgacccaatttaattaccaaaaagcacatttcattatcagtgcacctgatatccgccatttaccaccagatacaggaattgaaattgcctttgcgggtcgttctaatgcgggtaaatccagtgcattaaatgcactaacgcaacaaaatggattggcaagaaccagtaaaacacccggtcgtactcaacttatcaatctgtttcaaattgaggaaggacgacgtttagtcgatttacctggctacggatatgctcaagtccccgaagagatgaaacgcaaatggcaacactctttaggtgaatacctgcaaaaaagagagtgcttaaaaggagttgttattttaatggatatccgtcatccattaaaagatctcgatatgcagatgattgattgggcggtggattcagagcttccgactctcgtcttgctcactaaagcggataaattagcatcaggggcacgtaaaaagcagttaatggcggtacaggatgcactgtcagaaaaatcaggtgatatacgtgttgagtgtttttcttctttgaaaaaaataggcattgataaattacgtaataccttaaatgagtggtttactgatactaacgaaccagagacagaagcttaa

SEQ ID NO: 2603 - DNA, 1629 bp, Proteus mirabilis
aaagataacgagaactttattatgaatagcaaaatattttttttactcgtagcaccttgtcttttaaatttatcgctgtctacaaccagtcaagccgctacggtaactaatagttacgtttttattgagaataatgtggataatgaatattttattaccccaagaacaaccgatccgcgtttttcgggtgccaataaatatacgcgttattcaaaatcttcacagctcagtttaggttatatggggtataccaatacatccattcaggccaatcaatatgtcgatatttggctagaaaattctcaaatagataagccatttgtgggtaaccgatgtatgagacgctattgtaatgacgatagtggctattggcctgcgcaatatataggtaaagacggggcttataaaatagttcagactaatactaacggtgaatcggcttatgctcgggggatatttagtgattcggcatacctgtattttcgccagttgcctgtaggcactatagagacatatagttatagagcctgtatgacaaaaacagactatgatccaagcaaaggcggatcttgccaaagtgttggtggcagaatgcttgcatcacatgaatttaatatcactaagtcagggcatatcacgttaacttcaacaggtgctttacaagaaatatttattgatagtaacggtaatcccacgattggcttaggctctcagttttgccgagtgggtattgtatcaaaccaaaatggtattatttgtcaggtgattgatcatgaaactactggggatatatttaccaatattaggcttaatttaaaaattaataatacactgatcccttttacgccagcggcaaatacaataaaaattggccccgatgatggcagtaataactggtataattataatacaacataccccgctaattattattttaaagttaataataaaaatgtttctatctttttatctaatacctttttaaaaagactcgtctctagtaatgtcgactttaaaaatagccaagacttttttaccttttcatttaccaatacagcagtgcctcaatctgggtattatgagttcaccccctcaaatacacttattctgaaaccgagagattatggcataagcattattcctgctgattttaaccctcatcaatctaaaacgggaaaagtgggtaatgaagagccacccattgagtttaattatattgttaccaccagtggccctagacaagcagactctattactgcatctgtagaaggaccacaaacaacattaaaagggcaatcctattgtttattctcctccagtgataaccgacttaatgtgccttttccggcttatctctcatttaaaaatagtgatggcacggatgcaaaatatagagcgagttgtgatagtcatgaaatttcattaaaaaatgcgttatggacagaaacaccatgggatagacctgatgaagacttaggttctttttatagaacgaacctagatttatcttttccaatgaatgatgctaactcatttttcactttggatggtattgattggctaggaacagtctcagccagtggaacggtaacggttaaggctatatggactgggcctgatattaactaa

SEQ ID NO: 2604 - DNA, 249 bp, Proteus mirabilis
aaaggggacgagttagagggtgacgcattaatgggctactgtatacacgcagcaaattgcagttttttagacgatattcatcaatcaaaagcgttattgtacgacttgcaagcccgctatttgtgccgtcatcaaccgagaacatggcagatcgccaatgaaaaagccgcaccttataaatacaaccaagttttattgagttaccaccgttatatcgcctgtttaaatacccaaggagaaatgaaatga

SEQ ID NO: 2605 - DNA, 327 bp, Proteus mirabilis
aatggtttagagttaattatgaagactattaatgaaattgctaatttaatagcggaacaacgtaaaaaattaggtattgagcaaaaagatatgtatctacgtatcggtatgaaacagcaacaataccaacgtatagaatcaggaagtgatttaaaactatcaaccttattaagagtattagaaggactagatttagagttatcaattaaggctaaaaattctaatataaaccctatgattgcaagtactgtgatagcgaataaaagcgaaattgatttgaaagatgatggggatgatctcgacttttggtttaaaacagaggaataa

SEQ ID NO: 2606 - DNA, 282 bp, Proteus mirabilis
gacctcttagaaattagcgaacaattaaaaatggcaagtgaaaaaggtgattggaaccctgaaacaggtatatttaaatttagtttggaagtacagtctcaattagtaaatacatattctgcttttggtgcacatcctaatagccgtataggtattgaagatttatattggtattatcaagtcaatcccgaggtaacaacaccgatgcgttatatcaattgggggggagatacccaagaaaacaatcggcttttaggctttattaacagtgagaatatctaa

SEQ ID NO: 2607 - DNA, 207 bp, Proteus mirabilis
cgggtaatagacaagaatttgcttggcggccatagcgcggtggtcccacctgatcccatgccgaactcagaagtgaaacgccgtagcgccgatggtagtgtggggtctccccatgtgagagtagggaactgccaagcattaaataagacgagaaagccaacccaatgggttggcttttttgcgtttattctatttcgcttacgttaa

SEQ ID NO: 2608 - DNA, 549 bp, Proteus mirabilis
tttctgatagattgcgcaaccaataagatcacaaatcgagttaccattatgaatatgattaaaagaaaacccgcagctaaaacgcgtaaaaaaacacgtgaagagctaaatgcagaaggacgtgaacgtaagcgccagaaaaagcatcgtggcaatcctgctggtaaccgtcagcaggaagcgatgaaaaaagagcaagcgcaaaccaatgaacagaaagatccacgtattggtagtaaaaaaccaattccactcatcgtggataatcaggcgcctaaagtagataagaaaaaatccgcgccaacaaaaatggagcctatgcgcttatcgttagaagaagagttagcactcttagagaatgatactcgtttagatgaattactctctcgtctggaagaagggggtaaactcaatcctgaagagcaagcttatactgaaaaaacccttgatcgcatcgatgcgttaatggcggaattaggcattgagtttgaagaagatgacgatgaagaaaaaacagaagatattatgcagttattaaaaggtaagtaa

SEQ ID NO: 2609 - DNA, 369 bp, Proteus mirabilis
atgggagtagaaatgatcacttgtaaacgtgtctatgatgataaagacggtaagcatgaaggttatcgtgtattagtggatagattatggcctagaggggtgaaaaagagcgattttcattatgatgaatggaataaagcgctcgcgccttctactgaattaagaaaatggtttcatgaaaatggcgatttcacacaatttacggctcgctatataaaagaattagaagcaataccggaaagttggcaaccactattgaaggtagccaaagaaaaaccattagtattactgtattccgctaaagatgaaaaacagaataatgctgtggttttaatggaatttttgcaaaaacagtgcaaaaccagctga

SEQ ID NO: 2610 - DNA, 1239 bp, Proteus mirabilis
gtagtcagagacaaccaagaacgagacatcattgtgggatcattcgatacagttattataggtgcaggggccgctggacttttttgtgcctctttagcaggacaagcgggattatctgttttagttttagataatggcaaaaaagccggcagaaaaattttaatgtctggtggtggacgttgcaattttaccaatatgtatatcgagccatcagcttacttatccgataatcctcatttttgtaagtcagcacttgctcgctatacacaatgggattttatcgagttagtacaaaagcaccatattgcttaccacgaaaagacgttagggcaattattttgtgatgattctgcccagcaaattgttgatttattactcgcagagtgccatgaaggaaaagtaagtattcgcttacgtagtgaggtgactcaaatagagaaaaccgccgaaggctttactcttttggtaggagggaaaacaataaccgcctcctctgtagtgattgccagcggaggactttcaatgcccggtttaggtgccaccccttttggctataaaattgcgcaacaatttggccttaatgtattgcccactcgtgcaggcttagtcccttttacattacacaagccacaacttgaacaactcagcccgctctctggtgtggcgatccctgctattgtcaccgctgaaaatggcacccaatttaaagagaatattctttttactcatcgtgggctttccggtcctgctattttacaaatctctagttattggcatgcgggagagaatgtgagcattaacttacttcctgacacggatttggaaggctatttacaagaaaaacgacaagcacagccaaatcaattattaaaaaatacactttctcgcctactaccgaagcgttttatagagataatgattgaaaataatcaactgcctgatacctcactggctcaacttagcaatgaacgtattacacaaataacgacgttgctacaagcatggcttgttttacctaatggcacagaaggttatcgcactgcagaagtcaccctaggtggtgttgatacccgtaatctctcctctaaaacgatggaagcaacaaagataacaggtctctattttattggtgaagtggttgatgtcacaggttggttaggaggatataacttccaatgggcatggagctctgcttatgcctgtgcccaagcattgatctctcgacacatgactaagtag

SEQ ID NO: 2611 - DNA, 480 bp, Proteus mirabilis
ggtcggggagatcccgacatgactaaaatcaatacaatcatcggtgcgatttcagtagcttttgggctacttattatctatctctcccgtgatatgagtatgtttgatgaatatggtgtacctggggagcgtttttggccttacggtttagccatcttatttattttactggggatttttcaatggataggtgtcgtggttgataaaattaaacatgtacaccagtccgtagatttaagttcgaccgcagttaagcgtgcttatggcttaggcatttttatgctgctatatgcaacaggtttatatctatttggctttattgttccatcattgcttcttatcccaatcattatgtggttgatgaatgagaggaaacctattgccatggtggtgatcccgattgtgattgtagccgcggtttatgttttctttgacattatttttaattcacctctgccaacctctgtcttttttgagtaa

SEQ ID NO: 2612 - DNA, 768 bp, Proteus mirabilis
cataaactggagaacgggatgaaatctttattaaaaacgacgttgttggcaacaagtttagcatttgcatttagtgcacctcatgcactggcagaagagacagctaaagtaccaacattaaatagcgcgtttaaaactcaggatgagcagaatgcatatgctttaggcgcgtcaatgggtcgctatatggaagctgcattaacagaacaaaaaaatatcggtattaatttagattcaaaacaattattagccggtgttcaagatgcctttaataataaatctaaattatcagatgcagaaattgaattaacgctggcagcttttgaagatcaagtacgtacagttgcaacggcgaaaatggaaaaagaagccgcagagaataaagctgctggtgataaattccgtacagaatttgcggctgaaaaaggtgttgttaaaactaaatcaggcctactgtatttagttgaaaatccaggtaaaggtaaaacaccaacagatgccgatcgcgttactgtgaactataaaggtatgctgattgacggtaaacaatttgatagttcttatgatcgtaaagagcctttaactattagcctgaaaagtgttatcccaggttggactgaaggtatgaaatacattaaagaaggcggaaaaattaagttagttattccacctgaattaggttacggtcaacgtgcaacgagtggcattccagctaactcaacattagtctttgaagttgaattgctgagtgttgaaagcgacaaataa

SEQ ID NO: 2613 - DNA, 744 bp, Proteus mirabilis
gatatgctggattttttaaaaaattatgacaatttaaccgtcagtgaaaagaaagtattaaagtatcttaccgataatatcgccgatatcccctatttaaatattaatgatttagtcgctaaaacctttgtatcaaaaacggtaattattaatttatcgcagaagttaggttttagtggctttaaagagctaaagtttcaaattaataattatattctttcgcgtaataaaatagaaaagagtgatcactcatcttataaaaaacaactagagaagaatattaataaaagctttaccctcatcaatgaagagcaaattaaagagtgtgctaaaaccctgcgccattctcgtaatatttttattgtggcaaggggaacaagtaaagcagtcggttattatcttgaacacttattgtttgcactgggcctgcattgcttttttattaatgattataacttatcagattcatttacacgtttagtgaatgaagatgacacggttatttttatctctctttcagggggaactaaaaagatcattgaaacggcaaaaattgtgcagttaaaagaggcaaatattatcagtatgacagcctttaataccaatgagttaaccagttatgcgacgcatacgctattttgtttcgcggataatcatgatacgaaaaaagatgataccaagtcacgaattggtttttttattttggttgatttgttaataaatgaaatagaaaatctactttaa

SEQ ID NO: 2614 - DNA, 198 bp, Proteus mirabilis
tgggatcaacttatttttaatataaaattaatcacccatagggaaaatagaaaaatgttgataaaagaaacaacaaatgaatataaagataaaatacgtcatattctatctattatattagcaatataccttaagttagataaaagcagactcagacaaaagactaaaagtatattttatattaacaaaataatttaa

SEQ ID NO: 2615 - DNA, 282 bp, Proteus mirabilis
ggatttttttgtatgaattgtcaccgtcttaatgaagtgatggaattattgcacccagtatgggaagagcattctgatttaaacttagttcaattattacagaaactggcggatgaagcaggttttaaaggtcaacttgctgatctaactgatgatattttgatctatcatctaaaaatgcgcaataccgcacccacagatgttattcctgggctcaagaaagattatgaagaagatttcaaaacagctattttacgtgctcgcggtgtgattaaagattaa

SEQ ID NO: 2616 - DNA, 285 bp, Proteus mirabilis
aaaagaaaactattatttaacccattttggtatctcttatctgataagaagactaataatttaggtacatattattataattccgcatctattaatcgttggtatgtgtttgatcaaatgattttttcttcatcatttttatatggaaaagaagattgttttaaattagatcttgaacagcttgatttttatcgcgtcctaaatgatgataatcactgccttgatgatatcttttttaagaaatttgatcattaccccatattttgtaggatcttccatgaatga

SEQ ID NO: 2617 - DNA, 1383 bp, Proteus mirabilis
cagcatgattgtgctgtatgggagtattttatgagtcataagttaaaagtggttaccattggtggaggaagtagttatacacctgaattattagaaggatttattaaacgttatcatgaattgccgatcacggaattatggttggttgatgttgaagaaggcaaagaaaaactggatattatttttgcgctttgccagcgtatgataaaaaaagcgggtatccctttaaccatttataaaactcttgatcgtcgtgaggcattaaaagaggctgatttcgtcacaacacagttgcgagttggtcaattaaaagcaagagaattggatgaagccattccgttaagccatggttatttaggccaagagaccaatggtgccggtgggctatttaaaggattacgtactattccggttatttttgacattattaaagatgttgaagaaatttgccctaatgcgtggatcataaactttactaaccctgcaggtatggtgacggaagcggtttatcgccataccaattttaagaaatttattggtgtttgtaatattcctatcggtatgaaaatgtttattactgatgtgcttaagctaacggagcaagatacgctttctattgatctgtttggcttaaatcatatggtgtttattaaagatgtgattgttaacggtcaatcccgtttccctgaattattagaaggagtcgcttcggggacgttaaccgcaggatcggtgaaaaatatttttgatttaccttttagtgaggggctaattcgttctcttaatctgttgccatgctcttatttactctactactttaaacaaaaagagatgttagccattgaaatgggggaatactataaaggtggcgctagggctaaggttgttcagcaagtcgaaaaacaactgtttgaattgtataaagatccacatttaaatattaaacctaaagagttggaattacgtggaggggcttattattctgatgctgcttgtgaagtgattaatgcgatttataacgataaacaggcggagcattacgtcaatattcctcatcatggtcatattgataatatccctgcagactgggcaattgaagtgacggctattttaggtaaagacggagccaaaccacatccacgtttaacccattttgatgaaaaagtgctggggcttattcatactatcaaagggtttgagatcgcagccagtcaagcggctattagtggtgagtttaatgatgcattacttgcgatgaatttaacgccgctggtactttccgataaagatgctgaagtactgactcgtgagatgttattagcacacaaagcgcacttacctaattttgctcatgcgattgcacaattagcagcatcaaactaa

SEQ ID NO: 2618 - DNA, 1515 bp, Proteus mirabilis
ccactgagactttatatgataaaagattataagcgttggatagtcttacttttagtatcaagtatgctgtttctaattgttgttgatgttaccgtactttataccgcactaccgcgtttaactcatgatctcaatgcgagcgcctcagaaaaactatggatcatgaatgcctatccgctgattgtcgcagggctgttgccagcagcaggtatgcttaccgatagaataggccataagacgttatttattagcggattacccctttttgccatcgcctcattatgcgcggcttattcccctagtgccaccagcttaattatttctcgtggtttcttggccgtcggtgctgctatgagcatgcctgcaacgttgtctattgtgagacaagtatttactcatccacaagagcgtgccgtcgccatcggtatttggtctgctgttgcttctggtggcgcggcattagggcctttaattggtgggttgctattaaaccatttctggtggggctcagtctttttgatcaatgtccctattgtactacttgtgcttcctttctcgatttggctaattcctcacttttcgggacaacggcagcataaaattgattatttaagctcaatacttattttgattggcttagtcagcgctatttataccttaaaagagataggtaaggcttatacacaatggaatgaagtgatcatcgccacccttattgccattatttttctcacactatttgcgcggcgccaacgtcgtcaaacgcatccaatgattgattttagcctatttaaaaagcgctatttcagtgtcggtgtggcaatgtcgactctttctatggtgatcatcgtgggtattgaatttctgctaagccaacgcttacagttagtcgccggctttacaccactgaatgcagctttagtgattttacctatccctatcggctcagtattagcctctcctttggctgggttttggctagcgcgtttaggtgcagtgcgcttaattattatcggattcgccctaacattaatgggtaacttatggttaattgccatttcaaactcaccgataatgctaatgggtagcctctttttgattggctttggtttaggcattatttttaccaccgcatcgacctctattatgctaagtgtcgacgataaacaagcaggtatggccgcttctattgaagatatcgcctatgagttgggtagcgtgattggcgtgacatttatggggagtttaatgagcactctctataccttaaaactaactttaccggatacgcttaacgtcaatagtgtcgtttatgatagtttagatgaagcacttattgtcgctgaaaagcttcccgaagcagcggcaaccctcttaatcgcacaggctaatagtgcgtttgaatatgccttttctatcgttctgatcgccacagccattgtgactacaataagcttaattgcactcccttattgcttgcgtaatgcggtaagagaaaacaagcccagccactaa

SEQ ID NO: 2619 - DNA, 2085 bp, Proteus mirabilis
tgtatgccatgtcactgtaaacccagatacaggatgttttttatgtcaaatccattacttagcacaacgggattacctgcattttcccagatagaaccaaaacacgttgtacctgccgttaaagaagttttagctaattatcgtgcaaccgtagaaaaacttctcgctgacaacaccgcttttagttgggataatctttgccaaccgttagccgaagcgggtgataaactttctcgtgtttggtctcctgttagccatttaaactccgttaaaaatagcgctgaattacgcgaagcttacgagcaaagcttacctttactgtctgagttcagtacttggatgggtcagcacgaaggattatatcaagcctataaatctatcaaagaaagcgctgattttgccttactgactcaaccacaaaaaaaagccgttgagaatgcgttacgtgactttgaattatccggtatcggtttaccaaaagagaaacaacagcgttttggtgaaatcagtgcacgcctatcagaactgagcgccaaatttggtaataatgtgttagatgcgaccatggggtggtctaaacttatcaccgatgaaagtgaacttgctggtatgccacaaagcgccattgatgcagccaaagcaatggcacaagcaaaagagcaacaaggttatctattaacgctcgatatgccaagctatctacctgttatgacctatgctgataatcgtgagcttagaaaagagatgagtattgcttatagcactcgagcctctgatcaaggccctaatgcaggtcaatgggataatagtgaagtgatggcggaaattttagcattacgccatgagttagctcagttgctcggctttaaaaattatgccgaaaaatcacttgccactaaaatggcagaatcaccagaacaagtacttaatttcttaactgatttagcctctcgagcacatcctcaaggcgaaaaagagctggctgaattaacgcactttgccaaaacacattatggtgtggagaaactagagccttgggatctggcttactacagcgaaaaacaaaaacaacatctattctccattgatgacgaacagttacgtccttacttcccagagcaccgtgcattaagtggcttattcgaagtggttcaccgtatctatggtttaacggctaaagagcgtcatgatatcgacacttggcacgatgatgtacgtttctttgaattatatgatgaaagcaacacattgcgcggtagcttctatcttgatttatacgctcgtgaacataaacgcggtggtgcttggatggatgattgcattggtagaatgcgtcatgctgatggcacactacaaaatcctgtcgcctatcttacctgcaactttaataaaccagtaggtgataaacccgcactcttcacccataacgaagtaaccacgctattccatgagtttggtcatggtttacaccacatgctaacgcaaattgataccgctgatgtatcaggtattaatggcgtaccatgggatgcggttgagttaccaagccaatttatggaaaactggtgctgggagccagaagcgttagcctttatttctggccattatgaaactggcgagccattaccacaggctatgcttgataatatgctcaaagcaaaaaattatcagtctgcgatgtttgtattacgccaactagaatttggtctgtttgatttccgcctacacgctgaatatgatccggctaaaggtgctcgtatcatggaaatactaaatagcgtaaaagagaaagtctcggtagtacctgcaacaccttgggcgcgattccctcatgcctttagccatatttttgccggtggttatgcagcaggttattacagctatttatgggctgatgtactggctgctgatgccttctctcgcttctctgaagagggcatttttaatcgccaaacaggtcaatcattccttgataatattttaacccgtggtggttcagaagagccaatggagctgttcaaacgcttccgtggtcgtgagccgaaacttgatgctatgctcaaaggctacggcattaaaggatga

SEQ ID NO: 2620 - DNA, 1038 bp, Proteus mirabilis
ggattgccgtgcgaaagcgatgaaaaaaggaacggcctaatgctcttgagtccaaatcccctctataaagcgtattgggttgctcaatgccgttatactcgcaacggtgaacaattcaagggggtgatgaccgtagcaggtacaagtcaatcacaagctattaagcagatgcgccagtactttacggctcacccaggtgaatatacctttgcggactatgacacattaatccctttaatcacccatattgaacaaagttcaaccttagaattaccgttaatacggcaagtacgtgagcaacataatgcaaaggtttcagccgtattagtggataaatgcaacctcacacacccaagaccgtcagaaaaaggcgacattcattaccgtgaggggcaacctacgtttattgaatattcgcatctctatgtcgtcattgacagtggggaataccaccgccaaaccgggcaacatcttgtaccgaaactgcatggctcacaactgccatggaaatcactctatcaaggagaaactcaagacagccttgaagataaagccccttatttggtacacattgtcgccaatcaagccggtcagcggtttctggctcattacttgaatttaccacataaagcgagtctcggattatttatcaatagcctcaaaccctttaccgatattcaccggcaaatgcgaaaactcacctatttatataatcaaaaactggagagttggaatttctttcgtttttatgatgttaagcactttatcccatttattgagtctttgactcacggacagttaattaatgtggtcaatggggtaaatgcgttctacggctatagtgcacaataccccgatggggttgaaatcacctttcacccagattatctgtatgacggcagtaagcgagagccgttatttattaatacctatttatacaatcactacgcgaatatcacacagctgcaaactgtggctaaagctaaggcactgattgaacaattttctcaggtagaaaggggacgagttagagggtga

SEQ ID NO: 2621 - DNA, 750 bp, Proteus mirabilis
acaggtcatcgggatctttacaccacaataattgtaggtttttttgatataacccgatacagacgatttatttttcgttacaatcgggaaaattttgcccacgggtatgtaggagatgtcatgaaagtagcaaacgacttggtagttagtctggcttatcaagtaagaacagaagacggtgttttagttgatgagtccccggtgagtgcaccgctagactatctacatggccgtggttctttaatcagtggtttagaaaatgcattaacgggtcgtgaagttggtgagaagttcgacgttgaagtcgcttctgatgacgcatatggccaatacgatgaaaacttagttcaacgtgtaccgaaagatgtttttgttggtgttgatgagttagaagtgggtatgcgcttcttagctgatacagatcaaggcccagtaccagtagaaattaccggtattgagggtgacgaagttatcgttgatggtaaccacatgttagcgggtcaaaacctgaagtttcatgtagaaatcgttgctatccgtgaagccacggaagaagaattagctcatggtcatgttcatggtgaagatgaaggtcatgagtgttgtggcggacatggccacggtgaagaaggcggatgctgtggtggtggtcatggtcatgatcacgatcacggtgaagaaggtggatgttgtggtggcggtcatggaaaaggtggtcacggccatggcggttgtggttgccaacattaa

SEQ ID NO: 2622 - DNA, 582 bp, Proteus mirabilis
gctaatatgctgttacttattgataattacgactcgtttacctacaacctttaccagtatttttgtgaactgggggcggaggttgttgttaaacgtaatgatgagattgggcttaaagagatagaaaagatgatgccatcacatcttgttatctctccgggaccttgcacgccagatgaagcagggatctctcttgaggcgatacagcgatttgccggggaaatacctattttaggtgtttgccttggtcatcaggcgattgggcaagcttttggtgcatccgttatcagagcccgtgaagtgatgcatggcaaaaattcattaatacaccataatcagcaaggggtgtttaaagggcttaatcgacctttaagcgttacccgttatcactctttagtgattgatgcgacaaccttgcctgtcccttttgaggttacagcatggagccaacatgacgggaatgttgatgaaattatggggatacgtcatcgtactttacccattgaaggtgtgcaatttcatcctgaaagtattctgagtgaacaagggcatgagttattaaataattttcttaaatattaa

SEQ ID NO: 2623 - DNA, 1584 bp, Proteus mirabilis
catgtcttccggcatttattgttaaacctcataagtggtttaataccaaggattaataaaacagaggttcacatgcagggtgcaatgacacgaattttattgggaagcgttatgttcagcgctgctatttgtcaggttcaagctgaagcactgcagcctgatcctgcttggcaagaagggcgactcgcaaatggtttccaatggcaaattttacaaacaccacaacgcccaaatgataggatccaaattcgcttattagtgaatacgggctctttatcagaaaagcgcagtgaaacagggttttcatctctggtgtcaaaactgaatgtgttagaaaacaccggattaacaccagaaaaacgcgataatctttggaaaaatgcattcgatcctgattatccattgccaccgatgatcgtctcttatgactttacggtttataacttaagcttgcctaataaccagcctgaattattaaaagatgcctttgcattattggcgggcatagcaaaaccggcacaatatacagaagatgcggttcgaaatgcgattcaatcaccgcttccggtggtgacttttcccgctaatattgatgatcctatctggcgttcacgtctagaaggctcaaatctaaaaggccataatccaggtaaaccggttaatcattcggtaaatacaaaagagttatcagattatcaacagcgttggtataccccagatatgatgacgttatatattgccggtaatgttgataatcgtatcttaaccgaaagtattaatcaggcattttcttctctggaaggaaaacgcgtgacacctgtgcctgtgcctgttcttgccgatatgaaaccagaaacattgtatgtgcaagaacccatgcgaaaaaatgaccaaatctctcttatttgggatctagattggtcaccagtgaaagattctgacacactgagccgttattggttaagtgatttagcgcgtgaagtgatttttgtgcacttaggtcgtagtctcgaacagcgtaaagaaaaagaaagtacgcaagtgaatatcgattgtcgagtgcaatatcaacgagccagttgctcgttaaatgttgatacagcaacggcaaatattcctgcacttgccacttgggtgggggaagagcttggcgaattacgtaatcaaggtgtcagtgatgaattgtatcaagacttactacaagaaaagcaaattcaactcacccaattgtttgcgcgttatgccaaaacaagtacctctatcttgattaatcagcgtttattgtctcagcaaagcaatattattgatattccaccagagcaatatcagcgtttacgccaagcatttttagcgggtttaacgaaagagatgttaaatcaagagttatcgagaattctatctgaggatatcacttttgtattaacgcaaagtagcgagacgccaacggtaaacttgggtgaattgcgtgtgcaatttgaaaagcaagttcacccagaaacagcgaatagctcaaacagggctaaaacatcgttaactactggtgaaaaagcttcggtgcaggcagatgcacaacaaacaaaatag

SEQ ID NO: 2624 - DNA, 294 bp, Proteus mirabilis
gcaatgccacgagtttgctcttctgatgctgctaaaatctctttcatcgagcctgatacatggttaactgatgtgacgatctctcccatagataagctgacttgttcgacaagatcattaccctgttttactcgtaaaatagttgattcaatgagttcttttatctcttttgccgcctccgcactacgttgcgccaaattacgtacctcactggctaccacagaaaaaccgcgtccttgctcaccggctctggctgcttctactgcggcattgagtgctaatatattggtttga

SEQ ID NO: 2625 - DNA, 231 bp, Proteus mirabilis
ccaattacacgacgacgtgggcatggaaatactccgtttaaaattcagggttgtccaaaactcgatgagtttattttgacattaattgtgaaaaaatgtttggccttacttaacggagaaccattaagcctttggcttcttcacaccgtacttagagcgaccttgtttacggtctttaacaccggaacagtccagcgcgccgcgaacagtgtggtaacgcacacctggtaa

SEQ ID NO: 2626 - DNA, 186 bp, Proteus mirabilis
gtatatcagcgcattatccgaactcacttattcatgctaatgcacaaccatatgaagatattactattagatatgaaagtatatcttgggatcacatttgtgcaggaatgtcaggtgatagtattagtcaaaacatttaagatttctcaacaaaaagtgatgtggttcttgatttttcatcaatag

SEQ ID NO: 2627 - DNA, 1359 bp, Proteus mirabilis
tggaacgagcgtatcataatgagaaggctgaggctttcaccccacaataagctcactcgctctctatttctggttatcttattacttttttttagcttgatagccagttatgttgttgtacagcatcttattgtcgggccaagcctccagcaatttaataaagtattagcgtatgaaattcgtacgctagtaccagaagaactgatcttagtcgatggcaccccacttaaaatttctcccgctctacgtaataaaatttacaacgagttaggtatctcattttttgataaagacgccgctttaaaagccggtttagagtgggcaagagaagatttagaacttagccagcagatgacggattatctcaatagtgatacgacgatttggctagaaaacaccctagagtatcctattttatggattaatacccaactctcacccacgctatggatacgcgtaccacttaccgaattagggcaaaatttcttattacccgtttatcggcaagccattatttttatcatcatcgtagtggcatttttctggttatataaccgttttcaaaatcgtccattgcatgaagttgaatatgcagcacgacgcattggtaaaggggtgatccctccgccaatacctgaatctggcactgctgaaatgcgttcaattattcgagcatttaatcaaatgtcatcagatattcgctcattagataatgatagaacactggtgatggcaggggtaagccatgatttacgcactccgttaacgcgtattcgtcttgctacagaaatgatgagtcctgaagatagttatcttgcagattctatcaataaagatattgaagattgcgatgccattatcggtcaatttttagactatatgcgcacaggcaaagagatgtctttagaattatgtgatatgaatggtctattgcgtgaagtgatctgcgctgaatctaactcaggcaaagtcagcgaagaacatttatacccttatcctatcaatatcacagcaaacccaattgccgtcaaacgggcgcttaccaatatgattgttaatgccacacgctacggacatggttggataagcatcacaagtaatcaaaatgaagaatatgcttggtttcaagttgaagacgatggtccaggcattgccaaagaagatagacaacgtttattccaaccctttgttcaaggggaacaagcacgaagttcaaccggtgcgggtttaggtctatccattattcgtcggatcatggatgcccatggtggctttgtcgaactcggcgatagcacgaaaggcgggttacttatccgtgccaactttccgttaaaagtgcaagaagacgaagatgattaa

SEQ ID NO: 2628 - DNA, 1329 bp, Proteus mirabilis
tcaaatatttttcgccggtattttgtgacaaagaccaaatggacgtgcatcaggaatacacaatgtctgccacggcgaatattagtttcatttttcatagaccaaagtataatagataatatgaaacgtctacaagcctttaaattccagttaagacccaatggtcagcaagagcgtgagatgagacgctttgcaggggcttgtcgttttgttttcaatcgggcattagcacgtcagaatgaggagcacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaaacgtaccgcttttcctcgattcaagaaacgcggtaaaaatgacgcttttcgctacccgcagggcgtgaagctcgatcaatccaatagtcgtatatcattgccaaagttgggatggatgcgctaccgcaacagtcgtgaagtcgtcggagaagtgagaaacgtcacggtcagtcagtcatgcggtaaatggtacgtcagcattcagactgagcatgaagcgacagaaccacaacatggatcaacctcaatagtagggcttgatgcaggggttacaaaactggccacgctttcagacggtacggtatacccgcccgtcagcagttttaaagtcaaccagcgaaagctggcaaggcttcaacggaaattaagccgtaaaatcaaattcagtgccaactggcaaaaacaaaagcgcaaaattcaacgtctgcattctcatattgccaatatcaggaaagactaccttcacaaagtcaccagcgaaatcagcaaaaaccacgcaatgattgtcattgaggacttaaaggtcagtaacatgtctaaatcggcaaaaggtacgacagaacggcatggacggaacgtaaaagctaaatctggtttaaaccgctcaatactggagcagggctggtatgaaatgcgccgacagcttgagtacaagcagctctggcgaggtggtcaggtactggcaataccaccggcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtggagggagggtgcagtcagaccgcccgtcgaagcaggaacccgccgaggtgattcagacatcagtctga

SEQ ID NO: 2629 - DNA, 1329 bp, Proteus mirabilis
tcaaatatttttcgccggtattttgtgacaaagaccaaattgatgtgcatcaggaacacacaatgtctgccacggcaaatattagtttcatttttcatagaccaaggtataataggtaatatgaaacgtctacaagcctttaaattccagttaagacccaatggtcagcaagagcgtgagatgagacgctttgcaggggcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaagcgtaccgcttttcctcgattcaagaaacgcggtaaaaatgacgcttttcgctacccgcagggcgtgaagctcgatcaatccaatagtcgtatatcattgccaaagttgggatggatgcagtaccgcaatagtcgtgaagtcgtcggagaagtgagaaacgtcacggtcagtcagtcatgcggtaaatggtacgtcagcattcagactgagtatgaagcgacagaagcacaacatgaatcaacctcaatagtcgggcttgatgcaggcgttacaaaactggccacgctttcagacggtacggtatacccgcccgtcagcagttttaaagtcaaccagcgaaagctggcaaggcttcaacggaaattaagccgtaaaatcaaattcagtgccaactggcaaaaacaaaagcacaaaattcaacgtctgcattctcatattgccaatatcaggaaagactcccttcacaaagtcaccagcgaaatcagcaaaaaccacgcaatgattgtcattgaggacttaaaggtcagtaacatgtctaaatcggccaaaggtacgacagaacggcctggacggaacgtaaaagctaaatctggtttaaaccgctcaatactggagcagggctggtatgaaatgcgccgtcagcttgagtacaagcagctctggcgaggaggtcaggtagtggcaataccacccgcctacaccagtcagaagtgcgcttgctgtggtcatacagcaaaggaaaaccgccagtcacaaagtcaattcgagtgccttgaatgtggatatacagcgaatgctgatatcaatgcggcacgtaacattttagcggcaggacatgccgtgcttgcctgtggagggagggtgcagtcagaccgcccgtcgaagcaggaacccgccgaggtgattcagacatcagtctga

SEQ ID NO: 2630 - DNA, 645 bp, Proteus mirabilis
atcaaaattagagagaataatatgttaaataaaaaaatagcatcggtgatgctatcaacaattattgctgcttcttttgctacggctgctaatgcagatactcgtgttgcacaagcaaccgcgacttggcaagcaactgcaattaaagatacaaccagtatgttagttgtcactccattaaaaagtctgacttttaattatgctgaaggccaaaaatcatttaaccaacaaaatggtgcatttgatattgctattcaaggccaatctggcgcaactgattttaaattatcatcaaaactgattgctaatacgttagcaagaacaactgatgattcaacattaacagttggtgttaaatggaatggggaagacctttctaaaacaactgatgtcgtgttaattgatacatcaaaagggttaacctcaggtttagataatttagctgctgatggtatttacaatggctctgagcgcgctacagatcgtggtgaattcacttttgtaattgccagtgcacaagcagcaggagcaacagccgattttaaatcactggctgatggtgtctgggatggtgatgtaaaagtgcaatttactgccacttgggatggtgacttttctaccgttaaacctaatccagacccttaa

SEQ ID NO: 2631 - DNA, 777 bp, Proteus mirabilis
tgcttttataggtgttttattatgtttatatattctgatctaaagaataagaatgtgattgttacaggagctaatggtgatataggtattgcaatttgccagaaataccttgaacagcagtgtcatgtttatgcattatatcaccaaaatagaaataacttagataagctaaaaaaagagagtgaatattgtcagcgcttacatatattacaatgtgatatcaataatgataaatcaattcatgattttttagataaactaaaggcatatgctaatgctattcatatattaatcaacaatgcaggtgtgattaaagatgaattattttctgctataaatataagtgaatttgaatatgttattaaaaccaatttattaggaacttgtcaatttactaaacagttattgcttttattaagatcggcagaaaaagcgaccattattaatgttgcttctattgcagggattgttccaagtattgggcaaagtaactatagcgccgctaaggctggaattataggttttactcatacgttggctgcagagttggcaggtaaaggaattcgagtcaatgcggtggcaccgggtatgattgagtctgacatggtcaaaaaagtgtcacgccaagtcgtacgtcatattaaatcggttattccattacaacgattgggagcaagtgctgaagttgccaataccattgtatttttaagctccgaggcatcgagctatattgttgggcaaacattaattgttgatggtgggatggtgatgcgatga

SEQ ID NO: 2632 - DNA, 432 bp, Proteus mirabilis
acattggagctgaaagtgaatggattaaaattgaataaattttttatttttccaatattattgattttatctttaatgacgaccatcattttactgatgtttcctggtgacagagaatataccaagttaaatttcgtttattattacctatacacttttgatgaggtcaaaaaaatagattttatatcagatgaatatatcattatctatagacccatagatggaaattcaaatgagttcaatgatgttattttttttaatataaaacctgaaaagaacatagctcttattgataatctatctaaaaatggattcacctctacatatgatgatttctataaagaagagcgatgggttaaagataatatacatataaaaatatctattgatgaaaaatcaagaaccacatcactttttgttgagaaatcttaa

SEQ ID NO: 2633 - DNA, 315 bp, Proteus mirabilis
caggcgcatagattgcgcctgctgcaaaaagcgttacaatgcagactctttctattttcttattgcggagttttcatgtctgatgacaatttttccctgccaacaatcactcttgatgaatttcagcaagcacccttaaccgcacttgaaaatagtagtagtgtcgaagtgtgtgataataaccaaactccgttattttattgcctatcaaaacaggattatgacacgctaatggggcgtattatggatgcagaattagccgccattgtacttgaacgtcgccaaaagaaactcgatgaactggatttagagtga

SEQ ID NO: 2634 - DNA, 333 bp, Proteus mirabilis
gatattaatagtatggaaaatgacgataagttaaatgaaaaaattgaacaaagaaaaaaaatgttaaagcgagtcaaagaagggcttattgaacgactcaatttaaataagagtattaatcaaatagatgatgatactccattatttggtagtggtttaaaattagattctgttgatgccactgagataattgtctttcttaatgatgaatttaatattcaagtaacagaaggtgatgatccttcttatatgagaacaataaatagcctaacaacatttattttaaataaacagcgagaaaaacaagaaaaaaatgagagcaataataattaa

SEQ ID NO: 2635 - DNA, 888 bp, Proteus mirabilis
cctacaaatagccaacaccagaaaattaataaaatactaataaacaataagataaggggatttattatgaagcttcattttttagggacggctgcctcagaaggcataccgaatcccttctgccgttgtgaacactgtctgaaagcaagaaaattagccggtaaagatattagaacgcactcttctgctattgtggatgacattatattgatcgatgtctcccccacttttagttaccaactgatgcgtgatggtatggacgcaacacattttgaaagtttgctatttactcatactcatcctgatcattttaatgttggtgaactatttagcagaatggaaggctatggttttgaaattaaccatcctttacatattttcggtaacgatcgcgctatcaatggttgtattgaagtattaccaggttatacgaaagagcgatttgcatttcattgcttaatccctttcgttacggtcgaaagaaatggttataaaattacgccgctgcttgctaatcatgcgaaatgggaactttgttatgtatatcatattgaaaaagacggcaaagctattttctatggccatgattcgggttggttcccagaattaacttggcaatggttagaaaacaaaccgcttgatattgttgtttttgagtgtacttatggcttaaatggaaaagatcgtacagataatcatatgagcttagaaacggtttttgccgccaaagaaaaactgcaacaacaaggctgtttacatcaagctacacagattgtcgtttcgcatatctcacatagcggtaaattactgcatcatgaattagaaacggtttgtgctcctcatcatatccgtgttgcctacgacggattaacgttagaaaccaattaa

SEQ ID NO: 2636 - DNA, 924 bp, Proteus mirabilis
ctttctgatagatatcattcagatgaaagtcgatcctcgtctaaggcggtaacaatgtggcggttattctggcaacgacttgcgcaagataaaagtgcacaactttgtttattggtgatagtgatgattaccatcgccggaataggcgcaccttggtttgcacctcatgatcccactttaacatcgatacgcttaaaatttcagccaatcagctttcactatccactgggtacagataatttagggcgttgtgtgttttcacgtttactctttggtattcgaaccaccgttttttatgccatatatgcgatgggtataacactgctgatcggttggctaatggggatgttggcgggctattttcacggtaaaacggatacagtgattatgcgtttatgtgatgtggtattgtcatttcctgcggaaattatgatcttagccttagtgggcataatggggcctggaataggtaacatcttgattgcggtgatcttggttaaatgggcttggtacgccagaatgatacgaggcattgttcgacaatattcacatcgtcactatattgcttatgctcaagtgattggcgcaccaccaacacatattttacgacgccatttattacccgtgacattagctgaaactatcgttttagcctcaagtgatattggtagtgttattttaatgatctctgctctttcatttctggggttaggggtacagccacccaccccagaatggggcaatatgctgagtgaagcaaaaaatgtcatggtattacatcccgaacaaatgctacctgcggggatagcgattacggttgttgttactgcatttaacttttggggcgattttttacgcgatgtgttcgaccccgataatcgtcaatcagtcggggataaatatgaacaatttactgacgcttaa

SEQ ID NO: 2637 - DNA, 2145 bp, Proteus mirabilis
aataggggtaggtctgccttgtacctgtttgaaagcctgaatcaaatcgttcaaaaatacttgccacctgagcaagttgaacaactcaaaaaagcctttatcgtcgccagagatgcccacgaggggcagactcgttcaagtggtgagccttatattactcaccctgtggcggttgcctgtattcttgccgatatgcgattagatcatcaaacgctaatggcggcattgttgcatgatgtcattgaagatacacctgcgacatttaaagatatcgaaactctgtttggcagtacggtggcagatctggttgaaggcgtctcaaaactcgataaattaaagtttcgagataaaaaagaggctcaggctgaaaactttcgcaaaatgatcatggcgatggtaaaagacattcgcgttattttgatcaaattggcagaccgaactcacaatatgcgcacgctgggttcactacgcccagataaacgtcgccgtattgcacgcgaaacgctggaaatttatagtcctcttgctcaccgtttaggtatacaccatattaaaactgagctagaagaattaggctttgaggcactacatcctaatcgctaccgcgtgattaaagaagttgttaaggcagctcgtggtaaccgtaaagagatgattaataaaatcctctctgaaattgaagggcgccttacagaagcgagtattcaatgcaaagttaacggtcgcgaaaaacacctttattccatttatcgtaaaatgttgctaaaagagcaacgttttcactcaattatggatatttatgcctttcgcgtcatcgttaaagatgtcgatacctgctatcgcgtgttaggccaaatgcatagcctttataaacctcgccctggccgcgttaaagactatattgctatccccaaagctaatggttatcaatcccttcacacttcgctcattggtcctcatggtgtccctgttgaagtacaaattcgtaccgaagatatggatcaaatggctgaaatgggcgttgcggcccattgggcttataaagagcaaggtgagcagccggggacaacagcccaagtcagagcacaacgttggatgcaaagtttacttgaattgcaacaaagtgcaggtagctcttttgaatttatcgaaaacgtgaaatcagacctttttcctgatgaaatttacgttttcaccccagaaggtcgcattgttgaattaccaacgggtgcgactccggttgattttgcttacgcagttcatactgatattggtcatgcttgtgtcggtgcaagggttgatagacaaccttatccactctcacagtctttacgtaccggacagaccgttgaaatcattactgcgccgggtgcaagaccaaatgcggcttggttaaactttgtcgtcagttcaagagcccgttcaaagataagacagttgctcaaaaatctaaaacgtgaagactctattaatttaggtcgtcgtctacttaatcacgctttaggccatcataaagtggcagatattccgctagaaaatattgaacgagagttgaagcgcatgaagcttcactcaatggacgatattatggctgagataggtttaggtaatgcgatgagtgttgttgtggcgcgtaacttattgattgacaaccaacaacaagaagaacacacacatctaagcataaccaatgacgaaacacctaaattacctattaaaggggctgatggtgtacttatctcatttgctaaatgttgtcgccctattcctggtgatcctattgttgcgcacattagccctggtaaaggcttagttattcaccacgaatcttgtcgtaatattcgcggttatcaaaaagagccagaaaaattcatgccagttgagtgggataaagatattgatggtgattttattaccgaaatcaaagtcgatatgataaaccatcaaggtgcattagcgaatttaaccgcagcaattaatgacgctaattcaagcattcagagcatgaataccgaagagaaagatggacgcgtctattgtgcatttattcgactgacagccaaagatcgcatccaattagccaatattatgcgtaaacttcgtatcatgcctgatgtattacgtgtcagccgtaataaaaactaa

SEQ ID NO: 2638 - DNA, 258 bp, Proteus mirabilis
ttaaaagtcagactttttaatggagtgacaactaacatactggttgtatctttaattgcagttgcttgccaagtcgcggttgcttgtgcaacacgagtatctgcattagcagccgtagcaaaagaagcagcaataattgttgatagcatcaccgatgctatttttttatttaacatattattctctctaattttgatttataaaaaacaattacatagtataaaaaacacctttaattgtgctttttataaaatataa

SEQ ID NO: 2639 - DNA, 774 bp, Proteus mirabilis
aaaggagacagaatggcacatttgttaattgtcaatgccgatgattttgggctgagtagagggcaaaattatggcattgttgaatgtcatcgtcatggcatagtgacatcaacgacagcgttggtgaatgctgaaggtattgagcatgctgcacaattatgcaaggagctacctcatcttggtgtcgggcttcattttacattgactatgggacagccgctgtctcctatcccttctttaacgcgtaatggggtgttaggtaaatggctatggcaaatggcagagcaagagcagttacctttagatgagatacgagtggagcttaatgcacaatatcagcgctttgttgagttgtttggttgtccccccgaccatatagacagccatcatcacgtgcatatgtttaaacaaattttccccatcgtggcagagtttgcacaacaaaaagcattaccgatacgtgttgatagactgttggcacaaaaagaaagtcttaatactcaaggggttattagtagtgatggttttgatagtcaattctatggtgatgaaatcagccaagccttgtttttaaagacactggatgacgctaaagcacgtggtgaacaatcacttgaagtgatgacacatcctgcttttattgataatcctttacgtgcgagtggttactgtttccaacgtttaacggaattagaggtgttgacgcaatcatcgttaaaacaagcgattgctgagcgtggatatcaattaggtacttatcaagatttaatttaa

SEQ ID NO: 2640 - DNA, 798 bp, Proteus mirabilis
tacaacagcaggtttttgatgacaaataaaatcgataataaccaattacttcatgatgtgacccgttactggaatatccgcgctgaaagctatagtgctgccaaccagcaagagttattaagtgaaaaacaacaaaaatggcgtcagttattgttaagccatgtcaaagaaggggagacattaaaggttcttgatatcggtacggggccgggattctttgctattttattagcgttgtcgggccaccaagtcactgcaattgacgccacgcctgggatgttgcttgaggctaaaaataacgccagccaacataatgtttctattaactttgtttgtggtgatgtgcaagatcttccctttggcgatgaacaatttgatttggtcgtcagccgtaatgtgacatggaatttaaaatcaccctgtgaggcttatcaagagtggtttcgcgtattaaaacctgggggaagcttaattaattttgatgccaattggtatttacatctgtttgatgatgaatattggcaaggttttcttgctgatagagagcgagcggcgcaaaagcaagttgctgatcactatgttaatactgatacaaaagagatggaaagaattgctcgccaattaccattaagccaagttaagcgtccacagtgggatattaatacactactagatatcggttttattcgttatagcgtggatattcgtattggtgatcacgtttgggatgaagaagaaaaaattaattacggctcaacccctatgtttatgatccatgctcagaaaaataatcgatga

SEQ ID NO: 2641 - DNA, 264 bp, Proteus mirabilis
ctgtcactaagtcacaaaaggaaaaataagatggcaagtttgatgcaagttcgtgattgtgtcgcgcttaacggtcgggctgatgctcgtcttgtcagccatcagcttaatatgcctgaacctatggtaaaagcgatgttagagcggcttacgttaatgggtaaattacaagaggtcgatgtagaagagtgcttggtgggtagctgtaaaagctgccctgaagccaccgcatgtcagactaaagtttatcaattacgctcctaa

SEQ ID NO: 2642 - DNA, 183 bp, Proteus mirabilis
atacaaccaagttttattgagttaccaccgttatatcgcctgtttaaatacccaaggagaaatgaaatgactggagaagtgaatgagaaatatttaagagcgcaaagcgcgtcagatggtgaaggcggtaaacgaagcgagcccacgaaacttaccggccgacgcggtggtatgcccatgtga

SEQ ID NO: 2643 - DNA, 1080 bp, Proteus mirabilis
atgtcgaaaagttattctacctatcccacaggagggattatgaaactgatgcgtaccaccctgaccagtgtcattgccgctgcactttcaatgacggctctttctgcacaggcaacgacctcactgactggtgctggcgcaacgttccctgctccagtttatgcaaaatgggcagatagctatcaaaaagaaactggcaacaaagttaactaccaaggcataggctcttctggtggtgtaaaacagatcattgctaatactgtcgattttggtgcttctgatgcaccattagctgatgaaaaactcaaggctgacggtttattccaatttccaactgtcatcggtggtgtggtgatggcagtcaatatctcaggtattaaatccggtgagcttgtcttagacggtgagactatcgggaatatctacttaggcaagatccaaaaatggaatgatcctgctatagctaaactaaatccaaaactcaatctacctgaccaaaacattgctgttgttcgtcgtgctgatggttcaggcacatcattcgtttttactagctacttatctaaagtaaatagcgcatggaaagatgaagtaggcgcaggctctaccgttaaatggcctacaggcttaggtggtaagggaaatgatggcatcgcagcctttgttcaacgtctaccaggctcaattggttatgttgaatacgcttacgcaaaacaaaacaatcttgcatatactcaattagtcactgcagatggcgaagttattcctcctactgccgatagttttagcgcagcagcgagaaaaattgattggagtaagagctttgcacaagacctaacgaatcaaaaaggcgaaaatgcctggccaattacttctactaccttcattttagtgcatcaaacgcaaaaagatgcggctaaaggaaaagaagtactgaatttctttaactgggcatatgaaaaaggcaatgatgaagcgaaaaatcttgattacgccgtattgccaaaagaagtggtagaacaaattcgtgctgcttggaaaacaagcatcaaagacagtaatggtaaaccaatttactaa

SEQ ID NO: 2644 - DNA, 846 bp, Proteus mirabilis
agaatgctgagctatcgtcatagtttccacgctggcaaccacgccgatgtattaaaacatattgttcaaaccctgattattgagtctttaaaagagaaagaaaaaccgtttctttatttggatactcatgctggcgctggacgttatcagctcaccaatgcacatgcgactcgcacgggagaatacttagaaggcattgcacgcttatggcaacaagaagaggtgcctgagcttatcttgccttatttggaggcggtcggttcgttaaatacatctgatgagttacgttattatcccggctctcctttattggctgctaaattattgcgtgagcaagatctgttaatgctaaccgaattacatcctaccgatttccctttattacgtacggaattttcccgcgataaacgtgtgagagtgtgtcgggaagatggctttggacaattaaaatcaaaactccctcccgccagtcgtcgtgggtttgctttaattgatccaccttatgaacttaaacaagattatagtgcggttgttaaaggcattgtggaaggctataaacgtttcgccaccgggacctatgcaatttggtatcctgttgtgcatcgccaacaaattaaacggatgctaaaagagctagaggccaccggtattcgtaaaattctgcaaattgagttggcagtgaaaccagatagtgatcaactaggtatgacagcatcaggtatgattgttattaacccaccttggaaattggcatcacaaatggcgtctatcttgccttggctacataaaaccttggttcctgaaggtactggacacacattagttgaatgggttgtaccagaataa

SEQ ID NO: 2645 - DNA, 1605 bp, Proteus mirabilis
caaatgatgagggttcgcatggaacaacaatattttattggcgttgatgttggctcagccagtgtccgtgcagcagtatttgatagctttggaaagcgtctgggcttttcagtgcgtccaattgcacaatttcgcccgaaaacggattttgtcgagcaatcttccgctgatatttggcaacaagtatgcaccactgtaaaagagtcggtgaaattatcagccatcgatcctctccatgtgaagtctattggttttgatgccacctgctctttagtggccgttggtaaagaagggcaagcactttcggtttcacccagtaataaacctgagcaggatattattatgtggatggatcaccgggcagtacaagaaacagtgaccattaatctgactaacgatcccgttttgcggtatgtcgggggcgaagtgagcattgaaatggaattgcctaaaattctatggttaaaaaatcactatccggagcgttataaacatgtctggcgattctttgacttagctgattttttagtgtggaaagcaaccactgctgatgttgccagtatctgtacattaacgtgtaaatggaactatttggcacaccaagggcattttagtgaaagcttgttagctgatgtaggtttggatgaattattagaaaaagtaccacaaaccattttggctttaggtgaatcggccggatgtttaacgacctctgtggctgaggcttttggattacatactggcgtcatagttgctagtggcattattgatgctcatgcgggtgggttggcgttaaccgcatcacaacctgagggaagtttggccatcatcagtggtacatctaactgccatatgattgtcagccaatacccgattatggtgcccggggtgtgggggccttactttggcgcaatgttaccagagttatggctaaacgaaggggggcaaagtgctgccggtgcgctcgttgaatggtctatccgccgccatgagtcatgggctgacttagaacaagaagcgaaagaaaaaggtgttagttactataccttattaaaccaagctgtcgctgaattggaagaaaatgaaccttatccaacagcacaatttcatgttttagctgaccatcatggcaatcgctctccacgtgctaatcctgccgccaaaggaatggtcagtggattaacccttgaaagtggtcgggttgccttggctcgttattatcttgcgacactgcagtctattgcctatggcactcgccatattattgacacccttgaagatgcagggcaccaaattaatcgccttgttatgtgtgggggagcgaccaaaaatccactgtggttacgtgaatatgccaatgcaacaggtcgtgagatccatttagcgcaagaagaagatgcggtgaatctaggagctgctttattaggtgccgtggcatgtaaagcctttgataatttttctcaagcagcaaataccatggtacgagaaggtggtgttattacacccgatagtgacacctttgctttccatcaagcgaaataccaagtttatttacagatgtatcaagatcagcagcgctataacgacatgatggcagattgctga

SEQ ID NO: 2646 - DNA, 579 bp, Proteus mirabilis
ttacagatgagtttctcaatgatccacattatcacactatctaacccgcaacttgctgatatgttcgtcaattatatggcgacaaaaggtgttcggatccacgcaaaaacagaaaatcaacaagtcagcctttggttggaaaacgaacaacaactcaatcaggttgaaagtgagctaaaaacctttcttcgtgaaccttttcaccctcgttaccaagcggcaagttggcaaacaggtacgcctcaacgtacgggtctacaatatcgcccggctttttcaatcaaaagcatggtgcaacaatcaggccctttaacggttttgaccattattttatgtgtgctcgtctttatctggcagcaaatagtgggcgattacaatgtcatgttacaccttgcatggccatacgatgctagtctcgattttgaactatggcgttatatcaccccagcatttgttcacttttcgctcatgcatatcgcctttaatttagcgatgtggtggtatttagcccagccaaacagaaaaacaactgggtacaggcaaattatttgtcattatgctcatttctgcgctatttag

SEQ ID NO: 2647 - DNA, 285 bp, Proteus mirabilis
accttcgtgagtttcaccaattttatggtttacaccggtataaaacagaatacgttcacttgtagtggttttaccggcgtcgatgtgcgcactaataccgatattacgatagcgtgctatgggggtttgacgagccattttttcctctctcgtgggcgttcaattcaggtaaaggacagcatagctgtcctgaaaagagttgcgactacttcgcggattaccagcggtagtgtgcgaacgccttgtttgcatctgccatacggtgaacgtcttcacgtttcttaa

SEQ ID NO: 2648 - DNA, 2136 bp, Proteus mirabilis
acgcccacgagagaggaaaaaatggctcgtcaaacccccatagcacgctatcgtaatatcggtattagtgcgcacatcgacgccggtaaaaccactacaagtgaacgtattctgttttataccggtgtaaaccataaaattggtgaaactcacgaaggttcagcaacaatggactggatggagcaagagcaggaacgtggtatcactatcacatccgctgcaactactgcattctggtctggtatggctaaacagtttgagcctcaccgtgtaaacatcatcgacaccccgggacacgttgacttcactatcgaagtagaacgttctatgcgtgttcttgatggcgcggttatggtttactgtgcagttggtggtgttcagcctcagtcagaaacagtatggcgccaggctaacaaatatcatgtaccacgtatcgcgttcgttaacaaaatggaccgtatgggtgcaaacttcttacgtgtagttgaacaaatcaaaacacgtttagctgcaaacccagttccactgcaaatcccagtaggcgctgaagaagatttcactggtgttgttgacctgatcaaaatgaaagcgattcgctggaatgaagaagatcaaggcgttaccttcgaatacgaagacattcctgctgatttacaagatctagcagaagagtggcacaacaacctgatcgaatctgcagctgaagcatcagaagatctgatggacaaatatctgggcggtgaagaactgtcagaagcagaaattaaatctgcgctgcgtaaacgcgttctagataacgaaattatcctggttacctgtggttctgcatttaagaacaaaggtgttcaggcgatgctggatgcagttattgaatatctgccagcaccaacagatgtacctgcaattaaaggtattttaccagatggtaaagatactccagcagaacgtcattcaagcgatgaagagccattctctgcactggcatttaaaatcgcaactgacccatttgttggtaacttaacgttcttccgtgtttattccggtgttgtaaactctggtgacacagttctgaacccagttaaagacaaaaaagaacgttttggccgtatcgttcagatgcatgctaacaaacgtgaagaaattaaagaagttcgtgcaggtgacatcgctgctgctatcggtctgaaagacgttactacaggtgatacactgtgtgcaattgatgcaccaatcatcttagaacgtatggaattcccagagccagtaatctctgttgctatcgaacctaagactaaagctgaccaagaaaaaatgggtatcgctctgaaccgtctggctcaagaagatccatctttccgtgtatctagtgatgaagagtctggacagactatcatcgcaggtatgggtgagctacacttagacgtgttagttgaccgtatgcgtcgtgagtttaaagttgaagcgaacgtaggtaaaccacaagttgcttaccgtgaaacaattcgcgaagaaattactgacgttgaaggtaaacacgctaaacaatctggtggtcgtggtcagtatggtcatgttgttattgaccttagcccattaccatcaggtggtgaagagaactatgtgtttgtcaacgatatcgttggtggtgtaattcctaaagaattcatcccagctgttgacaaaggtatccaagaacagctgaaatcaggtcctttagccggttatcctgttgttgatatcaaagctcgtctgcacttcggttcttaccatgatgttgactcctcagagatcgcgtttaaaattgctgcatctatggcctttaaagaaggtttcatgaaagcaaaaccgattctgttagagccaatcatgaaagttgagattgaaacgccagaagattacatgggcgacgttatcggtgacttaaaccgtcgtcgtggtatggttgaaggtatggacgatctacctactggtaagatcattcgtgcacaagtaccactggctgaaatgttcggttatgcaactgacctgcgttcacaaactcagggtcgtgcttcatactcaatggagttcttgaagtacaacgaagcgcctagcaacgtcgctcaggctattatcgaagctcgtaaagcgaaataa

SEQ ID NO: 2649 - DNA, 651 bp, Proteus mirabilis
agtaaaacgagttttctattatggagagaatttatgctttatatctttgatatgggtaatgtgattatcgatattgatttcaatcgtgtttttgccgtgtggagtaaactcagtggggttccattagccagtataaaagataattttacgactggggaaacctttaaattacacgaacgaggcaatattacggatatagaatttgcagaagctgtctgtgctgagcttggtattggactgagttttgaacagtttgcggaaggatggcaggctatttttatcgctgttcgcccagaagtcatagatataatgaataagctaagagagcaaggtcatcgtgtggtggtattgtcaaatactaatcgattacatcaagattattggcctcagcactatcctgaaatcgccgcttcagcggactttctctatttatcccaagatatcggtatgagaaagccagatcctgaagtgtataaatatgtgctacagtccgaaggcgttgaagcacaagatgctgtcttctttgacgatttacaaaccaatgtcgatgcagccattgcgctaggtattcaaggcgttcatgtcgtagataaaaatacggttgttgaatactttaaagatcatgattttactctcccagtaacagaataa

SEQ ID NO: 2650 - DNA, 996 bp, Proteus mirabilis
cggagtaagagcatggcgttattaaatataaatcaattatcagttcactttggtgatgaagatactccgtttaaagcggtagaccggatcagttatcaagtagaagaaggtcaagtggtgggcattgttggcgagtctggctcagggaaatcagttagttcattagcgattatggggcttattgattttcccggtcgagtatcagcagaagccttgcaatttgatggacgtgatctgatgcaaatttctgaatctgaacgtcgtgatttggttggtgctgaggttgccatgatatttcaagatccgatgacaagccttaacccttgttttacggtcggttatcaaattatggaggccctcaaagttcatcaaggaggaagtcatcgtacgcgtaaacagcgggcgattgatctattaacgctggtgggtattcctgatcccgcatcacgtttaaatgtttatcctcatcaactgtcgggtggaatgagccaacgggtgatgattgcgatggcaattgcttgccaacctaaattattgattgctgatgagccaactactgctcttgatgtcaccattcaagcgcaaattatcgagctattacttgaattacaaaaacaagaaaatatggcgttagtgttaattactcatgatttggcattagtcgcagaagctgcagataccattattgtgatgtatgcagggcaagttgttgaatcaggcctcgcaacagaaattttcaaagcgcctcgccatccttatacgcaagctttattaaaagcattacctgaatttgcgagtgataaagctcggcttgagtcattaccgggcgtggttccgggacgttatgatagaccgatggggtgcttacttaatcctcgttgcccctatgcacaggatacttgttttcagatagagcccgaattgaaagagataggtaaacatcgagtgaaatgtcatacaccattggatgatacagggagaccaacatatggctaa

SEQ ID NO: 2651 - DNA, 1527 bp, Proteus mirabilis
aggagccttggtatggaaattttagatgctttaatggtcgtttttagtttagaaacgataacaatgatcctgttaggggttttcgcggggattattatcggcgcattaccgggtttaacagtgaatatgggcattgcactgttactcccactgacttactcctttcaaggaatgacggggatcttattattattgggaatgtattgtggggctgtttatggtggctccattaccgcgatattaattagtacaccgggcacacctgcatctgcagccaccgtcttagatggctatccgatggctaaaaaaggtgaagcagggcgagcattaggcttatcaaccatggggtcgatgtttggtggtgtatttagtactatcgctttaattgttattgctcctcaattggcaaaagtggcgacgggattctctgctgctgaatattttgctcttgcggtatttggcataagtattattaccagtgtatcatcgcaatcgattgtgaaaggattaatggggggcgcgattggtcttgcaattgccactatcgggcttgatcctatgacagctgggccacgttttacgtttgataccgtgtatcttatggggggcgtctcgtttattccaatcctcgtgggactctttgcattttctcaaggcttgattagctttgaagaagagtatcgtgagcgcaagcagaagaaaagcgagaaaattaatgcccgtattcatcgtgtattacctacgtggctcgattttaaacgtgttttacctacctattttcgttcatcagcgataggaacggctattggtgctattcctgggactgggggagatatttcatcttttatctcgtataacgaagcaaaacgttggtcaaaacaccctgaagaatttggaaaaggatcacccgaaggggtttcagcaccggaagcgggggctaactcggtgacgggtggcaccatggtacctctaatgactttaggtattcccggtgatggcgcaacggcgattattatgggggcttttatggtgcaaggattagcgctagggccacagttatttacggataatcccgttgaagtgaacagtatttttatcggcttaatgatggcgaatatttttctcggtatcttaggcttcttgtgtatgaaactgtttgtacgtgtgatggatgtaccacgaagagtattagtacccattatttttgtgttgtgtagtgtgggggcttattcagttaaccatagcatcattgatgtttttgtgatgatgggggcaggattactggcttatattatgattaagctcgatttttcgatgtctccggtggtgataggtattatccttgggccaatggcagaatctaacttacgccgtgctttaatgatgtctcaaggggatttatcgattctctatacacgacctattactgcgacattcctcgctattgcactattaacactgctgttacctattgtcgggccagggttaaaatcaatgtggaaaaaatggcgtagtcaatctgcttaa

SEQ ID NO: 2652 - DNA, 1464 bp, Proteus mirabilis
gcatttattggttacactattatttctggtggtcataatgtctgttggctggtatggcacatcggcggttcacttttggaaggtagaagcatgtcagaacaaacaattatttgggatcttgacctgatccataagtataactattcaggtccgcgctacacatcatacccaacggcattggaatttaatcagcaatatagtgatgcggatttcgaacaagcaacaaagcgttatcccgaacgacctctgtcactgtatattcacattcctttctgccataagttatgttatttctgcggttgtaataaaattatcacgcgccataaacataaagctgatgaatatcttgatgttttagaaaaagaaattattaatcgcgctcgctattttaaaaatagaaaagtgacccaaatgcattgggggggcggtactcccacttttcttgataaacagcaaattagtcgcttagtcgctttattaagacaacattttcattttgtggaaaatgctgagctctctattgaaattgatccccgtgagattgagttagatgttattgatcatttacacaatgagggatttaaccgcctaagtatgggggtgcaagattttaataaagaggtacaacaaaaagttaatcgtgaacaagatgaagcatttatcttttcattagtagcaagagcgcgtgaagtgggctttcattctaccagtattgatttgatctatgggctacctaaacagactaaagaaagttttgcttttacgttaaaaaaagtgattgaattgtcccctgatcgcttaagtgtgttcaattatgcccatttacctaatttatttgccgcacaacgtaaaattaaagatgaagatttaccacttgcagaagaaaagttagagatcttgcaagagactatcaccacactcaccacaaatggttatcagtttattggtatggatcactttgctaagcctgatgatgaattagcggttgcacaacgccaaggtattttacatcgtaatttccaaggatataccactcatgaagagtgtgacttattgggaatgggcgtttcagctatcagtatgctgggtgatcactatgcgcagaacgaaaaagtgctaaaagagtattatgctcgcgtaaatagcgaagggcatgcgttgtggcgtggactctctctaactcatgatgattgtattcgtcgcgatgttattaagaccttgatttgtaatttccatcttaactttactgagattgaaaatctatatcagcttgatttccaagattattttaaagaagacttagcattgcttgcaccaatggtagaagatggattggtggagatcagcgcagaaaaaattcaggtcactccaagaggacgtttattgatccgtaatatttgtatgtgttttgatacttatttacgtaatcaaatgcgccaacgccaattctctcgagtgatttag

SEQ ID NO: 2653 - DNA, 1719 bp, Proteus mirabilis
cgacatgatggcagattgctgaccataaatttttccgattatgaatcgagtttaccttaccagggatatcttatgttgaacttaaatctaccaaaattaccggacgttatcagtgcagaagctaatgagatcctgatggtcactaacgcagacttacgtgagcctgcaaacgtaacatgctggcctgtgcagaaaaaatttgaagataagctagccgctgcattaaaagcacaaggttacaccatgaaacgtgcacataaaattgatgaagcacgaggccatggttttatcagtagtcagcgtgaaggttgcgatatgtttgcggctatcgatcctgatgcacccgttattgtgctattaaccgcatggcaatactcacaccatattgcctcttcattagcgcatcatcgcgggccaattctgttgctggctaattttgatggtacatggccggggctagttggcatgttgtgtttagcggggacgttaaccagtttaggtaaaaattattcacgcttatggtcagaaaattttgacgatacattttttattgatggcttagcaacatggttgaaatatggttatgtaaatcatcagcttagctatcttaaagaagttgcgccaacacacagggtaatggcgacagaagctggcgaagtgggtcgaaaagtcggcgaatatataattaaaaataaagaaataataggtttgttcgatacattctgtatgggaatgattaatggggtcttcccacaacaggcaatgatcgatattggtatgcccattgaatcactctctcaatctgcattattggtcgaaatggcaaaagtacctgatgcattaagagaagagtgtgtgcaatggtacgaaaataatggcatgacgtttaagtttggtacagatgataaaactgaactgactcgtgaacaggtgaaagagcagtgtgccatgatgattgcaatggcgcgtttcgttaaacgctttggcttaaccgctgtaggcgtgcaatatcagcaaggattaaaagattgttgtcctgcctctgattttgccgaaggtgcaattgggtcaacggcacgcttcccgttaccggatgaaaatggcgacattatcagccctaacacaccgatcccttgtatcaacgaagtcgatatgggtacagctattccacaaacgatgttatggcgtttattaacctcgttaggcttgcctgcagaaacaacattacacgatattcgttgggggagtgagtatcagggaaccttctactgggatatggaaatttccggctctgtgccttttgaacaccttaaaggtgggatcaaaggcgcaacaggttaccgtcagccagctatgtttttccctaaagggggatcaactatagcgggtcaaggtaaagcagggcgtttgttatgggcacgtgcacactatcaaggtacagatgtgattatgcatattggtaccggtatggcggtggaattaccggaggcagagtttgaacgtcgccgtcgagccactaactacgaatggccattactcaactgtactttagatggtgtaactcgtgatgatcttatggcgggacatcaaagtaaccatattacagtggcttatgttgatgacgataaattggcgtttgtgctacaagcctttgttgctcaagcactgactcaaggtattcaagtgaaagtggcaggtgatgccattaacttactgtaa

SEQ ID NO: 2654 - DNA, 492 bp, Proteus mirabilis
attttaaacggagtatttccatgcccacgtcgtcgtgtaattggtcaacgtaaaattctgccagatcctaagttcggatcagaactactggccaaatttgttaacattctgatggtagacggtaaaaaatctactgcagaatctattgtttataatgcgctagagaccctggctcagcgttcaggcaaaactgaactggaagcgttcgaaatcgcattagataacgtacgtcctactgtggaagttaaatcccgccgtgttggtggttcaacttaccaagttccagttgaagtacgcccagttcgtcgtaatgcattagcaatgcgttggattgttgaagctgctcgtaaacgcggtgataaatccatggctcttcgcctggcaaatgaattatctgatgcggctgaaaacaaaggcgctgctgttaagaaacgtgaagacgttcaccgtatggcagatgcaaacaaggcgttcgcacactaccgctggtaa

SEQ ID NO: 2655 - DNA, 1080 bp, Proteus mirabilis
attaatttaggacacaggagtaggaatatgcctttcgtgatgaaggaaacccagtttgtgctggataatgcacattcactttttaatcactgccatgcttcaacgattgtgcgtgtgcctaactctgagcgtttattaaccgctttttttgctggcgataaagaaggtagcggtaataccgctatctggttggcgataaaagagggaaatgattggcaacccgctcaacctgtggttaaaaatccaggtgttgcgcactggaatccagttttacatgttgacccatcaacaggtaatatctggctgttttataaaacgggtcctgatgtacatagttggacgacccaatatgttatctcgaaggatggcggaaatagctggagtttaccaagtgaattggtttcgggtgatgtaacacctagaggtcctgtgaaaaacaaagtattagtgatgtcaaacggcgagtggttagcaccgggatcggtggaggatgatcgatactgggatgcgtttgtcgatatttctagcgacaatggtcaacactggcagcgagtggatattccgattgcccatcatcaaggagggcaagcggagcatgaaatctggcaagggctaaaggacgatgccttgtgggagactgatctacaacgtgtttttcaatgggatggcgtgatacaaccaacactatggggatctcagcctggacatgtgcatgccatgatgcgcagtacgcgcggtaaaatttatcgtagcgattcaacggattatgggcgcagttggtgtccggcttatgcaacaaccttaccaaataataatagcggcattgatgtcgtctccttcgcagatggtctgttggcattggtatataacccgaattcaggcaactggagtcgtcgttatcctatctctgtcagtctttcatccgataatggcagtacttggtctgaaccattcgatttactcgatggggaaggcgaattttcatatccggctattattgctgaaaacaataccctacatgtgacttttacttggaacagaaaaaacattgtttatcagcagttaatagctactcaataa

SEQ ID NO: 2656 - DNA, 558 bp, Proteus mirabilis
gcaaaattaggcataaaaatggcaaaacttaccttacaagagcagatgctaaaagcgggattagtgacaaataagaaaatggctaaagtacaaagaacggcgaaaaaatcgcgggttcaggccagagaagcgaaagaggctgtagaagaaaagaaacgtttacagcttgagcgtgataaacaactcagtgaacagcaaaaacaagcaaccttattaaaagagtataaagcgcaagttaaacaacttattgagatgaatagaattacccctgctaagggcgatattgattttaaatttaccgataataatgtgattaaaacgcttgaggtggataaagtaacacaatctcaattaattaatggtcgtttagctattgcacgtttagtgattgatagcgccggaaacaatgaatatgccattattcctgcgagtgtggcagataaaatcatgcaaagagatgcagattgtatcttattaaacaacacattaagccaagcagaacaagacgaagatgatccttatgctgattttaaagtgccagacgatttaatgtggtga

SEQ ID NO: 2657 - DNA, 417 bp, Proteus mirabilis
ataacagtaggaggcgtgatgcaaaacgaaacagatcctgaaaatcttactttactcgatgaatctacctcaacaagccttgttccttatcgtggaattagattagcgaataacccaataaataaattaatgaggaaaattaaacagaaactcgccacgctaaatgaaattaatattgtcacattagtcagttggatagcaacagtcactgcctgtggtatgtatgtctcttatattccacaaataatggacaatcttaatggcattaaaactagcccatttcagccttttgttgcagccataaactgtttattatggacttattatggcgtgaaaagtaaagaatatcccgttgcgattgctaatgctcccggtattctattcggtactattgcttgccttactgcaattatttaa

SEQ ID NO: 2658 - DNA, 222 bp, Proteus mirabilis
tttgttgcaggaatggctgctaggttatttgctgataaagctcctgatgcaacgggttttgtggttggttttgccacaggcttagtctgtgtggttgcaggaggtgttaccggcttggttggtgtaggtttgacctctggtttttgtgttggtgccggttgcggtttggtcaccggagtttgtggcgttgtcggttggttttgtgtattttgctgttgttga

SEQ ID NO: 2659 - DNA, 228 bp, Proteus mirabilis
aagaataaaggtcgctatattacaaggaaagatagcactccccattaccttttcgcattcattctgatatttctcttatttaatcgtctctttatatattccgaattaaggattatgcgccacggaaggaaatggacaatcaaccaaggatggttagttctctgcgatatatcatttccccccttaatgtttcactctcaaatcagtagtctcacgctgtttatataa

SEQ ID NO: 2660 - DNA, 426 bp, Proteus mirabilis
ggagagaaagggatgagtcaaccatcgcaagaaagcgctgtccgtttagataaatggctttgggctgcacgtttttataaaacgcgtgccattgctcgcactatgattgaagggggtaaagtccattacaatggtgtgcgaggcaagccaagtaaaaatgttgaagttggggctgaaatacgcttacgacaaggtaatgatgaacggacagttacagtcttaatggtgagtgcacagcgcctaggggcggcccaagcacaattgctctattgtgaaacaccagagagtattgccaagagagaaaaaatcgctctagcaagaaaaatgaatgcgttaacgatgcctcatcccgaacgtcgacctgataaaaaggaaagacgcaccttacttcgcttgaaacagacaaatttaccaggatcggattaa

SEQ ID NO: 2661 - DNA, 255 bp, Proteus mirabilis
ttagtggaaggacgttttatgtctctcattccaaatcatagctacaagatcctcagctattccccgcaaattagccctgcctatcggcagaagctattatcattagggatgctgccaggcgctattttcaatgtgatccgtatcgcacctttaggtgatcctatccaaattgaaactcatcgggtctctttaattttgcgtaaaaaagatctcgctttgataaatcttagcgaaatcgctcataacgaaaaataa

SEQ ID NO: 2662 - DNA, 375 bp, Proteus mirabilis
aataatatgggaataggaactgatattatagaaataaaaaaggtggctattgcaatatgtagaagtggtgaaccgttaactcagcgattattaactgaatatgaaagaaacagtatcggtagaattcatgaaaattatcatcgtgttgcagggttttgggctgctaaagaagccgctgtaaaagcaataggtacaggatttcgtttggggattttatttcatgatattgaaataaggcatgatgaatatggcgcaccttgttatttttttacaggccatttttctaatttattaaagcagaaaaaaataacccaatcattattaagtatttctcattgtgatcattatgctgtcgctgttgcaatttttaattga

SEQ ID NO: 2663 - DNA, 942 bp, Proteus mirabilis
gatttgacgggtcaaaatatgaaatatcattccttattaaaaaatttattttatgcaacactttccatcatggcgttaaattttagtggcgtcactatggcaaaaaataccatgaatgatatttatgttattaatttatcctcaaataaagcagtttgtggtataaaaattaatgaattattagtctcggataatacaatggcagtcgaaggaagctattctactggtcaaaacatatctagtatattagccaatgggaaaaataccttaggtataattatgtttaatggatcggtttttactggtgaagaaaaacttacccctgatatgtggtgtgaagtcgaacttaagaaattatctgcaaatggcgataataccttaatatcgggacttagattaaacggaaataatgatgggaaaatggtggtctctgataaatatcaaaataacagtgagcatatctattttggtagtcccagtcgaaaaagtgaatttgatgctttagaagcaaaaaaccaatttaatatacaaggcctcccccaatggcaatgggaaaaagcaactcccgttactgaagacgatattcctaaaattcgtgctttttataccgaactacgacaagcatttattgataaaaatctagataaattaaaaactatgggaaaaatatcgtgggaagaaatggcctatgccgataatggctctcctgatattttttggaattctttagagtttaaagaattactcaaggatggatataaaccctcagatatagattggaatcgatacgaattaaatacctataacaataaccgtttgtttcgctatgaaataggatttagcagattatcgccaataaaacttgttaatcctgaagagagaacatttcattataatccttacctttctattattgatgggaaagtgactattgtccgataa

SEQ ID NO: 2664 - DNA, 1038 bp, Proteus mirabilis
caaaatgagggcaatatcaatgacggaacattaatggcaaaaacagttgaacaaattgcaaatgatctgaatttatctatcaccacagtacgattagtactcaatggtaaaggtgatcaatatcggatcagtgcaaaaacccagaaaaaaattgctgattatgtcgaagtttttggttataccgttaaccatgcggcaagaagcttaaaactcaataaaacagatacctatggtctggttattcctcggctgtccaaccccttctttgctgctttagcggaaaagttagagatgcattgtcaccagattggttgccagctgatgataagttgtacctatggtgatattaaaaatgaaaataagctcgtaaagtctatggatgagcgtaatgttgatgggatttttattgtttcagcgagtcgaaaaaatcagcaacatcacgttaaacatcgtcaaaagcctttagtgttcttagatagagatttttctgttagtaatgcaatttgcgtggcgtctgataactgtgatagtggtgcacaattaacgaaagcgatgatacagcaagatgcgccaatccacttttttgccggtgatgctcttcttcctactattgcagctcgtttgcgcggttatgttcaggcgatcaaagcccattatggtgatgaaagccatgtaaccgtttcctatgcagaacataacaccaccaaagatggtgaacagatgatgaagcaatatcttgaacaacatcggcagatccccagtcattttattgcctcatcactgcccattttagaaggcgtattaagcgctattcgccaaacagaaggtgttattcccgcacatatcaatataggtacttttgatgatcacgttatgttaagttttttacccaataatgtctggtcaatgaagcaagatgaaaccttattggtagaaaaagcctttgaaatcatgactgctaagatagcaggtaacgtagtgaaagcgcctccattaattaaaacacaacttatcaaacgcctaattgcaggagcatga

SEQ ID NO: 2665 - DNA, 240 bp, Proteus mirabilis
tgggattttattgtggatgtcgttgctgtttttgttatttccgtttcagctggcttagccgagaatgttggtgatcgtggtgatgtaaccgcgacttgttctaccttgaaggtatttacaatcatatctaacattgaggcttgttcacttagtgttgctgaagccgctgtagattgttccaccatcgcggcattttgttgtgtcgctttatccatttcattaactgcaaggctaatctga

SEQ ID NO: 2666 - DNA, 336 bp, Proteus mirabilis
gagggttttatgcaaaagaaatatatttatctattttgttctgctggcatgtcaacatctctgttagtgacaaaaatgcgtgcacaagcagaaaaatatgatgtacccgttattattgaagcttttccagaaacattagcagagcaaaaaggccaagaagcggatgtcgttttattggggccacaaattggttggatgctcgctgatattcaaaaattattacccaataaacctgtcgaagtcattgattcattgttatatgggaaagtggatggattaggtgtattaaaagcagcagtagctgccattaagaaagcatcagcaacaactaattaa

SEQ ID NO: 2667 - DNA, 969 bp, Proteus mirabilis
agaggctttatggccgagcatacaacggtaataaaggccccgagtaaacgaggggacgttatttttagcgcactagttcgactagctgcgttaattacacttttgcttttagcaggtatcattgtttcactgattttcgcctcatggccaagtattcaacaatttggtctgtcattcttgtggacgaaagagtgggatccacccgcacaggaattcggtgctttagtaccaatttacggtactgtcgttacctcaattattgccctgatcattgcggttccggtgagttttggtattgcactctttttaacagaactggcacccaattggctaaagcgcccattaggtatcgctattgagttattagccgctattccaagtatcgtttatggtatgtggggactctttatctttgcgccgctctttgccacatacttccaagagcctgttggcaatgtgctctcatcagtccctattgtcggtgagttattctctggtcctgcgtttggtatcggtatattagcagcaggggttatcctcgcaattatgatcatcccttatatcgcgtctgtaatgcgtgatgtatttgaacagaccccggtgatgatgaaagaatccgcttacggtatcggctgtaccacatgggaagtgatttggaatatcgttttaccttatacccgaaacggtgtgataggtggtgtgatgcttggattaggtcgtgcgctcggggaaactatggctgtgacctttattattggtaacacctaccagttagactctgcatcactctttatgccgggcaatagtattacctctgcattagccaacgaatttgccgaagcagaaacaggtcttcataccgctgcattaatggaattaggtctgattttatttgtcattacctttatcgtccttgcgatttctaagtttatgacactacgtttatctaagaatgaaggagcacgttaa

SEQ ID NO: 2668 - DNA, 1941 bp, Proteus mirabilis
acgacatttatgattgttttttcttctttgcaaattcgccgcggtgtcagggtattacttgataatgccagcgcaacgattaatccaggacaaaagattggtcttgtgggtaaaaatggctgtggcaaaaccacactgctctctttattaaaaggggatctacaagctgaagcgggtaatgtgacgtttcctagcacttggtcaatggcatgggtaaatcaagagacacccgctttagacgttcctgccattgattatgttattgatggtgatagagaataccgcgaattggagcgtcgtctacaacaggcgaacgacaataacgatggtcatgctattgccctgatccacggccaactcgatgctattaatgcgtggactatccaatcacgtgcagccacattacttaatggcttgggattcagccaacaacaactcactgagccagtaaaatcattttctggtggttggcgaatgcgcttaaacttagcacaggcactaatttgtcgttctgatctattactacttgatgaaccgactaaccacttagatttagatgcggtaatttggctagaaaaatggctaaaaagttataatggtacgttgattttaatttcccacgaccgagattttcttgatccgattgtggataaaatcttacatattgaacaagagaaaatatttgaatattcaggtaactactcttcgtttgaaatgcaacgtgcaacaaaattggcacaacaacaagcactctttgaaaatcagcaagcaaaaattgcccatttacaaagttttattgaccgctttaaggcgaaagcgactaaagccaaacaggcacaaagccgtgtcaaaatgcttgaacgtatggagcgagtggcaccagcgcactcagataacccattccagtttagttttcgccaaccagaaagcttaccaaacccgcttctgtctatggaaaaagtcagtgctggttacggtgataagattatccttaataacatcaaacttaacttaattcccggctcacgaattgggctcttaggccgtaatggtgcaggtaaatctacattaattaagctgttagctggagaattagctccactacaaggaaaggttgccctttccaaagggatcaaattaggttatttcgcccagcatcagctggaatatttacgtgccgatgaatctgcattacaacatttaactcgtttagcgccacaagagactgagcaaaaattacgtgattatctaggagggtttggtttccatggtgataaagtcaccgatgcatgtggccaattttctggtggtgaaaaagcacgtttagttttatcgctactggtttggcaacgcccaaatttactactaatggatgaaccaaccaaccaccttgatttagatatgcgacaagcattaacacaagcgctaattagctttgaaggtgcgattgttgtggtatcccatgacaggcatttattacgctcaaccacagacgatttatatctcgtccatgacggtcaagtagagccatttgaaggcgaccttgatgattaccagcaatggttagtcgatcaaaatcgccaagaaactcaagctaataaaacgcaacccgatcaagaaacaacaaacgcctcgaacttaacggctcaagataaaaaagagcaaaagcgtaaagaggcggagtttagacaacaaactcaacctttgcgcaaaaagctcaccacattagaaagtaaaatggataagcttagccaagagctgaccgccatcgaaactgagctttctgatagtcaaatttatgaagcgaagaacaaggcgacgcttaccgattgcttaagccgtcaaagtattgccaaatcggctttagaagaagttgagatggcgtggatggaattacaagaaaaactagaagagatgaccaacgcttttgagtctcaataa

SEQ ID NO: 2669 - DNA, 372 bp, Proteus mirabilis
tatttcttcttatacaacattagtgctcattcattaataaatataaaaaccaataaaaacaagaagataaatatgctaaataaaaatgatagagataagctaattaaaaataataaatataagaatataaagtttaatgtaaaatgtaatattcaagttattttgtttatttcattgatttcattagtttttatcaacaacgaaaacttacctctaaaatataaaattgcacttagcggtgggatgatatcttttatctatatatttagcgcataccattcatttggtagtctatatctagcaaacaaaataacatatgtatttataaaaataaaaataaaaaaactaatcacttacattttcagaaagtaa

SEQ ID NO: 2670 - DNA, 2082 bp, Proteus mirabilis
gaggctattatgacaactgagactttccttgtggaaatcggcacagaagagttaccgccgaaagcgcttcgttctttagccgaatcttttgcgacccattttacggctgaactggataacgccaatattactcatggtgatgtatcttggtttgccgctcctcgtcgtttagccatcaaagtggcgaatatggcgaaatctcaagcagataggatcgttgaaaaacgaggccctgctatagcgcaagcatttgatgctgaaggtaagccaactaaagccgcagaaggttgggctagaggtaacggcatcactgttgatcaagctgaacgtttatcaacggataaaggtgagtggctcttttatcgtgctgaagttaaaggcgaagccgttaaccaactactggctggtatggtaagcaatgcactggcaaaactgcctatccctaaattaatgcgttggggtgataaagaaacgcattttgtgcgtccagtgcatactgttactttattattgggtgataccctcattgacggtgaaatcttaggtgtacaaagcgatcgtattattcgtggccaccgttttatgggtgaagctgaatttactatcgataatgcggaccagtaccctgaaatcctttatgaacgtggtaaggtcattgccgattacgaaaaccgtaaatccatcattcttcatgatgcacgtcttgcggctgaaaaactaggtggtgtcgctgatttaagtgacagcctagttgaagaagtcacttcattagttgaatggcctgtggtgttaacggcaaaatttgaggaaaaattccttgaagttccggctgaagcactggtttacaccatgaaaggcgatcagaaatattttcctgtttacgataaacaaggtgcgctattacctcactttattttcgtttctaacattgaatcctctgatcctcaacagataatcagtggtaacgaaaaagtggttcgccctcgtttagcggatgcggaattcttctttaaaactgaccgaaaacagcgtttagaagataacttaccacgccttgaaactgttcttttccaaaaagatttaggctctctacgcgacaaaacagaccgtattcaagctctcgccggttttattgctgagaaaatgggtgctgatgtcaataaagcaacacgtgctggtttattatcaaaatgtgacttaatgaccaatatggtgtttgaattcaccgatacccaaggggttatggggatgcattatgctcgccatgatggtgaagatgaagaagttgctgtcgcattaaaagagcaatatcaaccacgttttgcaggtgatgcactaccatctaacccagtagcaagtgctgtcgctatagctgaaaaaatggatacgctggcgggtatctttggtattggtcaacaccctaaaggggataaagatcctttcgctttacgtcgtgctgcccttggtgtgctacgtattattgttgaacaagatttaccattagatattgaagaattaacccaagaagcggctcgcctatatggtgacaaactgacgaacaaaaatgtcgtcagtgatgtcgtagagtttatgctaggtcgtttccgtgcttggtatcaagagctgggttatagtattgatactattcaagcggtattagcgcgccgcccaacacaacctgctgactttaacgctcgtgtaaaagccgttacttacttccgaaccttagaagaagcagctgcattagccgaagccaataaacgtgtttctaatatcttagcaaaatcagcagatgttaagctcaacgataaagtattagcctcggtgctaaaagcgcctgaagaagttcagctagcggctaatctttctgtgctacaagataagctagcccctctatttgctgaacgtaaataccaagaagcattagttgaactcgcctctttacgtgatgttgtgaataacttctttgataaagtgatggtaatggataaagacgaagaaattcgtatcaaccgtttaaccatgctacatgaattacgcgagttgttcttaaaagtcgctgatatttctgttttacaataa

SEQ ID NO: 2671 - DNA, 729 bp, Proteus mirabilis
aaactaattatgaatccaacacgctatgcccgcatctgccaaatgatggcgatgcggcaacctgatctcactgtttgccttgaagaagtgcataaatctcataatgttgctgctgtaatacgcactgcggacgcggtggggatccctaaaatccatgctatctggcctgaagaaaaaatgcgtatgctggtttctcccgcagcgggcagtaatagctgggtaaatgttaacactcatccaaccattgccgacgccatcaacacttttcgtgcacagggcatgcaagttcttgcgacccatctctcagataaagcggttgattttcgtgagattgattacacacaaccaacctgtattattatggggcaagaaaaaaccggtatatcaccagaagctattgcgctggcggatcaagatatcattgtaccgatgatgggtatggtgcaatctttgaatgtttctgtggcgagtgcattaattttatatgaagcacaacgccaacgtcaggcggcgggcatgtataatcgaaccgaaagtgcattaactgcagaagagcaacaaattttactctttgaaggtggctatccagtacttgctgaagtttctcgtcgtaaaggactgcctcgcccttatattaatgatcgtggtgaaattgaagcaccggactcatggtgggcagaaatgcaaatgacacaaaaacaacttaggaaatttaaactgacggagtaa

SEQ ID NO: 2672 - DNA, 747 bp, Proteus mirabilis
gtaataattatgtttgcgcagtttctttctcactatcttcttgagcctcactacttaagttggctgtggcaaggttttttaatcaccttgcttatctctttctggactatcattattgccacattactaggttttcttctcagtgctgcctatgatagccatatcgcgccattacgttggtgtgcggccatttatacttcactctttcgtaataccccattattggttcagctcttcttttggtattttgcttctggtgaactattgccacaaacggccatgatatggcttaacaccccacatgaactttctttatttggcttaacgctctcttggccctcttttgaatttttagccggtattattgggcttaccttttactctgtaccttttattgcccaagagctaagagcaggaatacagggagtcagacaaggccaaaaatatgcagctttagcgttaggattaacccactggcaatccatgcgttatgtcattttaccgcaagcttttcgtatcgcccttccgccattgttgggtcaatatatgaatattatcaaaaactcctctctcactatggccataggtgtcgcagagctttcttatgcttcaaggcaagttgaaactgaatcattacgtacttttgaagcgttcggcgtcgccaccatactgtatatcgctgccattgcattaatggaagcttgggggcaatggcatcagcaacgaaaattagcgcaaggatattaa

SEQ ID NO: 2673 - DNA, 1428 bp, Proteus mirabilis
ggaggaattatgtcattaaaaacaagctctcttccttttaaaacgctaattgatcgtcaagttcatgatcaaattatgcaaaaagccgttgctaatgcgcaagaaactattggccgtaatcgtcaaaaaatggttgatgaattaggacactgggaggattggcgggatagagcggcacaaattcgtgatcatgtacttgctaatttagatgcctatttatatcaattatctgaaaaaatagaacaacatggtgggcatgttttctttgctcaaacgaaagaagaagcctctcaatatattctcaatattgcaaaagagaaaaaagccaaaaaaatagtcaaagctaaatcaatggtgacggaagaaattggcttaaaccctgtattagaaaatgcaggtattaatgttattgaaaccgatttagccgagtttattcttcaacaagcaaaagacgccccatctcatgtagtggttcctgctattcataaaaatagagcccagatacgtcaaatatttcatgacaaactgggttataacggctcagatacaccagaagaaatgacgcgttttgttcgccagaacattagagacgatttttttactgccgatatcggtattacggggtgtaattttgcggtagcagaaacaggttctgtttgtttagtcactaatgaaggtaatgcacgattaagtacaacattacccaaaacgcatattgcggtgatggggatggaacgtattgcacctacttttaaagaggtagatatcttaattaccatgttggcccgtagtgcagtagggttacgtttaacgggctataatacatggcttactggccctaaagagaatgacaacgttgatggcccagaagatttccatcttgttattgtagacaatggccgctcgaagatcattggttctgaatttaaagatattttacgttgtatccgttgtggtgcttgtatgaatacttgccctgcttatcgccatattggcggtcaaggatatgattctatctatccaggccctgttggtgccgtcttaacgccactacttggtggatataaagactttaaaaacctgccttatgtctgctcattatgtactgcttgtgatagtgtttgcccagtaaaaatacctttatcaaatcttataaagaaacatcgtgaagtcatggtagagcaaggtataacaccgacaactgaacgtaatattactcgggtatttaattatgtgaaccgccatcctatgttatggaaagttgggatgaatatgggggctcatgctacaaaatggtttattaaagaaggtaaagcgccattaaagatcggtgcaataaaagcatggacagaagcgagaaatttacctgaaggtgatggtgaaagttttcgtagttggtttaaaaaacaccaaaaagaggagaaataa

SEQ ID NO: 2674 - DNA, 894 bp, Proteus mirabilis
gagaagattatgtctaaaaaagacgctttatcacgctttttatttgaaaaaagcgcggtacgtggtgaattagttaccgtaacggaaacctatcaatcaatacttgaaaatcatcattatcctgagccagttcaacacctgttaggtgatttattggtcgcgacaagtttgttaacagctacgctgaaatttgatggtgatattaccgttcaattacaaggtgatggcccagtacgattagtggttattaacggcaataatgaacaacagatgcgcggtgttgcacgttttagtgatgatgttaaagccggtagcagcttaaaagagatgatgggcaatggctttatggttattaccatcacacctaaaaaaggtgagcgttaccaaggtattgtagcgttggatggtgaaacgatagaagcttgtattgataactactttaatcaatcagagcagttacctacccgtgtctttatccgcacaggtctgcaagatggaaaagcggcgggtgcaggtatgttattacaagccttacctgcgagtgcagaacatagtgctgatgagacagcagaacactttgagctattaacacaacttacgcacaccattaaagctcaagagctgtttacacttgatactaaagagattttacatcgcttatatcatgaagaagatgtgacattatatgatccacaaccgatagcattccattgcacgtgctctcgtaaacgttgtgaagatacattagtaacattatctaaagaagatgtagctcatctgttacaagaacagggtaaaattgatatggagtgtgaatattgcggtgctcattatatcttcactgaagaagatattaataatatcaataaattatctagctctaatttgcactga

SEQ ID NO: 2675 - DNA, 1503 bp, Proteus mirabilis
gaggatgttatggaaactaaagacttgattgtcatcggcggcggaataaacggcgctggaattgcggcggatgcagcaggccgaggcctttcagtattaatgctggaagctcaagacttagccagtgcaacatcttccgctagctcaaaattaattcatggtggcttacgctatttagagcattacgaattccgtttagtcagtgaagcattggctgaacgtgaagttttattgcgtttggcgcctcatatcgcatttccgatgcgtttccgtttaccgcatcaaccccatctacgcccagcatggatgatccgcattggtttattcctctatgatcacctaggcaaacgtgtcagtttaccgggtagtaaaagtattaaattcggggctaactctgtcttaaaacctgaattaactcgtggttttgaatattccgactgttgggtagatgatgctcgtttagtagtattaaatgcgcaagagatcgttcgtcgtggcggtgaagttcgtactcgtaccaaagtgacgcgcgcttggcgtgaaaacgatttatggatggtggaagcacaagatttacgcaccggtgaaacttctcgctatcaagcaaaagcattagtgaatgcagccggtccttgggttaaaacattattcgatgaagggttaaaattaaaatcaccttatggtattcgcttaatcaaaggtagccatattgtgatcccacgtgctcacgatgaaccccaagcctatatcttacaaaatgaagataatcgcattgtattcgtgatcccttggatggatgagttctctattattggtaccactgatgttgaatacaaaggtgatccaaaagatgtggctattgataacaatgaagttgagtacttattaaaagtctataacgaccactttaagaaacaactgaccaaagacgatatcgtctggaattattcaggggtgcgtccattgtgtgatgacgaatccgattcgccacaagctatcactcgtgactataccttagatttacatgatgataatggtaaaacaccactactctctgtgtttggtggtaaattaacgacttatcgtaaactcggtgaacacgcggttgataagctaaatgcttatttccctaatatgggtcaagcgtggacaaaagagggtcaattaccgggggggaacttagaaggttacgatcgtgatggctattcacgtcttattcgccaacgtcatccttggttaccagaagcattagcactacgttttgctcgcacttatggtagcaatactgaagtgttgctagaaggaattactgatttagccggaatgggcgaaaatttcggtcataatctttacgaagctgaattacgttatttagttaaacatgagtgggtgattgagcttgatgatgctatttggcgtcgtaccaaacttggtatgtggcttaatgatgaacaaaaacaacgtattacgcaatggttagaggcaaatacgcacacagcataa

SEQ ID NO: 2676 - DNA, 405 bp, Proteus mirabilis
tttgacgttattatagtgatatcgttctctcgctcagaacataacaatgtaattaacaatataataaataagacaattatggatagttttcaatttcttagtattgaacaagcctatcaattttgggtatctcaatcggctattttagttgatgtaagagatccgcaaagttatcgtcttggtcatgccactggcgcttttcatttaacaaatgatacgcttaaccaatttctacaagatgcggattttgatgttcctgtgatggtgatgtgttatcacggtcatagtagccaaggcgcagcacaatatctggtcaatatgggctttgaaaccgtatatagtattaatggcggttttgaagcatggctaagagagtttcctcaagcgataacttctctgcaataa

SEQ ID NO: 2677 - DNA, 924 bp, Proteus mirabilis
gagcttactatgtatcatttacgaacccctaagacgcaagcagaattagcagcttattatacttttcgttgggaaatgcttcgtaaaccgttacatcagcccgaaggctccgaaaaagatggttatgataccttagcgcatcaccagatggtggttgatgacagtgggcaacccgttgctattggtcgtctctatataaatgccgataatgaaggtgcaatccgctttatggcggtacgtgaggatgctcaaggtaaaggattaggctctttagttgccatggcgttagagtctttagctcgccaagaaggggtaaagcgtattgtttgtagcgccagagaagagtctgttcgtttctttgaaaaattaggttatgagaattgtggtttagtcacaggtcctcaaactaccccgatcaaacattactttatgaaaaaaagtattgaatcattagatgatattctccatcgtcctgattggtgtgcggagttacaaaaacagtggcatcagcatatccccctaagtgaaaaaatggggttacgtattacgcaatatacgggcacccgtttttataccacgatccctgaatccggtaatcaaaacccacaccatactatttttgccggtagccagttttctttagcaacactgaccggttgggggctgatttggttgttaatgcaagagcataaactgcaaggcgatattgtgctggtggatgcgcatattcgttatcgtaaaccagtctctggtcggccgtcagccgttgctgatatggaaaatttaagtggtgatttaggacgattagcgaaaggaagcaaagctcgtattaagttagatgttgatatttgtggtgatgaaggaacgggggcggtttttagcggcacttacattgtgttaccctcacaaaataaacagtactaa

SEQ ID NO: 2678 - DNA, 933 bp, Proteus mirabilis
gttggcactatcacatcacatttaacaataaggtatagcccttattttgaaaaggaacatgatatgtcaatcaaacaccctattattgctgttactggttcaagtggtgcaggtactactacaaccagccaagcttttcgtaaaatatttcagcaactcaacgcccatgcagcctctattgaaggggatagttttcaccgttatacacgccctgaaatggatatggccattagaaaagcgaaagagcaaggacggcatatcagctattttggccctgaagccaatgactttaatttattaagttcaaccctaagtcactatagccaaacagggcaagggcaatttcgcaaatatcttcattcttatgatgaagcaaccccttataaccaattacctgggacatttacaccttgggaagcattgccagaaaaaacagatattttattttatgagggattgcatggtggtgtcgttaccgatcaacataatgtcgctcaacatgttgacctattagtcggtgttgtgcctattgttaaccttgaatggatacaaaaattaattagagacaccacagagcgcgggcactctcaagaagcggtgagagattctgtggtacgttcgatggatgattatatcagttacatcattccacagttttctcgcactcatatcaatttccaacgcgttcctacggtggatacctctaaccccttctcagctaaagctattccaacactggatgaaagttttattgttattcgctttcgtggcttaacggatatcgatttcccctatctattggcaatgttgcatggttcatttatgtcgactatcaatactattgttgttccaggagggaaattaggcttagcgatggaattaatcatggcaccactggtgaagaaattattgaatggtgaaaaaattagctaa

SEQ ID NO: 2679 - DNA, 375 bp, Proteus mirabilis
atggcaactattaatcagctggtgcgcaaatctcgtagctcgaaagttgttaaaagcaacgttccagctctggaagcttgcccgcaaaaacgtggcgtatgtactcgtgtatatactaccactcctaaaaaaccaaactcagcactgcgtaaagtatgccgtgttcgtttgactaacggtttcgaagtttcttcctacatcggtggtgaaggccacaacttgcaggagcactccgtaatccttatccgtggtggtcgtgttaaagacttaccaggtgtgcgttaccacactgttcgcggcgcgctggactgttccggtgttaaagaccgtaaacaaggtcgctctaagtacggtgtgaagaagccaaaggcttaa

SEQ ID NO: 2680 - DNA, 696 bp, Proteus mirabilis
aaactgactattatgaataagataaaattaatcctttttttattattgtggtttccattaaaaaatagttttgcagtaaatgtaggtaatataacagagataatatcttctgatgaaagtactcttgccaaagaaattgaaaatacagtaaatacggcaagattagtcaatttgacaatagaaaaattagactcaccacttgaaaatgggaaagttattccggttactgatcccaatgaaattctatcaacaccggctaatctgattcttcccggtcatgcaagtgatgtatttaaaatcatttatcaagggcctaaggatgataaagagcgttattatcgattaaattggaaagatgatcctattgctgaaaatggtataacacaaagctcaaaatcagcgacagcaacaacatctgcaactattagtacaattttagtggttgcacccagaattgagaattttaattatcagtatcatgataataaagtttctaatatcggtaatagttcatttcgtgttgtggcttcaggcccttgtctagcagaaaaacaacaatatggtgtggaggggatgtgtcgcgagcgttattaccttatgccacatttagccgttaaattacaacttgtcgatctcacaaataaaaaatctagcgtaggcatttggcacaaaggagagttcattgttgtcaaataa

SEQ ID NO: 2681 - DNA, 1032 bp, Proteus mirabilis
ttatcttatataggagcaattatgttgcctaattatcattattatatgcaagcgcatcatcatactatgctaacacctatttatatcgcctcgatagtattaagtttatgctttattaataattataatgagttaagtttttggttattatttatgggtaactttgctatttttattgtcattttactcagtgcaatgatgaatgagcgaatatattggcgatactgtattttttctgaaaagttttatttaaaaaataataataaaagcgatataaaaaggacgataatatcacgttattttactgttttttcgttaagctatataattggggttataataatatttcttgttacctcttatttaatcgagattgtttttgatagccaaatatatattattatttttcttggttttttcttgtcaccattaatgatatggttttttatgtattttttgatcaagttttatgtcagttgttcaattcattatttgaataacttttctttatatagccgtgagaagaaaaaatttaacatatcctatattattgttaatgaggtttttttaagtttacttgttaattttcctattgtttttccgctccagaacagtgctactttctcgttagagcaaggttatcttaatattgagtttattgttgcattaatcattcttttatatagtgttctgtttgttatgctttttttatcgaaggcgagtaaaattaattacctaatggggatgattatctgttatagctttgaagaagattttgctgaggtaaaaaaaagaggcctgttttgccgtgtattatggtttctgattttgatccctttaggtacattgttactctgtttattattctatttgctgaatataaaagagaatttctttttaatttattcggtgagtttatctttagttatttatctctattttattgagcggagaaataaactctatcaggaatttatattagcatttgatatgatcttacgtttaaaagcactaaaaaattttaaggagtaa

SEQ ID NO: 2682 - DNA, 1032 bp, Proteus mirabilis
agaggatatatgtcagaagagacacagaaaaaggcatccaataaaaacactcaactgactcagcccattaagcatgggttagaaaaagggcttcatggtggaaaaaaagccattggtattggtataaaattcactaattttgttaccaacattccctttattgctcaccttattcgagcggcagagcgttttactgaccgaatgggaaaccagtttggtgcggctatcacttacttctcatttttatcattaattcctgtactaatgctctcttttgcttgtgcgggttttattttagcttcaaaccctgatttgttggccaaattaattacgggagttgccaatagtattgatgatccaactttagcctcaaccgttcaacaaagtattgatactgcggttcgtcaacgtacaaccgtaggtttaacagggttagccatcgccttgtattctggtgttaactgggtcgggaacttacgccaagccattttggctcagtctcgcccgatatgggaacgcaacaaagaggatcaagaaaaaatttactttcgttattttcgcgattttttagcccttatcggtttacttgttgcacttgttatcactattacactaacctccgttgctggctccgcacaaaaattgattgtgcatacattaggtttagatggtattgaatggctcacacctgcttggacaactattggtttaactatctctattagtgccaattatctgttatttttgtggatattgtggatcttacctcgtcaccaacctaaacgtatctcattattaaaaggaacgcttatcgccgcaattggctttgagatcttaaagtcggtgatgacatggttattacctagattagccagttcaccttctggtgcagcttttggctctgtgattggtttaatggctttcttctacttttttgcacgactaacactcttttgtgccgcttggattgcaacagatggacctaatatgcgcaaagaaaaacacaagagtgaaacgcaatctatcacctaa

SEQ ID NO: 2683 - DNA, 912 bp, Proteus mirabilis
ttgaggtatattccgcagtttacggagggaagcatggacaccaatttatctactcgtcttaataaatatatcagtgaaagcggtatctgttcacgtcgtgaagccgaccgttatatcgagcaaggtctggttcttatcaatggtaagcgcgcaggcattggcgatcgcgtaacggcgggcgatgaagtgaaagtgaatggacgattaattgaagcgcaagataattctgagctggtgttgatcgcactgaataaacctgtaggtatcgtcagtaccacagatgaaggtgagaaagataatattgttgattatgttaaccatagcacccgtattttcccaattggtcgtttagataaagattctcagggactgatttttttgactaaccatggtgatctggtcaataaaatcttacgggcgggtaactcccatgaaaaagagtatttggtcacggttgataaacccattactgatgaatttattcgcggtatgggggcgggtgttcctattctgggacaaaaaaccaagaaatgtaaggtgaaaaaagaagccgcaatggtatttcgtatcaccttagtacaaggtctaaaccgtcaaattcgtcgtatgtgtgaatattttggttatgaagtcaccaagcttgaacgtatccgtattatgaatgttagtttggcgggattacctgtcggggaatggcgtgacttaacggatgatgagctgataaagctatttgatgctattgaagcatcaagctctgaagcccctaaacagaagcaaaataaacctaagaaacagataagtagtaatgcgaaagcgttagggatccatattccgaaaacaaaagccaaagagacggaaaataatacgcgtaaacgctttgcacaaccggggcgtaaaaagaaaaaacgttag

SEQ ID NO: 2684 - DNA, 687 bp, Proteus mirabilis
aattttaatatgaaactaatatcttggtttaagatactttgcgggatgttgttagtcttcttttatcaccatgcatatgcactttatattagtgcagatatttcctctatggagtcgggggaacccttcttttctaagccctatattaatgatactaaaaaaaccaatttatatacatttagtgcttaccaaattgataggccgggttatcaagagcagggcacacctattcagaatggagaaattctttttactccccttaaaaaaattctattacccggggagcaggaattttttaaaattttctatcgaggagaggcggatgagaaagaacgttattataaaattattattagtgaaacgccacttgatataagaaatgatgaagggcaaaaaaaacaaccactgttctaccccacagtaagtttagaaacctattttgttgttagacctaaagatccagatttcaaatatgatttaaatattaaccaaggaatattaaaaaatacaggcaatacttattttagggttttgttacatcaaaattgtgatggtgatgatgactcagagccttatgtattttatttattacccaatcaacaaattaaagatctgcgcataagtcaaaaaagtcgtaagtatattgttatctttgataaatattactctatagggaattgtgagtaa

SEQ ID NO: 2685 - DNA, 1566 bp, Proteus mirabilis
ggaaaaaatatggccaagaaaaaattcagcgaatccatacagcgctttggtaggaccctactcctgccaatcggtgttttagcgcctatcggtatgatactgggtatcagtggcgctttagttcagtcttatatgattgcacgctttcctttcctggggaatgaaacagtcaatgcattattagtgagcatccgctctattgcaggggtcgtgtttgataatattccactgctatttgctatgggtgtggcttatggtatgagccataaagacaaggggatcgccgtgtttgcctccgttgtcggctatttaaccttgattagcaccattaatatttggctcgttttgacggggaaactcgctgatcctgccgtaatgactcaagtggggcagatcaaggtgttaggtattcaaaccatgaatatcagtgccgcaggggggattatcaccggattaattgccgcttgggcgacagataaattctataaccttgaacttcctaccgcttttgccttcttctccggtaaaaaatccgttgccattattatggtgggattaatgattggcgtaggggcattactaccctttatctgggaagtcttggtgatgggattaacaaaactttccgcagtcttcctgagtcctgtcggaccattctttacagcagggggagagcgactgtttattccatttggtttacaccatgtatggaacgtgttgtttagatttaccgaagcaggtggctcttacgttattgatggacaaacctatgtgggtgttgttcctgccatgacagaagtgctgtttaaccaagggccaagtagtgaatattggtcaatgatgccaagcttaacgcgttttatggcacaacaacaaatgctggtcactctgttcttattcccagcaattgccttagcaatttatagaacatcgaaaaaagagaatcgcgcagaagttaaatctatgttggtgaccatggtattaaccgccatgttaggtaacgtcactgagccactcgaatttacctttgtgtttattgcgccacttttatatctgatttacgccattattgttggtattggtgcggttttactctcttttgctggcgtggcgattggctatatccgaggtacggtatttgacttcaccatctttggtctgctctatgaacataccaactggatctacttagtgattattggtttaggtctggcggttgtcacttacttcattttctactgggccattattaagtttgatatcaaaacaccgggtcgtgaagaatcaagcaatatgaaaaatacgcttattaaagagaagcgttatggcgaaattgcggagatcttaattcgcgctttaggcggaaaacaaaatattcgtaacgttgataactgtattactagactccgtgtcgatatcggtgaagtaaatcaaattgataaagagttaatgttggaatcaggttgtacagcattctttattcctgcagcgaaccatgtccatattgtttatgggccaaaagttgagtttgttcgcaatgctgttgatgaagcaatgaagaaataa

SEQ ID NO: 2686 - DNA, 933 bp, Proteus mirabilis
gttatgaatataaaatatcgtgctgatattgacggtttaagagcaattgctgttattttggttatcttctttcatttagataatcgcttaataccatcaggttttattggtgttgatatcttttttgtgatctcgggtttcttgatctcgttaattattaaaacatcacttttacaaggtcatttttcatttggtgatttttatattcgccgattatggcgtttacagccactctatctttttgttttagtagcagttcttgtaatttcaggtattttctatctacctagtgattatcttgatatcactaatagtgaaaaatatgcttcagcttttctgtctaacaaatattttgcaagagcaacgactagttatgcagcgcaagatgcactcttcttaccgttattacatacatggtctttagcaatagaatggcagtggtatctattcttaccttttgtactctattttcttcacaaaattaatcataaagagaaaataaataatttttattttattgtttttattacaataatttctttctccttggtgcttgtttatcaaaaagatcaacctaagaattattattactttagtacgcgtatatttgagtttatgttaggggcttgtgttgcttatttacccgtaaaagtaatcattaatcaaagagttaatagtgttattagtctcatcgccttaggggttatcttttggatagccgttcaaaaagatgtgattgctggttatccgaatttcaatacgttatatgtttgtcttagtgttgcactaattatttatacaggacaacatggcagtattattcaaaaagtgttgtcattaaagccaatagtgatcattggattattatcttattcactttatttatggcactggccccttatttgctattgcgcgttatataggcgtatttaa

SEQ ID NO: 2687 - DNA, 750 bp, Proteus mirabilis
tatgtgaatatctgtttactttgtgaagaaggcgctgataacagcgccttatctgctttagcgcaacgttggggattaattcacgacgccacacaaactatggcgttagtcttaacgcccactcaccttgaattgcgtaaacaagatgagcctaaacttggtgggatctacgtggattttgtcgcgggtactatggctcatcgtcgtaaatttggcggtggtcgtggtgaagcggtagcaaaagcagtaggtattaaaaaggattatctacccgatgtggttgatgcaacagcaggattaggccgtgatgcctttgtattagcctctattggttgtaacgtaagaatggttgagcgtcatcctgtggtggctgcattacttgaagatggcttgaaacgcgcttatctcgatgcggatattggtgagtggatgcaacagcgtatgaagctcatttatgcttcatctgcacaggcactcacgcaaattagccctacacctgatgtagtctatcttgatcctatgtatccccataaaaccaaaagcgcattagtgaaaaaagagatgcgggtattccaatctcttgtcggtgcggatgaagatgctgatgcactattagcaccagccatggcactggctaaaaaacgagtggttgttaagcgtcctgattatgctgagccgttaaataatcaacccgcacatgcaagtgtcaccaccaaaaatcaccgttttgatatctatccttgtatctag

SEQ ID NO: 2688 - DNA, 765 bp, Proteus mirabilis
cgcaaggatattaatatggactttactgttattgctgataattggcagtatctactttttggcgcgtatcctgatgggccattagaaggtgcggctttaactatatttattagtgtgatcgccggtattgtatctattatattagggacgcttggggggatcgctctcgccatgcttaaaggggtatgggttaacttatttgccgcttttttaggttttttccgtgctattccggtcattatgttgattttttggctctattttctattacccgtggtattaggaatggaaattcctgagataaccaccgtgatctgtgctctagcacttattacctcctcttatatcgctcatggtgttaaagccggtattctcgctattggcaaagggcaatggcaagcaggtttatcgttaggatttaatcgctggcagacgctttggtatatcgtgttaccacaagcattacgtatgatggtgccctcttttatcaatcaatggatagccttaattaaagatacttccctcgcttatgttgtaggtgtcggtgaactctcattcttagcaacacaagttaataatcgcagcatggtgtacccgatggaagtttttttatttgttgcctttatttactttgtgctctgtttttcattagagttaattgccaaccgagtggggaaattatttaccacccaaaaagaaaaacgctctttttggcaatatgttatccctaataaaaaaccttcactgagtgaaaaaattatttaa

SEQ ID NO: 2689 - DNA, 1347 bp, Proteus mirabilis
tatttaagtatacatctgttaacggttgatgctgagtccggctcacggtatggtgtttatctaatgaaaaacgacaaagaagatcctgcaaagatgactcaactatcacgatttgggcaaaaatttgctcgccactcaggtatttctcgcttgatgcaagacttaaatgaaggaatacgtacaccagaagcggtgatgttaggaggaggaaatcctgcccatattcctgagatggacagctattttcaccaattattacaagagatggtgaataatggctcattaagtgatgccgtatgtaattacgatgggccacaaggtaaagatgcgatgctcaacgccttggctatttgtttaaaagaaaaattaggatggaatatttccgctaaaaatattgcgcttactaacggcagtcaaagtgctttcttttatctttttaatttactcggtggccaatctgctgagggtaaaaagcgcaaaattctttttcccatcgctccggaatatattggatatgccgatgccggattagaagaagatttgtttgttgcgaataaacccactattgaaatgctacctgatggacaatttaaatatcatgtagattttgaacatttaacgataggtgatgatattggtgctatttgtgtttctagaccaacaaatccaacaggtaatgtgatcactgatgatgaagtaaaaaagctggatgccttagcgaaaaaacatgatatcccactgattattgataatgcttacggcgtgccctttccggggattattttttcccaagcaactccccactggaatgacaacaccattctttgtatgagcctctctaagctaggattaccgggggctcgttgtggcattattatcgctaatgaagagcttattactgcaatcacgaatgtgaatggcattattagtcttgcccctggaggtattggccctgcgatggcattagaaatgctcaaacgtgatgatttaatgcgattatcccaagagataattagatctttttatcatcaacgagtacttgaaactattgatattattcgtcgctatctacctaaagagcgttgccttatccataaaccggaaggggctattttcttgtggctttggtttaaagatttaccaatctcaagtgaagaactctatcggcgtttaaaaaaacgtggtgtattgatggttcctggtcactatttctttccaggcttagaagagtcgtggcaacatgcacatcaatgtatgcgaatgaattatgtaccagagcctgcattaattgaaaaaggaataaagatcctatcggaagagatagaacgatgcttatcgccagaataa

SEQ ID NO: 2690 - DNA, 1056 bp, Proteus mirabilis
ttttttggtataatcattgtttcctttgtgaagctcattattaggtcacagctagtaaactgtgctatttcatatcgcaacaatatgggaaagagaatgtttaaaaaatcattaagcccactgttcttattgctgtcttctctggttatcgcaggttgtgataacgcacaagatacctcaacaacgcaatccacagagaaacaaactctcactatcgaacatgctcaaggcaccactgagatccctgctcacccacaaaaagtggttgtgatgaacatggaaacacttgatattgttgatgctcttggcgtacctgttgttggcctaccacaaacaaacgtccacctacctaaatttctagagaaatacaccaacgaaaatgagtacatcaacgaaggtggcctgtttgaaccaaactacgaaaaactcagtactactgcccctgatctgattttaacgggtagtcgtgctcgcgatgcatatgccaaattaagtgaaatcgcaccatccatttctatggatatcgacagcacacgctttattgacagcctcactgagcgtacaacgactttaggtcaaatttttggtaaagaagaacaagctaaaaaattattagctgacttcaatagcaaaattgatacggtaaaagcaaaaaccccagatgcgggtaaagcaatggtcgtattagtcagtggcggtaaaatttccgcttatggcccaggctctcgctttggttttatctacgatgtattgggctttgaacctgcatatactttcgatagcccaggctctcacggtaatattgttaactcagaactactgctaaaacttaatccagactggatgtttgtcattgaccgtgatgcagcaattggtcgtgaagattcacaacctgcaaaacaagtgcttgataatgccctagttagaaaggttaatgcatggaataaagaccaaattatctatcttgatgccagctcgatttatatctcaggtgggatacaaacttactctcgcttaatggatacaattaatcaggcgttggatcaaaaaaaataa

SEQ ID NO: 2691 - DNA, 909 bp, Proteus mirabilis
ggtataggtatgagcttttatcacgcaagccagcatgaagcgcttaatcaaaatcttgctgaattagatggccagatccaagtttcttttgagttttttcctcctcgcacacaagagatggaaaatacactctggcaatcactggctcgtctaaataccttaaaacctagctttgtttcggtcacttatggtgcaaattcaggtgaacgagatagaacacatgccattattaaagatataaaagagcgtacaggccttgaggcagcaccacatttaacctgcattgatgcctgtcgtgaagaattacagcacattgcccaagactattggcaaagtggcattcgtcatattgtggcgctacggggagatttacctgataacagccagaagccagatatgtatgccgttgatctggttcgtttactgaaagatgtaggagattttgatatttcggttgctgcttatccagaagtgcatcccgaagctaaaagcgcacaggctgatcttattaatttaaaaaagaaagttgatgcgggcgctaatcgagccattacacaatttttctttgatgtagaaagttacttacgctttcgtgatcgctgtgtttcaacgggtattgatgtagaaattgttccgggtattttacctgtcaccaattttaaacagttaaaacgttttgccggattaaccaatgtgaagatccccggttggatgcataaaatgtttgatggcttagataacgatccagaaactcgcgcactggttggggcttctatcgctattgatatggtgaaaattttaagccgtgagggcgtgaaagatttccatttttacactcttaaccgctctgaattgacctacgccatttgccatacattaggtgttcgcccacaacttgcgaaggtttag

SEQ ID NO: 2692 - DNA, 1629 bp, Proteus mirabilis
ggaattatcttaaaaacccgtcattttccttggttatcaaatcaaaaaaaggttaaatttcgcttccaccgttcgcatttgtcgctgataatgcgccgcgttcatgtccaactaactggcttaacgtctatgctacatttgtttactgacctggaatttcatacaggtttaatgttggttttagcactgattttcgtgctattttatgaagccattaatggctttcatgataccgcaaatgcggtagcaactgttatttatactcgtgctatgcgtgcgcaatttgcggtcgtgatggcgggtgtatttaacttccttggagttttgctcggtggattgagcgtggcttacgctattgttcacttattaccgacagatcttctgctaaatgtgagctcggctcatggccttgccatggttttttcgttgctgttagctgccattatctggaacttaggtacatggtatttcggtattccagcatccagttcacatacgctgataggtgctatcattggtattggtttaacaaatgctatcgtgacagactcgtcaatcgttgatgcattaaacatacctaaaatgatcagtatcttcctttctcttatcctttccccaattattggcttggtgattgctggcgcgatgattttcttgttacgtcgctattggagtggcacgaaaaaacgtcgtcgtatccacctaacccctgccgaacgtgagaaaaaagatggtaaacgcaaaccaccattttggactcgtaccgcgctgattttatctgcggtaggggtgagtttctcacatggtgcgaatgatggtcagaaaggtattggtcttatcatgttagttttaattggtgtcgccccagcagggtttgtcgtcaatatgaatgctagcggatacgatatcactaaaactcatgatgccgttgtacacttacaacagtattatgagaagcatcaaccagctctacaacatgcgattgaaaataccccggtagtatcagcacaagctgatcctaacgacacggattttcattgtaatagcgcaagaacgccaattgttctcaatcaaacagaacaaatgttgtctggtattagctcttatgatgagctgagtgcagaccagcgtgctcaaatgcgtcgcttactgatgtgtattgctgatacagctacggaagttgctaaactaccagaaactagcgcccaagatgcacggttcttaaaaacattgagtcgtgacctgctaaatacagtggaatatgcaccaatttggatcattatctctgtggctttagcgctctctatcgggacaatggtaggttggaaacgcgttgcggtaactatcggtgagaagattggtaaaaaaggtatgacttatgcacaaggtgtttctgctcaggtaactgctgcagtttctatcggtgtagcaagttatacaggtatgccagtatcaacaacacaagtgttatcatctgcggttgcaggtacgatgattgttgatggtggtggggtgcagaccaaaaccgtgaaaaatattgcgttggcctggatcttaacattaccagtgagtattgctttatccggtgtgctttattggatttcactttcactgctggtgaatagctga

SEQ ID NO: 2693 - DNA, 507 bp, Proteus mirabilis
ggagttttcatgcgctataaaagtctacttgttgctttacctttcgtgttcggtgtagcaagtgcaaatgcagcggagaatgttgtgcatcataaattagacggtatgcctatttcagaagcagttgaaattaatgcaggtaataatctggttttcttaagtggtaaagtgcctactaagaaatccgcagatgcaccagaaggtgaattagcttcttacggtaataccgaagaacaaactattaatgttttagaacaaatcaaaactaacctgaataaccttggtcttgatatgaaagacgtggttaagatgcaagtattcttagttggtggtgaagagaataacggcactatggattttaaaggctttatgaacggttattctaagttctatgacgcttcaaaaaccaatcaattaccagcacgttcagcattccaagtggctaagttggctaatccagcatggcgtgtagaaattgaagtgattgcagttcgtcctgctaaataa

SEQ ID NO: 2694 - DNA, 531 bp, Proteus mirabilis
aaggatctcattatgccaactccttgctatatttccattgaaggaaaaactcagggcaacatcactgcaggcgcgtttactgcagattctgtcggcaacatttatgtacaaggtcatgaagaccaaatgttggtacaagcattttctcacgtggtgacggttccgaccgatccgcaatcaggacaaccttccggccaacgtgcgcataaaccatttcgttttaccgtggcattaaataaagcggttcccctgctgtataacgcattggcttccggcgaaatgttgccaaaagtcgagctaaaatggtatcgcacgtctgttgaaggtaaacaagagcacttctttaccacgacgctaactgacgcgactatcgtgaacatcgattgccaaatgcctcattgccaagatccggctaaagccgacttcacgcaacttatcgaagtctccctctcttaccgcaaagttgactgggagcatactgttgccgggacttcaggtgcagatgactggcgtgcaccactcgaagcataa

SEQ ID NO: 2695 - DNA, 930 bp, Proteus mirabilis
aaaataatcataaataccctttatattcccatttctttatttcttgaaaactgtaaatttataaaaaaaacacttatacacatatatttaacattatttttatgcaacactatttgtcatacaaatgagtttataaatgagtctcggcttatttacttactctacatagataaaagcaatgggagcataagtatggatgttaatttttatgtaacatgcattggtgacgctttaaagtctcagatggcaagagatagcgtattgctgttagaaaaactaggctgtcgagttcattttctcgaaaaacagggctgttgtggtcaacctgctattaatagtggatatattaaagatgccattccagcgatgaaaaacttgattaaaacctttgaagttaatgactatcctattatttctcctgctggatcatgttcttttgctattaaaagttatgctaaatatctggtaaatgaacctgactgggctattcgtgcagaaaaaatagctaatcgcatgtttgatctcacctcctttatcgttaatcaattaaatattgttgatgtaggtgcaagtcttaaaggaaaagctgtttatcacccgtcttgtagcttatttcgtaaaatgggagtgaaagaagagccactcacattattacgtcatgtaaaagggctagaattattaccttttgacaatatggaaacctgttgtggttttggggggacgttttcggtaaaaatggctgaaatttcaggtgaaatggtcaaagaaaaagttcaccacattatggatgttcatcctgactatttaattggtgcggatgtcagttgcttattaaatataggtggtcgtttagagagagaaggtcgtccagttaaagtgatgcatattgcgcaagtattgatgagcaatgaggaggaattatgtcattaa

SEQ ID NO: 2696 - DNA, 903 bp, Proteus mirabilis
gaagtgatcatgaacaaactctctggactgattgccgcgcctcatactccttttgctgcggacggtagtgttaattaccctgttattgatgatattgctaagcacctaattacgactggggtaacaggggcttatgtcttaggtactactggtgaaggtatacattgctcggttgaagagcgtaaaaaagttgctgaacgttgggttacagcgagtcagggacaacttgatcttattattcatactggtgcattaagtattgctgatacgttagaacttgctcgtcatgctgaaacattagatattaaagccacatcagtgattggcccttgcttctttaaacctagtcatgttgatgatttagtagaatattgtcgtttagcagcggcaagtgcaccctcaaaaggtttctactattatcattccaccatgtcaggattaagcattgatatggaaaagtttttacaagcagcaggtaaagtgatccccaatttatctggcatgaaatttaactcccctgatatgtatgaatttcagcgttgcttacgggtagagggaggtaaatatgatattccatttggcgttgatgaatttattccggcaggattagcttgcggtgcgttaagcgctgtaggtagcacctataactacgctgcaccgttatatcttgagttgattgagagatttaatcagggtgatcaccaaggtgtggcagattgcatggataaagttatcgctattattcgagttttagtcgaatacggtggcgttgctgcaggcaaagtagcaatgcaattgcatggtattgatgttggcgctcctcgtcgtcctttacgcccactgacagctgaacaaaaagcagatgcattggcgaaatttaaggcggcaaatttcttatcataa

SEQ ID NO: 2697 - DNA, 234 bp, Proteus mirabilis
aacaccgtcttctgttcttacttgataagccagactaactaccaagtcgtttgctactttcatgacatctcctacatacccgtgggcaaaattttcccgattgtaacgaaaaataaatcgtctgtatcgggttatatcaaaaaaacctacaattattgtggtgtaaagatcccgatgacctgttcattttcacgcacaagtgcactaacctcaccgtctgtttgcctttgctga

SEQ ID NO: 2698 - DNA, 999 bp, Proteus mirabilis
gacatggccatatctgcctcatttaattttcaaggattgtctcccgatagtatttgggatgcgctaattaatattgggttttatcctgattcagggctgacggaattaaacagctacgaaaatcgtgtttttcagtttatggatgagcacaaacaacgttatgtggtgaaattttatcgtcctcaacgttggagttattcacaaataaaagaagaacatgaatttgttttagcgctaaaagaggcacaggtttctgtcgcagcgcctatcgaggtaaaaggcgaaacagttcatctttctaatgaagggttttattttgcattattcccaagtattgggggaagagcatatgaaactgataatctatttcagcttgaagaggtggggcggacattaggacgtatccaccaaataggtagaaaaaagagctatcaatatcggccgacactgtctgttgcggactatttggtcgcgccaaaattagaatttgaacaaagtgatttagttccaacgcaattaaaatctcaatttattgatgctattgataaaattattcatgaagtgagtcctaaattatcagactcaacatggaaaaaattacgactacatggggattgtcatcccggcaatatattgtggcgtgatgaagtcgttatggttgattttgatgattctcgtatgggaagtgcaattcaagatttttggatgttattaagtggctcaaagcaagatcagcttatacagctagatacattgcttgagtcttataatgaatatcaagattttgatgtgagagaactatcattaattgaacctctacgtgcgatgagaatggtgcattatatcgcatgggtattaaagcgctggaaggatcctgcttttccaagaacctttgtttggtttcaagagcaagacttttggtttaaacaactcgctttatttaaagggcaagtggagcaattaaatgagccacctttacaacttagcccaatgtattaa

SEQ ID NO: 2699 - DNA, 1404 bp, Proteus mirabilis
gaaattcacatcatggttacttcagaaaatcgtaatttgtcacaaagtagtcagatttcgccccaaaaaacaagtgagcttctattcgctttagaagaaaaacccccattaccacaaacactatttgcggcttgtcagcatctattagccatgtttgtcgccgtaataacccctgctatcttaatttgccaagcattaggattacctgcacatgacactcaacgcattatcagcatgtcattattcgcctcaggtattgcatcactgatccaaattcgagcttggggtccggtaggttcaggtttattatcaattcaaggcaccagttttaattttgtggctcctctgattatgggggggttggcattaaaaaatggtggcgcggatattccaacaatgatggcggctctatttggcactttaatggttgcttcacttaccgaagtgctattatcgcgttttttacatttagctcgccggattatcacaccattggtatcaggaattgtggtgatgattatcggcctttctttaattcaagttgggcttacttctattggtggtggttacgccgctattgaaagtaacacctttggctcacctaaaaaccttttattagcgggttcggtattagtggttattattttacttaaccgccaaagaaacccttatttacgtgtcgcttctttagtgattgctatggctgtcggttatattttggcatggtggctagatatgctacctacaccgcctgaacaacaagaaacaccgattatcaccgtaccagaacctttctattatggcctctcatttgattggcatttacttatcccactaatgctggtgtttatgatcacctcattagaaaccattggtgatattactgccacctcagatgtttcagaacaacccgtcagtgggccactttatatgaaacgcattaaagggggcgtattagcaaatggattgaactctatggtttctgcgttttttaatacctttccaaactcctgttttgggcaaaataacggcgttattcaattaacaggtgtggcaagtcgctatgtgggctatgtcgtagcagccatgttgattattttagggttatttccctcggtggcagaatttgtacaacaaattcctgaacctgtactgggaggggcaacgcttgttatgtttggtactatcgctgcatctggggtgcgtatcgtctctaaagaggcgctaaatcgtcgtgctattatgatcctcgccatctctttggccgtaggacttggggtatcacagcaacctcaaatattacagtttgcaccagattggctaaaaacattactgtcatccggtattgctgcaggcggtctaaccgctattattttaaacgtgatttttccacccgaaaaataa

SEQ ID NO: 2700 - DNA, 690 bp, Proteus mirabilis
cgattaaacatggagagttatatgatggggagaaaacttaattgtatcggtattattttaataatactttctctattgctctcgcaagtagagagtaaaatagacattaaaaatagcgataaacgttttttattatttatatcactgaatacatttactgccagtgataaattgacctcattaatttcagagttagaatacagtataaaacaaggtgatcatccatttgataaagtcatttatggttatgtcagtgtatttttatccgcttattatcataaaaataaagcttattctcaggctgcacagacaataaaaaaggcctttttttatcttgatgaagttgttgaacaaaatccaactaattggcggttgatctatctaagattaagaatggatgcttttacacctcgttatttagggcgctgtgtggtggctaaaaaagacagtcagcaattacttgagaatattaatatcaatagtgaacttatacccatgattaactatatgtatgcgcgtgcattatttagttgtgagcaagtgacacaagcaaaaaagatcatggctcaattacttcaagaaaatgaggcgagtaaaaaaattgctcgatatagtttcactagcgttcctccttggttatctattgaaaagaccgcggttattcaaccaataacattagagagtgattaa

SEQ ID NO: 2701 - DNA, 1425 bp, Proteus mirabilis
aagatgaacatttcaaggagaaagctacttttaggtgttggtgctgcgggcgttttagcaggtggtgcggctttagttccaatggttcgccgtgacggcaaatttgtggaagctaaatcaagagcatcatttgttgaaggtacgcaaggggctcttcctaaagaagcagatgtagtgattattggtgccggtattcaggggatcatgaccgctattaaccttgctgaacgtggtatgagtgtcactatcttagaaaagggtcagattgccggtgagcaatcaggccgtgcatacagccaaattattagttaccaaacatcgccagaaatcttcccattacaccattatgggaaaatattatggcgtggcatgaatgagaaaattggtgcagataccagttatcgtactcaaggtcgtgtagaagcgctggcggatgaaaaagcattagataaagctcaagcgtggatcaaaacagctaaagaagcggcaggttttgatacaccattaaatactcgcatcattaaaggtgaagagctatcaaatcgcttagtaggtgctcaaacgccatggactgttgctgcatttgaagaagattcaggctctgttgatcctgaaacaggcacacctgcactcgctcgttatgccaaacaaatcggtgtgaaaatttataccaactgtgcagtaagaggtattgaaactgcgggtggtaaaatctctgatgtggtgagtgagaaaggggcgattaaaacgtctcaagttgtactcgctgggggtatctggtcgcgtttatttatgggcaatatgggtattgatatcccaacgctcaatgtatatctatcacaacaacgtgtctcaggggttcctggtgcaccacgtggtaatgtgcatttacctaatggtattcatttccgcgaacaagcggatggtacttatgccgttgcaccacgtatctttacgagttcaatagtcaaagatagcttcctgctagggcctaaatttatgcacttattaggtggcggagagttaccgttggaattctctattggtgaagatctatttaattcatttaaaatgccgacctcttggaatttagatgaaaaaacaccattcgaacaattccgagttgccacggcaacacaaaatacgcaacacttagatgctgttttccaaagaatgaaaacagaattcccagtatttgaaaaatcagaagttgttgaacgttggggtgccgttgtgagtccaacatttgatgaattacctatcatttctgaggtcaaagaatacccaggcttagtgattaacacggcaacagtgtggggtatgacagaaggcccggcagcgggtgaagtgaccgctgatattgtcatgggcaagaaacctgttattgatccaacgccgtttagtttggatcgttttaagaagtaa

SEQ ID NO: 2702 - DNA, 1002 bp, Proteus mirabilis
ttcattttaataaacggaactatgtctcaatattttgatccaataccttgggctaagaatccccatttacagacacttttgcctcgaatagtgcgaagaacgccactattaacgccttattggcaacggcttaatttgcctgataatgattttgtcgacttagcatggagtgaagaacccaaaacagcgcaacataagccccgtttggttatctttcatggtttggaaggtaactttaatagcccttatgttcatggcatgctagccgcggcgaaagcgcgaggatggctaggtgttgtcatgcattttcgaggctgtagtggcgaacccaatcggcaaaaacgcatttatcattctggtgaaacagaagatgcccgctattttctgaattggttaaaagagcaatttggcgaacaaccaaccgcagcggtaggttactctttaggaggcaatatgctggcctattatcttgccgaaagtggtgaaaatgcggtattagatgccgctgttattgtgtcagcacctttgatgttagaaccttgctcaaccaaaatagagcgaggattttcgcgcttctatcaatggtatttactgaaagggttgaaacgcaatgcaactcgcaaattgatccgctatccccaatcgttacctattagtctattaaccattaaatccattaaaaagttacgtcaatttgatgatctgatcacggcaaaaattcacggtttcaaagacgcccttgattattatcgtcaatgtagcgctctccctttactcaatcagatcaaaaaaaatacacttatcattcacgccaaagacgatccctttatgtctacagaagtgatacctgatatcacaacattacctaaaaatattgaataccaattaacagaatttggtgggcatgtaggttttgttagtggaaaactctctaagcctgtaatgtggcttgaaaaacgtatccccgactggctatcgacctatttggagaaagtaaaatga

SEQ ID NO: 2703 - DNA, 948 bp, Proteus mirabilis
gaatatctaatgagtatttttttcaatcccgctaaacacccacatcgcttaaagccacaaccattgggggagcaaggtgagcgctataacgaagattggcccatgcctgagctcgattttttagagaccgtcgataaacaacagtgcattctagttgataaagaaatacgccgacgtgatgcgttttcttatcccggatttatcaccggaattattgcctttattatggtattccattttatttttacagaacataattcaaaatatatccgttttaataaaaatcttcatgactatacattagaatataaagctcaatatgaagataaagcccaaagagataaactaccttcatttatacttgataagtacgccccttatttcaatcaagaaaaactgtctattttagattatattcatgtttattttgaaggacatattacatcaaagccctatcaagatacgttattttttcttgctgcgtcctttgtacctttcttcttaattggcgtagggggttaccagtcttttttcaaaaaaaatccaatactcgtttttaatcgtgaaagaaatctggtctatacttggcgcaaaaataaggtatttattgcccgctatcctgaaattggtatcggtaaaattggtaaaacacttacctttcaattattcgggttagataagtcaaaacaaactttagtttctgaattgtttttccctaatgtctatgtttattcagtctacaataccagtactgactatcacgaccagcgcttcattaattttatcaatacttatatgcgcgaagggcgtgatgccattattccattcgattatcaccgtaaaaaacccaaagtgtattttggcaaaaacccacctcctgctgattttgaacaacaggtcgaacaaattttagcaaagcttgatcaggagaaagaacaccatgcgtag

SEQ ID NO: 2704 - DNA, 750 bp, Proteus mirabilis
aataatataattcggagttacatttcaaaaaaagagagcagtgagttcaacatggcactaattgaaaagatgactaaagatattcaacaaaaaggtgggttaattgtttcttgccaacctgttgataatagtccaatggataaacctgacattgtagccgcaatggctcaagcagcagtaaatgcaggtgccgtcgcagtacgtattgaaggaattgataatttaaaagcaacacgtcctcttattgatgtgccaattattggaattgtaaaacgtgatttgcctgatagccctgtcaggatcacgccttggttaaatgatattgaagcattggtcgcagctggtgctgatattatcgcttttgatggtactgatcgcctacgcccagttcccgtgaaagcattgctagagcatgttcatcgtttaggaaaactagcgatggcagattgtgccacttttaatgaagggatgtattgtcatcaactcggtactgaatttattggctcaacgatgtcaggttataccggtggggaaataccaaaattacccgatcttcaactggtgaccgcattagcagagcaaggatgtcgagtgattgcggaagggcgttataacacaccaatgatggcggcaaggggtatgcaagcgggagcttgggctgtcaccgttggctctgcattaactcgtcttgaacatgtctgtgagtggtttactcaggcattaaagtggcagcaggagttagatagatga

SEQ ID NO: 2705 - DNA, 1620 bp, Proteus mirabilis
cggagaataatgatgagaagctccaaaaaacagacagggttgctaaccgctacaatcggcttactcgctttggctatttcagcaggtgtgcaagcgaaaacattagtgtactgttcagaaggctcaccggaaggatttaacccccaactatttacctcaggtacgacttatgacgcaagctcagtaccgctttatgatcgcttagttgagtttaaactcggcaccactgaaattactcccggcttagctgaaagttgggaagtgagcgatgatggtaaggtgtatactttccatttacgtaaaggggttagttggcatagcaacaaagaatttaagcccactcgtgaatttaacgcagatgatgtgatatatacatttatgcgtcaaatggatccaaatcatccttatcataaagtctctggtggaagttatgaatatttcactgggatggatatgaataacatgatcgagaagatcgaaaaagtggatgacaatacggttcgttttgtacttacccgttcagaagcgcctttcttggctgatatggcaatggacttcgcatctattctttctgccgagtatgcagataatatgatgaaagcagggactcctgagaaagtggatctcaatcctattggtacgggacctttccaactgcaacaatatcaaaaagactcacgtattctttataaagcgaatgataaatattgggggaaaaaacctgatatagatcgtttagttttctctattacgccagatgcctcagttcgttatgccaaattacaaaagaacgaatgtcaggcaatgccttacccaaatcctgctgatatcgccaagatgaaacaaaataaagatatccagctactggaacaacccggattaaacgtggggtatatctcttttaatgtggagaaaaaaccgctcgataaccaaaaagtacgccaagcattaagtatggcggtgaataaagacgccattattgaagctgtctatcaaggcgcaggccagaaagcgaagaatcttattccaccgacaatgtggggttataacgatgacatcgtcgattatgaatataacccggaaaaagccaaagcactgttaaaagaagccggccttgcagatggctttactatcgatttatgggcgatgccagtgcaacgaccatataaccctaatgcccgccgtatggctgaaatggtacaagctgactgggaaaaaattggtgtgaaaaccaagatcgttagttatgagtggggtgaatatctgaaacgtgctaaatcaggtgaacaccaagcagtaatgatgggctggacgggagataacggtgatcctgataacttttttgccacactgtttagttgcgctgcgaaagagcaaggctctaactactcgaaatggtgttataagccgtttgaagatctgatccagcctgcgcggatcacggcagatcacgataagcgtgttgagttatataagcaagctcaagtggtgatgcatgaccaagcgccagcactgattattgctcactccacggtatatgaaccaatcagtaaaaaagtagagaactatgtggtcgacccattaggtaaacaccactttaataatgtctctctaaaatag

SEQ ID NO: 2706 - DNA, 510 bp, Proteus mirabilis
atgatgataatcactgccttgatgatatcttttttaagaaatttgatcattaccccatattttgtaggatcttccatgaatgatgaacataagatattcgaaaaaataaaagcttcactcaatagagcatcttttattattgatctacgaagtaagatagaagataaaatcagtgcagtggtcaaaaagctagaagtgatcaccaataataaagttaaggtatcatttgaagataataataaaagtaatattcattttataaatagtgaacgccttgtttatattaataatgctgatttaagtaaagagggtggttttatactatttggttatagctttagtaaaataaatggctttcctattgagatagaaacggaaatagaatcttttcacgcagaagatattgaaaatttattacatattattgttaatattattgataatgagtctatcaggatcatcgaacttactcatcatactatttataataaattgattaatcaccaataa

SEQ ID NO: 2707 - DNA, 2880 bp, Proteus mirabilis
tctcaggtaatattcgtctattgcgttgcaatgtggcattctagtcatatcaatgaacctcagaacaatgatgaacagattatggtccagatagcagaaaacccctttatccttgtagatggctcttcatacctttatcgtgcctatcatgcttttcctccgctaactaatagcaaaggagaacccacaggggcgatgtatggtgtgttaaacatgctacgcagcctaataattcagtataagcctagtcatgtggcggttgtgtttgatgctaaaggcaaaacattccgtgatgagttgtatgaggaatataaatctaatcgcccaccaatgccagatgatctgcgtgagcagattgagcctttgcatgaaatggttcaagcgatgggcttaccgttactttctattactggcgttgaagctgatgatgtgattggcacattggcattaaaagcagccagtgatggtcgtaatgtgttaatcagtaccggtgataaagatatggcacagctagttacgcccaatatcacacttatcaacacgatgacgaatgttattttaggccccgatgaagttaaagaaaaatatggagtgccaccggagttgattatcgactttctcgcactgatgggtgactcatcagataatattcccggtgttccaggcgtaggtgaaaaaacagcattagggctattgcaaggacttggtagcttagaggatatttatcaacagcttgataaaatagccacattgagtttccgaggtgcgaaaacacttggcgctaaaatggttgaacatgagaaagttgccaaactttcttatcaattagcgacaattaaaacagatgtagcgcttgataaaacctttgatgacttagtggttaatgaacctaatttagataagttgcttgaaatgtttacgcgttatgaatttaaacgctggataagtgacttacaaaatggtggttggttagctcaacgcagtagccgtaaagcgccagtcccctatagtgcagaagtcgcaacacccaaagagcagccagctgcagacaatttcccgcttatctctcaagagaactatgagtctatattgactcatgaaagcttaatgcgctgggttgaggtactgaaaaaagcgcccgcctttgcttttgatactgaaacagatagcttgaataatattgatgcacgtttaatcggtctgtcatttgcggtagagcctggcaaggccgcttatattccattgcgtcatgattatctagatgcaccagagcaattacctgttgatgaggtactaactgctttaaaaccgattttagaagataaaaccatcttaaaaattgggcaaaacctgaaattcgaccgcggcattatggaaaatgaaggcatcgaattaaacggtatttattttgataccatgttggagtcttatgtcttaaatagtgtgagtagccgccatgatatggataccttagcggaaaagcatttaaatcataaaacgacgacatttgaagagattgctggtaaaggtaaggggcaacttacctttaatcagattgaggttgaacaagcgaccttatatgcagcggaagatgctgatattaccttgttactgcatcaagcgctttatcctcaaatagaggcgattgcaccgctaaaacacgtttatcacgatattgagatgccattagtccctgtgctttcacgcatggagcgtaagggcgtattgattgacgcacaagtgcttgccatgcaatcccaagaaatcactcaacgtttagctgagattgaaaaagagacattcgcgttagcagggcaagaatttaatctctcttcacctaagcaattacaagagattttatttgaaaaactcaatcttcctattatcaagaaaacgccaaaaggtgctccttcaacaaatgaagaagtgttagaagcgttagcgcatagtcatgagttacctcgtttaattttagaacatcgtggattggcaaaattaaaatcgacttatacggataaattgccgttgatggtcaatagtaaaactaagcgggtgcatacttcatatcatcaggcggtgactgcgacaggacgtttatcttctcgtgatcctaatctgcaaaatattccagtaagaaatgaagaggggcgtcgtattcgccaagcgtttattgcccgtgatggttttaaaatagttgctgccgactattctcaaatcgaattacgtattatggcgcatttatcgcaagataaaggtttgcttgatgcttttgctcaagggaaagatattcaccgagctactgcatctgaagtgtttggtatacctttagacgaagtcacctcagaacaacgtcgtagtgcgaaagcgatcaactttggtcttatttatgggatgagtgcttttggtttatcacagcagattggtgttgaacgaaaagaagcacagcgatatatggatctctattttgaacgttatccaggggtattagattatatggagcgtacccgtaaacaagcgtcacagcaaggctatgtggaaacgttagatggacgccgtttatatctgccagagattaactctaaaaatgcgatccgacgtaaagcatcagagcgtgaagcgattaacgcacctatgcagggaacggcagccgatatcattaaaaaagcaatgattgcggtggataattggatctgtcatgaatgccctgatgatgtacatatgattatgcaggtacacgatgaattagtgtttgaggtacgagagtcatatttagaaaaagcaaatgcgatgatccataagctcatggaaagtagcatggagcttgctattccactgaaagtcgaagtcggagtcggtaataactgggatgaagcccattaa

SEQ ID NO: 2708 - DNA, 2532 bp, Proteus mirabilis
tataaggtaattataatgaataggaaaaaaattgtttcttttaaaattaatttattagttttctctgtattatcaacgttaaatatggcgactgtagtacaggcggatccgtctgctcatattgttgtgcaacaacagcaaaaaaatagtagtgttgatattcttaatattgccgcagcgattaatggctattccagtaattcattaaccagttttgatgtttctgaagcagggttaatattaaataatagtcctgatggtgctgatactcaattatcggggcatattgacggtaatagtaatttatctagcggtgcggcaaaagagattactcttgaggttaacgctaaaaaagccattacgttaaatggtcctgttgaggtggccggaacaaaagcacgggttattttatctaatcctgctggaattatttgtagtagctgtaactttcttagtgctgaccgtgttgtgttgactactgggaaagtgaatacacaaaatgataccgttgatagttataaagtggaaaaagggaatattactgttaaaggtaatgccacttttgataaaagtgcgcaacagattgatttaattgcccgcaatgtttccattgaaacgcctcttgatgcatctggtattaatgtgaatgtgataactggcgctaatgaagttaaagcacaagataatactgtggttgcacaaaagccaacaggcgttgctagtaaatatagtttgcagatagtcaagaatgcaggagtgagaagctcatcgttaaaatttataggtactgaagctaactcaccactgaaaaataatggtaatgttgaaactgctgggggagggatcgagcttattcatagcggtgcacttgataataataaaggtaacttcttatctgagggggatatctattttgctttcgataaaggtgttacaaatagtactggtgaaatacaaagtactaaaactatctcaatagaaaccaaagaagcgaaagttgataatatctctggtggtaatatttctgctgatggaaatgtaactatcaatagtggtgaatttaaaaacaatgcctcctatattgcaagtaaagataaattagatattcagacaaacggtaaaccaataacgaatactgcaacggtcggtgaaggcgtcggtatttctgctactaatggtattaagattaatagtggcttatttaataataaagagggtgaaatcaattctaaaagtgtcattgatattaatactaacctaaaagatttcaataatattgatgcttatattgatgcatcaggggatattagtattaatagtggcgcaatgaataatacccatagccgcctacgctcagttactcgtgttgaaattgatactaatggtaaggcgctgaaaaataccggcatgactgcagatactgctagcgatgattcattaggtattcttagtggtctggatggtatgacagttaatattgctggactgaataatgaccaagggattattgccaccgatggcgatatgaacttcactaacaaaggcgacattaccaataaatggggacatataaaatcagggggatacttgacatttagtagtgataagatcaaaaacctctatggtggcttagcatctaaaactggtgctaatgtgactttctcccagacattagataataactttggtgttttttacttagaaggcgatagcgttaccatcagtgcgccttatataaataataataaaggtgttattaaaggagacgctatttattttaaaacagataaatttaataacacatcaggatttgtgatcactgaacagaaattagagattgatacaccagaactgacgaataacagcagtttagatttcaaaacagaaatgggcttttatctggggcaacctgatcagaaagggggattaattagtaaaggagaaatgaaattaagcggtaataaattagtgagtaataaaggacgtattgtaacagaaaatggggatatggagcttaaattcacctctgttgataataccagtggtactattgcatcacataaaaatgcctttgtagtgacaagcacctttaccaattcacaaggcacattgtttggccaggataaattaacactacaaaccgatacactgaaaaataacagtacaggttcggttgaaagtaataccttaaaaggtgttattgcgtcgagtggtgatactgaagtgacggttaatcgtgattttgaaaacaatggcgtcatttctggtgtagaacatttacgtgtaaatataaatggtaaatataccaatgccagcaatagtattatgtcaggtaaaaatagtttcgaattaggtgtgacaggaaatattattaatcgcggtattcttaattcaataaaagacacgactatttctggtgagaatattactaatgaaaaatcaggtattattgttggtagagaaagtattactatcgataataaaggcacttttactaataaaggtaaagttgtcgggccgttaaataaataa

SEQ ID NO: 2709 - DNA, 195 bp, Proteus mirabilis
gcaaactcaatagcacccaagttgcttaatggaatgtatttaacttttgatattgttaatactaatgacttttatagtgtaagctcagtcaaacaactgggctttttattttttatccccccacaattcctattgttccccttccctagctttaaatatagcaaagcgggaaaaccttatggctatcccgcttaa

SEQ ID NO: 2710 - DNA, 756 bp, Proteus mirabilis
agtctgccaatacaatttattcattgttatgctctcttctcttattttacagggatgttcactatgctgataacaatagcaggatattgctggttatgtcgtcaaccattgcggtatggtaaccacagcatttgttcaagttgtattcgtcatctgccacaacaaaataatcgttgtccgggatgtttgtatccctctacccactcaatgatattgtgtggacggtgtttgcgatcaccaccacgctggaaacagatgttgacagtcactgactatcgcccaccgcttaataaattattacacctttataaatatcatcctcgccctcagatagcattatgtcttgcgaaactttttttattacggtggcttgctcatcgtcgcgagaatttagttcgcaagccagagcaaattattagcgtaccgctacatcgacatcgtcgttggcgtagaggcttcgaccaagttgaggctatcgctaaacctttggcaagatggttaaattgtccttatcaccctaataccttgataagaactcgtgctacactggcacaaacacatcttaatgccaaacaaaggcaacaaaatttagataatgcctttatcgtaaatcgcacagtgtcagtggcaggcaaggatctggcactgattgatgatgttatcaccacaagcgcgacgctcaatgctattgtacctttgctatttcgtgctggagcacgctctgttgaggtatgggctatttgccgaaccttgtag

SEQ ID NO: 2711 - DNA, 624 bp, Proteus mirabilis
aatataacaatggaattaaatttatgctggtggaatataggaatatctccaccgacaaaatcaaaacagaacgtcaagactgaaaaagttggcttagcgaaaaaatatcttgaagaacttatcattaaaaaaacacttgatatcattgcgttgagtgaggtttctgaaaacgagagctacgcttttaagcagttggcgactcaattaaaaatgggttatatcgatctctcaggaaaaataggacggattattattgatatatcattaatatatcaaatgaataaactagagtttatttcaagtaagtttttaaccaaactccagcctgataatagaatggtaagggtaggcgttgctgttgtatttaaagaaatcgaacatcaaaaaataatcaccctttttttatcacattggccatcaatattaagtgctaatgatacaactcgagaagtggctgctgcaggattaagaagtagtattaataaactctttgaaaataatggagatgatgttcagtttatttgtatgggggattataatacagagccttattctaatgcgatgcttaatatattgtatgcgacaagagattatcatttaataaaaaagaaaactattatttaa

SEQ ID NO: 2712 - DNA, 1764 bp, Proteus mirabilis
atttgtgcaataagacacagcgtttttttatctttttggcaaactagatgtatcgttttagctagtaagttacttggctatttcacttggcataggatctgttttatgagtgatattgcattaacaatggtgatgttgtcattagcaggcgccttaggactttggataggtaacgttaaaatctatcgggtcagtttaggaattggcggagtgctgtttggagggattattgtcggccatttagctcaacgttatggactggtgctcaacacacagatactccattttattcaagaattcggccttatcctctttgtatataccattggtatccaagtcggccccggttttttctcttctttacgtgtatctgggcttaagctcaatgcctttgccattttgattattttacttggttcactagtaacagcctttatttatcacttatttaatgtgccactccccattattcttggcattttttctggtgcggtaacgaacacgccttcattaggtgcagggcaacaaatcctcaccgaccttaatattgatccagccataatcagtcaaatgggaatgggatatgctatggcttaccccatgggaatttgtggcattcttttggtcatgtggtttattcgcgtgctatttaaaatcaatatagagcgagaagcaaaacactttaaccatcagcaaaacagcactaaagagacactgcataccattaacattgccattcgcaatcccaatttagatggcttattaatgcaagatatcccactactcaatgaagatgcccttgtctgttcacgtttgaaacgtggcgacgatattatggttccgatgccttccactattattcagttaggcgatttactgcatattgtcggctcaagagaagatctcaataaggttcgccttattttaggcgaagaagtagatgcttcactttctacctcaacccatcaattacaatctgtgcgcattgttgtcacgaatgacgcagtattgagtaaacgattaaaagatctcgatttaaaaagaaaatatgatgttgttatcacacgattaaatcgagctggaattgaattaattcctagtaataacagtatgctacagtttggcgatattttaaatgttgtgggtagacctggggccatagaagcaattacggtacttttaggtaatgcacgacaaaaattagaacaagtacagatgttgcctgtttttattggcattggtttaggggttttattaggctctatccctatttttattccggggatccctgttgcactaaaattaggtcttgctggcgggccactgatcgtggccttgattttaggccgtattggtactttcgggaaactctattggtttatgcccccaagtgctaatcttgcactacgtgaactcgggatcgtcatgtttttagctgtggttggccttaattccggtggtgggtttattgataccttaatatatggacaagggttaagttggattggctatggtatcgctatcacactactcccattattgatagtcggtataatggctcgtctcgtttttaagttaaattaccttaccctttgtggcgtacttgcgggctcgatgactgatcctcccgctctagcattcgctaattctattcatcaaaatagcggtgctgccgcactttcttatgccacggtttatcctttagctatgtttttacgcatcatcacgccacaactaatggcactgattatttgggctttgtag

SEQ ID NO: 2713 - DNA, 1071 bp, Proteus mirabilis
aatggtgcaatgggagtattcaatatggaaacggcggatttacctgataacacacttattttggattcattaatccactcagtattggttatcaaccaagagtttattatttgctatgcaaaccatgctgcattgcaattactggctcaaagtcgtcgcaaattatttgaaaccccttttagcgcactgtttagttattcctcttttgatgaacagttaatgcgtgaaacattagcaaatgggcaaagcttcactgataacgaagtgattttggttattaataaccaatcacacactatgtcgctcagtgcccagcctatttccgagcaacacattttgttggagctggcgcctatggatagtcaacgccggttaagccaagagcagatacaacaagcacaacaaatggcggctagggaattggttaggggactggcacatgaaattaaaaatccactcggtggattacgaggggcggctcaattattagcaaaatcattacctgatcctgcgctgactgagtatacccaagtcattattgaacaagccgatcgcctaagagcgcttgtggataggttactcggtccacaacatcccggcaccaaaacctttcagagtattcatcatgttgtagagcgtgttgcacaacttatcacattagaatgccctgaaaatgtcaccttactcaaagattatgatcctagtctacctgagctttcacactatccggatcagattgagcaggtattgttaaatatcacccgtaatgcattacaggcagtggagaaaactgggggaactattattttgcgaacccgaacagcgttccaagtcacactgcagggtgaacgtcatcgactagtggctcgcattgatgtgattgatactggcgcgggtattcctcctcatctacaagacacgcttttttacccgatggtcagtggcagagaaggcggaaatggccttggtttatccattgcacgtagcttagtcgaccaacacgccggtaaaattgagtttaccagttggccgggaaataccgagttttctatttacttgccaataaaatag

SEQ ID NO: 2714 - DNA, 1665 bp, Proteus mirabilis
ggtagaaaaatgaaaaataaacactacgccatatcactattaacgttattatcccccaatgtattagccgcagcgataacagaagggggtgaaaaacagccaattaacttccaagccattatcatgtttctgatctttgttggcttaacactgtatattacttactgggcctctaaacgaacacgatcacggtctgattattacactgcgggtggcaaaattaccggatttcaaaatggtatggctatcgctggtgattttatgtctgccgcctcctttttaggaatttcagcgttagtatacacttctggctatgatggacttatctactctattggctttttaatcggctggccaatcattctatttattatcgctgaacgtttgcgtaatttaggacgctatacttttgctgatgttgtctcttaccgtttaagtccaaagcccattagaacactttctgcaataggttcattagttgttgttgccctctatcttattgctcaaatggtaggggcgggtaaattaatcgagttactttttggcttaaactaccatattgcggtgatcttagtcggtattttaatggttctttatgtcctttttggcggcatgttagccaccacttgggtacaaataatcaaagccattttattactcgccggtgcaacttttatggcggtcatggtaatgaaagcggcagactttaacttcaataccttgtttaaagaagctgttaacgtccatcaaaaaggcttttctatcatgagtccaggagggttagtttctgatcctatctctgcattatccttaggtcttgccttaatgtttggtaccgcaggacttccccacattatcatgcgcttttttaccgttagcgatgcaaaagaggctcgtaaaagtgttttctatgcgacaggttttatcggttatttctatattcttacttttattattggtttcggggctatcttactcgttagccctaatcctctgttcaaagatgccgctggtgctttaattggtggcaccaatatggccgctgttcatttagcggatgctgttggtggtaatttcttccttggttttatttctgcagtcgcttttgccactattttagccgttgttgcaggattaactttagcaggtgcatctgccgtttctcatgatttatacgccaatgtaattaaaaatggccaagcagatgagcgacaagagctaaaagtttcgaaaataacggttgttattctcggcattgtcgccattggtttaggtattttatttgagaaacagaatattgcctttatggtcggtttagctttctctatcgctgcaagttgtaatttccctattatcttactctctatgtattggaagggattaacaacacgtggggctgtaattggtggctggtctggcttaattgttgccgttaccttaatgatcttaggtcccacgatctgggtgagtattcttggtcatgatacacctatttatccttacgagtaccctgctcttttctctatgatcattgcctttatcgtttcatggttattctccattaccgataattcttctctggcaactcaagagcgtatgaaatttgaagctcagtttattcgctcacaaataggtattggtgcagagcaaggtaaacctcattaa

SEQ ID NO: 2715 - DNA, 1338 bp, Proteus mirabilis
cataatgaaatcggaggcaaaatgagccaacaatggacatctcgtgtaggccatattttagcagccgctggctctgccattggtattggtgcaatttggaagttctcttatgtcgccgccaataatgggggtggtgcattcctcgtcgtctttctgttatttagctttattatcggattagctgttttattagctgaaaatattttaggtagtagcacccatgccgaagccgttaatgccttcaaaaagatgatgggacgtaattgggtaattatcggtgtcattggtgtatttagttcatggtgtatctatagcttttatagtgttgtcggggggtggaccattggttacaccattatggcagctactggtgaattaaatattactgatagtagtgaattaacggggatcttcacccgttttatcagtgaccctttatggcctattcttgctcacttggtgtttgccggattaacatgttttgtcgtattagcgggtgttcaacgcggattagaaaaagccgtcaagatcatgatgccattgctgtttattatcatgattattttgattattgtcggtattagcttacccggctcttcagaaggtttaaaattattcttatatcctgattttagtaaattaaccccgcaaggggtattagatgcgttgggattagccttcttctcgctgtctatcggtttgggtattcatattacctatagcgcctatttagcggataataagactattgctaactctagtatgtgggttgtgatcctctcttgtttagtgtgtgttttagcaggcttaatgattttccctgcgttaactgctgctggattagagccaaatgctggcccaggcttaacctttatgaccatgccagtctattttgctaacttgcctggtggcaatatcttggcggtcactttctttgtcttattattaatggcagcattaacctctgcaatttcattactcgaacatatcgtcgcttatgtacaaatgcgttttcagtggactcgccgtagagctggcttagtggtcacagcctctattatgttaatgggtatcccggtttcattatcatttggtcctatgagtgatgtgactttagggggcaaaacactctttgatttattggattacttaacctccaatatcttaatgccactgtttggtattgcgatgtgtttaatttttggctggtcacgtagagccaatgcggttattccagataatattactggagcaaaacgccaatgcttattattagtttggcgttatattggccctatctgtatcggtataatattggtacatggtttgattggttaa

SEQ ID NO: 2716 - DNA, 720 bp, Proteus mirabilis
ggtatcgaaatgacagaaaaaaaactcaaaggtattcgtgctatcgcttttgatcttgatggcacactaactgacagcgctgttgggctaacagaagccacaaactatgcactaaaagcaaaaggcttcccaacagtggataaacaccatgtcaccatttgggttggtaatggtgttgatatgctattaaagcgcgccctacaccattgtggtgttaaagatgtcaccgatactttattaaaagaggtacgtgatctctttgatgagtgctatgcaaactctgtcaaaacaggaagcaatctatttccacacgttaaagagacactagaaaaacttgcttcgtattctctctccttaggcatagtgacgaataaacctacgccttttatccaaccactgttaaagcaattaggtatagacaacgacttctcattggtgcttggtggtgatgatgtaaaacaaaaaaaaccccatccagcaccattatatttaacaatgggcacgtttggtgttaaaaaagaagagcttctttttgtcggagattcccgtaacgatattatcgccgcacaagcagcacagtgcccttgtgtggggttaacttatggttataactacggtgaacccattgcagatagcaaacccgattttatactcgacgattttgctgatttgctctctatccttgatattacgtcaatgacaacagtggaacagaactaa

SEQ ID NO: 2717 - DNA, 402 bp, Proteus mirabilis
aggaatagaatgaaaaaatatatttttactgcaattattcttagtttaacagctagttatgcatcagcagaaacagcggttaatggttgtgacatcaaaaaacagaatattcaacgacaaatcgactatgccaaaatgcatggtaatcaatatcgagtacaaggcttagagcgagcacttaataaagtagaacgttattgcactccagaaaaggttgttgaagatacccgcctagaattacgtgaaaaacaactggaagtgaaagagcgtgaattagaattaaaagaagcgcaacttaagggagagcgcgataaaattactaaaagagaagataaacttgcgcaagcaaaagctgagttgaaagcagctgaagaagagttagagctactcacaaaaaaataa

SEQ ID NO: 2718 - DNA, 732 bp, Proteus mirabilis
caatgcagaatactttcgccaacaaatgcctatttggccaacccaaaaagagcggctatttatgtctataccgcccaaaaagacgctacctctaattgccattggtttagctttgcgtccttgggagacagcatgtatcaaataaattttcttccttggcgtcaagccttatatcgacatcaagcacaacggtggctttattggagcatgatactcgttgttattacattcagtgcttgcggttactacgcttattatttagtacaacaagtaaaaacactctcacttttacaatcacaatatcaaaaacgtgagtactcactacaaaaacaatatcacaatgaccaacatgaacagaaagtcacccgcttatatcaacagcgttattggcattattatcaacattggcttcactatttaaattacctcgctttctttcaagcactagaaacactgctccctacggaaggttatatcgcgcagttttctgaaaatgatgcaacattttcgcttcaggtgcggctcccttgtgagcaggcacttacttttatatctaaagttaaccaacaccccaacctgacatcattaacactctcctcttttcaacagagcaaacaagatccccgttacagcgaaataaggttttctggtaagtggcagagttggcaatatcaagtatctcaacataggcatagcgaacaagatgtcgataacaatgaaaataaagactaa

SEQ ID NO: 2719 - DNA, 297 bp, Proteus mirabilis
caaagcttgatcaggagaaagaacaccatgcgtagtttggtaaacggcagaaagattattttagaaaatgatacaacaaataccggcggtaccgtacttaccggctcttctattgctaaacaaacccaagggattgcctgtgtaggtgatcctgtttattgccctgcgtgtaaaaaaacaggcactattattgaaggggataatttaatgaaaattaaaggtatccctgtcgccctcgaaggacataaagtcgcttgtggctgttcagatggctgtatactcgttgcaacagattaa

SEQ ID NO: 2720 - DNA, 1500 bp, Proteus mirabilis
ttaaccctgatattctatttttcttcttttaatatacgagtaataataagtatggataataaacaacactatttagatatcgccgcagggcaaggaaaaaaagagccctctcgtatagtggcattccctgcacagccactaaactatgcattgatagaacaacgcctagaggaacagaccgaatacacagatggtgagataagctatcttagtgatgatcttgatgaaggttttttctatcattgccaacatggcgatgatgagctccatttttttatctgcctgctaccacgatcagaagattatcaaatacgtcctatgtatgcgacagatgagatgactcctgagctattagcccatgccaatgccaccactcaagacatcttattagaaacgatgttctctgacaccctacatcctttagcgagttatcgccatcagctcaatctactgaacataattgcgccagaaatgatcctcgcactggatgaatctgccgcaggtaaaggattaactcccgaatggatacgctttcaattggagacacccgatctctatcctgaagtagaaagtttgtatgttattcatgcagtttacgatacagaaaatgatccaccaaccatgttctggtttcatacccatggcttgcaacgttgtggcttaactgaagttgatttagtgatcccaagcatgttggaatcttactacggtattcctgatcttttccgttgcttcgtcaataacagtattaacaaccgccaaattgaatttggcgagccgatgctttgtggacaaacttcgtcaggattagaatatttagtcgcgctaccctttgaagaaggtatacgtcacgttaatcagtccacacctttagatagtcttagaccattagaagagatgcgttataacactcaaggggcaccacatggcgtatttctgggcgatatggctgatagagacgaatatcatcagcacccatcatcgatgttatttagaactaatgaagaaaaccctattttagaaactttctttaaaggttatgaagaacaacaagccatgatgctactacgcagtaacgaagaaacctacgaaatggcagaaaaggccaaaaggcgttggcaatattttctctccatgtttgataactaccatcagccccccgtagagaaaaaaaccggtttcttggcaaaattattaggtagtaaagagagcaatgaagaaactgagagcccatggcaatttatgattaagtttggtattccttatggtgataaggaagaaaaagagcttgagcacatgtggtttatccctcagtctcgagaaggtgaccgaatttatgctaagttacttaacgtaccattctatgtacaagaaatggaagaaggtggcatttatcccattgatattgcgttcatcactgattgggttatctcttatgaaggttatagttatacccctaatacgatttatcaactttttagccaccagcagactcactaa

SEQ ID NO: 2721 - DNA, 570 bp, Proteus mirabilis
ggaggaatgatgtcaaacgcatcaaatgttttactggtgtatgtccatcccgagccgcgtcaatctatcgccaataaagcgttgttgcgtgcggtgagggatctggaaaatataacaattcatgatttatatgccacttaccctgatttttttatcgatattcaccgtgagcaagcactattgtgtcaacatcaagtcattgtatttcagtttccattacaaacttatagttgtcctgcgctattaaaagagtggcaagatagagtgctcacgcgtccttttgctaataaagttggacgagctcaacttaaaggaaaaacattccgttgtgtggtgactactggtgagcctgaacatgcttatcaacataatggtaaaaatcactacacactatctgaattattgcgtcctatcgagttaatggcggaaatgtgtggtatgcgctggttatcgccgatgattatttactccgcaaggcaacagtccaaaacaacactagggcatattagtgatgcttatcgccaatggttacaagcaccgttagagggggaacacgcggatggaaggtaa

SEQ ID NO: 2722 - DNA, 450 bp, Proteus mirabilis
attatgccgatcactgaattctcatccattatctctacgggtacacaaggtgggttgcagatgcaatgtgcttctcgccaatttcaattattacttgatgagcctatttcattgggtggaaacgacaccgcgatgacccccgttgaagcgctacttggcacacttggtgcttgtaaatgcattgttgctaagagcttcgcccgcctacaccatattaatctccataatattcgtattgaggtaaaaggcgagctagatatcgatggctttatgggaaagaataaacaggctaaaatcggctttagtaagataacgacgcatttctatatccaagcagataatagtaaaacagaaatagaagcttttatcgcctttattgaacgaacctgccctatattagataccataaccaacccaccagaatgcgaaacgctatatcatcttgaatag

SEQ ID NO: 2723 - DNA, 402 bp, Proteus mirabilis
agtaatacgatgaatctgacatattgcttgctggtgactgggccacattatggcacggaacaagcttctagcgcttatttatttgctaaagcgttacttgaaaaaggtcatcacatcgcacaagtatttttttatcgtgaaggtgtgtccaatgctaatcaattggtctcacccgcaagtgatgaatttgacttgccaaaatcctggatagcattggcttcacgctacaatatccctttgcaggtttgtgttgctgcagcattacggcgtggtgttgttgatgagcaacaagctaaagagcaggggttactgagcagcaatatggcaacaaagtttgagctaagtggcttaggagccctcgctcaagcgatgttaacttgtgatcgtgtggtgcagttttaa

SEQ ID NO: 2724 - DNA, 690 bp, Proteus mirabilis
gagggagcgatattaaggaatatagtcgtgtctaaagaaaaatttgaacgttcaaaaccgcacgttaacgttggtactatcggccacgttgaccacggtaaaacaactctgactgctgcaatcactacagttttagctaaaacttacggtggtgctgctcgtgcattcgaccaaatcgataatgcgccagaagaaaaagcgcgtggtatcaccatctctacttcacacgtagaatacgatactccaactcgccactacgcacacgtggactgcccaggtcacgccgactatgttaaaaacatgatcactggtgctgcgcaaatggacggagctattctggtagtagcagcaactgatggtccaatgccacaaactcgtgagcacatcctgttaggtcgtcaggttggtgttccttacatcatcgtattcctgaacaaatgtgacatggtagatgatgaagagctgttagaattagttgaaatggaagttcgtgaacttctgtctcaatacgatttcccaggtgatgacactccagtaatccgtggttcagcgctgaaagcactggaaggcgaagcagagtgggaagcaaaaattgttgaattagcagaagcactggattcttatatcccagagccagagcgtgcaattgacaaaccattcctgttaccaatgtcttcaccacggggctga

SEQ ID NO: 2725 - DNA, 375 bp, Proteus mirabilis
attggatggatagataaaagtcatgcaaaaggtgaagatgcatccactttaatgggtgttctaactgcaggagactatgttagtgacgtagacccaatgacatatttaacagtattaagtaaagaagaggcttatcgtcgctgggattattacggctctattagtaaatataaaaataagcttttcaaaccgttaatttttcctgatcctgctatttatccaaataatgcaagaccttacttcgtttcattaccatgctatttggatcgcgtaaaaccgatagaagatattagaaataatagtattttaattcatgtaaaagatacaacaggaataaacattggagctgaaagtgaatggattaaaattgaataa

SEQ ID NO: 2726 - DNA, 585 bp, Proteus mirabilis
gcaaatgggatattaaaaatgaaaaaacaactattatcagcattatttatcagtggaatattttctatttctaccgttcaagcacatgaaaatacctcattagataaaacaacaatttctgcaggttatgcacaaataaaaattgccggccaatcaggcattatgcgcggtggtaatctctctatacgtcaagaattcaatcaacagctaggtattatggcaattgctacctatgcgcaaaatgaatatgatttaaataagcctttaaaacaattaataaaagatgttgatgcccgctattattcagtgatggcggggccaaccctacgcctcaatgactatattagtgtatatggtgtggcaggtatggctcaaatcgaatttaaaggtttagatactagacaagtacctgaaagtataatcaagaaaaatgcttttagctggggagccggtgttaccattaaccctatcgatatgctttctgtttccgttggctatgaaaacagccgttataaaatgaataaattaagtgataataaattaattattgatggctttattgcaaatattggttatagcttctaa

SEQ ID NO: 2727 - DNA, 264 bp, Proteus mirabilis
ttatcagtttttttactcaaaagcgggattattttctttgaaagaggttttattgatttagtgcacttgggaatgattttatttcagcgtataatcatcatgttatttcatacaaataatcctatatggaagatcatcgtccccggtggggcggctggacttcaaatccagatggggccgccagcggtccttggcaggttcgactcctgtgatcttccgccaattaagttcattacacctcccaaaactcaatcaatcccttaa

SEQ ID NO: 2728 - DNA, 729 bp, Proteus mirabilis
tcagtgcacttttgtgatcaggataatttgatgtcgacgattattgatacctttattgcccccacttgccatgacaagattgagtatctttatcaagatgaacatctactggtaataaacaaaccttcaggtttactaagcctttcaggtaaaaacccgcaaaatatcgattctgttcattatcgcttagtaccattgtttcccgagtgcacattagttcatcgtttagactttggcacatcgggggtgatggttattgccctgaataaagcgattaaccgtgcactttgtcaacaatttagccagcgaaccgtcactaaagcttatgacgccctattatgtggccatttgcaaaatgatagtggtgttatagaagcgcctatcgcgaaagatccacaacactttccacgtatgtcgattagcaccacacaaggcaaagctgcgcgctcttactatcaagttatcgaacggttttatcagactcttgctgatggcactcgcttacctttaacgcgcgtgcgactcacgccagaaacaggcagaacacatcaattgcgtatccattgccaatatatagggcaccctattttagggtgtgatttgtatggtggcctattattatcaggaacagagcataccccacggctaatgttgcatgcctgtgagttacattttattcaccctgttagtgagcaaccgatggatatttatctaccttcgccgttttaa

SEQ ID NO: 2729 - DNA, 1632 bp, Proteus mirabilis
atggttaactttttattctatatggaaaaaggtgataatgataaaagcatgtctcaagtaataaacttttctcttttatttattttatctatagtacctgcactattagcgggttcaaccctgcatattgaacaaaagttctctatggtgattatcggttggctcctgatgttgctctgcgcaggtatctatcggtttactataggaaaagtgattacttttattgttgcagctttatggtctttaaacctctccatctcactgtttttttatcgtgaacatgatattcccttttcatcatcaatagcagaaactttcattaatactaatggaagtgaaactgttggtatgctctcttataataaatattatgtactcttttatattgttatatttaccagttttttctatttaatacatattagcgcccgttatttaaataacaaaactaataaaagatgtttaattgctatttttatattaataattcttatttctctatacaaaaacttagcaataagatcagagagtaaaacccaattacttgctgagtattatctacttaatacccctttttacaatgcagcagctttagtgcggactttccacgaaaatagacaaatcaaaaagatcacatcagaaaaagttaattttaactatgataaagtggatcaaaaaacagaaatttatattcttttgattggtgaatcagtacgacgtgatcatttaggaatttatgggtatccgtacgatactacccctaatttagagaaagaaaaaaataatattttattatttaagcaagcttattctcctgcgcctgtgaccatattatcagtacccatatccctttctaatatcaacctaacagagttatatgataagaaacactacgctgataatatcatttctcttgccaatcatgctggcttcaaaacatattggttaagtaaccaaggtaaaggaaatccaaaaacgagtgtgatttctgttattgccaatatggcccaacataaaaaatggaatgaatttattggctatgatgaagaattattgccatttttagataatgcgcttaatgataactcatcaaataaaaagctcattgtcctacatacttatggtagtcatgagccagcatgtaatcgttttcctagcacttaccttaaaaccttttcccaacaagaagatgataactgctacgatagctctatcgcttatactgacaaacttatcagccaaattattgaaaaaatacaagataaacccgcatctatactctatttttcagatcacgcattacaacgattagataaaaatagagaagtacgttatcaccatggcgtgaacagtcctcgccaagaagcttataatataccgctctttatttggtatagcgcatctgcaacgcgaccaaatatcaatgaagaaaatttgaataaacctttttctaccgcagataattattggctattaagccaatggctagatattgaacataactcagcgaaaaaatgttactcacctttaagcgaatgctatcaaacaaaaacgtcaatgatggtcatcgatggtaataagaagttattaaactacgcactattagaatcagaagaacaagcgcctcaataa

SEQ ID NO: 2730 - DNA, 2103 bp, Proteus mirabilis
cggagtaactttcccatgaaaggaaaactgcttgatgcaatccccttaaccactcttcacggcgtaggtgcaagtcaggcagataaactggccaaaatagggttagtcactgtggaagacttattgcttcatcttcctttacgctatgaagatcaaacccatctgtatgccatcagcgatctacttcctggtattccagccactgtttccggtgaaatcttaagaactgaagtaaattttggtcgtcgaaaaatgatgacctgccaaatttctgatggttcaggtattttaaccttacgcttctttaacttcacggcagccatgaaaaataaccttgctcagggtaagcaagttatcgcttatggtgaaataaaacgaggaagtcgaggccctgaaattattcaccccgaatacaaaattaaagtggctggctcagaagttaagttacaagaaacgcttacccctatttattcaacaacagaaggcttacgccagacatcgttgcgtaaattaatagaacaagccttaaccttacttgatacttgtgccattaatgaactgcttcctgatcaatttatttatggtttaccgccactcgctaccgcgttacgaaccttacataatcctccccctgatattgcgtttgctgaacttgaaaaggggcaacatcctgcacaaaaacggctgattattgaagaattattggcgcataacttaggtatgcttaatgctcgggcaggagcacaatcttatcgtgcagaacccttattaatgccacatggctcaacattacgtgaacaatttcttgcaacattgccctttacacccaccacagcacaacagcgcgtcgtcaatgaaatagaacaagatctagaaaaaaattatcctatgatgcgcctaattcaaggagatgttggctcaggtaaaaccttagttgctgcactaagtgcattaagagcgatagccaatggtaaacaagtggctttaatggcgcccactgagttactagcggagcaacatgccctcacctttagaaaatggtttgagccttttggtattcaagtggggtggttggctggcaaacaaaaaggtaaagcgcgagaagcacaacaaaatgcaatagctaatggcgaggtttccatcattattggcactcacgccatttttcaagagcaagttaagtttcactctctcgcattagtcattatcgatgagcaacatcgctttggagtacatcaacgccttgcattatggaaaaaaggcgaagagcaaggctttcatccacaccaattggtgatgaccgcaacccccattcctcgaacactggcgatgaccgcttacgcggatatggatacctccattatcgatgagctacctcctggtagaaccccagtaacgacagtggctatccctgacactcggcgaaatgacatcattgaacgtatcagggtggcttgtagcgaagaaaatcgccaagcctattgggtttgtacgttaattgaagactccgaagtccttgaagcacaagcagcacaagttatttatgatgagctgacgattgccttaccggaaatcaagattggattggttcatggtcgaatgaagccggcagaaaaacaggcggtgatggccgactttaaagaaaacaaactacagcttttggtcgcaacgaccgtgatagaagtcggggtagatgtacctaatgccagtttaatgatcattgataaccctgaacgattaggtcttgcacaattacatcagctacgagggcgtgttggtcgaggtgctgtggcttcccattgtgtcttattatataaaacgccgttaactcaaactgctcgtttacgtttacaagtgctcagagacagtaatgatggctttgttattgcacaaaaagatctcgagataagaggacctggtgaactattaggaactaagcagacgggcaatgctcaatttaaagtcgcagacttattacgcgatcaggcgcttattccagaagtacaacgtatcgctcgttatttacatcaacattatcctaagcattcgcaagcgttaatcgaacgctggctacctgcaaagacccaatatagccaagcttaa

SEQ ID NO: 2731 - DNA, 234 bp, Proteus mirabilis
tctggccctgtatttattgccacttttaacggtttatcaccttcatctggtgagcaagcggttaaaaccaatgaagtacaggccaaaagcaccactaataataattttctcatcttctctccaataatcgaccatatcactcttattatttataacttattgttattattaagtttaatgtttttattatgctatcaaggggaatacttatactatatgccaacatgtatttag

SEQ ID NO: 2732 - DNA, 768 bp, Proteus mirabilis
gggacacctgtgaagcaaacacaacggcatgatgccatcatcgaactggtacgcttacaaggctatgtcagcaccgaagaattggtggaacattttgaggtcagcccacagactatccgacgtgatttaaatgaattagcggaaaagaacaaaatccaacgtcatcatggaggcgctgcattaccctctagctctgtgaatgccgcttaccacgaccgtaagatcatgtggtctgatgaaaaatcacgtattgcccaacgtgttgctagcttaattcctgatggtgcaacactatttattgatattggtactacccctgaagccgtagcccatgcactgattaaccataaaaatctgcgtatcgtcactaataatctaaatgtcgccactttattgatggataaagaagactttcgcttgatcttagcgggtggcgaagtgcgtacccgtgatggtggtattgtcggtgaagccaccctggattttatctctcaattccgccttgattacggcatcttagggataagtggtattgatatggacggatctttgttggaatttgactaccatgaagtccgcactaaacgtgccattatcgaaaattctcgttgtgttatgttagtgaccgaccactctaaatttggccgtaacgcgatggtcaatcttggtaatatgaatctgattgattaccttttcaccgaccaagagccaccatctggcattcaaaaaattattgaacaacataacgttcagcttgagctttgctag

SEQ ID NO: 2733 - DNA, 351 bp, Proteus mirabilis
accatggctgtgatccccaaaaactatgcaaaactagaaagcggttaccgcgaaaaggcgctaaaactctacccttgggtttgtggacgttgtgctcgtgaatttgtctattcaaatctgcgtgaattaaccgttcatcatattgatcacgaccacaccaataatcccgaagatggcagtaactgggagttactgtgtctgtattgtcatgatcatgagcactcaaaatacacagaagcagaagagtacggctctaccgttgttgcaggggaagatgctcaagatgatgttgggcaagcaacctataacccctttgctgatttaaaggcgatgctgaataagaaaaagtga

SEQ ID NO: 2734 - DNA, 402 bp, Proteus mirabilis
acaatggctgtgcagcgcttattttgcacagctaagcaccaaagagggggaatgatgttagatattgagaattgtgttgatagctcagcgacagatgatgaatttgaagaaattatcatggggttaattattaattcagggcaagcacgaagtatcgcttatgcagcgttaaaaaaagcgaagcaaggtgattttgcacaagccaagaaaatgatggaacaatctcgagcagcattaaatgaagctcataaaatacagacccgcttaattggtgatgatcaaggattgggtaaaacgaaagtgagcttggtactggtgcatgctcaagatcatttaatgacatctatgttagccagagagcttgtcacagagcttatcgagttacatgaaaaaataaagtaa

SEQ ID NO: 2735 - DNA, 876 bp, Proteus mirabilis
gtggattatgtcattatgcctacattaacgaagatagcgtggataaaaccagggatggcgacaaatcaacgtaaaatagcggattatattttagaacaccctgaaaaaatcgtgactttatcatcacagcaattagccgaaattatgggagtcagccaatcagcaatagtgaaatttagtcaaaagataggatttaaaggatttccttctttaaagctggctatcagtgaagatttaggccgaaaaaatgctaattcagaaaaaaattccagcatattacataaccaaatagattcagaggatagcctggttgttattgcgcagaaattagcacaagaaaaaaataattcaattcgggataccacacgtcaaattaattatcaccagtttgaacaagtgatccaacagattgatgacgcctctcgggtacaaattataggtattggtggatcaggtttagttgccagagatttaagttataaattacagaaaataggtattacgactttaattgaaactgatcaccatgtacaaatttctgttgctcagatgttaagccctcgggatttacaaattgtgatctcttacagtggcaaaagaaaagatatgctggtcgctgcatctgtggctaaaaaacaaggtgctaaaattatagcgatcacaggagaaaaacattcaccactaggtctgatggccgattatatattagaaactattgctgatgaaggtgagtggcgtagtgctgctatttcttctcgcactgcacaaaacaccattaccgatcttatctttatggcattattaaagaagcgtgatgaaaatgcgaaggctttagtattaagctctcaagcactaattaatagtctggatgattaa

SEQ ID NO: 2736 - DNA, 1788 bp, Proteus mirabilis
ctgatgtatgtttgtcgttccttgctctttatcctacaaattaatgaaataggtaaggctatgcttaaacgaataaaaatatctagtggcttaatgtttattttgatcttgttttgtgccattcagttgttttctggtgctacaggcattcgtgatgcttatttaactaataagcgaatttcacagttagccgatggttttgaacagataaaaaccatggattatggttatgccgcattaaataaattacgtgaagatatgcttaatgtaatgtttgatgctcatctcaccccagatcttgctgaaagcaaaattacagatttcctctcctcttaccctcaacgaaaaaaagaagtctctagcattattacccaatattttacctccgctgaaaatgccgattttgatcgcgaaaaagtggcgaaaatgaaaaaactatttcagcgtgtcatttacgatcttgaccagctcgtttcatgtttagaaatacgagattattacggtttccaatctctttatgctcacaatacgaatgagcgcttcacacaatcactttatgaggcaacggatcatcttagcgataatgtcgtcaaccacgcgatagaagccgcacagggtaattaccaacgcgcgttgatcttcgcgtttatttttatgtcggtatttatcttatttacggtgtttgtcatgttgtggatacgccaccatatcgtgttacgtattaaacaagtcattgattatatgtcagatatctcacaagggaatttacttgaaaatagcaccataaaagccaaaggtaataatgagatagaccaacttattaatggaatacagtatatgcggtctgaattatcactgatagtcaatgctattcgcggaacaagtcatcatatttataatggtgtacaagagctcagtgctggtaataatgatctatctagccgtactcaagagcaagcgagtgctttagaagaaaccgcttctagtatggagcaactaaccgccacagtaaaaaataatactgaaagtgctcgtgaagtatcacaccttatcaatcaaacctctaatattgccagtaaagggggggatgttacccatagaatggtaaaaaccatgaacgatattgcacaaagctctcaaaagattggcgagatcacaacggttatcaacagcattgcttttcaaaccaatatattatcactcaatgctgcggtagaagcggccagagcaggagagcaaggacgtggtttttctgttgttgccacagaagtaagagaattggcgcaacgcagtgcagaggcggcaaaagagatcaaagagcttattgatgcgtcgattaaccgcgtcaaacaaggtaatcaactggttgaacaagtcagtacttcaatggatgagatcctcacatcagttaaacatgttgaaagctcaatgactgagatcctatctgcatcagaagaacaaacgcgaggcatttctcaagtctctttagccgtcactgaaatggataaagcgacacaacaaaatgccgcaatggtggagcaatcttctgctgtagcaagtttactaaccgaaaaggcgggtgatcttgagcaaattgttgagcaatttaaaacagcggaaagtctattttcgaagaatagcacattagcaaaacccgttgagaaatcagcaaatattgggttatcgctcataaaagaaaatcaacaagactcaagaataaaagagccaaaaaaccataaacaatcgacattcaaagaagatgaagatgatgattggacaagtttttaa

SEQ ID NO: 2737 - DNA, 207 bp, Proteus mirabilis
ttgttgagtgtttattggttgtttatttttattaacattaattttatgattatttatcaatgggataaaattttattattatgctatatattgatatttaatggagttttatctgcagtgatattaaggaataaattatttcaaaaaactaaaaaaaatttaagcattatttataatttgtttaaaaatagatgtgcttatacgtaa

SEQ ID NO: 2738 - DNA, 207 bp, Proteus mirabilis
atgccatacgttaatattaaaattacccgcgaaggtgcaacagcagaacaaaaagaacaattaattgctggggcaacacagcttttagtggatgtgttaggcaaaaatcctgcgacaactgtcgtcgttatcgatgaagttgatacagataactgggggataggtggtaaaacagtaaccgatttacgtgccagtgcaaaaaaataa

SEQ ID NO: 2739 - DNA, 1020 bp, Proteus mirabilis
agcagcaacgttatgcaaaaagttaattcatccatgattagcaaatatactggcgctgttcaacctaagaaagtgcgcctctcacctatggcgcgtatttggctcttacttggcgtctcattattagccattgcgctgtttatgacgatcaacctaaacggtaatatctcttatattctgacacaccgcgcttatattattctaacgatgatcatcgtcgcctttgcggcaggcgtttctactatactgtttcagactatcgccaataaccgcattcttactccttcattaatgggcttagaagctctgtttgtattgctacaaacgctctttatcttttttgaaggggatatgcctgcctcttggatggccaatctgacgaagttctttttagagtcggccttattagtgttattttcggtagttctgtaccgttggctatttagttctgtgcgctttaatatcaatttagtccttatgattggtattattttaggcaccctatttcgtagcagtgcaacgctattacaacgcctcatggacccaaatgagttttctgtcttacaaagccgtatgtttgcgacatttactcgagccactcctgatcttatcttatgtgcattagccattattgtcgtcgtcggcgtattactttggcgtatgcgttatagttttgatgtgatggccttaggccaggcgaatgcgattaatcttggtattaattatcgtaagcaaacgacttatattctattacttatttctgttctggttgcggtatcaacagcattagtagggccgttgacatttttaggcttaattgttgctaatctggcttatcatattagtggtagcagtcagcaccgctttttaatgcctgtggcattcttattaggcactatcgcactgattggcggacaattgattttagagtatggcttaaaaatgacaggtactctctctgttgtgattgagtttattggtggtatgttctttatttatttggtattaagaagactttaa

SEQ ID NO: 2740 - DNA, 597 bp, Proteus mirabilis
actattaaagtaaaggatccctgcatgttaaaacgtttttttgtcactctcgttaccgcttgcaccttgacaacaacaagccttgcaatggctgcaacgggagagacctttgttaaattagtcacatctgaaggcaatattgaactgtcactggataataaaaaagcccctatcacaacgaaaaattttattcagtatgtcgaagatggttactataacgggaccacttttcatcgagtgatccccggatttatgatccaaggtgggggatttacggcagatttgcaacaaaagcagacacgagagccgattaagaatgaggctgataatggcttacgtaacttaaaaggcaccattgcaatggctcgtacatcagataaagacagtgccacaagccaattctttattaatgttgctgataatgcctttttagatcacggtcaacgtgattttggttatgcggtgtttggtaaagtagtgaaaggcatggatgttgtcgataaaatttcacaagtgcaaacccgcaatattggtccttaccaaaatgtacccgttaaaaccgtgacgattttatccgctgaggtggttaaagaataa

SEQ ID NO: 2741 - DNA, 870 bp, Proteus mirabilis
aaaaataaagtaaggcgaatgatgatgcactcattaaaagcgcaagctgaaatacgcatggtatatgaaaaccaattatttaatggtaagaattttcatgtgtttatttataacaaaacagaaagcgtcagtgggttgcatcagcatgattattatgaatttactattgttttaacagggcgctattatcaagaaattaacggtaaaaaggtgttattagagcgtggtgattttgtctttattcctattggctcgcatcatcaaagtttttatgactttggtgtaactcgtattttaaatgtgggaataagcaaagctttttttgataaacattatcttcctttattgcccgcttattttgttgcttctcaagtttatgcattaaaaaatgagtttctttcttatattgaatccgtgattagctcattaaatttcagacatacagaatttaatgaatttattgaaattgtcacctttaatgtggtgaatagattacgacattatagagatgatggtattgaagatgatattcccttatggctaaaagacgccattgatggaatgcatgataaaagccgatttggggagaatgcattagcaaatatggtgcaattatcaggaaaatcgcaagagtatttaactcgagcaactcgccgttattatgataaaacgccgatgcaaattattcatgatattcgaattaattttgctaaaaaacaattagaaattacgaattactccgttaccgatattgcttttgatgcaggttatagtagcccgagcttatttattaagacttttaagaagataacatcgctgacaccaaatagttatagaaagaatttatacagtattaaagagactaactaa

SEQ ID NO: 2742 - DNA, 840 bp, Proteus mirabilis
ataataagagtgatatggtcgattattggagagaagatgagaaaattattattagtggtgcttttggcctgtacttcattggttttaaccgcttgctcaccagatgaaggtgataaaccgttaaaagtggcaataaatacagggccagatcagcaaatttgggatgaagttgttaagctggcaaaagaaaagcagggattagatatcaaggtgatcacctttaatgactacgtgttacctaatgaagctttgcgtaataatgatgttgatgtgaatgcgttccaaaccgtaccctactacgaagctcaaagcaaagagcgtggttatcaatttgaaatcataggtaaaacctttatttttcctattgcagcttattcaaataaaatcaaaaccatagaggcgcttcctgatggtgctaccgtcgccatttctaatgaagcaaccaccctaggtcgtagtttattattactgcaggctcaaggattgattaaattaaaagatggggtggggtatttaccaacgacacttgatattattgaaaaccctaagaaacttaaatttgcagaaattgatacaccacaactaactcgtacgttaagtgatcctaatatttacctttccatcatcaataataacttctcttcacaagtgggattattagccaaacgagatggtttatttatggaaaataccgattctccttatgttaatttgattgttgccagagccatagacaaagataacgaacgattaaaaaaactcgtcgcggttttccaaagtgatgaaattttgcaaaaagcgcaagaagtttataaaggtgatgcggtgaaagcgtggtaa

SEQ ID NO: 2743 - DNA, 609 bp, Proteus mirabilis
ggttttctggtaagtggcagagttggcaatatcaagtatctcaacataggcatagcgaacaagatgtcgataacaatgaaaataaagactaattgggtaatttatttcgtccttttacctttttggcaaaaggcactcttaagtttagccccttctataatagtgagtttgttatgttatttattcagcttttcgggctatcagcaggacataaccgcgcaacaacagcttattagccaacaccaaacgcagatacaacaactgcagtcgatattgcattcgtctcctgctatagccttattaaaagcgttacaacatgactataaacttccaccacaaacaggctcagcctatcagcgtttacaacagataatcgataaccatcacttgatacctcatagttggcaacatagtgtcgataatagttttaagctacgtttttcactctcttactcacaattactaacgttattagcgcatctacatcaagcaggttgcgctctttctgcactgctcatttcgcctatcccccctgatttactctcagttgaattgaatttagtcgacataacgacaccaaatgttctagcgcctttgaagtcagagtga

SEQ ID NO: 2744 - DNA, 972 bp, Proteus mirabilis
aagtggcaggtgatgccattaacttactgtaaggaatttataatgagtcagcaaaaatacgttggtgtttggcctgtgatgctcactccttttgatactaaaggagagattgattgggcgtcattagagcgccttgtcgattggtatatcgatgcgggcgtacatgggttatttgccgcctgccaatcaagcgaaatgttttatttgagtgatgaagaaacacaagcactcacccgttttatcgttgaaaaagcagatggaagagtacctgttgttgcttctggccatacggcaacggccttaagccagcaaaaagaacaactgcaggcaatggcgagtaccggcgttgatggtgttattatgatcagtaatcgcttagcgcaagtgggcgagtctgatgataaggcgctggaaacgctacaatccttaacccatgctgtacctaaagagattgatttgggtatttatgaatgcccttatccttacaaacgcttgttatctgaagagatagtagagtggtgcgcacaaagtaatcgctttacctttattaaagatacttgctgttctcttcctctcatagaacgtcgcttagcattatcaaaaggaagtcgtttgcatctagccaatgctaatagtcaaaccttattagcgtcattccaagcaggatgccaagcatatagtggtgttatggctaacttccaccccgaactttatgtctggctgtatgaaaattggcaggataaaccagagcaagctgcgctattagctgattatttatcaacagctgcgatgactgaaacgctggattatcctgcctgcgctaaatatcatcagcgcctgatcggcaatttcgcgacactggtttgccgctctcgtaatagtagtcagtttgaaaactcatttttcccttctgctgttaatagcatgacggcattgggtgaaaatatgaagaagtggctttcgttaaattaa

SEQ ID NO: 2745 - DNA, 495 bp, Proteus mirabilis
tcgtatttattggtaatggcaaaaagtaactatattactcgtgatggctggcatgccttggataaagagctaaaatatctttggaaagaagagcgtcctcgcgtcactcaatcggtctctgaagcagcggctcaaggtgaccgttcggaaaatgctgaatatatctatggtaaaaaaagattacgtgaaatagaccgacgagttcgttttttatccaaacgtcttgatgaattaaaaattgttgacccagatcctcgtcaagaaggaaaagtgtattttggcgcttgggtaacccttgaagacgatgatgaaaacattaagacatttagactagtcggccctgatgaatttgacccagcaaaacagtggatttctattgattcccctgtcgcgagagcgctgatcggtaaaaaagtggatgatgaagttagcgtgcaaacgccaggtggcatcgttaattactgcgtattatctatcaaatattattcggaataa

SEQ ID NO: 2746 - DNA, 1746 bp, Proteus mirabilis
cgtttcttattatttagtctccctttaaatttactaaataaaagggacgttatgttttataaaaaattgccatcattaaatcttctagttatctctatttcatttgcttttatacataatagtgcagtagccaataacgttattgtagatgcaggaaaatctgcaaacacaacagtgagcaagaatggagatggttcagaaactatttctatcaacaaagcaaacgatatgaatttatcagttaactattttgaacaatttaatgttggaaaagaaggcgttaatattgataatagcgaggcaaaagcaaaagttattcttaacgaagtgacttcaaaaaaaacgagttcattagagggtaaaatctctgttttaggacaagatgcagaattgattatcgccaatccaaatggaattgattgctacggatgtcaattttcaggttcagataaggtgatgttaatttcagggaagttagatagtattacaggcaaaaaaattcacttatcagatggttatgttaatctaaagaatgttaataatttcaatgaaaaacaaacaatcaatgttttttctaatcgtattaatatattgggtaaaaataaaattccagtttttaatgtgatcaatggctatgaaacggttagttttgttgattatgattggaaaggtgaccaaggaaaagagctatctaaagataatcaagaaggcttctctattttagaaaatagtttattaaaaacagatcttttctctctacaaggtggcatttttaatcttgatggggatctaatcactaaaaaaatcaatatcattcgtaataaagaaattaatgctaatgaaaaatcagtattcggaattattaataaaaaaaatgaatttagagcatataatgaagtagatctaatgttcatgttagcatctatgaagttatattttcttgaaatagatgcaaaaaaatcagctgaaatagcattagaattagaggcattagaagaaaaaataatggagttagagcctcataatatacataaaaatagactaaagaaaataagagaactagctgctgaagctaggagagttgctgatcaacagcaagcagaatataacaagatccagagtgctgttcttaaaatcgatgaagctaaacaagcagaaaaaagaaagttggaggctgagggtaaagaaataggatcagcacttcaatatatagaaagtgacaatattaactttaaaggtaaactagctattataaatagcgaagttttatttaatgcgagaaatattaatgttgatattgataaaacaatttcttatgtcagaaattctggtgtctcatttaatgcccatcaagataataactactcgggtagatttgctctgataaatagtagtatcagatttttaggttatcgaaatatcccgataggagatggtaacgacgataatagcttagataaaaataagcttaatgatattaatttaaataaactatctatgcttggttttggtcaaatttttgcacatggagataacataaatataacagatgttaaatttaaagaaactctttcagatgatggattaagcaaaacttatatagatttgatagctgataatgaaattaatattaaaggtcagtttaaaacttctttaattaataaatatagcttatttaagtttgctagcaagataacggagaatgataaggttattttcgatattaacccacataaaactaaataa

SEQ ID NO: 2747 - DNA, 477 bp, Proteus mirabilis
tctatgttatttggacatttatctgatttggcgactatgccagaaatgaatccagcgttacgtcatgcaatggaaaaagcattagcacttgatcccgcgtcacttgcatcgggcagctataaaattgatggtgagacgttgtttatgaatgttatgacttttgaaaccgtgcctcgtgagcaaaaacaagccgaattgcatcagcgttatatcgatattcagatcttactatccggtgaagagacaattgattttggaatacaaggttcggcacaagatgtgacaccttataatgaaacggatgattatcagttgactgataacatcatacatcgtcaaacattatcccttacaccaaatatgttcgccatttttatgccttatgagccacataagccaggtattgcgcagaaaaatgaggccagtacattaaagaaagtggttattaaactagatgttgccgcgttaactcactaa

SEQ ID NO: 2748 - DNA, 1647 bp, Proteus mirabilis
aaaagcctatttatcaggagcaaaactatgaacgttaaaggtcttacccctaaggatctcgagcagtacggtattcatgacattagtgaagtcatttataaccctagctatgacttattatttgaagaagaaactaagccaggattaacaggttatgagaaaggcacattaacctcgttaggcgctattgctgttgatacggggatttttactggacgttctccgaaagataaatacattgttcgtgatgatgttactcgtgatactgtgtggtgggctgatcagggcaaaggtaaaaatgataataaaccactctcaccgcaagtatgggctgatttaaaatcattagttactgagcagctatcaggcaaacgtttgtttgtcgttgatgccttttgtggtgctaatgcagatacgcgattaaaagtgcgttttatcaccgaagtggcttggcaggcgcattttgttaagaatatgtttattcgccctacgcaagaagagttagaaaattttacacctgactttattgtgatgaacggtgctaaatgtaccaatccaaattggaaagcgcagggattaaactctgaaaatttcgttgctttcaacttaactgaacgcattcagttaattggtggtacttggtatggcggagagatgaaaaaaggtatgttctctatgatgaactacttcctgccattaaagggtattgcttctatgcactgttcggcaaacgttggcgaaagtggtgatgtagccattttctttggtttgtcagggacaggtaaaacgacattatcaacagatcctaagcgtaaactgattggtgatgatgaacatggctgggatgatgatggtgtattcaactttgaaggaggttgttacgctaaaactatccatctatcaaaagaagctgagccagatatttacggtgccattaaacgtgatgccttattagaaaatgtcgtggtattagcagatggtagtgttgattttgatgacggctcaaaaacagaaaatacccgtgtatcttatccaatctatcatattgataatattgtcaaaccggtatcgaaagcgggtcatgctaaaaaagtcattttcttaaccgccgatgccttcggggtgctacctccggttgctcgtttaacacccgagcaaacacaatatcacttcttatcaggctttactgcgaaacttgctggcacagagcgtggtgtgacagagccaacaccgacattctctgcgtgttttggggcagcatttttatcactccatccaacacaatatgctcaagtgttagtaaaacgtatgcaggcttgtggagcacaagcttacttagtgaatacgggctggaatggtacgggcaaacgtatttcaattaaagatactcgagcgataattgatgccattttaaatggtgatattgataaagcggagactcaaactctgcctgtatttaatttggcgatcccaacagcgcttcctggcgttaatagcgaaattttagatcctcgagacacctatgcggataaagcacaatgggatgttaaagcggacgatcttgctgatcgctttgtgaaaaactttgataaatatactgatacgccagtagggcaagcgttaacaaaagtgggccctaaacgctag

SEQ ID NO: 2749 - DNA, 222 bp, Proteus mirabilis
accacaatattttccattgtttccaccgtctcattcacttgctttgagccaatcttaatattgttacttgatgtattaatcaatgctttgatctcttttgccgcctcagcactgcgttgcgctaaattacgcacctcgctggctaccacagaaaaaccgcgtccttgctctcctgctctggcggcttccaccgaagcgtttaatgccaatatgttggtttga

SEQ ID NO: 2750 - DNA, 531 bp, Proteus mirabilis
aatgaggtattcatggctgtattaacgctactgcattttcctgatgagcgactacgcaaagttgctacacctgtggaaaaagtagatgacgaaatacgcacattaatcgatgacatgattgaaaccatgtacgcagaaagaggaattggcttagcggctcctcaggttaatgtctctaaacgtattgtcgttattgatgtttctgaaaatagagatcaacccattgctcttattaacccagaaattatcagtactgaagatgaaataatggatatgatggatggttgtctttctatcccagactcttttgctcccacacaacgctttcgctacttaaaagtcaaagcactagatagaaatggtgatgaaatcgagctagaagcagccgatctctttgctggctgtattcaacatgagctagatcacctcaatggtaaactatttatagaccatttatcgccgttaaaacgtcaacgtatcgagaaaaaacagaaaaaattaagcaaactcaatagcacccaagttgcttaa

SEQ ID NO: 2751 - DNA, 1179 bp, Proteus mirabilis
tttatatcatttttatttattggagatgttatgaaatactttgaaatggaaaataaagcgaatgtattattcggtgaatataatggagtgacacttcccaaacgttatactaatgaacatgaggcttatttttcggtaagaaatagcatattaatgacagacttttctcattatggcatggtgaaaatttctggtgaagatgcttggcggttactcaattatcttatttctgcagacatttcatctattcgtgatgaacaactactttatacattgttactagataaagcagggaaaataataagtgatgcctatgtactatgtgataatgaacactattttttaatttcagagtggatgaatagtgatgccatatgccagcagataaaaaaagtattagataagcaagatgaacggggtgaatgctaccaaattgatgctatcgcttctcttactccagattggcgtatgatctgtctagaaggcccctatgcttgggaaattttatctgaaatcgtcggtatggatattattggattaccttttcatgagtttatgtatgttgatgaagatgtcattactatgcgtgttggtaaacacggtgaatattgttatcacattatgggagatgaagagaagttaatgtctatttggcgacatttatgcactttatctgagaaatttgatttaaagattggcggggttgatgatttaaaaaatatacgactagaaaacccttgttgggagcctcaagtgattaatccttttagtcgctgtcctattgagttacaaatgcaatgggcgattagttacgataaagatgcatttattggtcaagatgcaataaaacaacgtgctgataatggggtagatcagaaaatagttggcgcaagaataattaatatgcctcagaatgctgcaattttacaaggcgatgcaatctattaccaaaatgaacaaataggcgtagttattcaagtgggatactcttttatattaaaagaacacattgccagaatattattaaaacgagaatttgcttacgttgatattgatgactataaaataaaaacggcttatggtgatattgattttatcacaacgagtattccctttgttaataatttaagtttaataattaatccaaccgaagatagttatcttgaaagacatcaataa

SEQ ID NO: 2752 - DNA, 870 bp, Proteus mirabilis
atgaatacattagcgattgatattggaggaaccaagatctcggcagcattaattagccgagataaccaattgacacaacatcgacaaatagcaacaccagcaagtccatctccaacacaactttatgaagcattagttagcattattacaccattaaaaaaccatgccgatagtgttgccgtagcatcaacagggatcatttgtaatggcattttaaccgcattaaaccccgataatttaggtggattaaacgattttcctttaatggaaacactatcaacccttaccggatcaccttgttggttacttaatgatgcccaagctgccacatgggctgagtattatcatcgtcgtgacactatatctgatatggcgtttattacggtctcaaccggcgttggcggaggcattgttcagcaagggcagctactaataggaaaacgtggtcttgcaggccatttaggtcataccttagctgatcttcgaggccctcgttgtggatgtggccgctatggttgtgttgaagccatcgcatcggggcgtgcgattgcctcacaggccgaaggggaacttgctggtaaagatgctaaggcaattttcagcgcttttcatcagggaaacttacaggctaccaccattattaaacgctctgccaacaccatagctaatttgatcacaaatattaaagctacaacagatgctgattgtgttgtgcttggtggcagtgtggggcttgctaacggctatctcgaattggttcaagttgctatggcacaacaaccattagcattacaagtgccgattgtatcagctcactatcatcatgatgctggattatggggcgcagccctatggtctagagagcaataa

SEQ ID NO: 2753 - DNA, 2568 bp, Proteus mirabilis
actgcccaattcacattacatgggaaatttaaggtgaagttcttaaaatattttttcatcttcgtttttgcttgcataattttgggagcagcctcgatatatggcatgtataaatatgtcgagcctcaactacccgatgtcgcgacattaaaagatgttcgtttacaaactcctatgcaggtctttagcgcagacggagagttaatggcgcaatatggcgaaaaacgtcgtttgcctcttaccttgcaggagatgcctccgcaattaattaatgcctttattgccactgaagatacgcgttttcgtgaacatcatggtattgaccctattggcatctctcgtgctgttgttgttgcgttaacatcggggcaagcatcgcaaggtgccagtaccatcacgcaacaattagcgcgtaatttcttcttaacacctgagaagaaattaatgcgtaaaatcaaagaagcctttttggctatccgtattgagaaagagcttactaaagatgagatcttggcactttatctcaataaaatttatctaggaaatcgcgcttatggtgtgggtgctgctgcatatgtttactttggtaaaagtgtgcatgatcttagcttaagtgagatggctgttattgcaggtttacctaaagccccttcgacactaaacccactttattcgtatgatcgtgccttaaaacgccgtaatttagtgttacaacgcatgttggaagagaactatattacccgcgaagagtatgacagtgctaaagctgagcctattgtggctaaatatcacgccccacaaattgatttttcagcgccttatttgactgaaatggtcagaatggagatgtatcagcgctatggcgaaaatgcctatacggatggttataaaatttacactacagttatccgcaaagatcaattagccgctgaacaagcgctacgtaataatgttattgattatgatatgcgccatggctatcgcggtgctcaagaggtgctgtggcatgcagggcaaactccttgggatgataaagccattaacgataagctaaagggtatacagacttatggcccattaatccccgcagtggtgttatccgctgatgctaaagaagctcaggtggtattaaaaaatggcgataaaataacactcgatttaaaagcggttcgttgggcgcgtaaatttatttctgatacggctcaaggggccacgccgagcaaagttgatgctgttgtacatgctggtgagcaaatttgggtacgacaaaatagtgaaaatgattggttattagcacagcttccagaggttaatgcagcttttgtcgcattagatccacttaatggcggtattattgcgctggtgggaggttttgactttgaattgagtaagtttaatcgcgtatctcaatcgttacgtcaagttggttcaaatatcaaacctttcttatatgcggcagcattagataaagggttaacattatcgacattactaaatgacttacctattagtcgttgggatgcaggagctggaactgattggcgccctaaaaactcaccacctacttatgcagggcctattcgtttacgtcaaggtttaggtcaatctaaaaacgtagttatggtgcgcgctatgcgggcgatgggggttgattacgctgcagattatctattgcgttttggttttcctaatcaaaatatagatagaacagagtcattagctttaggctcaccttcatttacaccaatgcaaatggctcgaggttttgcggtaatggcaaatggtgggtatctcattgagccatattttattcagcgtattgaaaatgctgatggtgaagtgatctttactgctgagccgaaagtcgcttgtcctgaatgtaccgatatccccgtgatttatggtgatactacgcgctctattgcattatctgatgattatatggaaaacgtcgcacaatctcagcaagcgcaaccggcagaaacggcgcctgatattgagttagagcaagctcctcttgctgaaacagtcaaagaaagcccatatgctcctcatgtaataagtacgccactggcgtttctaatgcatgatgcgttaagaaccaatctcgttggtgagccgggatggtctggtacaggatggcgtgcattgcgagatttaaaacgtcaagatatcggtggtaagacaggaacgaccaatagctctaaagatgcttggttctctggatatggtgctaatattgtggcgactgcatggattggttttgatgatagtagtcgcaatttagggcgaactgccgcaacgggtggtgaagcgggtgccaaaacggcacaacctatttggaatgactttatgaaagttgctttagaaggtgttccggtacaaatgatgccgatgccaaaaggcgttgttgctgttcaaatcgatcgcaataccggtaagttggcgggagatggaccatcaatgaaagagtattttattgaaggcactcagccaacagaaaaagcaaaaagtgaagtgggtacacggatctttgaggataatggcgaatctaacgagctattttga

SEQ ID NO: 2754 - DNA, 1494 bp, Proteus mirabilis
aaaatgcaattacatgattttggttttattaactatgcagtgctgtttggctatttggcagctatgttactcgtgggtgtttatttttctaaacgtcaaaaaactgcggatgactatttccgtggtggagggcgagttcctgggtgggccgctggagtgtctgtatttgcgaccacattaagctcgattacatttatgtccattcctgctaaagcttatacttctgattggacctttattattggacagtatttagctattgcaattttacctttagttttttatttctatattcctttttttagaaaattaaaaatcacctccgcttatgaatatctagaagctcgttttgatgttcgtagtcgtttatttgctagcctttcatttatgttattccatattgggcgtgttgctattattacttatttaaccgtactagctttacgtccttttatggggattgatccggtcgtgttaatcgtattaataagtttattatgcattatttatacttggatggggggcattgaaggcgttatttggacggatgttattcaaggtttattactttctggtggtgctgtactgatctttattatgatctgttttaaagttgatggtggtattagcgaaatttttactactacagcacaagcagataaattctttcctaccacacaatggcgctggagttggacagatagcactattcctgtattaatgattgggtttttatttgccaatattcagcaatttactgctagtcaggatgttgtgcagcgctatatcgttaccgattctattaaagaaactaaacgtacattgataactaacgctaaattagtggctattattcctattttcttttttgccatcggctctgcattgtttgtttactaccaacaaaacccaagcttattacccgcaggatttaatacggggggaattttgccactatttatcgtgacggaaatgcctatcggtattgcagggttaattattgcagctatttttgctgctgcacaatcaagtatttctagtagtttaaatagtatttcaagttgctttaattctgatatttatactcgtcttagtaaatcatcccctagtcctgaacaaaaaatgaaagtcgcaaagttagttattattgtggcagggatattcagtagtttagcggcaatttggttagttttatccgatgaagctgaaatttgggatgcatttaatagccttataggtcttatgggcggaccaatgacaggcctatttatgctgggaatttttgtaaaacgtgctaatgccggtagcgccgttgttgggatcatcgtgagtattattgcagtattggctgcacgttatggcagtgatcttaacttcttcttctatggagtcattggttcaatgtcagtggtgattgcaggaaccattacggcaccacttttcgcaccagcaaaacagctttccttagatgacagtgaaacatcagagaactaa

SEQ ID NO: 2755 - DNA, 2622 bp, Proteus mirabilis
aagattaaatttatagcaaaaatatttattaaaaataataaatattatataggaattaacatgaatagtagacgccgtcgggttgtaataaccggaatgggggttttatcatctttagctaaagatgtgcctcaatttaaacaggttctttttaatagacaatgtaatattaagcccagccaacgttatttaaaatggtttaaaaatgccaatgcatctgagattgagatggcattagattattcagatataccgcagcatatcgctcgatcactagacaatgcggcattatgggcatatcgagtctgcaatgaggcattacaacaagcaaacttaatagataatcagtctattttagataataccgcgatgatcgtgggcgtctcttcagcaggaacggaagcctttctgccattatttgaacaacatattgatgatttttcgataaaaaaagccattttatccggtggattttcatcatgctgttcgagtgtatcaagtctacttggcttacgtggtggtcttgaattagtggcgacggcctgtaccgcaagccctaacgcgataggtatggggtatgattatatccaaaatggcaaaaatcctgttgtgctagcggtcggaacagaacccatttatcttcctacctttgcgggtttttatgcccttaatgtgatgaaaacaacaccaacttccccattttcaggtactcctggtatgtctattggtgaaggtgcaggagcgttagtattagaagattatcaacatgcggttgaacgtggtgcgacaatatatggtgaaattgtctcttacgcgacatcttgtgatgcttaccatgaaactagccctgatcctcgaggaaatggtgcagtgcaagttatgtataaagcactggataatgcgggtattactcctaatgatattgattatataaatgtgcatggtacaggtactgaagcaaatgatcgcattgaaaccatgtcgatgaaaaaagtgtttcctaatatttatcatatcccattaagttcaacaaaatcttatgttggtcataatattggtgctgcgggtattgttgaaatcatcgcgtgttttatttgtttagcagaagacaaacttccccctacattaaatttcactcagccaaggcatagctgtgatttaaattatgtaccgaatttctttcaagataaaaaagtaaaattttttatgaagaataattatgcttttggaggaaataactgctctattatcgcaagcccttatattacagataaaacaccgacggaatataaagctaaaaaagtggttattaccggggtgggggcgattacgtctattggcaataatataatggagataataacagcgattttggcaggagataaaacaggtacattaaaacctattgtatttgcgagtgatgtgcagaaagatatcgacaacttgatgtctgttgtcataaaagataatgattttgagcaatcgttaggacatccttattttgatctcgacattgatcatcgcttaaaaaataacgcctgttatcatgctatcactgatgttaatccgaaaaaaacattacgttattatgatccaagaaaagctattcctagcgggacttatgctttattcgctttaaatgaagcacttgcaaatgctggacgcaaaattaaacgtgatggtgataacttaggttttattgttggaatgtcaaaagggccacaaagtaccgttaatcgttatttacaaagtttaattcctgatccgcaaaaagtaagaacatcagaatttcctggtactttaatgaatgcagtaccgacattttgtgccatcacagagggaataaaaggttataccacaacattggcaacaggggttaatgctgcattaggagcgttaacttatggttatgaaattatcaggcaagatctacaacctcaggtaattgtcggaggggcagatgagcacttcagttctatttcactctattttcaagcgatgagtaagaaagttaatctgaccaagaatgcgacagattatcaggtttattctaatgcaagtgccggctatatccccggagaaggggcagggatgttatttcttgaagataaagagtatgccaagcaacgaggcgctaaaatttatgctgaaattattggctacggtaaagcgaatgataatacttttttagtagacgaaaatattactgatagagtggccgccttatgtaaggctatccaacaagcattatctgaggcgcaactcagttgccaagatattgatattatctgtggtaccagtgatggtaataaagagaatgatgaagttgaaatccgtgcgattcggcaactattttatcaagcggcaaatcatgtaccagtagttaattacaatgccttttttggtttagttgaatcatgcgctgggatattggcgatctctttagtgattcatatgatgcaaagcaacacgataatacctattccttatacaaaaagttttatagctgatgatattcattttgttacccaaccgattaataagcagatagaaactgctttagttcttggttcatcagaaggatgtaaccactatgcaattatcatcaggaaaccgttatga

SEQ ID NO: 2756 - DNA, 1371 bp, Proteus mirabilis
gggtatttttctatgagtaaggtcattggttcacttgaaaaggtactccttccttttgcggttaaaattggaaagcaacctcatgttaatgcgataaaaaatggttttatccgtttaatgccattaacacttgccggggcaatgtttgtacttatcaataatgtttttctcagttttggtgagggctcctttttttactctcttggtattcgtttagatacctcaacaattgaaacacttaatggtttaaaagccataggtggtaatgtctataacggtacgttgggaataatgtcattgatggcgccgttctttattggtatggcgctggcggaagagagaaaagtcgaccctattgcggcgggattactttctatcgccgcctttatgacggtaacaccttatgacgctggtggcgcttatgctgtgggggcgaactggttaggaggtgccaatattatttcagggattattattggccttgtggttgccgaaatgtttacctttatagtgcgtcgtaattgggttatccgtttgcccgatagtgtacctgcctccgtttcgcgctctttttctgccttaattcctggttttattattttatcaattatgggaattatctcttggggattagcgcattacggtacacatttccatcaaatcattttagattctatttcaacgccattggcttcgttaggatcagttgttgggtgggcttacgttatttttacctctttgctgtggttctttggtattcatggttcactggcgctggcggcacttgatagcggtattatgacaccttgggcattagaaaacgtctctatttataccgagtatggttcagttgaggcggcacttgctgcaggcaaaacgttccatctttgggcaaaaccgatgctagattcgtttatcttcttaggaggaacaggggcgacgttaggtctgatattagctatctttattgcatcgcgtcgagcagatcaccgtcaagtggcgaagttagcattacctgcaggtctattccaaattaatgaacctattatttttggtttacctgtgattatgaatccagtgatgtttattccttttattcttattcagccaatccttgctgctattaccgtaaccgcttattaccttgggattattccgccggtcacaaatattgcaccttggacgatgccaacagggttaggggcattttttaataccaatggcagtattgccgcactgttattagcactctttaacttagctgttgcaacactgatttatctgccttttgtgattatttcgaataaagcacaaaccgaaattgataaagaagaaagtgaagaagatattgctaatgcattgaaattttaa

SEQ ID NO: 2757 - DNA, 843 bp, Proteus mirabilis
ataatgaaattacgtgttttggcaacggcattaattgctggctcagtgcttttttctggtctggcaaaagccgataaattagacgatataaaacaggcaggtgtggtacgcattgctatttttgatagtaacccaccgtttggttttatcgatccacaaaccaaaaaattggcaggttatgatgcagatattgcgaatgaaattgccaaagatctcggggtaaaattggaattacgtccaactaacccagctaaccgtattccactacttagcgccaaaaaagtcgatttaattgccgccaacttcaccattaccgaagagcgagcaaaacaagtcgatttctctgtaccttattttgctactggacagaaatttatcgcgcgcaaaggcgtattaaccagccctgagcaaattgcgtcattacgcattggggctgacaaaggcaccgtacaggaaattaccttacgtgaacgctatcctgaaactaaagtcatctcctatgacgatacccctcttgcgtttgccgcattacgcaatggcaatgtacaagcgataacccaagatgatgctaaattagtagggttattagctaatttacctgagaaaatcaaagctgattttgaaatatcgccctttagtattacacgagaatatcaagccgttgccgcagctaaaggtgaacagcgtttaattaacgagattaataacacgctattaagattagagaaagaaggcaaagcagacgaaatttataatcgttggtttggcccagatactaagtccgctcaacctcgtggtgactttaagtttgccccactttctgagcaagcgcctcaatcctaa

SEQ ID NO: 2758 - DNA, 219 bp, Proteus mirabilis
tatcagcattcgctgtatatccacattcaaggcactcgaattgactttgtgactggcggttttcctttgctgtatgaccacagcaagcgcacttctgactggtgtaggccggtggtattgccagtacctgaccacctcgccagagctgcttgtactcaagctgtcggcgcatttcataccagccctgctccagtattgagcggtttaaaccagatttag

SEQ ID NO: 2759 - DNA, 441 bp, Proteus mirabilis
acagcaccttttaatacatcatttgccgcaccaaatgcgtcaagtaacgaaataccacggccgagtacttttagcagcttgtcatttggaatagtgattaatgagtcaacatgcttagataactcagtaattccctgctcagcaaatgccatacgctttttgccttcaaaattaaaaggcttagtcacaacagcaaccgttaaaatacctaactctttcgcaacttcagcaacgactggcgcagcaccggtaccagtaccaccgcccatacccgcagcgataaataccatatccgcaccttctagtgcagcgcgtaacgcttcacgatcttcttcggcagcattacggcctacctcagggtttgcacctgcacctaagcctttcgtaatggcattaccgatttggatagtttgtccaactgctgttttacgtaatgcttga

SEQ ID NO: 2760 - DNA, 1695 bp, Proteus mirabilis
gggatttcctcttttatgacatcaccccgcttagagttgcaatttattcgcttatggcaagcttttgagggaaaagagactgaaaccacattacaagagcttgctgaaacattacattgcactcgtcgccatgtgcgttcgttactaaacaaaatgcatcaaactggttggatagattggcaagcagaagtaggaagaggaaaaaaatccaccctgacttttcattctaacgcctttgacatccaacaaagccgagcagagcgattactggaagaaaatgatatagaaaagctcgttgcactgatgggcgataaagactcgttacggcaaatggtgctttcacagattgaaaaaagctttcaccctagccaacaacgtctacgaataatttactatcgcccttttcgtaatttattacccggtactccgcttcggcgctctgaattacatttaatgagccaaatatttaattcattacttcacttaaaagaggaaaatggggaagtcgaagcggaattagcccatcactggcagatgatcagcgagcaacattggcgcttttatttacgccctgctatctattttcaccatggacgagaattaaccatagaggatatcagcacctctttaatgagaatgaaagtctgcaatccactttatgcacatattgagaaaataacctcaccgcaaccttatgttattgatatttatttaaccgtaccggataaacaatttgccaccctattaggtagcccacaagcagcgatcttaccccaagaatggcgaactctcgctaatttttctctgcaccccgttggcacaggggcataccaagtgatgagcaatgatcaacataaactgcaaatcaaagcgtttgatcgctattttggtttacgcgcactattagataacatcgatatttgggtggttcctgaattaaaagacaaaatggtttgctctacccttcatttaaccgatgatgatactcataacaactcactggaaagccgcaaagaggaaggctgttattttttactttacgatagccgctcaacacaatgccaacaacctgagatccgcgaatggcttagtagtgtattaacaccggtgaatatgttggcccattgtgcgccctcttatcaacgccattggtcacctgcttatggtttattgttacactggcaccatagcaaactgatcccaccgcatactaaacccgcttcactcacaaaactgaccattacactgtataaagagcaccacgaatacagcactattgctgaactgatcaaaaaaatcttatctgactatgatatcgaattatctattcaagtgcttgattatgaacagtggtattatggtgatgcaaagagtgatatctggttagctaccgtcaatttctataaaccgctcgagttttctatttttgcagcactttatgaactgcccctatttcaccagtgcatgggtgaacgttatgaagatgccctagccttatggcgtcaaaaagtattaccgcttgaagagtggtgtcgccaattaacacaaaataattggcttttcccgttatttcaccatttacttgaattacaagggcaacgtacgatacgcggtgtaaaaatgaatacctttggttggtttgattttaaatcggcatggtttatacctgatttagaaacgcccccattaaaatag

SEQ ID NO: 2761 - DNA, 768 bp, Proteus mirabilis
cttgtaccctccagggccagcttttataaatattgccaaaatagtcataaggcattggcgttattaatgcgggaagagtcaaacgatcgctcattagcaatgacatcaagtttttcttcaatgatgatggcggcggtcactagctttttaggcgatagtgtatttactgatgctattgcgccgttttttagtgattacaaagcgcaatttgacaaagcaaataaaattatccgccatcaatacgcaggaaaattcaaacgcgttatttatcttggtagcggaggattacaagggctagcacaagaagccgcattaaaaatgttagagctgacggcgggtaaagtcgtagccaattttgataccccattaggctttcgacacgggcctaaatccatcgtaaataaagaaacccttgtggtgatgtttttctctaatgatccttatacacgtcaatacgagacagatttattacgagaggttattcacgataatgcatcaggcaaggtgatcgcgatcaccgcacgaaatgataaaactttttcaccagagagttttgtttatattccagcgttagagaactgttcagatgtggcgctattgttcccttatttgatgttggcgcaatcatttgcatttcacagttctattgcactagggaatacgcctgataatccatctccaaccggagaaatcaatcgagttgtacaaggcgtcacaatttatccgttctcacttaaaacagaagacacacagtctgctttaaattaa

SEQ ID NO: 2762 - DNA, 1335 bp, Proteus mirabilis
tttgctaactccattagcaacaccgccggtgttgattatggagttagtatttacatgcatcctttagaaaagattgttcagcaacataaatcaggcaaacagaatggtatttattctgtttgttctgcccaccctttagtaatagaagctgctttattacaagcgctggacgatgattcctttctgctgattgaagccacctctaatcaggttgatcagtttggtggttatacaggtatgactcccgctgatttctaccaatatgttattgagaaagcggaaaatgtcggttttcctgtcgaaaagcttatccttggtggtgaccatttagggcctaatcgctggcagcatcttaatgctgaagaagcgatggcaaatgcggatgtacttattgcacattatgttgccgcgggatttaaaaaaatccatcttgattgcagtatgtcttgtgcagatgatcctattcctttaacagatgaaatcgtggcatcgcgtgcagctcgtcttgctgttattgcagaaaataccgccaaaaagacatttggttttagtgatattgtttatgttgttggcacagaagtccccgttcctggaggtgctgctgaagagcttgataccgttgaggtgacttcacctgatgctgcccgtaaaacattagcgtgccatcgccaagcattttatgacgctggtgtgggagagtgttggactcgtgttataggtttagttgtacagcctggggttgaatttgatcataccggtattattgattatcaatctgaaaaagcacaagcgttaagccaagtagtaaatgactattctcatctggtttttgaagctcactctacagattatcaaaccaatcaagcttatcagcaactcgtccatgatcactttgctattttaaaagttgggccggcgctaacatttgctatgcgtgaaggtttatatgctctttgcgccattgaagaaacattatttcctcttgaaaagtgctctcgattacgtgaaaaaatggaacaattgatgtgccgtgagcctaatttttggcaaaaatattatcacggtgatgaacgtcaactcgcctttgctcgtgtttatagttttagtgatcgtattcgttattattggcctgatgccgagattaatactgctattgacacattaatggataatttatctgttaagcctattccacttcccttacttagccaatatttgccttatcaatttacccagtttagagaggggaaaattgcgggtacgcctgagtcatttgttattgcgaaaattcgtgatgtgttgtcggtttatgccgatgcgtgcaatgtccattaa

SEQ ID NO: 2763 - DNA, 192 bp, Proteus mirabilis
tatttactatccatatctaatgtgcaagcaggcgaaattacttttcctaaaaactttgctgttccttgccaccaaactttatctgatgggatatatttatccaatacagctccgcttgcatatgttgaaaagattttagtgaaaaataataatattatgatttttttaaacatagattttggccttaaataa

SEQ ID NO: 2764 - DNA, 285 bp, Proteus mirabilis
ttagcgtcatctttggctgtacttgtactctctccggcaagtgcagccaaccgttctaatctttctcttaatttcttcgggcttttctctgccaaatatttcaatgattgtgcactctctacacttaaatggcgtttttttacgggtgttggatcttttaatgatgaagtgacactcttttttcccgcttttatgcttaaagaaggatttattttgatgtctattgaggataacgatggtaaaatttcctttcttaatgcagaaagtaatgatggaatttcataa

SEQ ID NO: 2765 - DNA, 297 bp, Proteus mirabilis
gactctgcatcaaatttaacagatgcagtacttactgttgcagggcaattaattaatttaatcgtaaatttagttgccgcagcagtaactccggcactaggtaatgctgttttagataccttacctaaattaacttttagagcatcagatccagctgctaattcacatgcgttatcgataatttctcctgtaaaatcgattgttccatctgcagctaatgcattattcgcgacaaaaatagacgttgtagcaatcaacattgcaataaagctttttctcatttatttctccaaataa

SEQ ID NO: 2766 - DNA, 1329 bp, Proteus mirabilis
cttgtagcatcgttcacaatgaaattccctggcaaaagaaaatccaaacactattttcccgttagtttacgagatccattattaaaacctatcatcaatatgactgagagcgaatcttctcgggcttatattgttggcatcgaccaaacattagttgatattgaagctaaggtagatgaagcgtttatcaatcgctataacttgagtcagggacactctctggttattgaagatgatgtagcggaagccctttatcgcgaattaacggttaataatcttattacccatgaatttgcgggtggcactattggtaacacactacataactactccgtattagcggatgatcgttctgttttattggggactatgtgcaacaatattcagattggtagttatgcttatcgctacttatgtaatacctcaagccgtactgatttaaactatttacaaggtgttgatggtgcaatagggcgttgctttaccctcattactgaaaatggtgaacgtacttttgctatcagtcctggccaaatgaatcaacttcagcccgaaagtattcctgaggatgtgattgcagatgcatcggcattagttttaactgcttatctcgtccgttgcaaaccgggagagccaatgccgttggcaactatgaaagcgatagaatatgccaaaaagcatgatgtaccggttgtcttaacgttggggactaaatacgtgattgctgacgatcctcagtggtggagagatttcttaaaagagcatgtctcggtagtggcaatgaatgaagatgaagccttagagcttacaggtcatgctgatccattgttagcatcagatgcggctttagagtgggttgatttagtcttatgtaccgcaggccctgcagggttgtatatggcaggttttacagagagtgattttaaacgccaaaccactcatccgttacttccaggtgcaattgctgaatttaatcgttacgagtttagtcgtgctatgcgttttaaagattgccaaacgccggaaaaagtctattcgcatatagagccttatatgggagggccggaaaaaatcatgaataccaatggtgctggcgatgcggcattatctgcactattacatgatattacggcaaatagttatcatcgcattaatgtacctaattcgagtaaacacccacgtagttatttgacttactcttcattggcgcaagtgtgtaaatatgctaaccgtgtaagctatcaagtattaagccaacactcaccacgtttgactcgcggtttgcctgagaaagaagatagcttagaagaagcttactgggaacgttaa

SEQ ID NO: 2767 - DNA, 1239 bp, Proteus mirabilis
ataatggcatcaaatcaacctgctttatttcatatgatggcaaagccgacaagctaccactgtaatattaaatgtgaatattgcttttatctggaaaaagaaaatatttttcaagatgagacaaaagaaacaggccatacagtgatgcctgatggtgtacttcgtcgttatattaaagactatattcagtcacacagtggcgatcaggttgattttgcttggcaaggtggtgaaccaacgcttgcaggattagccttctttgaaaaagtggtcaaataccaaaagcaatttgctaacggcaagacaattaccaatagtgtacaaaccaatgcgattgccattaatcgccaatgggcacaattctttgctgataaccactttctattaggcgtttcaattgatggcattgaagccgttcacgataaatatcgtatttcagtcaatggtagcccaacatttgaacgcgtaaaacgcgccatcaatttactaaatgagtatggtgttgaatttaatacattaaccgttgtaaatgatcaaaactggaataaaggaaaagagacttatcaagctttaaaaaatttaggttcaactttttttcaatttattcccatagtcgaagtggatagacgtttcccacacactcatggcggacattatgctcccggtcctaacgcacaattagcggctttctctgttcccgctgaaggttacggaaaatttatgaccgatatattcaatgaatggatacgccaaggtgatgtaggaaaaatatacattcgcttatttgatagcttattagggacatggatgggatatcctgcatcaacatgtattcaatctaaaacttgtggtcaagcattaattattgaagccaatggtgatgtttactcttgtgatcactatgtttatcccgctaataatttaggcaacatacaactaacaagtcttgcacagctcgcaacatcaaaaacacagcaacgctttggtcaaaataaatacgataaacaaaccaacctttgcaaacagtgtgaagtgcaaagcttatgttatggcggttgtcctaaacatcgcattattgcgatagaaggcgaaaaatatcgccacaattatctatgtcactcttataaaaaaatatttcatcacacggcaatcggcatgcaattaatgcgtcaagcgatagctcgtggaggccttgccagtgatgcacttgaggcgatgcaaaaaaactatctcaagtga

SEQ ID NO: 2768 - DNA, 408 bp, Proteus mirabilis
aatagcgcgtcgcttagcagaaacaaaattacaaccatctttaagcgaggattaagacggatgtttgagcaagtgaacatcatttatggtgaaatagttaagaaaatgactgtaatggtgggagattttagtcaaaaagagatcttatttgcgaaaaatacgatcggtaatttgcttgctcaaagagatgtgggaaaaatttatcagttaaaagtagcgaaatttaaagaaaaactcgctattttgacttttaaggtaaataattctcaacagattgaacaatttagtgatttaattatcaaagctaaaggtatttatagagtatatatatctagtggaagtattaatcgtaggaatatcgtacaaaagaatagccgattctcttatttgaatgttgcgcaggggtga

SEQ ID NO: 2769 - DNA, 537 bp, Proteus mirabilis
tttgtggagtcaaaatctatgcgggatagctacccacaatcattggaaaacatcctaaaagagcttgaaggttccaataaaagcacattacagcttatacaacagcgtgcaacaattttactcaaattaaatcgtaccgtcatggcacttttaccagcaccgttacaaggtaaatgccgtgtcgccaattatcgcaatgctattttaattattgaagtcacaaacgcaagttggatgacccgattacgttatgaaattccatcattactttctgcattaagaaaggaaattttaccatcgttatcctcaatagacatcaaaataaatccttctttaagcataaaagcgggaaaaaagagtgtcacttcatcattaaaagatccaacacccgtaaaaaaacgccatttaagtgtagagagtgcacaatcattgaaatatttggcagagaaaagcccgaagaaattaagagaaagattagaacggttggctgcacttgccggagagagtacaagtacagccaaagatgacgctaattag

SEQ ID NO: 2770 - DNA, 678 bp, Proteus mirabilis
atgagtactcctgcaaatttcaatggtcaacgtccagttattaatccagatgatgctgttatgttattgatcgatcaccaaagtggtttattccaaaccgttggtgatatgccaatgacggaattacgtgctcgtgctgcggtattagcaaaaatggctacattagcgaagatgccagttattacaacggcttctgtccctcaaggtcctaatggcccattaattccagaaattcatcaaaatgcaccacatgctaaatatgttgcccgtaaaggtgaaattaacgcatgggataaccctgagtttgttgaagctgtgaaagcaacgggtaaaaagcaattaattattgctggtactattacgagtgtttgcatggcattcccagcaattagtgctgttgctgaaggttatcaagtttttgctgtgattgatgcatcaggaacgtatagcaaaatggcagaagaaattaccttagcacgtattgttcaagccggtgttgtgcctatggatacggcagcagtggcttctgaaatgcaaaaaacttggaaccgtgcagatgccgctgaatgggctcaagcttatacccaaatattccctgcttatcagttattaattgaaagttatagtaaagctcaagatgttataaagaataatgaaactttagattcacaacgttaa

SEQ ID NO: 2771 - DNA, 2715 bp, Proteus mirabilis
agagttatgttaggtaaaattgtaaccaaaatttttggtagtcgtaatgaacgcgctattcgtcgtatgcgtaaagtggttgctcaaatcaatcaactagagccagaatttgaaaaattaaccgacgatgaattgaaagccaaaacagatgaatttcgtgagcgtttaaaaaaaggtgaaaaagaagaggatattttacctgaagcttttgccactgtacgtgaagcgagtaaacgtgtttttggtatgcgtcactttgacgtacagcttattggcggtatggtactaaatgatcgctgtatcgcagagatgcgtacaggggaaggtaaaaccttaactgcaacactgcctgcttatttaaatgcgctatcaggtaaaggggtgcatgttgttaccgtcaatgactatttggcgcaacgggatgcggaaaataaccgcccactatttgaattcttagggttaagtgttggtatcaacctccctaatatggcaccaccagcaaaacgtgaagcttataacgcagatatcacttacggtacaaataacgaatttggtttcgactatttgcgtgacaatatggcgtttagccccgaagagcgtgtccaacgtaaattacactatgcattagtggatgaggttgactccattttaattgatgaagctcgtactccactgattatttcagggcctgctgaggatagctctgaactttatattaaaatgaataaagttattcctcatttagtgcctcaagaaaaagaagattcagataccttccaaggagaaggggattactctgtcgacgaaaaaacgcgtcaagtgaatattactgagcgtggcttagttaaaattgaagggttattagccgaagcaggtatgatgaaagagggcgagtcactttactcacctgctaacatcatgcttatgcaccatgtaacggcagccttacgtgcccatgcattatttacaaaagatgttgattacattgttaaagatggcgaagttatcattgttgacgaacataccggtcgtaccatgcaaggtcgtcgttggtcggatggtctacaccaagcggtagaagcaaaagaaggtgtgaagatccaaaatgagaaccaaacattagcgtccattacattccagaactatttccgtttatatgagaaattagcggggatgaccggtactgcagataccgaagcttttgaatttaactctatctaccgtttagaaactatcgttattccaactaaccgcccaatggtccgtaaagatttacctgatttagtttatatgaatgaaaaaggtaaatttgccgcgattattgaagatattcgtgaacgtactaaaaatggacaaccggtactggtggggaccatctcgattgaaaaatctgaagagatctcccaagcactcacaaaagcgaatattcatcataatgtcctgaatgccaaattccatgctatggaagcagatatcattgctaatgcggggttaccatcagcggtgactatcgcaactaatatggctggtcgtggtaccgatatcgtattagggggaagttggcagactgaagttgcgaagctggaaaatccaacagaagagcaaattgaagagatcaaagcacaatggcaaaaacgccatgatgcggtattagcttctggtggtttacatattattggtactgaacgccatgaatcacgtcgtatcgataaccagttacgtggtcgtgcggggcgtcaaggggatgagggttcttctcgtttctatctgtcaatggaagactccttaatgcgtatttttgcctctgataaagtatcaggcatgatgcgtaaactgggaatgaacgaaacagaagctattgagcatccatgggtaactaaagcgattgctaatgcacaacgtaaagtagaaaaccgtaacttcgatattcgtaaacaattacttgagtatgatgatgtagccaatgatcagcgtcgagctatttatactcaacgtaatgagttgttagatgttgctgatgtcagtgaaactatcgacagtattcgccaagatgtgtttacttcgatgattgataactatattccacctcaatcattagaagagatgtgggatattgaaggtttaacggcctgtctgcaaaatgactttgatttaaatttacctatcaaagagtggttagataaagagcctgaactacacgaagaaacactgcgcgaacgtattttagaaaaatcaatcgaagtctataaagcaaaagaagagattgtcagtgctgaaatgatgcgtaactttgaaaaaggtgtcatgttacaaacactggattcactgtggaaagagcacttagcggcgatggattatctgcgtcaaggtatccatttacgtggttatgcacaaaaagatccaaaacaagagtacaaacgtgaatcttttgctatgttcgctaatatgttggaatcactgaaatatgaagtgatcagcacattaagtaaagtacaagttcgtttacctgaagaagttgaagagttagagcgtcgtcgtcgtgaagaggcggagcgtttagctaaacagcaacaacttagccatgaagtgacaaaagaatcacaaatgtctgccgttgatggtcaagtggcatcaggcaaaaaagtgggtcgtaacgaaccttgcccttgtggttcaggtaaaaaatataagcattgtcacggtaaattaggttaa

SEQ ID NO: 2772 - DNA, 231 bp, Proteus mirabilis
aggttgtaccctcaaggaatgtttcttcacgtctggcttcatcgggtgctactggtgggattaactttaacttacggaatggataccaatacccagatagcctgtaatatccaatattcattattttctttaccgcctgctcaggaggtagatcctcaaaactcattcctcgtttttctagcttttttatttggtcaaaatacgttagatgaggttttagagggtgcatag

SEQ ID NO: 2773 - DNA, 1224 bp, Proteus mirabilis
gtttgcccgtttagcgcaggagcttggctgatgagtgtatacgcaatgcgaagattaaaacagtggctggtgggaagttatcaaacagataacagcgcgttcgtgccttatgatcgcactttgctctggtttacattcggattagcggttgtcgggtttgtgatggtaacctcggcgtcaatgcctgttggacaacgtttagcagaagatccttttctatttgctaaacgtgacggcatttatatgattgttgccctttgccttgcattagtgacaatgcgagtgccaatggcggtatggcaacgctacagtagcttaatgctgtttggttctatcttgctattactcgtggtattggcagtgggtagctcagtaaatggcgcatcacgttggattgcatttgggcctttacgtattcagccggcagaactttctaaattggcactgttttgttatctctccagttatttggtgagaaaagtagaagaagtgagaaacaatttttggggattctgtaaacctatgggggtgatgttaatattagccgtattactgctattacaacccgacttaggtacggtggtcgtgctgtttgtgaccacattagcgttgctttttttagccggtgcaaaaatttggcaattcctcgccattattggtacaggtattgccgctgttgtgatgttaattattgttgagccttaccgtgtacgacgtatcacttcgttcttagaaccttgggaagatccttttggtagtggttatcagttaacacaatccttgatggcttttggacgcggtgatctactggggcaagggttaggaaattcagtacaaaagttagagtatctacctgaagctcatactgactttattttctccattttagcagaagaacttggttatatcggtgtggttttagtgcttttaatggtattcttcatcgcttttcgtgcgatgcaaattggacgccgtgctttgctgctcgatcaacgtttttcaggttttttagcttgttcgattgggatctggtttaccttccagacgttagtcaacgttggtgcggcagcaggtatgttgccaacaaaagggttaacgttacctcttattagttacggtggttcgagtttgattattatgtcaacggctatcgtgatgttgttacgaattgattatgaatcacgcctagcacaggctcaggcgtttgtaaggagtcctaaatga

SEQ ID NO: 2774 - DNA, 969 bp, Proteus mirabilis
gcgcatcagccgccgcactctacttcttctttagtggtaacaataaaaattcaagtcagcagaatgaggatttcgaagatggtatctgataacagcaccgcattgaaaacgcaggataaaccagaaacaggttctttgattgatggcattgatgagtatcaagatactgctgtcagaaaagttattactaaaggcatactttggaagtgtgcattccgtggcttatttatggaaggtaacttcaactttgaacgtatgcaaggtggtggattcgctttctcaattattccagcattgaagaaaattcacggcaataataaacgcgattatgcaacatcgttgaaaaaccatctgcaattttttaatgccagtccaaagctgtttacctttttattaggaacggcggtggcaatggaagagaacaaagaaaagccatcgactgttaatgtgatgaaagtggcaggaatggggccgactgggggcattggcgatgctatcgaccatatgaccttaatgcctttgaccttagcattaggtgcttctattgcaatggaaggctcgattgcaggacctttcgttttcttcttcttgtatcaagttgtgcattttttagtgtatttcggactgatgtttatgggctatcgcgcaggtactgcggcaatggtcaatatgagcgatgccactgaaaaattagcgaaagcggcaaatattatggggatctttgttattggtgcgctctcggcgacctttatcaaagtgcaaaccaccgcctcgctggaacttggcggaaaagtcgttgaattacaaacagccctcttcgacaaaattatgccgaatttactgccactgtgcttagttttcttaatgtacaaaatggtgaaaagtaccggtttttggggtaagccaccggtattgattttttcaaccctagcatttggcgttattgggcatgtattaggattcttataa

SEQ ID NO: 2775 - DNA, 2652 bp, Proteus mirabilis
tcaacttctacaatggtgtttgcctttattgttaagcaaaaaaggatagccacaatgtcaaccatcgattatccagagaaaaaagcgtcccgctcgataaggcaacaggctactatgcagtcgcatatcttaacccgttattacaaattttatcgtcataatggggcttcattcagtgcggctatcgtgaatgagcttttctgggtattaatgtggctctttttgcgtatggaatcccctttttggcagaaaatagcacaaaaacaacaacaactatttcctcatattaatccgcgtcgccctaaattatgcgatccgatccgatacttattacaaagtatttggcttatttgccattacttgatgctcaccttggtgaaaaaaccgattcaatttattgtctatattagacagtattatcaaaatctctttgctcgcttatctcctgttgcgcgagatatgatccatcataagaaaacaaacacgccactatggcaatacgctctattatcgctcgttgctgtttttgccatttttattatcttattaagtattactcaaccttttgatttaaaactacaatttgtttttgttctcgtgatttggctgatagccttagctatccgcgatatccctagacgactgtcttctattaccattattattttatcgctgactattgcttgccgatatatttggtggcgctatcaatacacactctactgggtggataatctgagccttttctttgggatcttactattactggctgaaacctatgcatggattgtgttatttcttagttttatgcaatgtatttggccactccatcgacaacctatttcaatgcctcaagatacaacacaatggcctactgtcgatatttttattcccacatataacgaagcgctacaagttgtaaaaccaacactttatgcctgtttaaacattgattggcctaaagataaattaactatctatttattagatgatggctctcgccctgagtttgcggcttttgctaaagaaattggtattcggtatatcactcgcgaaaaacatgattttgccaaagccggtaatatcaaccatgcattgagcaaagcctgcggagaatatgtggctatttttgactgtgaccatattccgacgcgctcattcttacaatttactatgggctggttcctaaaagacgaaaaaatggcattggtacaaacaccacaccactttttctctcctgatccctttgaacgtaatttaggcaatttccgcgaaacaccgaatgaaggcacgcttttttatggattagtgcaagatggtaatgatacttggaatgcagcttttttctgcggctcctgtgctgtattacgtcgttgtgctttagatgaaattggcgggctggcagttgaaactgtgaccgaagacgcacatacctcattacgcttacatcgtcatggttggacttctgcttatattcgtatccctcttgccgcaggattagcaacaggatcactttcagcacatattggccaacgcatacgttgggcaaaaggaatgatacaaatatttcgtttagataacccgctctttggcaaagggctgacactgccacagcgcttttgttacctcaatgccatgttgcactttttatcaggcataccaaggatgatcttcttattagcaccactaacgttccttatctttcatgcctatattatttacgcacccgccatcgctatcgctttgtatgtcgtgccttatttattacacatttggttagccgcgaccaaattacaaggtccttatcgccactcattttggggagagatttatgaaacgattttagcttggtacaccactcgtcccgtattaagcaccctattctcaccttataaaggtaaatttaatgtcacagagaaaggggcaattatgaagaaaagttttgtcgattggcaaattaatcgcccctatattctgtttcttaatcttaatttgctaggaattctatttgctttctggcgtatcgcaacaggcgatcccgatgaaaggttagccgtactcatgtgcttagtttgggtatgctataacttagtattactaggtgttgccattgctgtttctgtagaagcaaagcaagagcgacagttcccacgggtacgtctaaaagtgcccgcaatactattactccaagacggttcgctttattcttgtcagctcaatgacttctctgataatggctgtgccattgtattaccagataattttacagttcccttatcttgtcaccaagagatcaccgttattctcaaacaaaatcaacgtgaatatgcttttgaagcacgtattttacggattgataatcgcattattggcttacaactgcttaatatggatacacaaaaatccattgattttaccgcctgtacttttgaacgagccgacacttgggctaattggcaacacgctctccctgccgataatccactgaatagtttaagaaatatcatttatatcagtatgcgtggctataacaccttacttaaacgcgccccgtatcttgtttacctcttatttcgtttattagggcagtgtttattgtggctattatcgctacttccacgacgtgtcaatgtttcacaaatatttcattaa

SEQ ID NO: 2776 - DNA, 240 bp, Proteus mirabilis
atggcccctacaggattcaatataaagacgtattatattgattataaacatcttaatttcattcaattttgtatcatgcccccaattatgccccctttttattttgttactcacaaattgagaaatttagattttagtttttccaaaaccacttgtattgcaaaaatatcatcaatagcatttatagttgcaaataatgaaatattttatcgcgctcagctaattttctatgcacaatag

SEQ ID NO: 2777 - DNA, 324 bp, Proteus mirabilis
aatggaactaccagtcagacggttttaccgagtcgaggggctttagtaaaagcgaatttttcagcaaatgtaggctatcgtgtattaatgacgataaatttggaaaacaaaaagccagtaccatttggcgctcaagctatttttaaagacaatagtcagttaaatagtattgtaggtaatgatggagaagtttatttatcagggctaaaacagaaaggaaactttactattaaatacaacaatgaaagctgtcaggtaaattatgatctatctgatattccagattatttagggctctataaaactactgtaacttgctattaa

SEQ ID NO: 2778 - DNA, 1044 bp, Proteus mirabilis
caaacagagttcactattttcctttactcttttacttttggttatgttaataaaacagctctaaggagtcttggtatgaatgatgctaaatacggcgttcttttggtcaatcttggcacccctgatgcacctcaaccagatgcagtgaagcgctatttagctcagtttcttagcgatcctcgcgttgttgatgtttccccgtggatttggaaacctattcttcatggggttattttgccatttcgctcacctaaagtagccaaattataccaacaaatttggttgccagacggctctcctcttttagtctatagccgtgcacagcaaaaagcgttagcacaacgttttgcgcatatacctgttgaattaggtatgtgttacggcaatccttccctcaacgaaggactgacgcgattattggcacagggcgttgaaaagctaattgtattacctctctatccacaatactcttgttcgacatcgggggcggtatttgatggtattagccaactgtttaaaacgatgcgaactattccttcactgcattttgttcgtagttatgctcaacatccactttatattaaagcgctggcaaatagcattgacgagagtttcaagcaacatggtaagccggatcgtttagtactttcatttcatggcattcctgaacgatttattaaaactggggatatctattttgatgaatgttgccttacagtagaaaaattaaaacagcaacttgattatccagcagaaaaagtgatgatgactttccagtcacgttttggtcgtgagccttggttatcaccttatactgataaaacgatggaaaaactgggtagtgaaggggttgaacatgtacaggttatttgtcccggattttcatcagactgtttagaaacattagaagaaattaatgaacagaaccgtgagttctttatacatggtggtggaaaacagtatgaatacattcctgctttgaatgataaagttgagcatattgacttacttgaagctataatccgcgacatatgtgaaaaataa

SEQ ID NO: 2779 - DNA, 1467 bp, Proteus mirabilis
atagtgaatacacaacagctggcgaaattaagatcttttgtgcctgagatgagaaaagttaggcatatccactttgttggcattggtggtgccggcatgggcgggatcgccgaagtgttggctaatgaaggttatgcaatcagtggttctgatttagcgcctaatgtagtcacacaacaactcgttgcattaggggcgacaatctattttaatcatcgccctgaaaatattcgtgatgctagtgttgtggtggtttctaccgcaattagtgcagataatccggaaattattgcagcaagagaagcgcgtattcctgtgatacgtcgtgcagaaatgttagcggagttaatgcgttatcgtcatggggttgcgattgctggaacccacggtaaaacaacaacaacggcgatgatttcgaacatttatgcacaagcaggattagatccaacttttgttaatggcggtttagtgaaatcagcaggtacccatgctcgtttaggttgtagtcgctatttaattgcagaagcggatgagagtgatgcttctttcttacatcttcaacctatggttgcggtggtaacgaatattgaagctgaccatatggacacttatcacggtaattttgataatttaaaagagacttttattacttttttacacaacttaccgttttatggtcgcgcagtgatgtgtattgatgacgatgttattcggtcaattattcctaaagtagggcgttatattactacctatggttttagtgaagatgctgatgtacgcattactcattacgaacaaaaaggtgcgcaaggatttttcactatttctcgtgaagatatgcctgatatagatgtggtattaaatgcgccgggacgccataacgccttaaatgcaaccgcagccgtggctgttgccacagaagaagggattgcggatgagcatattttagccgcactacttaatttccaaggtactgggcgtcgtttcgatttcttgggaaatttcagtcttgagcatgtgaatggccaagaaggggaagtcatgctggtggatgattatggacatcacccaacagaagttgatgcaacgataaaagcggcacgagcaggttggcctgataaacgtttagtgatgttatttcaaccgcatcgttatacacgtactcgtgatttatatgaagattttgcaacggtgcttaatcaagttgatattttattattaaccgatgtttatgcagcaggagaggcgcctattcccggtgcagatagtcgttcactgtgtcgtactattcgtcaacgtggcaaactagatccgatttgggtttctgatgtcgagaacatctcctcaatattagcgggtgtattaacagataatgatcttgttttagttcaaggtgctggaaatattggtaaaatagcgcgtcgcttagcagaaacaaaattacaaccatctttaagcgaggattaa

SEQ ID NO: 2780 - DNA, 807 bp, Proteus mirabilis
atcttttggtttcgtaaggagacgaaagtgaaagcggcagttgagaggcgtatggaaatcctcgatatggttaaccaacagggcaaaaccagagtcgaagatctcgctgaattatttaaagtctcaagtgtcactatccgcagcgatctaagttttcttgagaaaaatggctatatcgttcgctctcatggcgcagcaattcctaatacaggctttattgctgaactgagtatccatgaaaaacgtggacaaaatgcgggcattaaaacattaatcgggaaagctgccgcaacgctgataaaggatggagacaccgtcattcttgactcggggacaactacacgcgaaatcgcgacacatttaaagtcgcgcgaaaatgtagtcgtcatgactaacggtctggatgtcgcaatggagttagcaaataccacaggtgttgaagttttaatgacaggtggtgtattgcgaaaaagtgcattgtctttttctggctcacaagctgaaaatagtctaagaaattaccgtttcgataaggtttttcttggtgttgacggatttgatttacgtgttggtatcactactcacaatgaacaggaagccagtcttaaccgtttaatgtgtgatatctcagaaacgattattgcggttgcagattctacgaaattcggtaaacgcagctgtcatatgatcagagagtttggtgatattgatgtgttagtgacggattcaggtattcctgatgagtatgttcaggaactgaaagatcataaaatcgacgttatcattgtggacgataagacagcgtaa

SEQ ID NO: 2781 - DNA, 1209 bp, Proteus mirabilis
tatcgtcggttcatccgccaacgccatgatgcatgttatcaacagtatttggcgttcagagcaagtcgaaatagaaaaacgcaaacaccatacaacacaagaagcggtttaatcattatgtctaaacattatcatattgcagtattgcccggagatggcattggccctgaagttatggcgcaagcacaaaaagtgatcgatgcggtaaataaacgattttcactgaatatcacgaccaaagagtacgatattggtggtattgctatcgataatcatggcacaccattaccggcaaccaccttggctggatgtgagcaagctgatgcgattttattcggctctgtgggggggcctaaatgggagcatttaccggcagatcaacaaccggaacgtggcgcattattacctttacgcaaacactttaaattattctgcaatctgcgcccagctcgtttatatacaggtttagaagcttattgtccattgcgtgctgatattgcacaacgcggttttgatattttatgtgttcgtgaattaactggggggatctatttcggtcaacctaaaggccgtgatggtgaaggtcgcgaagagcgtgcttttgataccgaggtttaccatcgctatgaaatcgaacgtattgctcattttgctttcaaatcagcgcaaaaacgtcgttataaagtcacgtcgattgataaagccaacgttttacaaagctctattttatggcgtgaagtcgtcactgaggtcgctaagcaataccctgatgtgaccttgcaacatatgtatatcgataatgcgacaatgcaattaattaaagatccagcgcaatttgatgtattgctgtgctccaatatctttggcgatattttatcagacgaatgcgccatgatcaccggttcaatgggcatgttgccctctgcaagcgtaaatgaagcacattttggtttatatgaacccgcaggtggctccgcaccagatattgccggtaaaaatatcgccaatccaatagcacaaattttatcaaccgccctattactgcgttatagctttaatgaagataaagcagcccaagccattgaagaagcaattacaagagtactagcaacaggctatcgcaccgcagatttagcgggagaaggaaacgcaataacaaccgcagaaatgggtgatcatatcgctcagtttattcaagaaggggcataa

SEQ ID NO: 2782 - DNA, 1038 bp, Proteus mirabilis
gtgaataacactgaactcgttgatatttcaacatttgaagaatttgaaagttatgtaaatcaagctattgcagacccagagtttagcttggatataactaacttaaagtttagcatatttgatgcctttaaaatgaagatagaaggggatgattcaaagtattatggtggagtaaacacaactttagcccaaggtatgagtgattttcaggtagagttaaacaaaatctttgctatcattcgatacaacaccgataatctacagaggttatcttcacaagataagaaagacctagagcttacttttctagttaatgctgggtgtactgaaatattaactagcctgactgaatttgtaaaatcaataggagatgctggagcaaaggtcatgaatggaatgactccaaaccaaaaaacactttgtgttttatttactgtcgctgtaattggcggaggatggggtatttctaattatgctaacaatgttcatgatgaaaatatggctcagatacaatctcaacagtcagcatctgagaggcagtctgaattagatagattacaacttcttaaagatgggatgttggacgctattaatgccactagcaatacagaattgaaggaaaagtcggttggaatagaaaaccatggagctaaggcatatacggatataataaaatcagctagtgatgcagataacataaccatcagtgggttaacaaatatttcgctggaccaacaaggcatacaaaatgtaatcaaaaaccctatagaaaagcttgaaaacaaggaagatactatagaagttgaaatagaaagtatcaagagaaacgcagatagcttgtcagtggcatgtagaatacctggtatggattatgtgttttcaataagtgttaatactggttttatagatagggatgagacagatttattatttgatgcgatgaaagagtcaaaaactgtaaaaatattaggtaattataaaacaagaggcggagtgattgaaaaggggaatgcttcatcaatcattatatctaattaa

SEQ ID NO: 2783 - DNA, 561 bp, Proteus mirabilis
aatttgaggtttcttatgaataaaagtaaatattttatactgcctatttttttatatttactatcaggaactgcacgggcagttgatataaatatagctattacaggcgctatttatgttccaccttgtgttgttaataataatatccctatacagttttcttttaatcaaataatgacttataaagtcgatggtcaaacaagcgctatcacaaaaaatattcctattacatgtacttattttaagggctcaccttacgtcaaagtatctggcattcagttagctggagcgcctgataatgtgcttaaagtttccgcagatagcgtgaattcaaatcgatttggccttgccttatatcaaggagagagtgttgatgagaataatcctttgcgtttgaatggttcagcccctcgaggttatgccattacaaaaggtttttctaatacagggcaagacaggagccaatttactattactgctgttccttttaaaacaggtactgctgatttatctcctggaaattttacggcctccgcatcattaagcattgtttataactaa

SEQ ID NO: 2784 - DNA, 1050 bp, Proteus mirabilis
gccaaaataacagcgattgacagcataaaaaatacccactattgcactgtgataggtatccatcacacaaaaatagattatttttaccatacacattatgtgacttttacctctttcaccatcaggaaaaagaatatgttagatcaagagatgatccgtacttttattcaagtagcagattgccaaagctttactaaagcggcggagatgttacacaaaacatctgcggccatcagctatcggatcaaaaccctagaagagaatattggtacacagttgtttaatcgtacgacaagaaccgtcacattaacgccggcaggagaatatttattagaaaaatgtcgccagtggattgtttggcttgaatcaatgcctatcgagctacagcagatgaatgcgggagttgagcaccaagttaatattgttattaataacttactctatgatcgtaccgccgtggccagtatgttagcctgcctgcaccagcgttttccttctacccaatttcatattactcgacaagtttatatgggagtatgggacgcgttaattaatgaagattaccattttgccattggtgtcacaggtaatgaatcactgaaaaataatattaatatttgtgctatgggggaaattcaatggcaatttgtcgtggcaccaaatcatccattagccaatgttagtggggtattaagtgatgatcaaatgcggatatactctgccgtcaatgttgaagatacttcacgccatctttccaaacgtaccgcttggcgtctatctggacaacatgaaattaaagtacctgatttacatacaaaactagcatgtcatttaaaaggagtcgggatcggttttttaccattaagtctatgtaagccactgattgatagtggacaacttattgcaaaggaagtgaaaaatcgtcgccataattctcccctatcattagcttggtgcgaagataaaaaaggtgccgttgtcagctatctggttgatttgttccgacaagggcatcccagtgtgcaatctttttacgatccccttaactaa

SEQ ID NO: 2785 - DNA, 972 bp, Proteus mirabilis
acaaactcaacatacctctgccatccactcatctttggttcattttgcctaaacgaggttgttatgaatgaaacacaattaacccatcttcagcaattagaagcagaaagcatttatatactgcgtgaagttgtcgctgaatttgaaaatcccgtcatgctttactcaataggcaaagattcttcggtgatgttgcatctagcacgtaaggctttttatccggcgaaattaccttttcctcttttacatgttgatacgggttggaaatttcgtgagatgtatgagtttcgcgataaaacggccaaagagtatggttttgatctcaaagtttatcgtaatccccaaggggcacaattggggatcaatccctttattcatggtagcgccaagcatacagatatcatgaaaacagaaggtcttaagcaagctctggataaatatggttttgatgccgcatttggtggggcgcgtcgtgatgaagaaaaatcgcgtgctaaagagcgtatttactcatttagagatagatctcatcgttgggatccgaaaaatcaacgtccagaattatggcaaaactacaacggccaaattaataaaggggaaagtattcgcgtttttccattatcaaattggacggagctagatatttggcaatatatctatttagaaaatatcgatattgtgccgctctatttcgctaaacaccgtccagttattgagcgggatggtaccttaattatggttgacgatgatcgaatcgacctaaaagctggagaggtgatcacacaacaaaaagtacgctttagaacattaggttgctggccattaacgggtgctattccttcacaagcagacacattacccgccattattgaagagatgttaatttccaccagtagcgagcgacaagggcgtttaattgacagtgatcagtctgcttcaatggaacttaaaaaacgtcagggttatttttaa

SEQ ID NO: 2786 - DNA, 2625 bp, Proteus mirabilis
agtttaacaaccaacactcacaaacgagataaacttcaatacgttaagaaagacgacaccatgactgacagccaaaatttcgaatcccacacccccatgatgcagcagtatcttaagcttaaggcagagcacccagaaatcttactgttttatcgtatgggtgacttttatgaactgttttttgatgatgctaaaaaagcctcacgcttattagatatttcattaacaaaacgaggtcagtcggcaggtcaacctattcctatggctggcgttcctcatcatgcggttgaaaattatctggctaaattagtgcaattgggggaatccgttgccatctgtgaacaaattggtgatccggccaccagcaaaggccctgttgaacgtaaagtgatccgtattgtcacaccgggcaccgttacggacgaagcgctacttgaagagcgccaagacaatctattagccgctatctggcaagataaaaatggcgcttttggttatgccactttagatatcacctctggacgttttcgggtcactgaaatgccggatagcgaaagtatggcagctgaactgcaacgcactcacccagcagaactactctatccagaaacctttgagtcaatggcattaattgagcgtcagcaaggtttacgccgacgtccaatttgggagtttgagtgtgaaaccgccaaacaacaacttaatttacagtttggaacccgtgatttaactggatttggtgttgaaaatgcccgacttgcactttgtgccgcaggttgcttattacaatatgttaaagatacgcaacgcactgcgttgcctcatattcgtagcattaccatggagcgtccgcaagataccattatcttagatgcagccactcgccgtaatttagaattaacccaaaatcttgctggcggttgtgataacaccttggcatctgtacttgatctgtgcgtgaccccaatgggaagccgcatgctcaaacgttggatacacacccctttacgccagcgtgaacaattaattaaacgccaagatgcgattagcgccttacaacccctctattttgagttacagccttttttacgtcaggtgggtgatttagagcgggtacttgctcgtttagcattgcgatccgctcgtcctcgtgacttatcacgcatgcgccatgcctttcaacaatatcaagatatccaccaagtgcttgatcaggcggatatgccctatattaaagaattacagcagcgtatcagccagtttgatgagttgcgtgaattactggaaaatgccattgttgaaacaccacccgtattagtacgcgatgggggtgtgatagcccctggttataatgcagaattagatgaatggcgagcattggctgacggtgcgagtgactatcttgaaaagcttgaagttcgtgaacgtgaaaaatggggtattgataccttaaaggttggctttaatggggttcatggttactacatacaagtcagtcgtggccaaagcaatttagtcccaatgcactatgtgcgtcgtcaaacactgaaaaatgctgaacgctatattattcctgaactaaaagagtatgaagacaaggtattaacctctaaaggtaaagcattagcaattgaaaaaatgctctacgaagagcttttcgaaaaactattacctcatctaaccgccttacaaaccagtgctgaagcgttagctgaaaccgatgttctggctaatctcgctgagcgtgcagaatcactcaattatacacgccctgaattaacagaaaaaacaggtattcaaatcactggtggacgtcaccctgttgtagaacaagtactgagtgagccatttatctcaaaccctctacaactcgcgcctcaacgccgtctactcattattaccggccctaatatgggcggtaaaagtacctatatgcgtcaagcggcattaattacgctactggcttatattggtagttttgtgcccgcagaaaaagcggtaataggcccaattgatcgtatttttacccgcgtgggtgcctctgacgatctggcttcgggtcgttcaacatttatggtggaaatgacagaaaccgcaaatatccttcataatgccactgaaaacagtttagtgttaatggatgaaattggccgaggcacttctacttatgatgggctttctctcgcttgggcttgtgccgaaaatttagcgaatcgcattaaagcgatgacactctttgccacacactattttgaattaacgacactgccagaaaaactagaaggcactgccaatattcacttagatgcagtagagcatggagaaactattgcctttatgcacagtgttcaagaaggtgcggccagtaaaagttatggtttagcggttgcggcattagccggtgtgccaaaagaggtgatccgccgtgcaaagcagaaattaaaagagttggaaaccctatctggtcattcaggggcaagccatgtagaaacgtcacaactgatgttattagcagatattgagccttctgaagttgaattagcattaaataaaattgatccggattcattaacaccaaaacaagcgttggaattgctctatcacttaaaagagctaaataaataa

SEQ ID NO: 2787 - DNA, 951 bp, Proteus mirabilis
ataatgacaacgaataattttagccataccagtgtattactggatgaagcagtaaacggcctgaatattaaaccttcaggtatttatattgacggtacttttggccgtggtgggcactctcgtctgattttatcgcaattaggtgaacaaggccgtctaattgcgattgatagagatccacaagctatcgcagtggcaaatgaaattgatgatccacgattctctattattcatgggcctttttcaaatattgaacaatatatcaatgagttaggtttaagtggcaaagttgatggcgtattattagatttaggcgtttcttcaccgcaattagatgatcctgaacgaggattctcttttatgcgtgatgggccactcgatatgcgtatggacccaacaacaggacaatcagctgcacagtggttaatgaatgccgaagaagatgatattacttgggtgctaaaaaccttcggtgaagagcgtttcgcgaaacgcattgcccgtgccattgtggcgcgtaataaaactgaagagccattaacacgtactaaacagttagcggatttgattagtgaagcaagtccagtaaaagagcgacataagcaccctgcaacacgtagctttcaagcgatccgtatctatatcaatagcgagttagatgagattgaaaaagcattaaaaggtgccgtgtctattttagcgccagcagggcgtttatctgtgattagtttccactctttagaagaccgattagttaaacgctttataagagatgaaagtaaagggcctgttgttccagcggggatcccattaacagaagaacaaattaaagcactaggaagtgctcgcctgagtagcattcataaaatgaaacctaccggtgttgaagttgaggagaatccacgagcgcgaagttctgttttacgcgtcgcacagcgtattgaggaataa

SEQ ID NO: 2788 - DNA, 237 bp, Proteus mirabilis
ggcttaaaaacgcaaaaacccatttgtagacaaaaaatacttttcatctacaaatgggttttgtgtagtaagccaggtactattacaatccctacgtttactaggacgttaacatgggatatttatatcgtcaaacttagcacagtaaagttagtaatagatcacatatttatccgacttattaaaaaaagattgtttaaggtaagaacgataccggctgatggctttatattttaa

SEQ ID NO: 2789 - DNA, 744 bp, Proteus mirabilis
atgagaaaaactatgccactaatcgtattaaaagggctcagaggtggagtaggaaccacctcaataaccgttgcactggctcgccaatttcatcaccataaatacaatgtcattgttatcgataactgtgtgaataatatcttacatttctattttccagaaaaatcacaagtcaccacattaggacaagcactactcgcgcataccccaatagaacaagcgatttgtgattatcaaaacggttatcaaattttaccttttggagtcgttaattcagaagataaattgcatttgcaagcatctgccactgccaaccaacatctgcagcatttttttaccgcttttactcaacaatacccagacactttaatttttctcgatttacaaccagagcacgataccctttttaaatcatgggttgcgaaagccaatatcgtattaaccgttaccacacctgaaagtaactgtcatattcggcttaaccaacatacctttgctgccaatgagtatattctggtgaatcaattttgtgccactagccaaatccatcaagatttttatcaattttggcaaaccagtcagtttcctttctgcccaataaaacttcatcgcgatgaagcattattagaagcctgtgcttcacgcttacctttatatgattaccgcgctaattgcatgttagttgaagaaattaatcaacttctacaatggtgtttgcctttattgttaagcaaaaaaggatag

SEQ ID NO: 2790 - DNA, 216 bp, Proteus mirabilis
tcaatggaaacatttcaattagatggtcacccctatgtagaactgtgtgatctattaaaactccaaggctggacagaaagcggagccgctgcaaaaaatattattgctgaaggcctcgtttgcgttgatggtgaagtagaaacacgtaaacgctgtaaaattactgccggtaaagtcgtcacactcggtgagtttgctgtcactgtcagcaactag

SEQ ID NO: 2791 - DNA, 504 bp, Proteus mirabilis
ttgagggaaaccatggaatatttaagctatcaaaccgctgaacttgagcagttaaacgcattttggacagcgaaagaaattgaccagcaaccagagtgctggaaaaaaacatggctatcaattcgagaaaaacgtgctgatattgagtcttttttagaaaaagcattggaggcatcaaatagcagaataattcttacgggagctggaacatccgcgtttgccggtagagcgttagcacctattttgacgggagctataaaacgtcgtgttgatgctattgccacaacggatttagtcgctgatcctcaagaatatttagccgaagatatccctacattactgatttcttttgctcgttcagggaatagccccgaaagtgtggctgcgttagatattgcaaagaagtgcttatcgcaatgttaccccttagtttttaacttgtaccctccagggccagcttttataaatattgccaaaatagtcataaggcattggcgttattaa

SEQ ID NO: 2792 - DNA, 471 bp, Proteus mirabilis
cgattaatgactagaccaatattgaccctgaaaaagaaatcaatggcagcagaaccactagctagagaagcaacaaaaagcgcacggactaaaaggtcacaggaagcctcaaagcaatcgaagaagaaaaataaggcagatgctcacgctaaaaagaaacaataccgtatcgaccgtatagcgaagcactggacgatatttaatgaaccagaggctaaaccactgatgataggcatcaaggaagtcatgattgctgaggttaaagataaagggttggatattccagagagccatattaaacagggattacgatcatacattagtcgtaaaacctatctaaaagctcttactctgggcggtaatcgttttgatatgaacgggcgtcctaaaggagaaatcacacctcaacaacaagcattagcaaaacaaatgctggtggaatgggctaaaaaaaagcaacagcacaaatag

SEQ ID NO: 2793 - DNA, 1020 bp, Proteus mirabilis
atgaataagacattaataggaatagctttattttctttagccacaccatatgcggtaggctggcaacaaaattttttgcatgtaccgtcaaatggtagtactgcatcagcaacagcccctgcgcttaatgtgacagatgctaacgccagtggtgtaattaaggtgaccatacctcaggttaaagggtggcgggttatcgcttcttactgtagtggttcaggctcaatggcagaagaaggaaattaccgctattggattagattgccacaaacaaatacttggcaaaaacattcatcaggattgagctattatttgtccaatctctcttggacactagcaggtaccaataataacaataatcaggtttatgtagggccaaattattatgctaagcagtcaccgagtggttgccatagtgttggaaccgtttggggattaggttctgcagtgcttccgttagatcgttctatgtcattaactgtggcagtgtccagagcgacggcttatccgggatcatataatttaaatattccttttgcatgggcttatgaagaaaataaagggtctggtggtaacagtacgggttatcttcaatttggtaatgcaatgaagccttatatgaatagttatattaatattcctgtgagtatcacaagtaaatgtaatattaaaaaccaagttattaacttatctcatggaaatatgaccccagaagaatctattaacaatgtgacgccaccttataactatcaactaacgtgtgattatgatgcatcagtatccgtttcattaataggaagtgcacctgtttctggaaaaacggaaaactatacaaaatgtggtaatagtggctcttgtgagttgaaatataacgataccgaatataaaggtaaatttaaacttaacgcaggtgctgcaaaaacattttctatcacatcaacctttcatcctaatgatataagaaaccctgttgaaggtagttttcaaggaagtgctattttgcgggtattggttgactga

SEQ ID NO: 2794 - DNA, 1707 bp, Proteus mirabilis
gccacttatttttatactttatatttttataaggactttttaatgaattataataaattatttcttatttctttctctttaatttattctgcaaatgttttttctaatactgatagcccattaccaacagataatccttcacaattaggaaatggttctatggtagaatcaaatataggtattccctcaacatcaacaactcatctaccacaaccaccattaatgggtaatcgcgcaccagtaattagcccaagcccattaccaacagataacccttcacaattaggaaatggttctatggtagaatcaagtgtagatattcccccaacatcaaccactcatctgccacaaccaccattaatgcctcatctaccgcaaccaccattaatgcgtgatcgcgcaccaacaataggtaatacatcaggatatatgtcacgatttccgtatacatttatcaatccaattacccgttatgaaatgccatatataggacaaaaatctataaataatattcataaagatgattatataacaacaaaagcatactttgacatgtctgattcttctatgggttattataattacattataggtcaatacattgaatcctatcttaatatttctaatccttctacaccatctgaaaatattgtagtcagacttgctcaacctttttttgaccatatgcgtaaatcattgtctgaagcaatacatgttgattctaatgaagtaggaagtatgttacgtgatatcgataaaaataaaaaggatatcgctcgtgctctgttttcttatttagaaaatgtaaaaaatgaccttgaaagaacaatgaataatggagatactagtgagccagaactagcaaagatagcattattagataagataaaaaaatttaaaaatattgttgacgaaaatataaaaaatggtacctcttttattattgttgaaaatcaagaaacagcagaaccattaactgaaatcgaaaagattattgggcgattatcgcaaccagcaacacaaggtgaggttgctaatgcatatatttcattatcaagagtaatagaagacgaagttagaatgatagcgaatcaacaaaaaataactgctaacacattaacttcacaggataataaaattactaaagtagaaagtgatgtgaaaaaaaatgaaggtaatatagctgttaatagagaaggtattactaaagtagaaagtgatgtagaaaaaaataaagaggatatacaaacaaatagagaaaatattaatcaagttaaacaaactgctgacaaaaacaaaatatacgtagataaatacctagctaataatttcgatgttaatgagcaatctaaaagtttagtaggtcatcttggctctttatatgcaggaaataagtcaaacacagataatattaatgccattaaaaatgatcttagccattttaaaaatgaaaccaataatcgtttctataaagttgaaaagcgcgctaatcaagggattgcttctgttgcagcgatgagtaatttaccttttaatgatgcagcaacctttagcaccgcaatgggtatcggtaattatcgtaatgccacagcatttgcatggggaatgcaataccgtatcaacgaaaatgttaaagttaaagcctcaaccgcttggaatgacgctaacaattgggtctctgcgggggggatcggtattagttggtaa

SEQ ID NO: 2795 - DNA, 246 bp, Proteus mirabilis
atttgcgatgcagggttatcaccgactaaaataaccgctaaacccggtgcacgttttcctatcttaatacgttgttttactttttctgccacttcacttctgatggtccgcgcaatcgttttcccatctataattcttgctgacatctatacatccaaattattcaattatggtattgctctattttgtcagatcataagcaatctgtcagttgattacttaccatattttaaccatctagtttga

SEQ ID NO: 2796 - DNA, 534 bp, Proteus mirabilis
aaaagagatgccctaattgtcgacactgttaatcgaaatacattattaacttgctacaaacgggtagtagagctatctgctactcgcaaggagttactcatgataggtcttattgtctcaggacatcttaattttgctacaggtatggcatccgctgtaaaggcgattgctggtgagcaagaaaatatcgcgtttattgattttattgagtcaatttctccggatgagcttgaacaaaaaatgcgtgaagcgattaacgctatgtcatgccagcaatatctcttcttaacagatttacctggcggtaccccctgtaatcgcgcaatggcaatcatgatgcaaaatccctctgttgaggtgttagctggggttaatttacccatgattgttaatgcggcatttgaacgggaagggtgttcaacgacggaattggtgcaaacgctacgcgaaattggtcaagacagcattcaagatattcgagagcaattggcacaaatagatagtcatgatgttgaagaagaagacggcttatga

SEQ ID NO: 2797 - DNA, 192 bp, Proteus mirabilis
catattctttttcctgatggtgaaagaggtaaaagtcacataatgtgtatggtaaaaataatctatttttgtgtgatggatacctatcacagtgcaatagtgggtattttttatgctgtcaatcgctgttattttggcttatttgttattatatgttgtataaaatttttgttatttatagataagcgataa

SEQ ID NO: 2798 - DNA, 219 bp, Proteus mirabilis
acaagcctcgcagctacacattcaggatatgggagattatcgctcatgagaacgtttctaattgcaggttatggcacaacactaaaaggcctaacactaggcattaacaagcaagtgatatctgccagcctaaaagatgctcagtcacaagtggtgcgagaggcgcaacgtgacggtttaattgatatccgaatcaactatgtgcgtgaggtgaagtaa

SEQ ID NO: 2799 - DNA, 672 bp, Proteus mirabilis
gacggatacgcattttatgctgagagcagtcaaccgcttagtgtgtgctcaaggaaaagaaatcacaaggttggtggaggtgatgaaatgagacaagtcactatcaatgccaccagcttaagcccattcatgtatcaaggtaagcgagttgtcacctttgccatgattgacgaggtacaccaacgcccgaaaggtacagcaaagcgcacattcaacacgcataaaaagcactttattgatggagtggattattttttgctcactaagtacgtcatacgtaccgagttacccgaactggaaatagctggaaaagcaaaagagttaatgcttatcactgaatcaggttacttgatgatagccaagccatttacagatgatttgtcgtggcaggttcagcgctcaatggttaacagctactttcgtttgtctgacttcccagaaattaaacacattcagataccctcattgacagagcttgaagccatgccaattggtgaggctcagaacttgattagccgcttagaggctgattcttatcaagggcacggtaggcgtggcagctatgccatgaacctacgtcgcaaagagaagaaagcacttaaaccaatggtaatcgccattgaacaagcctcgcagctacacattcaggatatgggagattatcgctcatga

SEQ ID NO: 2800 - DNA, 363 bp, Proteus mirabilis
tatatctgcgcgcttttgtggcgcagatgggagagttgtgggatgattagcccattcattttgggggtggtaatggggaaattaacagtcttacttctgatcttacttggttttctacaatattcattgtggttaggtaaaaatggtattcatgattacaacaaagtaagtcaagaagttgaatctgcattagcgcaaaacgcacaattaaagtcgcgtaatgatcgcttatttgcggagattgatgacctcaatggcgggcaagaagcattagatgagcgtgctcgtagtgaactaggcatgataaagcctaatgaaagcttttatcgtattgttaatgataaatcccaaccacgtcgttaa

SEQ ID NO: 2801 - DNA, 189 bp, Proteus mirabilis
atcaatttagcgaatcaattattttatttaaataataataaatcatatcttcatttattattgataataaatctgttgtctcattttaataatttgttatgctctgcgccgggtgcttggatcaatctggttcaagcattatgccaataccagaaagagaaaagccccggaaaatatacagtatattaa

SEQ ID NO: 2802 - DNA, 189 bp, Proteus mirabilis
aaggcattagcgtctagcaatttgttgagtaacacaaagagactgcaattttttgaaaatatttcatttattagtgcagattacgacaagctacaaaaaagcagtaataaaaaatggtcagatttatctggaagttatgctaactcacccgcaattagggggacaaagcgtacagcctcgatagattga

SEQ ID NO: 2803 - DNA, 1812 bp, Proteus mirabilis
ataattaaggcaagtatgaaattttcacgttcggcaaaagcgaagacaaagacaaagtcaaatgccaaactccgtaaacctgaagaaaaaacaggatttgtgagttggcgttttgcgttgctttgcggtggtattggtattgctttagcggcgttattaatacgagttgcctatttacagattattaacccagatcccctgatccgcgaaggggatctgcgctctttacgtgtgcaaaaagtccccacagctcgtggcatgataagcgatcgtatgggaagaccattggcggtgagtgttcctgtatatgctatttgggctgatcctaaagttgtgttagaagctaaccctgatatgaccgattcacgttggttagcacttgctgatgcattaaaacttcccgttaatcaaatttctcaaaaaatttctgcaacaccttccgctcgttttatctatcttgcgcgccaagttaatcctgaaattagtgattacataagtaagctgaaaatcaaagggataaacatgcgccaagagtccaaacgctattatccttcaggagaagtgaccgctcacatcattggtgttacaaacattgatggcgatggtattgaaggggttgaaaaaagctttaaccaatggcttaccggtgcccccggagagcgagttgtacgcaaagatggctttaaccgtgtgattgaaaatatcgctcaaacagatagccaagctgctcacaacttaatgttaagcattgatgagcgtttacaatctgttgtgtatagagagttaaccaatgcagtcattgaaaataaagccgaatcaggtacggcggttttggttgatgtcaatacaggcgaagtgttagcgatggcaaatagcccatcctataacccgaataatttagcgggaacgccgaaagatgcgatgcgtaatcgagctatcaccgatatttttgagccaggctctacggtaaagccgatggtggttatgagtgcgctaaacaataatattattaaagaaaataccgttattaatactgttccttatcgaattagtggtcatcagataaaagatgttgcgctttatcgtgagctttcgataactggaattttacagaaatcgagtaacgtaggggtatctcgccttgcgttagcgatgccggcgtctgaactggtagatgtttattcccgttttggcctcggaaaaccaactaacttggggctagttggtgaaagtagtggcatatttccaataaaaaaacaacggtggtccgatcttgaaagggccaccttctcattcggatatgggctaatggtaacgccattacagttagcgcgtgtctatgcaactatcggtagttttggtatttatcgaccgctttctattactaaagttgaccctcctgtaccgggtactcgcgtttttcctgaaaaagtcatgagaacagtggttcatatgatggaaagtgtcgccttaccgggcggtggtggcgttcgtgctgcgatcaaagggtatcgtgttgcgattaagaccgggaccgcgaaaaaagtcggcccagatggaaagtatattaatgcctacatttcttatgcagccggtgttgcaccggcaagccgtccacgctttgccttagtagtgatcattaacgagccaaaagcgggcaaatattatgggggtgcagtttctgcaccagtgtttggcacaattatgggcgcggttctacgtacgatgaatgtagagcctgatgcattaacgccagacgataaaagtgaaatagtgattaataaaaaagaggatacaagtggcagatcctaa

SEQ ID NO: 2804 - DNA, 1023 bp, Proteus mirabilis
ttagaagaggctaaagtgaaactggatgaaatcgcccgcttggctggtgtttcacgaacaacagcgagttatgtcattaatggtaaagctaaacagtaccgtgtaagtgacaagactgttgaaaaagtgatggcggtggtcagagagcacaattaccacccgaacgctgttgccgcgggattacgtgctggtcgtacgcgttctataggtttggttattcctgatttggaaaataccagttataccagaattgccaattatcttgaacgacaagcgcgtcaacgtggttatcaattgctgattgcctgctcagaagatcaacctgacaacgaaattcgttgtgtagaacatctactacaacgccaagttgatgccattattgtatcaacggcattacccccagagcacccattttatcagcgttgggctaatcgttcgttgcctatcattgccttagatagggcgttagagagtgaacattttattagcgtcgtcggtgatgatttagaagacgcaaaaatgttagcgagtgagcttaaagcttttccttctcaatcggttctctatctaggcgcattgcccgaactgtcagtcagttttttacgtgaacagggctttcgtagtgtgtggcaagatgatccacgacaagtgacttatctttatgcgaatagttatgaacgagaagcggcggcggaggtattttcggaatggttaaataataacccgatgcctgatgcactctttacgacctcttttgcgctattacaaggtgtgatggatgtaacgttgcaaagaagtggacgcttacctacgcagttagtgattgctacatttggtgatcatgaattattagatttcctcgaatgtccagtattatcggtggctcagcgacatcgtgatattgcacaacgtgtattagagctggttttagcaagtcttgaagaagagcaaaaaccacaagcgggtattacacgtattcgacgtgatttatgtcgccgaggtagtttaggacgtactcgttaa

SEQ ID NO: 2805 - DNA, 1710 bp, Proteus mirabilis
ctcgtggaggccttgccagtgatgcacttgaggcgatgcaaaaaaactatctcaagtgactcttattttatttcattttatttattttggagacaatctgtgaccttaccttttgttaaaaaaagcatactcgcggggatcattgccacgtcatgtttaagccttccaatatcagcccatgctggtggcacacctgaaaaaccgaatgtactgttaatcgtaatggatgatttaggcacaggacaacttgattttgtactggataccttagatgtagatgcgttagctcagcgaccaacacctcctcgttataaaggtgatatcaataaaatgatagaagccgcacgtattgcgatgcctaatgtcagtgatatggcagaaaacggtgcaaaaatgactaatgcatttgtagctcatcccgtttgtggcccttctcgtgcaggtatctttacaggacgctcgcccgccagttttggtacttacagcaatgatgatgccattttaggtataccccaagatatcaaattgttaccctcacttttccaagaaaatggctatgccactgccagcattggtaaatggcataatgcaaaagttatccgtaaaccgaaaataaatgaaaataaacaaacccgtgattatcacgacaatatgatctcaacccctgaagcgggttatgcgcctcatgagcggggctttgattacgcctttagttattatgcatcaggtgttgccttatggaattcgcctgcattttggcgtaatggtgtcaatgttcctgctccgggttacaccacccatctattaacggatgaaacactaaaatttattgatgaacataaagataaacctttttttatcaatctttcttatagcgttccacacataccgttagagcaagcatctcctgctaagtatatggataaatttgatacagggaatgtggaggcagataaatattttgccgccttaaatgcagcagatgaaggtattggacaaatcattgcgaaattaaaagaaaatggtgagctagaaaatacattaatttttttcttatctgataatggtgcagttaatgaatcccccatgcccatgaatgccatggatagaggctttaagggccaaatgtttaatggtggagttagagtaccttttattgcttatcaacccggaactattcccgcgggaacaaaaagcgatgcgatgatctccgcacttgatattttgccaaccgcgttacaagtcgctgatattcaaattcctgatagcctgcaagtagaaggtaaaaacattatgccattgcttaaaggtgaaacaacgcgttcgcctcatgcttatctgtattgggctggccccggcactaagcattatagtgaagaaaaccaagagttttggcatggttatcaccaatggatcacctatcaacgtcaaacgcctccagtaaaccctaacttagagaaactgtctaaaggtgcttgggcagtgcgtgatggtgaatgggcgctctatttttatgatgatggtaaaaatcaaccacagctttttaacgataacaccgatcctggcgaatcaatcgatttggcaaaacaaaatccacaaaaagtggctgaactaaaaaatgcgtattaccagtggatcaaagataaacctaaacctgttatttgggggcaagatcactatcaaatactagtagattcagccaaaccttaa

SEQ ID NO: 2806 - DNA, 963 bp, Proteus mirabilis
tattcattttatttattaaagcaggctaaggacagatacatggaaatagttattggtattattatcttattcgccattattttagttttaagtggtgtaaaaaccgttccacaaggttatcagtggactgtcgagcgttttggacgttatacacgtacccttgctccaggccttcaactccttattccatttattgaccgtattggtcgtcgtattaatatgatggaacaagtattagatatcccttctcaggaagtgatttctcgtgataatgccaatgtcagtattgatgcggtctgctttattcaagttatcgatccagtaaaagctgcttatgaggtgaataacctagagcttgcaatcatcaatctaacgctaaccaatatccgtactgtgttaggctctatggaactggatgaaattctttcacaacgtgatcagatcaatagccgtttattactgattgttgatgatgcaactaacccatggggtattaaaattacccgtattgaaattcgtgatgtgcgcccaccacaagagctaatttctgccatgaatgcgcagatgaaagctgagcgtactaagcgtgctgatattctagaagcagaaggtatccgtcaagcggcaatcttaaaagcggaaggtgaaaaacaagggcaaatcttaaaagcagaaggtgaacgtcagtctgctttcttacaagccgaagcccgtgagcgtgcagcagaagcggaagcaaaagcgacgcaaatggtatcagaagctatcgctaaaggggatatgcaagccattaactactttattgcacaaaagtataccgatgccctgtcacaaattggttctgccgataacagcaaagttgtaatgatgccattagaagccagtaacttaatgggtgcaattggtggtatttcagaattattaaataccaaaaaaagtgactcaggtaacaagagcaattaa

SEQ ID NO: 2807 - DNA, 294 bp, Proteus mirabilis
aaaagctattatcatggcgttttttatcatagcggtgttaatataatttcatctattaacgcactttttgatcaaagaatattcaggcagataaataacgttggaataatgttaatcttttcctctattttagagatgggtattgatgcttatttcaatagtgtgttgttctttcagactagatatttatataattcaaattgcttaaaaaataacgccctacccatcatcaaaattaattatctattaagtactgctatcccattatttaacaactataaatcaatcggttag

SEQ ID NO: 2808 - DNA, 195 bp, Proteus mirabilis
attagacattatagtttgaaacgattcagcctgataataaagtatgaagcgttatttttaatttttatgttgtatttgatccttaatctaataggagttcttatgtttaacctaccaatccaaggtgtctctctgcttttcttgcaacagaaaagtgatacctatgattttactacaggtaaggtacaagcatga

SEQ ID NO: 2809 - DNA, 873 bp, Proteus mirabilis
ccttttcgttatgctcccatcagtaaaaatgaggtatttataatggaaattcgtcagccaattcatagtgaacatgctaaaaggcttgatacagaaggacttcgtaaagagttcctgattgagaacctattctgtgaaggggaaatgaatctcacttatagccatatagatcggattattgttgggggagttgtcccaacaactcaacctttagcattaatggcgggtaaagcacttggtgttgatttcttcttagaaagacgtgaattaggggctattaatattggtggtgcgggtaaagttattatagacggtgaggtatttgaaattggccctcgtgaagccatttatattggtatgggagccaaatctgttgaattcaccagtgattctgtagagacaccggcgcgtttttatattaactgtgcaccagcacatcacacttatcctactcgcaaaattactcaacagcaggcctcacctgaaaagttaggtaatgcagaaaattgtaacgttcgtacgatttataagtttttacatccttcagtgttaccaacatgtcaattatccatggggatgacagtgcttgagccgggtagcttgtggaacacaatgccatgtcatactcatgaacgtcgtatggaagtatatctttatttcgatatgaaagatgacaatgtggttttccattatatgggagagccaactgaaactcgtcatttagtggtacgcaacgaacaagctgtcattagtcctagttggtcaattcattctggcgtaggaagcgcatcttatacctttatttggggaatggtgggtgaaaaccaggtattccacgatatggatcatgttgctatgaaagatctgaaataa

SEQ ID NO: 2810 - DNA, 861 bp, Proteus mirabilis
aagtttattctctttttgcatctaaagtgtttcccatctctgtccaaccgaaaaatcggctctctttttttcagtgtcttttcgcacgttagctatccaaaacaaagcatgtaccttatcataaagcctcttacggtgagacagttatctgtaataatcatcagcattcattggatatcagagtttcttatgcaataccccattaatgaagtgtttcaaaccttgcaaggtgaaggtgtttttactggcgttcctgcgctttttgttcgattacagggatgccctgtaggatgtagttggtgtgataccaaacatacttgggaaaaagaagagagcaagaaagtccctcttggagatattcccattaaaacacaagaaagtgatacttggggtatagccactgtcgaagatattttatcacttttccggcaacaacgttatagcgcaaagcatgtggtgataacgggaggggaaccctgcctttatgacttacggcctttgacggaaggcttagaaaaagcaggttttgattgccaaatagaaaccagtggcacgcatgacatcctctgtagtgaagcaacatgggtaacactttcgccgaaagttggtatgcgaggtggattgagtgttttatctagtgcgattaatcgtgccaatgaaattaaacaccctgttgctcgtgaaaaagatatcgaagcactggatgatttactgcgattaagaactcaacaacctatggcgatcgttgccttacaaccaatcagttgtaaagagagtgcaacagcgttatgtattaaaacctgtattgagcgtaattggcgtttttcaatgcaaacacataaatatttaaatatcgcctag

SEQ ID NO: 2811 - DNA, 327 bp, Proteus mirabilis
gcaatgcgctatattccctctactgtgaaaagtgaatcatattctaaactatcctctttgattagcaggaactaccccgaacttttcgaagtagctcaactgaattataaatacgagattatgattcaatctgtgttcatttttttctatttaccccaccatcatcaagccacttttgaattaatgatttacggtatttggctggtcggtttaaaacagggagaggaaattcatgcttcttttttagtcgccataatgccgtacgcttcagtcctaaccatttgtaaacatcagtttctagtattaaatctgtatcattcattttaa

SEQ ID NO: 2812 - DNA, 1314 bp, Proteus mirabilis
atgcaccttttaaacgaggttgttatgtttgttgctgcattaatttttgttttaacgatcaccttggttatctggcagccgaaagggttgggtattggttgcagtgcaacggccggcgctatattggcactcctttttggtgtgatcagttttcaagatattccgactgtttggaacattgtgtggaatgccacagcgacatttgttgcagtaattattattagcctacttttagatgaaagtggcttttttgaatgggcggcattacatgttgccaagtggggtggtgggaaaggaagattactattcagttatatcgtgctacttggtgcaatggttgctgctttatttgctaatgatggtgcagcattgatactaacgcctattgtgattgcgatgttacttgcacttggtttcaacaaaggtacgacattagcctttgttatggctgccgggtttatcgcagacacagcgagcttgccgctgattgtttcgaacctcgtgaatatcgtttctgcggacttctttaatattggatttactgaatatgcatcaattatggtgccagtcgatattgcgggaattgttgcaacgcttgtgatgctacattggtttttccgtaaagatattcctaaccaatatgatgttaaaaagctgagtgagccagctttagctattaaggatatgactacgtttaaagccggttggcttgtattgttgttattgctcattggtttttttattttagagccattaggcattcctgttagtgcaatagcggcaattggtgctttaattctttgggtaattgcagccaaaggccgtacgattaatactaaaaaagtgttgcgtggcgcaccgtggcaaatcgtcattttctctttaggtatgtacttggtggtttatggtttaagaaatgcaggattaactgattatctttctgaaatacttaattaccttgctgataaagggttatggatagcaacaattggtacgggatttattaccgcctttttatcatcaataatgaataatatgccaacggtattaattggtgctctatccattgaaggaagtgacgcgacaggggtaattcaacaagcgatgatttatgccaatgtgattggtgctgatttggggccaaaaattacaccaataggtagcttggcaacattattgtggctacatgttttatcacaaaaaaatatgacgatcacatggggatattatttcaaaacagggatcatcatgactatccctgtgctcattgtcacactcgttgctttagtacttcggctttcactgtttaattaa

SEQ ID NO: 2813 - DNA, 624 bp, Proteus mirabilis
ttaaatttatattaccctgttaataacaatattatggagagaacaatgtttaagaaggcgttattgagtttaactgcaggtgcattattatttaatgctagttcagcattagcggctgattatcaaattgataaacaagggcaacatgcttttgtgcaatttcgtatccaacacttaggttatagctggttatacggcacatttaaagattttgatggaagcttcacttacgataaagaagatccttcaaaagataaagtcgatgttgtgattaaaacgggtagtttagatactaatcacgctgaacgtgacaaacacttacgtagtgctgatttttttaacgtcagtaaatatcctgaagctaagtttgtctcaaccaaagtgactcgtgatggtgaaaattatacggtgacgggtgatttaacacttaatggcgttacaaaaccaatttcactaaatgcaaaattaattggtgaaggtactgatccgtggaaagggtatcgcgctggttttgaagcaacaggtaaagttaatctgaaagagtttaactttaaatcagatttaggaccaaaatcgcaagaagcagaattaatcatctctgttgaaggtgtgaaaaaaaattaa

SEQ ID NO: 2814 - DNA, 909 bp, Proteus mirabilis
gcgatgaagtatgatctaaatgacctctattattttgttaaagtggtggagtttggcggtttttcacaagcggccgaaacgttaggtattcctaaatcaaaacttagtcgtcgtattgctgatttagaagagagactaaaggtctcgctgatctatcgttcaactcgtcaatttcatgtcactaagatagggcaaactttttaccaacagtgtaaaaatgtcgttgaacaagcggagattgctcaagaggttatttgttcagcacaagggcaccctcacggcacgatcaaactctcttgcccagttgcattactgcaaatttatattcaagatattttggtggattttatggcaaaatatcctgatatcaatatacaaattttagcgattaaccgccctgtggatgtgatcaatgaaggtcttgacttagctttacgagttagagcattacctttggatgattctggcttaacgatgaaaatattaggctattctcgccgtgttttagttgctaatccgctattatttgcaaccaacagtgcgcctgattctccagagcaacttgctgattatcctattttagctaatagcgaacattcgcagcagtatacgctaacgcttacccataatgatggtaccgtttcaacgcaacatgttacacctaaattagcgacaacggatgtgatgaccttatataaagcaacattaaagggacttgggatcacgcgtttaccattgagtgtcgtagagaaagagttaacagatggctctttggtggaagtcttaccacagtggcgttttcctaaagatgttattcatgccgtgtatccgtcacgaaaaggtttattacctgctattcaagtgttattagattatttagcgcagaatatggctccatataaagagtaa

SEQ ID NO: 2815 - DNA, 1947 bp, Proteus mirabilis
caggcaaggtataaactcatactccctaaggagaatgtcatgaatgataacatcgctcgtaagatgcaacagacttataacatcacatattgggggggaggatactactgcgcgaataatcgcggcaatattagtgtttgcccaaatcctgatgtgcctgaagcaacgctggatttaacagaattagttaagcaagtacaagaagagcattcacatttacgccttcctgcgctgttttgttttccacaaattttacagcaccgtttgcgctcaattaatgccgcttttcatcgtgcacgtgagtcttatggctacaaaggggattactttttagtttatccaattaaagtcaatcaacagcgtcgtgtgattgaatcgctgattaatgctggagagccattaggattagaagctggctctaaagctgaattaatggcagtgcttgctcatgccaatatgaccagttcggtgattgtttgtaatggttacaaagatcgcgaatatattcgtttagcccttacaggggaaaagctcggtcataaagtgttcttggtcattgaaaaaatgtctgagataaaaatggtacttgaagaagccgaacgtttagaagtgatcccccgcttaggggttcgtgctcgccttgcttctcaaggctcaggtaaatggcaagccagtgggggggaaaaatctaaattcggcctagctgcaacacaagtactacaactgattgatacgctacgccaagctggtcgtttagatagtttgcagttattgcattttcaccttggatcacagatggctaatatccgtgatattgcgacaggtgtgcgtgaatcagcccgtttttatgttgagttacataaattaggggtcaatattcagtattttgatgttggtggtggcttgggcgttgattatgaaggtacgcgctcacaatctgattgctcggttaactatggccttaatgaatacgctaataacgtgatttgggcaattggtgatgcttgtgatgaaaatgaattacctcatccaaccgttattacagaatcaggtcgagcattaactgcgcatcatacggtgcttatttccaatgttattggtgttgaacgtaacgaatttactgcaatcacgccgccggacgaagatgcaccaagacctatcgcaagcctttgggaaacatgggaagagatgcaaaccaaagggaatagccgttcattgcgtgaatggctgcatgatagccaattagatttacatgatgtccatactcaatatgtacacggtatgttaagtctgacagagcgtgcatgggcggaagagttatatctgaatatctgtcgtcatattcaatatgatttagatccaagtaatcgagcccatcgcccgattattgatgaactgcaagagcgtatgtcagataagttctatgtcaacttttcactgttccagtcattgcctgatgcttggggaattgatcaattattccctgtattgccaattgaaggtttagataaaccgctcgatcgccgtgctgtattgctagatatcacttgtgattcagatggtattatcgatcattatgtcgatggtgatggggtcgaaaccacgatgccaatgccagcttatgatcctgaatatccaccaatgattggcttctttatggtgggcgcgtatcaggaaatccttggtaatatgcataacttatttggtgatacagcagccgttgatgtttatcttgatgagaaaggcaatcttacttatcagttgagtgaagagggtgataccgttgcggatatgcttcaatatgtaaaacttaatcctgcggtattgttggagcgcttccgtactcaagtgaaaaatgcacagttagataaagcactccaagagcagttcctaactgaatttgaaagtggcttatacggttatacctatctggaagaagaggagtaa

SEQ ID NO: 2816 - DNA, 1404 bp, Proteus mirabilis
cgtatggatttcatcacaaatatattaagcgctattaatggcgtggtgtggggagtaccgatgttagtcggtattctaggcatcggtctatttatgcagtttagactctcttttctgccaattagaaaattaggcacaggatttaaacttttatttgagaaaaatgataaaagaggtgagggacaaatctcaccttttaatgcattaatgacggcgctttctgccactatcggtacgggcaatattgctggagtcgctacagcggttgtattaggtggaccgggagcgctattttggatgtggatgactgctttagtcggtatggcgactaaatattcagaagctgtgttagcggtacgttttcgtgaggttgataaatacggcaactacgtaggcggaccgatgtattatattaaaaacggtttaggtaaaaaatggctttggttaggaacgctatttgctatttttggtagttttgccggcttcggtataggtaatacggtacaggcaaactcagtggcggatgttttgcaaagtaattttggtatttctaccacagtgacagcaattgcattagttattttagtcggtgctgtattaattggtggaattaagcgtattgctgatgttgccggtaaattagtgcccattatgacagtagggtattttggggcagggattgtcgtacttgcactgaatattactgctattcctgatgcatttatgttgattgtaaaatctgctttcacaccggttgctgcgcaaggtgggtttgctggtgcggctgtttgggcggcaatacgttttggtgttgcacgaggtgtattctccaatgaagcaggattaggtagtgcacccattgctcatgcgacagccaaaacacaaaacccgatccgtcaaggcttaattgccatgttggggactttcattgataccattattgtctgttctgtcaccggattaacgattgtgatcaccggacagtggctgacagggcaaagtggggcaacacttactgcaagttcgttctctatggctatccctggaggtaactatattgttgcgatcgcattggctgtttttgcttttaccactattttaggttggagctattacggtgagaaatgtgtgcaatatctatttggaccgaaagccattatgccttttcgtattgcatggttaattgccttgccaattggcgcgactcaatccttagaatttgtttggttacttgctgatacattaaatgcgatgatggctattcctaacttaattgcattagcactgcttagccccatcgtttatcgtctaacaaaagactatataaaagatgttaatgcggttgatattgatctcaatgaacaagtgaattctgtaagcaaaaaagaagcagaagcggaataa

SEQ ID NO: 2817 - DNA, 1404 bp, Proteus mirabilis
attatgtatcagcgaaacacgatcaaaaaatcgcaaaatcaacaacgctttaattggtttagaaaagcgaaagaaactaaccttgccccggtgaaaacgcttattctttccgccattatcggtacgttagccggattaattggggtactatttgaaaaagccgttggctgggtcattcatttaagacaagataaattagccgaggcattaaccaacccttatcttttggctattggcacgttacttgtttcctctcttttagccatgagtggctactacttagtgaagaagttttcaccagaatctggtggttcaggtataccggaaattgaaggagcaatgatagatattcggccagttcgttggtggcgggtattgccagtaaaatttatagccagtatcggtactttaggctcaggtatggtacttggtcgtgaaggccccaccgtgcaactaggggctaatattggtcaactcgttaatgatgtctctcgcgttaaagataaaggaacgcgccaaacactattagccacaggggctgctgccggtttaacggctgcctttaatgctcccttggcaggcattctatttattattgaagagatgagaccacaatttaaatataatcttatctctattaaatccgtcttcattggcgtgatcatgtcttgtattgtatttcgcctaattaatggtgaaggaggcgtcatacagataggtaaattttcttcagcgccgatgaatacactgtggctctatttagtgttaggaatgttatttggtgttgttggggttatttttagtaaattactgttttatgttcaaacacaattccaacatttttatcaagataaaacctcacgttttgttttagccggtggcgtgattggtggtgcatgtggtttacttgcgttgattattcctgaaataaccggaggcggttttagtattattcctgcattaagtgccggaggatattcgttaactgcactgctactattttttgtgttacgtaccatcaccaccattatcagcttctcctccggtgcaccaggaggaatttttgcccccacattagccttaggcacactctttggtagcgcttttggattaatggcaacctatcttttccctgattatcaaattcaaattggcacttttgctattgctggaatgggtgctttatttgccgcaacggtgagagcaccactaactgggattgtgttagttctagaaatgaccgataactatcaacttattttgccaatgataattacctgtcttggcgcaaccatgctggcgcaattattaggcgggcgacctatttatacggttctactcgaaagaatactacaacgctcagaagccaaagaaaaaacagaggctcccaaagagcccctatag

SEQ ID NO: 2818 - DNA, 822 bp, Proteus mirabilis
ggagcgtatcaaatgaaggatataatacagaaaatcaagaaatggatcggtatacagaaaacatcttattacccctatcctgctattgatatttcactccctaatcatgtctctttacatcttgttggtagtatccatatgggcgtgccaacgatgtcaccattatccaatgtactgattaataaaatagcaacagcggatgcggttattgtcgaagcggatatttcaaccgaaactcagccctttgatcaactatcgttattgcgagagccattagaacaacgagtaaatgaaacacaacttgccactatcatcagccattgtgatcttctttctattccacattaccaaattgatgataaaccactgtggcaaatcgcgctgatattacaatcaacccaagcgatgcaacttggattacaaccacaacacggcattgattatcaagttatccaacaagccaataaacaacaaaaagcgattatagagctagaaggtattgagcgtcaggtcgcattattattagattttccacaagatggagcacaattactcgaagatacgctaaaaaattggcatgaaaacgcccgggcattgcaaattatgatcaattggtggttaaattataccagtgaaaagcacccttctcctttgccaaatacttttagcaaagcggtatttgatattttaatggaaaagcgcaatcaagtctgggcaacaacgctttctaatcttccagcaggccactatgttgtcaccgtcggtgctcttcacttatttggtgaagataatttagttgatcgattaacttatcaagcataa

SEQ ID NO: 2819 - DNA, 888 bp, Proteus mirabilis
atgcaaaatcaagtcgcacaatcaatgaaaaacagtatcaaggtatacttggtaaactcatttactcgtgatcattgcggtggcaaccctgccggagtcgttctcaatcctcccaagctaacgacagaacaaaaaatcgccattgctcaacaagttggattttctgaaacggcatttgtctattcgggtgatgacactgattttaaagtagatttttttactgctgaaggagaagttgatttttgtgggcatgcaacattagcggtttttttcactctgtcatcgcttaagttactcaaacctggcgattatagccaaaaaaccaaggcaggaattttaaccgttaccattaatcacgataatattgtgatggaacaaacgcttcctattacccgtaaggggccttgtgttaacgatgtcgcaaaggcgctgggcattctacctgaagtgatagaaaagacagatttaccaatagagattgtctcaacaggattaaacgatatttttgttcccgtacaatttggctatttagatgctttacagcctgactatcaagctatcgctgctttaagccataaatttgatactatcggctttcatgtctttgaacttagtcatgatcaaaatattactgcccactgccgaaactttgcaccacgctatggcattaacgaagaatcagccacaggtagctcgagcggtgctttagggtgttatcttgttcatcaccttttgccaaacaaaaggcaatttttgttcgaacaaggtagagcaatgcaatgctcttctttaattgacgtatttattgattcgacagcaaaaaacgtcactcgcgttcaagttggtggaaaagcgacattgattggtacaaaaataattgagatctaa

SEQ ID NO: 2820 - DNA, 237 bp, Proteus mirabilis
aaactgaatcacagtgtaaaccgcaggattgctgatcctgtttctctgttagggaaatggcttataaggttaagccatgtgtggagtgaatgggtaatgatccattgtctactggttattcttttcaaaaaccaaaacagtactcgccaatactatacccgtagtatgtctagagtgatttcctctttgagctctttttctttagagcgaagttgtctgttacttgccaataggtga

SEQ ID NO: 2821 - DNA, 366 bp, Proteus mirabilis
cggtgggatcatttaagagccatcttgaatttactcttatttataattaaatgtgtcataaaggggtttcaagtgaatcgctcttatccagcatcaaagatggtaggaaaaaaaatcgcttattaccgtagagtaaatggcctcacattaagtgaattggctaagaaaataggtataagtcaacagcagcaatcaagatatgaacggggaattaatcgagtgagtctagataggctttatcaatatgcttgctttttcggtattagtttaagtgatctttttcaattagatgatgaagagaaagtagaaatagaaaataaaatatcaaatatggtaggtaataaaaatgaaccatttgatgggtaa

SEQ ID NO: 2822 - DNA, 279 bp, Proteus mirabilis
atctgttgtctcattttaataatttgttatgctctgcgccgggtgcttggatcaatctggttcaagcattgtgccaataccagaaagagaaaagccccggaaaatatactgtatattaaccgaggcggactcaaaaacacacagtttgattctgcctccatttttatcggaacgcaagaggaaatgaaaaagtcgacttttattttagccaatatattagttagaaacaaattaaaaggaataggtattaaattaccaattattaatataaaaagctaa

SEQ ID NO: 2823 - DNA, 294 bp, Proteus mirabilis
atctgttgtctcattttaataatttgttatgctctgcgccgggtgcttggatcaatctggttcaagcattatgccaataccagaaagagaaaagccccggaaaatatacagtatattaaccgaggcggactcaaacatagacaatttgattctgcctccattcttatcggagcgcaagaggaaatgaaaaaatattctttaatcgggctaataatggtcgccatgataacaccgagtaatctattattagagcagaagcctgttgtttattccccgctaataaggagtatttaa

SEQ ID NO: 2824 - DNA, 291 bp, Proteus mirabilis
cacaaacaccaaaaaataattcatctttatattaaagagaataaattgacatttaaattacatattaatgaaatgattataccgatatatattacaacctgttttaccttatgccttgcaaataataaaacaaaatatgataaaaatcataataaaataataaaatctatcaccttacaggacactttcagaactattacagtcaccacggtaataatttttattcttatattcaaaatgttgctcaaatttattgatattgttgttaactacaaccgctcatccccctga

SEQ ID NO: 2825 - DNA, 906 bp, Proteus mirabilis
cgtaataaacagcatttatatttaaaactctcaaaaagggataagttaatgttagcaactgcacatattgttgatgtaaatgaatcgaatattcagcaagttatagaacaatcgatgacaaaaccggtcatgatgtacttctattcagagcgtagtcctcattgtgcagagcttggggcaacgttggataaactagcggctgaatttgctgatcagtttgtattagctaaattagattgtgatgttgaacagatgattgcctcgcaatttggtctacgtgcgatcccaactgtttatatattgcaagaaggtcgtcctgtcgatgggttccaaggcccacaacctgaagaagctattcgccaaatccttgccaatatcttacctaaaccagaagaattaaaagcagcgcaagcttcagcactattagcagaaggtaaagcagacgaagcattaccactgttaaaagaagcacaccaaattgatcctaaaaacagtgaaattaccttagccctcgcaggtgctttaatttcattaaataaacataatgaagcagaagaattattagccgcaattccattgcaagatcaagatagctactatcacagtttattagctcaaattgaactgcaaaaacaagctgccgacacacctgaaattcagcaattacaagataattttaatcagcaacctgacaatactgaactcgctattcaactggcgttaaaactgcatgaagtggcacgtaatgatgaagcccttgaattgctatttaattttctgaaaaaagatcttaatgccggtgaaggacaagttaagaaaaccctgatggatattttatctgctttagggactaatgataatctagcatctaaatatcgccgaatggtgtattctttactttattaa

SEQ ID NO: 2826 - DNA, 435 bp, Proteus mirabilis
acctttccgcaaggggaaggtcaagggggaattttgaatattagtgaaatcgcaaccaaaaccggtttgacgacaaaagcaatccgtttttatgaggaaaaagatctgataaccccacctcatcgaggtgaaaatggctatcgatactatttaccgcaacatatcgaagaattaacactgttaaagcaagctcgtgaagtcgggtttagtttagaagagtgtcgttcattgctgatgttattacgtaatccctcacgtcacagtgctgatgtgaaagaggcaaccttaaagaaagtggctgagatagagaaaaccattaacgaattaaatgccattcgtcaacggcttctcttattagcaaatgaatgccctggcgatgatggggcggaatgcccaatcatcaatcatctttctggttgttgtcatcatcaataa

SEQ ID NO: 2827 - DNA, 195 bp, Proteus mirabilis
gccatcccgcaggagcggctaaatggaattgaggataaaattgctctccacgttttttttgtaaggcatttagggcagttgtcgattgttctaaacgttgcttcatctcattatcctgattttatcagttattctgtaagctatatgtcacccttattagcgataacatttagggttaaaaagcgtgttgtttga

SEQ ID NO: 2828 - DNA, 651 bp, Proteus mirabilis
aattgggagcaacatatggaatcgataatccatctgatcactttcgaagatgacagcacaaaagttcaacttaaagcagtgctttcttctttagcggcaaatgtgaaaacctattcaaatgaacaggcatttttaaagtactatttttcatcaactaaaggggctcataaagagtgcatcataattaacactaaaagtagtgcatcgccatcaattgcgttggtaaaagagttaaacaaattaaagaatatcattcctgttataattatttcgggagatgcatcgatagaaagttgccgtaacgcatttaaagcgggggctttcgaatatttaactcgccctttaaacgtcaatgagcttcttaatattgtgtcagaatcttttttacactatgaaagtgaggttgagcaattcagaacctatatttctttaaaagataagtttagtaaactatcaaatagagaaaaagaggtaatggagatgatccttgacggtaacaccagtaaagaagcagccgaaaagctctctttatcaccaagaacagtggaagttcatcgttcgaatatgtatacaaaactaaaaataagatcactaccacaactagtacaagaatatgatttctttaaaaaatatgacttaagagccaattaa

SEQ ID NO: 2829 - DNA, 837 bp, Proteus mirabilis
cagataattaattacattttattctttattcctacaaaaaaaagtgtggcaattattgccacacttctagaggttttaatcatgaatttatttgatttaacaggcaaagttgccattgttactgggtgtaatacaggcttagggcaaggaatggcaataggtttagcacaagccggtgcggatattgttggcgtgggtattcaagatgctcctgaaacgcgtcaaaaagtcgaagcgttaggccgtcgttttcattacatcacgcaaaatttaatccaacaagatggattagatgctttagtggatgaggctgttaaggtgatgggacgtattgatattttagtgaataatgccggtattattcgccgtgaagatcttttgcaatttagtgaaaaagattgggatgatgtgattaatattaaccaaaagacactgtttttcttatcgcaaaaagtggctcgccagtttgtcaaacaaggcgaaggtggcaagataatcaacatcgcgtcaatgctttcttatcaaggaggtatccgagttccttcttatacggcaagtaaatccgcggtaatgggattaacacgagcattagcgacggaattatcacaatataatattaatgtaaatgcaattgctcctggctatatggcaaccgataacaccgctgcacttcgtgctgatgaagcgcgtaatgctgctattttagagcgtattcctgcggggcgttggggaacacctgaagatgtcgcaggtcctgccatatttttagcctctaaagctagtgattatatcaatggatataccattgcggttgatggtggttggttagctcgataa

SEQ ID NO: 2830 - DNA, 1323 bp, Proteus mirabilis
aggtacgttaacatggcaaattatcaggggaaaaaagttgttatcgtgggactaggcattactggtctatcctgcgttgacttttttatccgccaaggtgtaacacctaaagtgatagatactcgccagcatcccgcgggtttagataagctacctgctgatgttgagtatcatacggggagttttcatcaagtatggcttaatgatgctgatttaattgtctcaagtccgggtattgcgttatcaacgcctgagttagttgaagcgcgagatcatggagtggaaattgtcggtgatattgagctattttgccgtgaggcaaaagcacctattgttgcgataacaggctctaatggcaaaagtaccgtaacgacgttggtgggggaaatggctaaagctgacgggatccctgtcggtgtcggtggcaatattggtgtacctgctttaacgttattaacacagccttatgacttatatgtcttagagctatcgagctttcaattagagacaacctatagcttaacagcggcggctgccacggtattaaatattagcgaagatcatatgaatcgctatccgttaggattagaacaataccgtgaagctaaattacgtatttatgataatgctaaaacctgtgtctataacgcagatgatgttctgacattgcctttagctggcaaagatgcacgttgtgtgagttttggtatcggacaaggtgattatcaacttgataataccaatcgttacttgaacgtaaatggtgaaaatattcttgccacttcacagatgttcctttctggtcaacacaattacaccaatgcattagccgcattagcgttagctgatgcagtgggaatttctcgtaaagcatcactggctgttttaaacacctatcatggccttgctcatcgtttccaattagtttactcccataatggggtacgttggatcaatgattctaaagcgactaatgtaggtagcacagaagcagctttaagagggcttgaagtagaagggactttgcacctgttgttaggtggggacggtaagtctgctgattttagcgcgctattaccttatctcagtggcgataatattcgcttatattgcttcggacaagatggtcaagcattggcaaatttacgaccacaagtctcacaattaaccgcgactatggaagaggccatgcgattacttgcaccaacagtgcaaactggcgatatggtgctactttcacccgcttgtgcaagtctagatcagtttaaaagtttcgaacaacgtggtgatgagtttgcccgtttagcgcaggagcttggctga

SEQ ID NO: 2831 - DNA, 282 bp, Proteus mirabilis
cctctagttaagcatattcttataaatataattatctatactcatctcttagccttctccccagaaggctttttatttgctgtaagcaacaaaaaaccgtatgcgcttttcctaatatctaatattaactgctcacatacggttattcgtttagatggtcatttagccttagataaacaaacgcgtttattccgcttctgcttcttttttgcttacagaattcacttgttcattgagatcaatatcaaccgcattaacatcttttatatagtcttttgttag

SEQ ID NO: 2832 - DNA, 897 bp, Proteus mirabilis
ttattaactaaaaacattcaatttgacttgaaaaaacactacaattgtagccgtatttttattgagggcactatgtctactgcaacaaatctgaatgaactacaggaacaagttcgctcccgctataatggattaagtaaaaggctacagcaggttgcacattatcttttggataataaaaacagtgtagcatttgatacaatcgcgatccttgcagataaagcaaatgttcctccatcaacattaatccgttttgccaatgcatttcatttcaaaggatttaatgaaatgaaacttttatttcaacgtcatttaatgggtgaaatggataatgaaaaattaacctataagcagcaatacaaaaaggaaccaccaaacttaaatgagccagattatattctgcaagagtttgcacaagccaatagccacgctttgcaacagttagctcatcaaacccataaggatatgttaaataaaactatacaactacttgagtatgcagaaactatctatataggtggttttcaccattcttttagtgctgcgagctatttttttcacgcgctttctcatatcccttgtgaaaccgtctttgttaattgcctagggggaatgtataaagaacaacttaggaatattacacatagagatgtgctgtttggcatccatttccacccttattcagaagaaatgcaaaaaatgtgtgagattgctgcttataaagaggctaaacaaattattgtaacagatagccccataagcccattagcaagtctaagtgatgtttgtttaactgtaaaagaagcacaaataaaaatgtttcgttctcaaacctcaacattatgtttactacaagcactttcagttgcattcgcttttagaaaaaagagccattaa

SEQ ID NO: 2833 - DNA, 495 bp, Proteus mirabilis
ggaacacataatatgagaattggacacggttatgatgtacataaatttggcggagaaggcccaattattattggtggtgtgagaattccttatgaacaaggtctactagcccattcagatggcgatgttgtactacatgcggtgacagatgccattttaggtgctgttgcgatgggcgatattggtacattatttcctgatacagatccggcttataaaggtgcggatagccgagtattattgcgcgaagccttttcaagagtgatggctaaaggttaccgtattggtaatcttgatgtcactattattgctcaggcacctaaaatgctacctcatactccacaaatgcgtgtcaatattgctgaagatctccattgtcatgtcgatgatatcaatgttaaagcgaccactactgagaaattaggttttgtaggacgcaaagaaggtatcgcttgtgaagcggtggtgttattaatcaaagagtctttatcttaa

SEQ ID NO: 2834 - DNA, 1482 bp, Proteus mirabilis
aatcaggataatgagatgaagcaacgtttagaacaatcgacaactgccctaaatgccttacaaaaaaaacgtggagagcaattttatcctcaattccatttagccgctcctgcgggatggcttaatgatcctaatggccttgtttatcataacggcttatatcatgcattttatcaacatcatcctttttctgaactttgggggccgatgcattggggacatgctaccagcaaagatatgatccactggcaacatcagccaatcgcccttgctccgggcaatgagtatgataaaagtggttgtttttccggatcagcggtaagtcatgaaggtaaattatacctcttttataccggccataactggttagcagaagaaggcgatgacagccaaatttaccaagcacaatgtgtggcagtcagtgaagatgggatccattttgaaaagaaaggcattatcttaccgccaccacaaggatatatgcactttcgtgatccaaaggtttggtttcaagaagggaaatggtggatggtagtcggtgcccgcgatgaaaaagaccaaggccaagtgttacttttctccaatgacaccctatttgaagaagggaaacaatggcgttcggtgtacaaggtattaggcaaaaccgatgataaaaacgtctacatgtgggaatgccctgacttttttcctatcagtgatgataacgaatttgctcttgttttttcaccacaaggaaaacgcgctgaaggttatcaataccgtaatctgtttcaaaccggtgcactgatcggtcagtggtcaccaaaacaaccttttatcatacatggtcattttactgagcttgataatggtcatgactattatgctccacaatcttttgttactgctgatggtcgccgtgtttctatgggatggatggatatgtggaactcccctatgccttcgcaacaggagttttgggctggttgtttcacgcttcctcgtgaaattaactttgataaaagggcaaaccgtttacgtatgaccccgataaaagaagttgaaagtctcagacaaacaagaaatacgatagagatgaccacactcaataaccaagcgcttaaattactcgataagacaccggctattgagttaaatttaacctggtcattagatagccaagcggaaaaatttggattatggctaggaaaaggtttagaggtatttgtcgataatcaatcaaatcgctttgtgatccgtcgccattatccacaatataatatcagtggatcacgtagcacaccgttgccagtaggaagcgaaattaacttacgtatatttattgatcgctcatcaatagaggtttttatcaatcacggagagctgacctttagtagccgttattatgcagatgaaaatgatcgcgatttatcgctatttgccacagatggcagtgccacattaatcgctggcgaatattggacactatcaacgataagttga

SEQ ID NO: 2835 - DNA, 381 bp, Proteus mirabilis
cgacaccgtaaccattcattaaaaggacgcaatgacatgataacgaagaattttaaagttaattcactagcgaatagctacgcagctgctatttaccacgatattaccacacgtaatggcggtgattggttttcgatgaaggtaggcaacaaaacgattgaagttgccattattgacggtgtgaaaggtattcgaatgctcgttgatagctatttgctgaaagccttaaaagggcaatatcccacatgggaggcagttgctattagcttgatagagcaatgtgtcattaatggatatgtcacaggttatggtcgagaggtgtggcaaagcatgattaatgatatgggcgactctttagctgataagggggcgtttcaatga

SEQ ID NO: 2836 - DNA, 273 bp, Proteus mirabilis
ccattaatcctaataataaaaatgatatttttttcatttcaagacctttgtcgtttattaattaccgatatttatttttcacacaataataatatcttattactcggttctattttatttggaagtttagcgacacattgttgttcagctccccaagatactctaatttcttcatttgggttaatacctgttagccaagcaaaaccatcatcactaattattcctagctctcgtcctttagcattactaattattgaaccaaatggtggataa

SEQ ID NO: 2837 - DNA, 198 bp, Proteus mirabilis
agccaaatcaacagaaaaaaaagcaagctcttaagcacagcaataaattgcgttagatcaaacatggcgcagattatttcatctgacacttttcctactataaaaatggcgtattcttatgttgcatatttaatgcaacttataaaaataaagcgtcatcttatagaaggaattcgatatgtattgtgtgcaatgtga

SEQ ID NO: 2838 - DNA, 234 bp, Proteus mirabilis
tgtggtgtcaaaaataatcacattgttgctcataatctgttccttatacttttttatttcgttttttgcgctctcccaggtataaaaaaacccgcgattagcgcgggtttttctctaagggtaggtatgtttcattttttacccatcagccgaccgcgcatcaatgttgcgaatagtagtaggcttgatagtaaaattgcgtttaacatgaaacatccttacatttgttcttaa

SEQ ID NO: 2839 - DNA, 765 bp, Proteus mirabilis
gctgtcaccaaagatcaaaaaggtatcagcagcgatagacttaaagctaaacatcatcatgacgataaggaaacaagtatgtcgacggaaaaggttcttgaagttcatcagttaaccaaacaagtaggagaaggtgatagtcagatctctatattgcagggtgttgagttagttgtcgagtctgcacagacaattgctttaattggtgagtcaggatcgggcaaatctacacttttaggtattattgccggattagatgatggaggtgctggtcgtgtgcaattaatgggacacgatctgaccaaaatgaatgaagaagagcgggcaaaattacgtgcacaacatgtcggatttgtttttcaatcttttatgctaattccaacgttaaatgccttagagaatgtgcaacttcctgcgttattaaaaggtgagtcagaaaaacagagccatacgcgagccgttgatttacttaaacaattgggtttgggtgagcgcttgtatcatatgcccgcacaactttccggtggtgagcaacaacgtgttgcattagcaagagctttttgtacccaaccggcgatcctgtttgctgatgagccaacaggtaatcttgatcgaaaaacgggagataaaattgccgatttactgttttcccttaatcgtgattatgccacaacattaattttggtcacccacgataatgagcttgccgctcgttgtcagcgaagattacgtcttgttgatgggcaacttaaggaggagtcatga

SEQ ID NO: 2840 - DNA, 348 bp, Proteus mirabilis
aaaatgaccaataaaatagatgtagtaaaaagaaaaactgttcctgcatatcttgaccatgatttagagatgataaatgaactacgagaagatcctgattatgctgaggtgtatttgcaaacggcgttagaaggtatttatgagcctgggggaataggtgcatttttaattgcattacggcaaattattgaggctcatggtggagtgggcgtgattgcgaaaaaatcaggattatctcgacaacatatttatcgagcattatctgaaaatggtaatccaacactgacaacattgacagaaatcaccagagcagtaggcgttcgattagcatcaactcactgtgtttaa

SEQ ID NO: 2841 - DNA, 501 bp, Proteus mirabilis
aagagacacaacatgagttatccattacgaaaaatgaccctcgctgatatcaaagcagtgacttcattactacaagaaaactcacagtcacagcaaggtggattatatggtgattatccacacgataaagttgaagctatgtaccaaagtagtaccaatgccatagtcgcaactgaccaagaacagattatagcagttgttttcagctttccggtcagttctttttctcttccacctattgctcaagaaattaaccgacgttttcctagccttacatacaataattggttttacggtcctgtatgtattgataaatcataccgcggaaaatcgctattaaccgagctttaccaatatattggtgcgttacaaggtggtcgcccgattgcatttattaatagtgaaaacatccgctcgctaaaagcacatcaaaaattgggtatgaatattgttgaaaattttcaatttcaaggaaaagcatggtgggtaattagtggataa

SEQ ID NO: 2842 - DNA, 321 bp, Proteus mirabilis
atgaataacaaattgaccattaaaagcctgacacctgctatctctgggtggtgggctaaaatccatgataataacgaagacaaaacagaatggtactcacctgtggcggcatgggcgttatgtgatgtacgctacgaaaaagagtcgaaagtatatactcaaatcctgcctgtattaacgggagagtttggaatggagccattgcatccagacgaggcatatagcgagttactttatttgcccaatgataaatttgttcgtatgggtggtgagtgtttatttgcatggcaattgttggatgaggtgacgattaatgactag

SEQ ID NO: 2843 - DNA, 594 bp, Proteus mirabilis
aggataaacaaaatgaaacaggttgccgttttattggctgatggttttgaagaaggtgaagcggttgtttttattgatatcatgcgtcgccttgatattcatgtagatgtactttcttgcatggatacactggtattaaacacctattttaacactaagatcagtgctgattacctattaaccgaaaaattcacacacagttatgacgcagtaatgatgccgggtggtcctaaaggtacagatcgtctatgtgcaaattcactcgtgattgattttattaaacgccatattgcacaagacaaatacatttgtgctctatgctcttccggtgcaaaagtattagcagcacatcatcttcttgaaggtcgttattacagcactggtgataaacttgctgataaatatgatgatggtcattatcttgaccaagatgttgttgttgatgggaaatttatcagtgccaaaggattaggtgttagctttgaatttgcctttacggtagctaaatatttgctcagtgacaatatagaaaaagtagattggcaagctaatcacatttactttaaacattggccgttgtcttaccttgactaa

SEQ ID NO: 2844 - DNA, 888 bp, Proteus mirabilis
accatgaacaaacttcgtattgtgcttttcttacctctttttggcttagctttaacttcttttcattctcacgcagcaacagttaatgcgatgttctcgtgggaatctgctgattatgatacatcgaataactattctggttatcgtgttgattttaatattaatccagacaaatcgaactggtattttgacgtcggttttcgtcagcgtgaacatgacaataaaaatcgttatcagcgttatgatttacaaggtagttatcgttttaaattaaataatggttggatacaaccaggattaaaaatacgtcaagatttaactaactatgataatggtagccgtttaactatcgacttttatgaatcaaaaacaaattatcaatttcctattaataaagactgggttttaaccggtagtgttttgtttggattacaaaaaaaagaggacaaacgaagtaatggcgtcactaatacggattatttaggttgggaaattgaacccggtattcgctactttatcaccccgaatctcaatacaacagtggcttattttgatggtggaaaacaagcaataagacatgaagagtatgatacaaaagaaacaaatcacaaccagcaattacgtatgtatgtaaactggacgacacctatcggtgttattatttctccctcaatgcgtaagtctatttttggaaaaatagaagacagaacaaataaaggtgaatatatcgataaagatatgactcgttataccttacaaatggcttaccaaatatctcctcaatggcgtgttatgacagaatattataatgagcgtgttgagaataaaaataacggcagcaagtcaactcaagattattttaaagtatcagtaagagcaactttctaa

SEQ ID NO: 2845 - DNA, 1236 bp, Proteus mirabilis
tcatcagacaaatttaaaaagaggtcgtttgagcaagcgaccctaaaaggcacaaaacggagagaaattatgtttgaacctatggaattaaccaacgatgcggtgatcaaagtcatcggcgttggtggcggcggcggtaatgcggttgagcacatggttcgtgaacgtattgaaggcgttgatttcttcgcggtcaatactgatgctcaagcattacgtaaaacagcagttggacaaactatccaaatcggtaatgccattacgaaaggcttaggtgcaggtgcaaaccctgaggtaggccgtaatgctgccgaagaagatcgtgaagcgttacgcgctgcactagaaggtgcggatatggtatttatcgctgcgggtatgggcggtggtactggtaccggtgctgcgccagtcgttgctgaagttgcgaaagagttaggtattttaacggttgctgttgtgactaagccttttaattttgaaggcaaaaagcgtatggcatttgctgagcagggaattactgagttatctaagcatgttgactcattaatcactattccaaatgacaagctgctaaaagtactcggccgtggtatttcgttacttgacgcatttggtgcggcaaatgatgtattaaaaggtgctgttcaaggtatcgcagaactgatcactcgcccaggtttgatgaacgtcgactttgctgacgtgagaacggtgatgtcagagatgggttatgccatgatgggatctggtgcagctaaaggcgaagatcgtgctgaagaagccgctgaaatggcgatttcaagtccattactggaagatatcgacctgtctggcgcacgtggtgtgttagttaatattacagcaggctttgatttacgtcttgatgagtttgaaaccgtcggtaacaccattcgtgcatttgcatcagataacgccacagtggtgattggtacttctcttgaccctgaaatgaacgatgaactgcgtgttactgtggttgctacaggtatcggcatggataaacgtccagaaattacgctggtaactaataagcaaaatcaacaaaacgctatggaaaatcgttatcagcaaatgcaaaatagcatgtcctctttctctacagtagaagagagcaagcctgcagctaaagcggttaatgaacaatctactcaagctaacaaagagccagattatttagatatccctgctttcttaagaaaacaggctgattaa

SEQ ID NO: 2846 - DNA, 198 bp, Proteus mirabilis
tttggcggcaaatacagtgtaaataccacttctttacttaccacttctgcagataaaaacgcgcttttaagcatacaacttatactttatctgaaaaatagcgtgattgtttatgttaagggtggggggaatacgaatattcatgtaatatatctgcgcgcttttgtggcgcagatgggagagttgtgggatgattag

SEQ ID NO: 2847 - DNA, 1905 bp, Proteus mirabilis
ataaaaggcaatgctatgaattataaagaatttgcaaaacaaattctcgctattgttggtggcgaggataatataaagtcattagtacactgctcgactcgattacgttttacattacataatgaagataaaattgatccttcaaaagccaaagcaaatagtaaaatattatctgatgtgatgaagggaggacaatatcaactggttatcggtaatgatgttgataaagtatttaatgaactaacaaaaatgataaaaacaaataatactcctcatgataataataaagaccagaagaaacagtctatcgtaaataaaatattatcagcaattactggctctatcgctccggttatccctctgttagcgggtgccggtatggggaaagtgttacttattgtattaacgatgctaggttggttggataaaagtgaccaaacctattatatccttaactttatctttaatacggccttctattttatgccggtatttattggtttctcggcggcgaaaatatttaattgtaaccaatatttagctgcaatggtctgtttggcgatggtcagtcctgaatggacaagcttagttaaagccggtgagcctgtcgaatttatgcatattcctgtcgctttggttaaatattcatctcaactgatccctgctttaattactgtttggatgatgtcttatatagaacgctttattgttcgtattgtgccagaaatggttaaagtatttatggtgcctttattggtgattttagtttcgacacctattgcgttgattgcggtcggtcctgtcacttcatggttcgctcaattaattgctgatggggtgatcttaatccaagagcacactggttttattgctattccattattagtggctatttatccatggttagtatctattggtatgcataaagcacttagtcctgtcagtattatgttagtggagcaaaaaggttttgacccgattattcgtgtgatggcgctatgctccaacatgtctcaggctgctgcttctttagctgtttctgtacgtactaaaaataaaaccttaaaacaattagctttttctgccagtattaccgctttttttggtggtataactgaacccgctatgtatggggtgaacctcaaactgaaaaaaccaatgtacgcttgtatgattggtggtgctattgcaggattatttgctggtattgttaagttaaaagcgtttgtctatgtcactccggggttattaagtttaccaatgtggatatctgatacagataaccaagtagtaaatgcaataatcaccttattgattgccagtgtagccacttttattgcaacgcttattattggttttgatgatcctactgatgacccaatccgtgacgaagaagaaaataataaacaagctgcatcaaccaacaaaaaaccacaaatagcgaatagtaaattacctgttgggttaatttcacctctgcaaggtaaaacggttgcactttcagaggttaatgatgaaacatttgcctctggcattatgggacctggcatggcaattatccccacaacaggaaaagtgattgcacctgcagatggcgttgttgatattaccttttcttctggtcatgcgattggcttaacactggttaacaatattgaaatgctgatccatgtggggattgataccgttaacttagcgggacagcacttcacatgctgtgtcgttaaaggtcagaaggtgacaaaaggtgatacgctaattgaatttgatttagatgcgataatagccgcaggctatgatccaacaacgatgatcatcattactaatgatgatcataaactagacgttgttcagaccgataaaaaacatgtcgaccaaaatacagttttactaaccgtgggttaa

SEQ ID NO: 2848 - DNA, 708 bp, Proteus mirabilis
agggatttaaaccttattatacaatcattttatggtgataatatgaagtctattattctattttttatttctttatttattattaatacatcttatgcaggtgttattattagtggcacaagggtaatttataatgaaggcaataagaatgtcagcattaacgtgaaaaacccagacaaaatgccttatttgatccagtcatggatagatgattttgaggaaaaaaaacagtcaaaatttacgatcacgccacctttatttagattgaatccagataaagagaatacattgaggatctttttaacagaagaagggctaccaagtgatcaagaatctcttttttggttaaatataaaaacgatccctgctacagaaaaaacagaaaattcattacaaattgcatttaaaacgcaaatgaaattgatctatagacctaaaagtctaaaagacgttaattttgaagaagaacaaaagaaattatcttggtcaaaggaaagagggaaagtcatagtttataatcccacaccttattttatgaattttcaaacaatcaaatttaatggaaaattggttgatgatgtttcttatgctaaacctttttcaactaaatcatttgatataaatgataataatgaacatggtcttataagctgggagcttattaatgattatggggctaatgtggatttatccgaagttagaatataa

SEQ ID NO: 2849 - DNA, 816 bp, Proteus mirabilis
cctagattaaatgagattaattgtaaaattatgcaaaaaacggtattgattacaggaagttctagtgggattggactatgtgcggcaaaaacactcaagcaaaaaggatatcgagtactggctgcttgtcgcaaagaagatgatcttaaccatatggaaacattggggtttgagcctatttttcttgatctcgatgatgcagaaagtatcgaaaaagccatattagaagtcattcgccttactaatgggcgtttatatggattatttaataatggtggttttggggtttatggtccattaaatgcgattagtcgccagcaaatggaaaaacaattttccactaatttctttggcttacatcagcttactatggggttactgccggcgatgttacctcatggcgaaggacgtattattcagacgagctcggtaatgggattaatatccactcccggccgaggtgcttatgcggcgagtaaatatgccgttgaagcttggtctgatgcattaagaatggaacttgcctctacggggataaaagtcagtttaattgagccgggtccaataaaaacacgctttactgaaaatgttaatcaagcccaacaagataaaccggtaaaaaatccggggattgcgagtcgtttcacattaacacctgatgatgtagtgaaaaaactaatccatgctttagaaagtccaagacctaagttacgttatcctgtgaccttactcacttatgccgtcaaagtgttaaaacgactcctccctgatagacttatggataggatcttaaacggccaaagtaacaaggcttga

SEQ ID NO: 2850 - DNA, 453 bp, Proteus mirabilis
aaaatgttaaaaattagaatatcacgcccctcagaagcaccagaaatcatacaaatctggaaaaattcagtcgatgctacacatgactttctgacagctaacgatcgccaagagattgaaaaagaagttatcggttttttttccgaaacaccggtatgggttgctactaatcaagaagatcgcccactcggctttatgtttttacatgacggtcatctagaggcgctttttatcgatgcatcagcacgcgggttagggataggaaaacagttaatatcacacgcattaactcttcatcctaatttaagcgttgatgtcaatgaacaaaatcagcaagccgtcggtttttatcagcatatgggctttcaaatatctggacgttcggagttggataatcaaggaagagcgtacccattattgcatctaagtagagctaagacgatcaccctttag

SEQ ID NO: 2851 - DNA, 1896 bp, Proteus mirabilis
attgaggtaaaaatgagtatgaaagatcaggaaacgagaggatttcagtctgaagttaagcaacttctacaattaatgatccattctctttactctaataaagaaattttccttcgcgaattgatttctaatgcatcggatgcggcggataagttacgttttcgtgcattatccgatgcagctctttatgaaaatgagggtgaacttcatgtccgcattgccactgataaagaaaaaagaacactgactatcagtgataacggcataggtatgacccgcgatgaagtgattgataatttagggactattgcgaaatcagggactaaagcatttttagagtctattggacaagaccaagcgaaagatagccaattaattggtcagtttggtgtcggtttttattccgcatttattgtggcagacaaagtgacggtacgtacccgtgccgcggggcaacctgctgataaaggtgttttctgggagtcacaaggtgaaggtgattatacggttgctgatattgaaaaagcggatcgtggtaccgaaattaccctgcatctacgtgaaggtgaagacgaatatttagatgattggcgtctgcgtagtattatcagcaaatactctgatcatatttccctacctgtcgaaatagaaactaaaaatgaagaagacggcaccgttacatgggaaaaaataaataaagctcaagcgttatggacgcgtaataagtcagaaatcagtgatgatgaatataaagaattttataagcatctttctcatgattttgctgatccgctgtgctgggcacataaccgggttgaaggtaaacaagagtacaccagcctgctgtatgttccttctaaagcaccttgggatttatggaaccgtgaacatcaacatggtttaaaactgtatgtacagcgcgtctttattatggacgaagctgaacagtttatgcctaactatttgcgttttatccgcggattagtcgattctaacgatttaccattgaacgtttctcgtgagatcttacaagatagctctgtgacacgtaatttacgtagcgcattaactaaacgtgcattacaaatgttacagaaactggctgacaataatcctgaagagtatcaaactttctggaaagagttcggtttagtgttaaaagaaggtcctgcagaagatcacgctaatattgaagccattgctaaattactgcgctttgcttctactcataatgacagcgatgcacaaactgtttcattggcagattacgtgagtcgtatggttgaaggtcaggataaaatctattacatcactgcagatagctatgctgcggccaaaaatagccctcatctagaattattccgtaaaaaaggtattgaagttctactgctatccgatcgcattgatgagtggatgatgaactatctcactgaattcgatggtaaatcattccaatctgtgagcaaagcagatgaatctttagataaactggctgatgaagagaaacaagcgcagcaggaggagacagataaacaactggcaccttttgttgagcgtgtaaaaaccttactaggtgataaagttaaagaggtgaaattaactcatcgtttaacggatacgcctgctattgttactactggcgcggatgaaatgagtacgcaaatggcgaaactttttgcggctgcaggtcaacaagtccccgaagttaaatacaactttgagttaaaccctaaccatccattagtcaaacaaacggctgagttgaccgatgaaacacagttcgcggactggatcaatttattacttgatcaagcgttatttgctgaaagaggaactttagaagatccaaacaagtttattcgtttagtgaatcaactattggctaaaaacgcgtaa

SEQ ID NO: 2852 - DNA, 1218 bp, Proteus mirabilis
ttccctacaaatataggaaataatatggcaacaaaaaatatagttattattggcggtggtacggggggtactattctcgctaatatcttagctaaaaaattaaatgatgaaatattttcaaaaaaaataaaaattacgcttatttcagataatccataccattattacaaacctgcatttatgtatattgcatttaaccttttcttaaaagaagagttaatgcgatcacaaagaagtttattaagaccagaaattgaatttgttatagataaagctgaaagtttcgattttaataataaaacagtttattgttgttctaagaaaaaatatcactatgattttctcgtattagccacaggatgtgttcctcgtcttgatagaattgaaggtttagctgaagctggaaatcatttttatcaatatgaagctgcacgaaaattagcagataaaattgctaccattgaaaaagggcgtgtatttatcacggtaactttccctgaaacgccaaatgtacctcaccaatgtggtattgcaccaatggaaacaaccttgatgctggatgaatttttacgtcagcgacgggtaagaagtaatatagaaattgtttatacctatcctaccgtagctcaactattaagaaattgtctttttatgcagcaagaagtttgtgaagtacttcctgcggtcttttctgaacgagatatcaaagcaaagcgtggttttacattaagtcatgttgatcctgataagaaaatcgcctattcgaaagaaggagaagcagagccttttgatatcttaatgagcacacctcctataacagcggtagaagccattcgtaatacaggattaagtgaatataacaatggtgaaggctggctaccgaccgaccctgaaacattacaggtatatgggttaaatcaagtttatgtgttaggtgatacggttgatttgcctattagtaaggccggtggtagctgtcataaccaagcgggtgttatagctaataatatttgtggtgaactgcgttatggttatccggctgcaatttatgatggtcgagtacaagctgttgcccaaatgggattatcagcgggtatgccattacagtatgactataaacatgatgttattccaacacctccaacaaaactcggtggcatgttacgtaacggttataaccggggcttatattgggcaacggtcagaggattattgtag

SEQ ID NO: 2853 - DNA, 1086 bp, Proteus mirabilis
ggaaccaaaaaaatgaaatatactcctcaacataaaatggatgctgcattaatggcaggcacatccttaaacacacccaataatcattcaatacaagagcaacatcatcgtttaaaagatgatgctaccgttagtgcttatatgagccagaattatatttctgtttctgtcgcagattcggttgaacatgtaaaagcacagctggttaatgatttaaaagatgaattaattccaacttatctgtatgtcgtagataaagataattatcttaacggtattttgccggttaaatcattactacttgctgataatgggctttttgtttcggatattatgcgccaaacatttttctcagtttcaccggagcaaagccgacatgatgtttatcagttaattagccaaagtggtttagacagtgtacctgtgatgcattttggtaagttagttggtgtattacggcctcaagatattgctgatttaattgaagatgaaaatacgctagatgcacaaatgcagggggcaacgtcgccattagaacaaccttatttagagacaagtccggttactttgtggcgtaaacgtgttgtctggctattaatgctgtttattgctgaagcttataccagtacggtgttacatgcttttgaagacagacttgaagctgctatctctttagctttctttattccattattaattggtactggtggcaatagcggtacacaaattacctcaacattagtacgtgccatggcattaggtgaggtgagcttgcgtaatgtatggtcagtattaagaaaagagatcacgacctcgataatggtggctttaaccatgggaatagcaggatttattcgtgcttggaccttaggggttggcatggaagtgatgatagtggtgggattaacgctaatttcaattacggtttggagtgctattgtctcttctattattccaatggtattaaagcgtattggtgttgatccagcggtggtgtctgcaccttttattgcaacatttattgatggtactgggcttattatctactttgaaatagcatctcatactatgagtgtgtttgcttaa

SEQ ID NO: 2854 - DNA, 222 bp, Proteus mirabilis
ttaaacaaaaatttacaattctatttaaccatcacaagggcttatagcaagcaaaaaataaagaagaggattttattaaagataagtgttctaaattttgttaatttaattatatttatatggcaatataaaaccatcaaaataagagtatctaattacacgtcttatttaatcaatataaaacccacacttaccacatctaagttaacactctatttttaa

SEQ ID NO: 2855 - DNA, 1509 bp, Proteus mirabilis
ttaataaaaaagaggatacaagtggcagatcctaatttaagtgacctattaggggcactcgggatacaagcaccgtctttaacgcttaaagacatgacactcgatagccgaaaagccgcgagtggtgatctgtttgtggcaattaaaggccatgaaacggatggtagacgctatattcctcaggcaattgcacaaggtgtttgcgctgttttagcggaagctgaaggtattgctactcatggcgaaattcgtgaaagtcatggtatacccgttatttatattgaaaacctaaattgtcaattatcaaaacttgcaggaattttttatcatcagccagcggataaattaaagctgattggtgtcactggtactaacggaaaaacgacaacaacacaattgttagcacagtgggcgcaaggtttagatgaagtcagtgccgttatgggaacggtaggcaatgggttattagatcatattgttccggcaatgaatacaaccggttcagcggttgatatccaattagaattacagcaattagttaatcaaggcgctacctttaccgcaatggaggtttcgtcacacggtttagttcaagggcgcgttagtgcgctaccttttgtcgccagcgtatttaccaacttaagtcgcgatcaccttgattatcatggtgatatggcaaattatgaacaggctaaatggttgttattttcgacccaccatagtggcgaaaaaatcattaatgctgatgatgcggtaggacataaatggttgacgcatctacccgatgctgtggcggtgactatggcggataaattgccggcaaattggcaaggacgctatgtgcaagcgacacaaatcaattaccatgatgcgggtgccactatccattttaattcaagttggggagaaggtgaaattgaaagcccattaatgggggcttttaatgtcagtaacttactctgtgctttagctacacttttggcacttgaataccctcttgatgcagtgattaaagcttccagtgcattaacgcccgtttgtggtcgtatggaagtatttagtgcgaataatcgtcctacggtgatcgttgattatgcccacacgccagatgccttagaaaaagcgttacaagcggcacgcttacactgtactggcaaactgtggtgtatctttggttgtggtggtgatagagataaaggtaagcgcccactaatgggcgctgtagcagagcagtttgccgataaagtggttatcaccgatgacaatccgcgtagtgaagagccacaagccattattcaagatatcctttctgggttaatggatcctggtcgtgcattagcgattgaaggacgagcagaagccgtgacgaatgttataatgcaagcttctcccgctgatatgatcttagtggcaggaaaagggcacgaagattatcaaatcgttggcactcgccgtcttgattattctgaccgattaacggttgcacggttattgggggtgatcgcatga

SEQ ID NO: 2856 - DNA, 195 bp, Proteus mirabilis
aaaatggaaaataaaaaaattattcgctcggagataaaaagagaaaaagagagtacaaaccaagatataaataaattaaagaaattattttcaataaacaactatcactatagagatattaataacgaagaaaatcaacatagccttatttatcgttggccattactcaacacatttaattcaataactaaatga

SEQ ID NO: 2857 - DNA, 1176 bp, Proteus mirabilis
ataaaaatgaagttatcggcagtcgttaattttatggagacatcgtcttttagcagaaagatgatgtctttcttattgatcttgaatagtctttttattatttactcgatattactttctcgtggtgtttatcttgattgggaaatacacggttttgctgactggctaaaatcgttaggtatattgaaattacttgatattcctaaagtgatgttagcgagtgcacttattttgctctctttctttatgtatatgggggcgcggattgcgtggtgcgtttcattaatattattagtgacgatcgtttttttagatgtcgcggtttatcaccaagccggtactcaagcctatacttcattagcattagccattgtattggttatcagccggcgtgcttttcctcatcatagcttaaccagtgccggttttgttgcttttatctgtacgatttcgctactgagtttctctatgttaggcagcctctatattggtgatgaatttaaaccacatatcacaacgttaatggatgctttctacttttccattgtctgtatgacaacacttggttttggcgatatcgttcctatctcaagtaatgcgagaatgtttaccctaacagtggttattttggggatcactgtttttacgacttctattgtttatgtgatgggatttttggctcgtggtactcgcgatattgtgaagaaaaggatcgctaaaatgcatgatcattttattattattggctcttcaatgttggcagcacaattagagaaagggcttagagagcaaggtaaaccggttattgcgatttgttcggataaaaagcaagccatgtatgataaagaagccaatattattgaaggtgatccaaccaatgtaaaaacattacaaacggcaaatattcgccaagcgagttgggtggcgacgttatctgaaagtgatgcggaaaatacctttattttattaactattcaagagtgtccagaccttcaagcgaaattaatcactatcattaataaagatgagaatagagaaaaaataagtcgattacgtccagatatgctgttgtctttagcttcgttaggcaaagaaattatgatgaaagtcctttgtggtgaatctattaattcgtctgatgttactgatttattaatcaataaatatttaaaataa

SEQ ID NO: 2858 - DNA, 192 bp, Proteus mirabilis
cttggtgcgaagataaaaaaggtgccgttgtcagctatctggttgatttgttccgacaagggcatcccagtgtgcaatctttttacgatccccttaactaaaaaaggcaaaccgaagtttgcccttgttgataacattaaacttaatgcgttagttggtcgctgtggcgtcaggattttctttaataaataa

SEQ ID NO: 2859 - DNA, 1464 bp, Proteus mirabilis
caaccgcagaaatgggtgatcatatcgctcagtttattcaagaaggggcataacatgggtaaaacattatatcaaaaaatttacgatgcacatgttgtcagagaagtagcgaatgaaacacctattatatatatcgatagacatttagtgcatgaagtgacttcacctcaagcttttgatggtttaagaaccaaaggtcgtcccgttcgtcaacccaacaaaacctttgccacaatggatcacaacgtttcaactcaaaccaaagatatcaacgcctgtggtgatatggcgcgtattcaaatgcaagagttaatgaaaaactgtcaagaatttggtgtgaccttgtatgacttaaatcacccatatcaaggaattgttcatgttatggggcctgaacaaggcttaactttaccaggcatgacaattgtttgtggcgactcacatacagcaacacatggtgcctttggcgcattagctttcggtattggcacttctgaggttgagcacgtattagcaacacaaaccttaaaacaatcacgtgctaaaaccttaaaaatcgaagtacaaggcaaaacagccaatggcatcacggcaaaagatatcgtattggcgattatcggaaaattgggtagtgcgggaggtacggggtatattattgaatttacgggagaagctattgaagctttgagtatggaagggcgaatgacgttatgcaatatggcgatagagatgggggcaaaagcaggcttagttgctcctgatgagactacatttgcttacttaaaaggacgtcaatttgcccctcaagccccattgtgggatgaagctgtcgcctattggaaaacgttaaagtcggacgaagatgctatttttgatgctactgtgacgattaatgccgcagagattgcaccacaagtgacttgggggacgaatccgggacaagtgattgctattgaccaaattgttccgcgattgaacagttttaacgatcctgttgaacgagctagcgccgaaaaagccttagcttatatgggattaactgaaggtgttaacttaactgatattacaatagataaagtttttataggctcttgcactaactctcgtattgaagatttacgcgcagcagcaaagatagctaaagggcataaagtcgcctcccatgtacaggcaattgttgttcccggctcaggccctgttaaagcccaagcagaagcagaaggtttagataaaatttttattgaagccggttttgagtggcgtttacccggctgctcaatgtgcttggcaatgaacaatgaccgattaaatcccggagagcgttgcgcatcgaccagcaatcgtaattttgaaggtcgccaaggtcgtggtggcagaactcatttagtcagtccggcaatggccgctgccgccgccattcatggacattttgctgatattcgcacttttgcaacagtatcataa

SEQ ID NO: 2860 - DNA, 846 bp, Proteus mirabilis
cggaataagaaaatgaaactaaaaaataacagcttaaatgctggtggattcgctcaccctgaaaaccactctagcgatattaaggaattatcttttgctgaaatgctgccagtaattcagggaaatattaacgggcagattattaacgcggtaagtgccaaagcattacacgaagcattaggtgtaggtcgtgatttttctacttggattattggccgtgttaatgaatacgcttttgtggaaggaacggattatcaatcagatgatgactttaatattcgctgcttacttaatgaacaatattcccccgttttggggaataatacaaaacgtggtcgccctgaaaaggattacttattaacgctaggcatggctaaagaattggcaatggttgaacgtaccgaaaaaggccgcttaatccggcaatactttatcaagtgtgaggaagctctacacaaagtcgcgccaacaatcaccaagcaattacgccatcaacttaaatcacgcctaaaagtggccagttactttaagccgatgtgttcagcgttagagctggcacgcatggagcaaggtaaaagcacactcccacaccattacacgactgagtcaaacatgctgaaccgtattgtgttaggtggactcactgccaaagcatgggcgaagcagaacggcattattggcaatcctcgtgatgctatgagcgaaacccaattagagcacctttcataccttgagcagacgaatacaacgctaattgaattaggcatggactatcacgcacgcaagggcaagttaatcagtctatctcaaaagtggttagcgcaacgtgtagaggtggcgcaatga

SEQ ID NO: 2861 - DNA, 1485 bp, Proteus mirabilis
tggaataacctgatgaataaattaactccattacgacctatacctaccttaattgcggttgctattacccttatcatttggtttgttatccctgttccccaaggggtagatcccaatgcttggcacttgttagcactgtttgttggtactattgcggctattatcggcaaagccttacctataggggcagtatccattattgctattgcgcttgttgccgcaacaggcgtcactaacccagactcaactaaaggggcgattaatgatgcattaagtggcttttccaacaatcttatctggttaatcggtatttctattatggtttcaatgagtcttaataaaactggattaggtgctagaattggctactattttatttcgttatttggtaaaaaaaccattggtatcgcttattctctagctattgcagaaacgatcctcgcccctgttacgccaagtaatacagctcgaggtggcgggattattcacccaataatgcgatctattgccgatagctttaattcaaaacccgaagagggtactagtggtaagattggtcgttatttatcgctagtcaattataatatcaatcctatcacctcagcgatgtttattactgcaaccgcgcctaatcctcttattgtaagcttaattatcggtgaaacagggcctgaaaatgagttaacttggtcaatgtgggcaatagcggcttttgttcccgccattgtttcattatttttaatgccgattgtgatctactttttatataaaccagagataacccatacgccgaatgctccccactttgccaaagagcgtttagctcaattaggccctatttcattgccagaaaaaatcactttgggagtatttgcactgttattaattatgtgggcaggaatacccgcactattatttggtgatgcttttagtattaatgcgactactgcggcttttattggtttatcaatcttattatgtactggcgtattaaattgggatgatattttaaaaaacaaaggtgcatgggataccgtggtttggttttccgcattagtaatgatggcctcttttttaggaaaattaggtctaattaaatggctctcattaagtgtgggggccggtattgatagtatggggataagctgggtaagtggtatgatattactcgtgctgatttatgtctattctcactatttctttgctagcaccacggctcatattaccgccatgtttgctgcattctatgccgcaggtttagctcttggcgcgccaccaatgttattaggacttattttagctttctcttcttcattaatgatgtctttaactcattacggtacaggtactgcaccgattattttcggctcaggctacgcgaccttaggtgagtggtggaaagcaggttttgttatgagcattgttaacctcattatctggataacccttggtagtttatggtggaaggtgctggggtattggtaa

SEQ ID NO: 2862 - DNA, 270 bp, Proteus mirabilis
ctagaccttgaaatactaggaattcttgtaatagctgattttataaggattttatggactattgtagacgttaaaatacttgagaatggtacgccctacaggattcgaacctgtgacctacggcttagaaggccgttgctctatccaactgagctaagggcgcctagaggggaaatagacgttagcatttatgctgataacgggtgtgaattatactttcaacattctgagagtcaacgatttttccacaaaatcaaactagatggttaa

SEQ ID NO: 2863 - DNA, 318 bp, Proteus mirabilis
atgtctactgaacgccattcattaccgggagtaataggacaagatttactgcgtcacggcaaattgccacttattctttttttcgccgttattatctccgcgatctatgtggtaacgacagcacataaaacacgcttactgacagcagaaaaagagcgcttagtgttagaaaaaaatgtattggatattgaatggcgcaacttgatccttgaggaaaatgcattggcggaccatagccgagttgaacgttttgcaagtgaacagttaggcatggttcatgttgatccaactaaagagaatattgtggttactaaataa

SEQ ID NO: 2864 - DNA, 1461 bp, Proteus mirabilis
ttatataatgataattattcactgcatgaaaggaattgtttcgaaatggcaataagtagaagaaaatttattcttggtggcacagtggttgctgttgctgcaggcgctgggattttaacacctatgttaacgcgagaagggcgttttgttcctggtacgccgagacatggttttgttgagggaactggcggtccattaccgaaacaagatgatgttgttgtaattggtgcgggtattttaggtatcatgaccgcgattaaccttgctgagcgtggcttatctgtcacaatcgttgaaaaaggaaatattgccggcgaacaatcatctcgattctatggtcaagctattagctataaaatgccagatgaaaccttcttattacatcacctcgggaagcaccgctggcgtgagatgaacgctaaagttggtattgataccacttatcgtacacaaggtcgtgtagaagttcctttagatgaagaagatttagaaaacgtaagaaaatggattgatgctaaaagcaaagatgttggctcagacattccatttagaacaaaaatgattgaaggcgctgagttaaaacagcgtttacgtggcgctaccactgattggaaaattgctggtttcgaagaagactcaggaagcttcgatcctgaagttgcgacttttgtgatggcagaatatgccaaaaaaatgggtatcaaaattttcaccaactgtgcagcccgtggtttagaaacgcaagctggtgttatttctgatgttgtaacagaaaaaggaccaattaaaacctctcgtgttgttgtcgccggtggtgtttggtcacgtttatttatgcagaacctaaatgttgatgtaccaacattacctgcttatcaatcacaacaattaattagcgcagcaccaaatgcgccaggtggaaacgttgctttacccggcggaattttcttccgtgaacaagcggatggaacgtatgcaacttctcctcgtgtcattgttgctccggtagtaaaagaatcatttacttacggctataaatatttacctctgctggctttacctgatttcccagtacatatttcgttaaatgagcagttgattaattcctttatgcaatcaacacattgggatcttaatgaagagtcgccatttgaaaaatatcgtgatatgaccgctctgcctgatctgccagaattaaatgcctcactggaaaaactgaaaaaagagttcccagcatttaaagaatcaacgttaattgatcagtggagtggtgcgatggcgattgcaccagatgaaaacccaattatctctgatgttaaagagtatccaggtctagttattaatactgcaacaggttggggaatgactgaaagccctgtatcagcagaaattacagcagatttattattaggcaaaaaacctgtattagatgccaaaccatttagtctgtatcgtttctaa

SEQ ID NO: 2865 - DNA, 1665 bp, Proteus mirabilis
aaggaattcgatatgtattgtgtgcaatgtgaacaaacaatgagaacacctgttggtaatggttgtgcctatgcacaaggtatgtgcggtaaaacagcagaaacctctgatctacaagacttattggtggcagtattagaagggctgtcagcatgggcattagctgcgcgtagtgttgatattattgatcacgatatagacagctttgcgccacgggctttcttctcgacgttaaccaatgttaattttgattctgaacgtattgttggatatgccaaagaggctatttatttacgtgaaagcttaaaatcacgtacgttagccaaaaatgcagccatccaagtcgctcatcctaaagccgaaattcaattagaaggcaacgacttagccagtctacagaaacaagcccaacgctttgcattaaataatgataaagcgcaagtgggggatgatttacatggtttacgtatgctttgcttgtatggcttaaaaggtgctgctgcttatatggagcatgctcatgttttaggccagtacgatgatgaaatttatgctgaatatcatcgttacatggcatggttaggtaccgatcctgcggatatgaatgagttgctagacaatgcaatgggcattggtcaaatgaactttcgtattatggcgttattggataaaggtgaaactcaagcttatggtgatccaacccctgtttccgttaatgtacgcccagtagcaggtaaagctattttaatttcaggccatgatctgaaagatttacagatgctacttgaacagaccgaaggtaaaggcattaatgtttatacgcacggtgaaatgttacccgcccatggttatccagagctgaaaaaatataaacacttagtcggtaactacggaagtggttggcagaatcaacaaagtgaatttgccaaatttcctggccctgtgttaatgacatctaactgtattattgatcctaatgtggggaactatggcgatcgtatttggacgcgtagtattgttggttggccgggtgtgaaacacattaaaggtgatgatttctctgaaatgattgagcaagcgctctctttagagggatttccgtacagtgaaattgaacacttaattactgttggatttggtcgtcaaacactcttaaatgcggctgatacagtgattgatttagtttcacagaaaaaacttcgtcatgtcttcttagttgggggatgtgatggtagtcgtggtgaacgtagctactataccgatcttgctcgtgccattccccaagattgcttaattatgacattagcttgtggtaaatatcgctttaataaacttgattttggcacattagagggcttaccgcgcttacttgatgtgggtcagtgtaacgatgcctactctgcgattatgctagcggttaatcttgcagaaaaattaggttgtggtgtaaatgatttacccctgtccttgattttgtcgtggtttgaacaaaaagcgattgttattttattaaccctactctcattaggggtaaaaaatatttatactgggccgactgcgcctgcatttttaaccgataatttgctcgcaatacttaatgaaaaatttggtatgcgtgcgatcaccacgccagaacaagatcttcaagaaattctttctgcttaa

SEQ ID NO: 2866 - DNA, 597 bp, Proteus mirabilis
tctgctctcgattatttaaggccaaaatctatgtttaaaaaaatcataatattattatttttcactaaaatcttttcaacatatgcaagcggagctgtattggataaatatatcccatcagataaagtttggtggcaaggaacagcaaagtttttaggaaaagtaatttcgcctgcttgcacattagatatggatagtaaatatcaattggttgatctaggtactatacctgttaataaaatgaacaataatgatgatttattagcgagtaaaaaaataaaaataaaattatctgattgccaatttattaataagactaaaaatatcgataaagtgaaaggcgttacgttaacattttattcagatgttagtggatctaaagctgatttattttcatttaataacagtgatgaagtctattttaaaataatagatgaatatggatatagcgctaattctggagagtcattaccattaatatatgttgatggggataatacatatctatattacaaaatagacgttgtaaaaaagttggatgtaattactcctggtgattattatgcaagcgttttattcaaaataaattatgaatga

SEQ ID NO: 2867 - DNA, 735 bp, Proteus mirabilis
ttaataaacgacaaaggtcttgaaatgaaaaaaatatcatttttattattaggattaatggttacatcaaactcctatgcagcaatttctttagatagaacaagagctatatacgaaggtgggtcaaatgcattagttattaatattactaatgataataaacaattaccttatttagcccaaacatggattgaaaatgataagaatgaaaaaattgagctagggccattaattgccacaccattagttcagcgattagagcctggtgataaagcgttaataaaagtatctgcgacaccagatattgaaaagttacctaacgatagagaaacattattttattttaatgttagagaagttccacctaaagctgaagacaataatgtattacaaattgccttacatacaaaaataaaattgttttatagaccgaaacaaatattgagagagccaaatgctatttggcaagatcaattagttttaaataagctatctgacggttatgaaatagagaatccaacaccttattacgtcactgtattcggtattggtggttcaaagaaagaagcggttgattctgagtttaatgcagtcatgattgcccctaaatcgtcacaaagggttaatagtaaagtgtactcaacgccatacttatcttatataaatgattatggtggaagaccgacaattaaatttcaatgtcaagctaatcgttgtgtagcagagaaaaaataa

SEQ ID NO: 2868 - DNA, 735 bp, Proteus mirabilis
gtagcgctttttatgtgcaccctgtttattgcagatctgcatttaagtgagcacgaaccggcaattactgccggttttcttcgctttttacaagagcaagcgattcacgcaaatgcactttatattttgggtgatttttttgatttttggattggtgatgatgatcctaatccactacatcagcgcatagcccaagcattaatggcattaaaaaatgcgggagtgccctgctattttattcatggtaaccgcgatttcttaatcggctctcgctttgcaaaagagagcggaatgacactgctaccacaagaaaaagtgcttgagatagagcaacatcgcattttaatcttacatggtgatacgctttgcaccgatgatgaagcctatcaacgctatcgtaaaaaagtccacaataagtttattcaacgcttattcctactccttcctctgaccattcgattacgtattgctaaaaaaatgcgctctcgtagtcaaagtagcaaccaatacaaatctgaagcgataatggacgttaatgctcaagccgttatcaatacctttaaacaatttaatacccaatggatgatccacggtcatactcatcgaccggcgatccacaccgtcgacattgatgggaaaccacattatcgaggtgtattaggagcttggcatacggaaggctcaatgtttaaagttacctcagataaaatcgaactgatccaatttccattttaa

SEQ ID NO: 2869 - DNA, 582 bp, Proteus mirabilis
tttaaggtagatcatatggttatttatttttatagagaatgggtaaaaatattattttttatgcttatttttttacctgttgcaaatgcggctacaacaatgaattttgatggtactttgattgatacgccatgtagaattgatcagccaagtttaaatcaaaatgtggtttttttaaatagcacaccaagggattattggaaatatcctgcggttagacctgcagaaaaatttaccattaaactgatccaatgtgatgcaaaatcgttatggaaatcagtgaaaattaaatttaatgggcagccagagccagagatgggggctgaacaacaaaagtaccttacactttcttctggcgttaataaaagtaagttagccattggattaattgatatagatggaaaccaacgtattactttaggtgaaaaccataacggtggaaatggaactcaacttaacgatggcacgatgttgctaacctttaatgcatttgttgaagcgacaccaaaagcaatacaggaaaaaagtgttgtacctggagtttataatgccacggtagaatttgaggtttcttatgaataa

SEQ ID NO: 2870 - DNA, 1278 bp, Proteus mirabilis
ggaattgcagatatgtactcaactatcgaacaagcgaatgaagcagttatcgaacgtatccgtgaagcccgtcctcactggtgtgatgtgagtttagcaaaagaagtagtgccaactttagcaacaggaaaaaaattactgcatgcgggacctcctgtaacttggcaagaaatgagtggccctgtccgtggcgcctgtattggtgctagcttatttgaaggttgggctgaaaatgaagcgcaagccttggctatgttagaggcgggagagattgagtttattccttgccataatgtcaatgccgtagggccgatgggaggtattacttctgctcatatgccaatgctagtgattaaaaaccatgttcacggtaactatgcttactgcaatatgaacgaaggtattggtaaagtgatgcgttttggtgcttatggtcctgatgtacaagaacgtttgcattggatgcgtaatagcttagctccggtattaaaagcagctttagccaccattgagaatgggatagaccttacggcaattatgggtcaagccattacgatgggggatgaattccaccaacgtaatattgcagcttctgcactattgttacgagagctggcgccaattcttagcacattggatttagatgcggctgagataactaaagtgaccaaattcctcagtattactgaccaattcttccttaatttagccatggcttattgtaaagcggcgatggacgcaggagcacaaattaagcaaggtacgattgtgacggtaatgacgcgtaatggtagtaattttggcatcaaaataagtggtatgggtgatcaatggtttactgcaccggttaatacgccacaaggattattcttctctggttttagccaagcagatgccaaccctgatattggtgatagtgctattactgaaactttcggtattggtggtgcagcaatggttgcagctccgggagtaacccgctttgtcggagcatcgggtggtatggatgcagcacgtgaagtgacagaagagatggctgaaatctaccttgctcgtaatatgatgctacaaataccgacttgggatttccaaggtgcgtgtttaggtttagatgctcgtcgagttgttgaaacgggtattacaccgctaattaatacgggtattgctcataaagagccgggggttgggcaaattggcgcaggaacggtacgtgcacctttaggctgttttgaaaaagcgatagtggcactggcagaagaattaggcattgaagcttaa

SEQ ID NO: 2871 - DNA, 1368 bp, Proteus mirabilis
atgcaaaaagagaataaactttcacgaggactatcagggcggcatattcgtttcatggcgctaggctctgctattgggacagggcttttttatggttcagccgcggcgattgaaaaagcaggccccgctgtacttcttgcttatcttattggtggtgccgcagtatttatggttatgcgcgcattaggggaaatggcggtccatcatccagtggcgggttctttttcacaatatgctagccattatatgggaccattagccggatttttaactggctggaactacgtttttgaaatgcttatcgtttgtcttgccgacgtcaccgcatttggtttttatatgaaactttggtttcccgatgtcgaccaatggatatgggtattaggcatagtctgttttattggtgccttaaatttatgtcatgtgaagatatttggtgaaatggaattttggctctctatcgttaaagtgactgcgattattgccatgattatcggtggtgtagccataatgatctacggctttggtcagcaaacagaacatccaattggtatttctaacctatgggagtttggtggctttatgccaaatggtatagaaggcattattgcctcactcgccattgtgatgtttgcctttggtggtattgaggttattggtattaccgccagtgaagctaaagatccagaaaaaacgatccctaaagctatcaatgcggtgccatttcgtatcttactattctatgtactgaccatttttattttaatgtgcatcttcccatggcaacaaattggccataacggtagtccatttgtacaaattttttccaatctgggtatcaattcagccgctaacattcttaatcttgtggtgatcaccgccgctatctctgcgataaacagtgatattttcggtgctggtcgcatgatgtacggcatggcacaagaagggcaagcacctaaatcctttatgaaactgacgcgtaacggtgtaccttggatgaccgtattagtgatgtcagtggtgctattattaggggttgtgcttaactatcttattccagaaaaaatcttcgtacttattgcctctatcgcgacatttgccactgtatgggtctggttgatgatcttactttctcaagtggctatgcgtcgccaaatgagtgctgaagaggcgaaaaaactaaaatttcctgtaccattttggccaatagcacccgccattaccattatttttatggcatttgtgatagcaattttaggctactttgaatcaacccgaatggcattaatcgttgggttagtatgggtggctattttaactgttggttactatattggtatcaaaccaagaataacgcagaaataa

SEQ ID NO: 2872 - DNA, 225 bp, Proteus mirabilis
tgtaaaaaagattctgacacaatattaagaagctcattgacgtttaaagggcgagttaaatattcgaaagcccccgctttaaatgcgttacggcaactttctatcgatgcatctcccgaaataattataacaggaatgatattctttaatttgtttaactcttttaccaacgcaattgatggcgatgcactacttttagtgttaattatgatgcactctttatga

SEQ ID NO: 2873 - DNA, 213 bp, Proteus mirabilis
aatttcagagacgaagaaatacagagaaatacgtcattagatcaacaaaaaacaccttatattgttgacgttacgttgacgtatgttttatctatcaaccattctgcaagtattgatacaactgacattaacactcatttagttatgatcagattcggacttatagaaaaatacttatataagggtgatatttcgataacgtcaagcatatag

SEQ ID NO: 2874 - DNA, 1197 bp, Proteus mirabilis
tgtcaaggagatataatgacgcaaagtaataagtgttttaatactcaagcaatacattatggctactctccgttagattatcagggggcattggtgcctcctgtttttcaaacgtccacttttgcatttcccacggctcaatatggtgctgattgttttgctgggaaagaaaaagggcatttttatactcgtatatctaaccctacattggatttattagaaaaacgattagctcagttagagcaaggagacgcctctgttgttttttcttccggtatgggagctatcacttcaacatgttggtcattattgcagccaggagatgaactcattgctgatatgaccgtttatggttgtacttttactttctttaatcatgggctggctaaatttggtatcactatcaaacatgttgatttaaccgatcctgaaaaattagccgaagcaattacagatagaacaaagcttattttctttgaaacaccggctaatcctaatatgcgggttagtgatattgaaaagatcgctaatattgcgcaccaacatgatgttttagtcatggttgatagtacttactgttcaccttatttacaaaagccactaaccttaggcgcggatattgtcgtacattctatgactaaatatttatcaggtcatggtgatgtgatggcgggcgcaattatcactaattatcaattagcagataaaattcgcgttgagggcttaaaagatatgacgggggcttgtttatcacctcatgatgcagcactcgtcttaagagggataaaaacgcttagcattagaatggaaaaaatttgccagaatgcgcagcttattgcgcaatttcttgaaaatcatcctaaggtggcaacgatttcatatcccggattaaattcttttcctcaatatgaacttgccaaaaagcagatggcgttacctggtggcatgataagtatggagttgaatggtggaataaaagctggcagagaatttcttaatcgcttaatgctttttactcgagcggtgagtttaggtgattgtgaatcattggctcagcatcctgcgactatgactcatgcgacatacagtgcacaagagcgtcaacgccatggtattagtgatggattaattcgtttatcaatcggtcttgaagacgttgatgatttaattgctgatttaacccaagcgctagcctaa

SEQ ID NO: 2875 - DNA, 1776 bp, Proteus mirabilis
caagaaggagaattgatgccgcattcaacccccctcattaccaccattgttggtggattagcacttgcttacatcttaggcatgattgctcaacggctaaaaatctcacctttagtaggatatcttgctgcgggtgtgctcgctggcccatttacccccggctttgttgctgatacctctttggcgcctgagcttgctgaaatcggtgttatcttactgatgtttggcgtaggtttacatttttctttaaaagatctaatggctgtaaaagctatcgcgatccccggtgccatagcacaaattaccgttgccaccttattagggttagggttatccactttctttggctggggtctatttagtggcattgtctttggattatgcctttcaacggcaagtactgtggtattgctacgcgcactcgaagaaagaggtttaattgatagccagcgcggtcaaatcgctattggttggttaattgtcgaagatctcgctatggtattagccttagtattactaccagctattgccaatatgcttgaaagtagtgaccaaacaagtatttcacagttattaattaacttaggtatcactattggtaaagtagttgcctttattttaattatgatgattgtcggtcgtaagcttattccgtggatcttagctaaaacggctgccactggctctcgtgagctttttaccctatgtgtgttagcactagctttaggtatcgcttacgcagcagtgacgctatttgatgcctctttcgcattaggcgctttctttgccggtatggtacttaatgagtctgacctcagccaccgagcagcacaagatactttacctctacgtgatgccttcgccgttctgttctttgtctctgtcggcatgctatttgatcctatggtattaattgagcatcctctaggcattttagccacacttgcgatcattattataggtaaatccttagcagccctagtgctcgttcgtatgtttgggcattcacgcagaaccgcattaaccatttcagccagtcttgcgcaaattggtgaatttgcctttattttagctggaatgggggttgcactaaatgttttagaaccagatgcacgtaacttggttcttgccggcgccttagtctctattatgcttaatcctgttctcttctctttgttagaccgttatctagcaaaaacagaaaccaaagaagagcaagagcaacttcaacaagaagagatggaagaagagatgcctgtgcctgtcgatatttgtgggcatgccattatcgtcggttatggtcgtgcaggtagtatgctagctgaaaagctacaaccacaagctatcccattggtcattattgaaaatagccgtaataaatttgctgagttaaaagaaaaaggcttaaacgccgtactcggtaatgctatgaccaaagaatcgctggcattagcgcgtgttgattgtgctaaatcgctactactaaccattcctaacggttatgaagcagcagatatcgcagaaacagcaagaaaaatgaaccctgatcttaatattatcgttcgtgctcattttgacgatattattgttcgtgctaactatgatgaagaagcttcctttattcttgagaaaggggcaaatcatgtgataatcgatgaagatcagaccgcttcagcaatggctgagatgctaatacaagaagtcgagttcggttgcaccattgatgacacacctgaagagggtcaacaaattattgcacccaatgcagcgcaataa

SEQ ID NO: 2876 - DNA, 948 bp, Proteus mirabilis
aaaatgacggattacacatcagcaacaacgaccaataaagagtcagcagatatgcatttacgtaatgttgatcttaatttattaacggtgtttgatgctgttatgcaaatgcaaaatgtcacacgagcagcacaggtgttaggtatgtctcaaccggcagtcagtaatgcagtttctcgtcttaagatcatgtttaatgacgagttatttgttcggtatggccgaggtattcaaccaacattaagagccaaacagttatttggccctgttcgacaagcattacaattagtccataatgaattgccaggggcgggatttgaaccggaacaaagtgatcgtgtgtttagcttatctatttgcagtccattagatatcaagttagcgccaaaaattgtagagagaataaaaaataaaacccctaatattaatgtaaatattaagtcttatttgaatagtaatattgaacaccaattaaaatatcaggaagttgagttctttattaattataaacaatttgataaaccagagtttcattcacaccctttattcaatgatgaagtggttttggctgtctctaaccaacacccacgaattaaagaaagcgttactgaagagatgttattaaatgagcatcattctattgtttctttagaagatgtggggtcttttagtgctgcttattataagaatacagagttagaagatttaattacttatgaaggtactgatttaaatagtgtattaaatctagtctcaaaaacttattcggtcgctattgcgcctagatggttagttgaaagctattcagaacaattgaacattaaggcgatatcattaccttgggagaaggtagaacgtccatgctatttaatttggcatgagtcaacggcgcgagataaaggccatttatggatgaaaaatttacttagtgaggtttgtcaaaactaa

SEQ ID NO: 2877 - DNA, 270 bp, Proteus mirabilis
ctaaaatcactaatttgtggttttgataccaagggtagcatttcaactgttaccctttccgactacggcgataatcaccatagtacagcactcatttttgagctttgctatgtattcaatcagttacaaggcgcaataatacgctttgcttgttttacagtaagttaccttaactttaagttatggacttattcgttaaatccactagcaatgatacattttctaatctgtataacactgttatacactgatataataagcgctcactga

SEQ ID NO: 2878 - DNA, 234 bp, Proteus mirabilis
tactttgtttgttcacaaagtgttcagactcatttttacattttcattagtatgatgaaattgacaaaacttttcatgactcacaattttacaaatttatgtaaaattagattcctttatttttgcggatcacttagacttccagataagtcagcgaacaggtgtaagctgaaattagaagatgacattattctttatttcaacttaattattcctacgcttttccataaataa

SEQ ID NO: 2879 - DNA, 1083 bp, Proteus mirabilis
atgttagtttggctagccgaatatttggttaaatatcatacattttttaatgtgttttcttatctgacattcagagcgattgttggtttattgacggcattaattattgcgttatggatgggaccccatttaattgcatggttacaaaaaatgcaaatcgggcaagtggtgcgtaacgaaggccctgagtcacactttagcaaacgtggtacgccgaccatgggtgggatcatgatcctattttctatcgcagtatcaaccttattgtgggcgcgattagataatccttatgtatggtgtgtactcttggtgctaattggttatggcatcatcggttttatcgatgattatcgcaaagtagtgcgtaaagatactcgaggcttaatagcgcgttggaaatatttctggcaatcggtattagctttagcggttgcatttagtatgtacgcgattggtaaagataccccagcaacgcaacttgtcgtgcctttctttaaagatgtcatgccacaacttggcatgttgtatatcttactggcttattttgtcattgttggtaccagtaacgcggtaaatttaaccgatggtttagatggcttagccattatgcctaccgtgtttgtagcggctggatttgcattagttgcatgggctacaggtaatgtcaattttgccagctacctaaaaattccttatttaatgcatgcaggcgaattggtgattgtttgtaccgccattgtcggtgcgggattaggcttcctttggtttaatacttatcctgcccaagtctttatgggtgatgttggctctttagcattaggtggcgcattaggtactatcgccgtgttattacgccaagaatttttattagtgattatggggggcgtgttcgttgttgaaacgctctcggttattttacaagtaggttcatttaaactgcgcggtcaacgtattttccgtatggcgccaatccatcatcactatgaattaaaaggttggccagagcctcgtgtgattgtccgcttttggatcatctctcttatgttagtccttattggtttagcgacattaaaggtacgttaa

SEQ ID NO: 2880 - DNA, 570 bp, Proteus mirabilis
tttatatattgtgcaagttttcttttattgcgtgttttaataaggcgctatatgctctctaatatgaaaacagtaagagtccctatcgccttagtgcaaagtgttatgcgtacactgcgtgaaaaactgcaacaggccaataaatatcttaatacagattacccagaacccactctacaatataaccagagaggaactattgcaggcagtgcctattatgcaaattgggagatccgtcttaatcctacattattgattgaaaataaacagaattttattgaagaagttattcctcatgaattagcacatctgctagttagtcgccattttggtcgtgtggcacctcatggcaaggagtggaaatggatgatggaaactgtgttacaggtgagtgcgaaacggacccatcattttgatatcagcaatgtaacagcaaaaacgtttagctatgcttgtcgctgccaagaaatacaccagttaactcttcgccgacacaataaagtacaacgaggagaaacccagtatcgttgtcgtcattgtcaggcgattttacaattaattaaagagtaa

SEQ ID NO: 2881 - DNA, 321 bp, Proteus mirabilis
tcctgtcattgttccattaagccagttcagcaacgaatacacctatgcagggagggcttaattatgggctgttatccagaaaactataagcgtattcaagccgaaatttcgaacatgttaggcaatgacctccttttatcttcagaagaacgtagccgtgaccgattacttagggttcgaaaaggtatggctcatattcttagtgaagtatttcctctaattgatgatcccaaaaaacaagaactctattactggttggaagccattagccgtatcagtggcgcagaagccgtagacgctaaatcgaagggggaagcatga

SEQ ID NO: 2882 - DNA, 858 bp, Proteus mirabilis
attatggaacttgttacgtataaaacgctacctgaatggcacttaacagcgatccctttagcattattagagcgtcataacacaaaagaaggcacttatgcgcaaatgcggatattacaagggagtatgacatttgtgctatttaaggatgatggagaacaagtgttcttagagtgtgatagcgaaaatcagcctccgcttattcaacctcagcaatggcataaaatcgataaagcgagtgatgatgtactttgccagctctcttttttatgcactcccgaagataaattttttaaagaaaatgatttgtcattacctcattcggaagtgcgttatatggcaacattgactaccccatgtaaagtgcttgatttaggcgcagggcgtggtcgtaatagcttctatttagcattacaaggttatgatgtgaccgcattagatattaatgccgctcatattgatgcaattgaagccgtcaaagctaaaaccggtttagcgatcaaaagcggcttatatgatataaatgaagcagcattaaatgagaaatacgatattattatttctactgtggttttgatgttttgccagcgtcaacgtatcgcagatattattaaaaatatgcaggagtgtacaaatccagaggggattaatgtcattgtttgtcctgttgaaacagcaaatagtggatctgctgaagttcctttcaaaaccttcttgcgccaaggtgagttagcggattattaccaaggctgggatattattaaatataatgaaaatccagggcatctacataaaactgatgctaatggtaatcgtattcaacttaattttgcgacattaattgcgcgtaaaaaataa

SEQ ID NO: 2883 - DNA, 402 bp, Proteus mirabilis
ctgattaattgcgactattttttcggtttaaaacgtaataatcggttggcattactgacgacagtgattgatgataaggccatggcagcccccgcaaccacagggtttaataatgtaccggtaaaaggatataagataccggcagcaataggaatgcctaaactgttatatataaatgcaccaaacaagttttgtttcatattgcgcagtgtgccttttgagatctcaaccgcatcagcaacaccatgtaagctatggcgcattaaggtaatggccgcggtttcaatggcgatatcactgccaccacccatcgcaataccaacgtctgctttagccagtgctggggcatcgttaataccatctccaatcattgctacgcgacgaccttctgcctgtagttga

SEQ ID NO: 2884 - DNA, 216 bp, Proteus mirabilis
atgcagatctgcaataaacagggtgcacataaaaagcgctacttattcgctaacagtaacactgttaatgataatatcttcacgaggaacatcttggtggaaaccactgcgaccagtagaaacggctttgattttgtctacaacatccattccttcaacaacttcagcaaatacacaatatccccaaccattggcattttctgcacggaagtttaa

SEQ ID NO: 2885 - DNA, 672 bp, Proteus mirabilis
aaaattaaatgcaaggggatttacgcgatgcgtatcattctactaggcgctccaggcgctggtaaaggcactcaggctcaattcattaaagaaaactatggtatcccacagatttcaaccggtgatatgttacgtgctgcggttagcgcaggcacggaattaggactgaaagcaaaagcattgatggataacggtcaattagtgactgatgaattagtaatagcattagtgaaagagcgtatcaaacaagacgattgccgtaatggtttcttgttggatgggttcccaagaacaattccacaagctgatgcaatgaaagaagcgggtatcaatgttgatttcgtactggaatttgctgtacctgatgaaattattgttgaacgtattgttggtcgtcgagtgcacgcgccatcaggtcgtgtttatcacattaaatttaatccacctaaagttgaaaaccgtgacgatgtgacaggtgaagagttaacaactcgtaaagatgaccaagaagaaacagtgcgtaaacgtttaatcgaatatcattctcaaacagcacctttagtttcttattaccaaaatgaagctaaagcgggtaacgcgcagtaccacaaaattgatggtacacagaaagtaagcgaaattaatgctgaactgaaaaacatcctcggttaa

SEQ ID NO: 2886 - DNA, 3279 bp, Proteus mirabilis
gttatgatgtggcgcatttgttatcaatatcgccaatatctccttgctcttagtttgctggcaggcattttgcctgtcacgcaagccgcagatgatccgactgaaacttttttatatgagcaagttagactaggcaactcgaaaagtaacgatgttttagtttctcaatcactgtatcgtttatcacttataaaaccgaacgatcctagtgtgttgttaatgtgtatccaatttgctgtaaaacaaaaagaaacagcaaaagcacaacaactggttgagcaattacgtatgcatggcgaaaatactgaacaatatcaacgtgcgattaggctactatcattaacccatgaagataaccgccaaatcctacaaaaagcctacctttatcagactgcggggcgttatgatgaagccttgcaattatatgatgatatttaccaaggcacgccccccgatgaagggttagcccttgagtatctcaatgtattaattgcttcaagccatgccaacaaaatggcacgtattaagcagatttatcacacttatcccaataaccaacagatagctaatatctatcagcaatatcatcttaccccagcattatctaccgcatcggcgggctctgtctcctataacacactatctattcgcgcattaaaacagcaattacgccagcagcctgataatgcagacataataggaacattaggcgtgcgctattcgcgcgcaaatcaacgggcacccgcgatttattatctttctcaagcactcacattgtcccccaaacacgatgatagtgatttgtggcgtacgctgttgcaatcaaatcaatattggcatttacttgccaaggctgatgaagcgttattaaatcaagagtactctgccgctaagcactattttacccaagtacgtcaactcagcccctataaaagtgaagcttatattggtttaggggatatcgagttggcgcaacatcaattagaacaagctgaacgttattatcaacaagcgctacaatatcagcctaatgatgcggcgactttgcatagtctgaccaagctctatcgtcaacaatctcatcaaaaagccgcccaatttatggctaacttgacatcacagcaatacaaaaatttagcccaagactatgggtatatcatttcaggtatacaacaagacttagctgctgatgatgaacagcaacaacactatctcagtgcgattgagaaacgtaaggctatcgctaaagcgtatcccgatgaagtctggaatatttatcgtctggcggatgatttacttatcactcaacaaccccaacttgctgaggattactttaatcaacttaatcaacgacgacctaatgatccctctcgacgatatgcctatgcgttatatctcaataaaacagggcgagcacaacaagcacttaacaccttaaagacgatccctttatcgcagcgcagtgaaagtatgaacgccttagatagccaattacgttttggtcaaattatggcgcatgcacaatcactaagagaacataaccaacaacagcaagctgtcgaatatcttttcacccatattcctcctgagcaaaaaatagaaagctatctgttattagcgcaatgggccgaagaagatgaccaactcaatcaagcattaaattattatcatacagtattaaatttagcgcctaataatgaaacagcactattaggtgcaacagagatatctttagcgcaacatcaaatagatcaagctcgttattacttagctcagatagaacaattatctcctgaaaaatttaaccactattcactaagacgtttagcaaacgctgaaaaaacgacgggaaatattgataaagccaaacactattttatctatttagctcgccaagttgacaaggagccagatagtgctgatggattaattttacgtgatattggtcgtttttatcgtgatagccaacaagttcaatccgctcatcactattatcaacaagcgatgctaaaagagggtatcacgcatacactgccaaaaaacaatattgaatacaccacacttatgcgtaacaacctaaatgataattggctatcacgtagtgtacgtgatgatgcaagtaccctttatcgtcaacaagagtggcgttttaccctagagcatgattattggggatcaaatggcagtgagggatactctaaattacgcgctcataccaccatgttacaactggatcatcctatttatcatggacgtttcttttggcgtactgattttgtgcacttaaatagtggcacattaggtacagcgccatacgatgctaaatttggtagttgttatcgcacaggttgtttccctctaaagcaaaaagcctttggtgttagtcctgctatcggttgggaaaatgagcaatggcaatgggatttaggtaccacgccactcggttttaatgtaactgattgggtaggtaaaattgcttataacgatagtttttatcatctcggttggagtgtagatcttcaccgtcgcccggtaaatagctcattacttgcctttgcaggccaacgtgatagttggaccaatcaagtttggggaggagtaagaaaaacggggcttcgtttaagtggcagttatgatctgggaggcaaggatgggtattggggagaaatatcgtttgatagattaacaggaaaaaatgttaaaaataacagcagtgtaaaagccatgggtggttattactataagttaatcaatgaaaatgatcgccgcatttctgttggcttaaatagcatgctttggcattacaataaagatcttagtggctacaccttggggcaagggggttattatagcccacaacaatatctctcattctcactgcccgttaattaccatcaacgtactgaaaattggtcatgggaagtatctggctctctctcttggtcttattcaaaaaccgatgatagcagacgttatccattacaaaatctcgtttcaagcgataaatttaattctgatcccataaaagaaatatttaagcatgagagaaatatcattgataagggggattcgggtcatggttttggttatacagcaagagcattaattgaacatcgaataacaccacattggtttataggtgccgctatcgatattcagcaagcgaaaaactatacgccaagccatgcactaatgtatttacgctattcatttgatggatggaatggtgatttagatcttccgcctaacccgcttattccttacgcagattttaaataa

SEQ ID NO: 2887 - DNA, 231 bp, Proteus mirabilis
ttgaatgtgtggatctcagttacttgtggcatgccttcagttaaggtacctgttttatcaaaaactaaggtatctaattggcttgcttgttgtaatgcatccgcatcacgcactaatacgccatattctgcggcacgtcccacacctgaaataatcgacatgggggtcgctaatcctagagcacaaggacaagcgataattaataccgttgtgataatgacgagtgcataa

SEQ ID NO: 2888 - DNA, 1086 bp, Proteus mirabilis
agcgtatctcgagaaggaggaacgattaataactcaggaaacttaacgattaatggcaatagcgtccatcttcaaggagcacaagttaatagtaaagatactcagctaacatcacaatccggtgatatcgagatcacatctgcgcagtctactgattataaaaacaattggggaacagatattggctttaatggcaaaaaaaccaataccaccccaaaagaagttacagaggagaaacctgctacctctattcataacatagggggtaaattactggttaatgtggaagatcaacaaaaaacgagccaccaaaatgcaaccttagaaacaggtacattaacgattaatagtaataaagatctgacactatctggtgctaatgtgactgctgatagcgttacgggtaatgtcggtggttcactcaatattgctagccaaaaagagagtaatcgccatgtcactgttggcgtcaatgttggctataaccacaccaatgatcctaaatcaagccaagtgaataaaacggctaaagccggagggtcattattagagaaaactatcaaagatacgattgattcaggaattaaatcatcaaccgatgctatctctgataaatataactccctctcttcaactattgcagataaaacaggtatcagtgatgaaactaaagccaaaattgatcaaggttttggtaaagtcggtaatggtattaagaatatcgtcacaggtgctgagggtcatactgctaatgcggatatcaaagtcactcatgtagataatgatgctgtcactaaaaccacctccttaactagcaacaacgacctatcattaaatgtgaatggctcgacaaaactcaccggagcagaaattgcgagtaaacaaggccaagttgatttagggggaagtagcgttaaattagaaaatattgaaggtcatcattatgaagccggcgccgatcttgatctgaaatcctctgtggtggatttagcaaaacaactggtaggtggagatatttcttttaaatcccccgttaaaacgaatgaaaccgtcaatacaaaagcatctatttctgaaaagaaataa

SEQ ID NO: 2889 - DNA, 1017 bp, Proteus mirabilis
caacccaatcgagccaatattatggcgtcactgaaagatgttgctcgacttgcatctgtttctttgatgacagtctcaagagcgattaataaccctgagttattaaaaccagatacgttgaaacaagtccaacgcgcaatcgaagaactgaattatgtgcccgatttttcagcgcgaaaaattcgaggtcaagggactaaggtctcatcgatcggtgtgcttggtattgataccgcaacgacccctttttccgtggaaatgattttatccatcgagcgtaccgctcgtcagtttggctggagttcatttgttgtaaacctcactgaacaagaggggtatgatcaagccatttggcaactgttagctcaacgtccagatggtattatctataccacaatgggattgcgagaaatcacggtacatgaaaagctacgtgataaaaatgtggtacttgccaactgcctagctaaagatcaaacttttccaacctatattcctgatgattatcacggacaatattttgcgataaaacacgtgattgaaaaaggttatcggcatccgttatgtttttatctacccgaagataccgttgcaggccctattcgccgtaaagcggtcgaagatgcttggcaagatgccggcttacctttgtcatcattgcgccaatacacgatgttatttggcgatgaacattaccgtgatgtgattggattgttacaacaacactgtcgtcagcaaaaagcagattttgatattttaatctgtggtaatgatcgtatcgcatttttagcttatcaagttttactgtcgatgggattacgtatccctgagcaagtggctgtattaggctatgacaatatgataggaacgggggagttattctatccgccactcaccacagtacagttgccacattatgacttaggtaaagaagcaacattacatattattcaagagcgtaatcataataaaacagtacaagtcccctgtcagttaattgaacgagagtctctgtaa

SEQ ID NO: 2890 - DNA, 360 bp, Proteus mirabilis
gctaaagatcgtaaagggggatacatgaaaccattacaactgtttaaaattttaggtgatcaaaccagactagacatcgtattgcttttaaaagcatctggtgagctatgtgtttgtgatatctatactgccttaaatttatcgcaacccaagacatctcgacacttagctatgctgagagagtcgggtcttttgctcgattcgaagcaaggcaaatgggttcattatcgattatctcctgtattactaccgtgggtgaaaaatattattgatataacttacaccacagagaaaaatagagttgcagatttactcaagatcctagagaaaaaagagtctggtcatcgttgttctgtgtaa

SEQ ID NO: 2891 - DNA, 645 bp, Proteus mirabilis
agcagaggtcgaaaaaacatgttaagtcggtcaatgaaagacttactgacaatgttaaaacaacacggcatcaatgatgagcgtctgttggaagctatgagcaaagtaccccgagagctatttattgatgaagcgctctcccataaggcttatgaaaatacggctttacctattggtaatggtcaaactatttcacagccttatattgttgctaaaatgacatcactgcttgaattacaagcaacggattctgtgttagagattggcacaggctctggttatcaaactgcagtattagcaaacttagtgcatcatgtcagttcagttgaacggataaaaatattgcagtggcaggcaaaacgacgctttaaacaccttgatttacataatatatcgactcgtcatggcgatggttgggaaggttgggtatcaaaaggcccctttaatgctattattgttactgcctgtgcaacagaagtaccgcaacgactcttgatgcaattagctgatggtggcaggatgatcattcctgtcggtgaacagcagcagatgcttaagtttattcgtcgtttaggtaatgattttcactatcaatctatcgaggctgtacgctttgtccccctaattgcgggtgagttagcataa

SEQ ID NO: 2892 - DNA, 1092 bp, Proteus mirabilis
aaaattatgctaaaaaaattacgacatactttattaagtacattaattatttcaggtacctttttaagtagtataactacggcgcaagcttgtacccgagttgtttatttaggtgaaaataaccaaataattaccgctcgttctatggactggaaatacgaaattggtactaatttatggatattccctcaaggaatgcaacgttctggtgaggctggtgataattcagttcaatggcaatcaaaatatggtagtgtgattgcatcaggttatgatatttctactactgatggtattaatgaaaaaggattagtggctaatttattatggcttgctgaatcagattacccaagttattccaaagataagcctgcaatggctatttctgcatgggcacaatatgtattagataattttgctactgttgaagaggcggtaactgctttaaaagatgagccttttattgtcttaacagacaaagtacccggacaggatagagtcgcaacgttacatttatcattgtctgacagttctggtgatagcgcaattattgaatatattgatggtaaacaggtgatccaccatagccgaaaatatcaagtgatgactaactcccctatattttctgaacagttagcattaaatagctattggcagcagattggtggtacggtaatgttaccgggtactaatagagcatcggatcgttttgcaagagcctctttttatattaatgctattcctaaatcgcaatcgagcaaaaaatcacttgccagtgtatttggggtgatccgcaatgtttcggtgccttatggattaagtaccgtagaatctccagaaatatcatcgactcgttggagaactgtcgctgatcataaaaatcagctctacttttttgaatctgcattatcaccaaatactttttgggttgatttgaaacaaattgatttttcaaaagaaacaggaaaagtgatgatgttagcgttaggccaagagcagtcaacgatttattcaggagatgcaagctctcagtttaagccagcgaaaccttttaaatttaaagggttagaaaatataccaatacaaaattaa

SEQ ID NO: 2893 - DNA, 1641 bp, Proteus mirabilis
agaaaaacccgcgctaatcgcgggtttttttatacctgggagagcgcaaaaaacgaaataaaaaagtataaggaacagattatgagcaacaatgtgattatttttgacaccacattaagagatggcgaacaagcattgcaagctagcttaagcgtaaaagagaagttacaaattgcttatgccttagaacgtttaggtgtagatatcattgaagcgggttttcctgtctcttcccctggggattttgaatctgtacaaaccatcgctcgagaaattaaaaatagtcgcatttgtgcgttagctcgctgtgttgataatgatattgacgttgccgcagagtcattaaacattgccgaggcatttcgtattcatgtttttttagccacctccgctttgcatgctgaacataagttaaaaaaatcctttgatgacattattgaaatgggaacacgctcaattaaacgcgcccgacgctatactgatgatgttgaattttcttgcgaagatgcggggcgtacccatattgataatttatgtcgcattgtggaaagtgccatcaacgcgggcgcaacaaccattaatattccagacaccgtaggttataccacgccttatcaattcggtggcattatcactaatttatttgaacgtgtacctaatattgataaagcggtgatctccgttcattgccatgatgatttaggtatggctgttgcaaactctattaccgcagtacaagcaggtgcaagacaagttgaagggactatcaacggcttaggtgaacgagccggtaactgcgctttagaagaagtgattatggcgataaaagtacgtgaacaaatgatgaatgtacaaacgcgtattaatcacaaagagatctaccgtaccagccagttagtcagtcaattatgtaatacccctattcatgccaataaatccatcgttggctcaaatgcctttgcccactcctctggtattcaccaagatggcgtactgaaaaatcgtgaaacttacgaaattatgacacctgaatcaattggtttaaaagaggtgcaattgaacttaacgtctcgctctggtcgagctgcggtaaaacaccgtatggaagagatgggctatcgcgaaacagattataacttagattctttatatgccgctttcttacgtttagctgataaaaaaggccaagtttttgactatgacttagaagcattggcttttatggggcaacagcaacaagagcctgatgagtttgtaatgaactattttaatactcaatccggctcctcaacagttgccacggccagtgtcagcattagtcgtaaaaatgaagaaatcactgaagcagcaacaggaaatggtcccgttgatgctgtctatcaagctatttctcgtgctacaggttatcccttaaaactggtgacttatcaattaacagccaaaggtgaaggacgagatgcattaggacaagttgatatcgtggttgaataccaaggacgtaaatttcatggcatgggattagaaactgatatcgtcggttcatccgccaacgccatgatgcatgttatcaacagtatttggcgttcagagcaagtcgaaatagaaaaacgcaaacaccatacaacacaagaagcggtttaa

SEQ ID NO: 2894 - DNA, 1845 bp, Proteus mirabilis
ttattcctacgcttttccataaataacaggaaaatcatgataaataataataatctatatgattatcatataattagaagattgcagatgcaattttcatcttctggggaaaaaacggcttatcgtcagtgggaggctaagtctgaaatcgccatgtcatgggcgtcagtagcaaagaaaacacgtgcactctcaaatgcattactcgatatgggcgtggcagttcaagaaaatgtggggattttttcccaaaacagcattgattggtctattgctgatattgctactttgcagttgcgtgctgtcacagttcctctttatgcaacaagtagtgtggaacaagccgcttatatcatcaacgatgcggatattcgtattctttttgttggtgaccaaaaggaatatgacgttgtttctgagttagcgctattatgcccgcaacttaaacatattattgtgtttaattctcaggtcgttttaaatccaacaataccttcttatcatctgacaaacttaatcagtgactgtcaatctcaatatgactctctgctacaacaacgtattgatgaatgttgtttagatgatttgtttacactgatttatacctcgggtacaacaggtgagcctaaaggtgttatgctggattacaccaatctggcttctcaactttatctgcatgatcagcgcctttcattatcggataaagatgtttcattatgctttttaccgttatcacatgtatttgaacgggcatggagcttctatgttatgcatactggggctattaatgtttatctcacagatacccatgccgtaagggaagcgatggctgcagtaaaaccaacggttatgtgtgcagtgccacgcttttacgaaaaagtatatagcgccattcaagagaaagtttctcaagcacctcgactacgccaatggatgtttaaatgggctcttaaacagggtgaaaaacaacgtcaggcacacttagctggacgttcattaggcgtgttatctcaatggtgttatcgctttgcggataaaaaagttcttcaaccactacgtcaaattttaggtgggcgagttcgttttttacctgccgcaggcgctcgtttagatgatgcggtgatcggctttttcttagctgctggtattaatattaaatatggttatggcatgacagagacttgtgccacggtatcttgttgggaagaaaaccattataaactaggctctattggtactccgttaccgggggttgaggtacgtataggcgaagaaaatgagatccaagtgcgcggtagtatcgtgatgaaaggttattttaataagcctgaagagacagttgctgcgtttactgaagatggttggttacgtaccggtgatgcgggtgcattagatgaagatgggatgttatatattaccgaacgtttgaaagatcttatgaaaacctcaaatggaaaatatattgcaccgcaaatgattgaaggtacattagggcaagatcgctttattgagcatatcgctgtgattgcagatacccgtaaatttgtttctgcactgatcgtaccttgctttgatgcattagaagaacatgctcgagcattaaatttaaaatatcacgatcggatagagttattacgccatactaagatcaaagaattatttgatgaacgcttgcgtgaaatgcaacgtaattttgctagtttccatcaagttaaacgatttaccctattagcggaagggtttacgatggagtctggagaattgacacctaccttaaaattaagacgtaaaataatttctgaacgctatcgaaatgaaattgagcagatgtatcaagagtcgtga

SEQ ID NO: 2895 - DNA, 1083 bp, Proteus mirabilis
atgagcgaacgtaaacgccgattaatggtgatggccggcggaacaggagggcacgtctttcctggattagcagttgctcattatctgcaatcccaaggctgggatattcgttggttaggaaccgcggatagaatggaagcacaattagtgcctaagcatggcattgaaatcgagtatatccgtatttcgggtctgcgaggtaaaggggtaaaagcgttaattgcggcacctattcgtattataaaagcgatttttcaagcccgtcggattatgaagcgctatcagcctgatgccgtattaggcatggggggctatgtttctgggcccggcggtgttgcagcatggagctgtggtattcccgttgttttacatgaacaaaatggtattgcaggcttaactaaccgttggttgtcaaaaatagccaaacgtgtgttacaagcattccccggtgcgtttgctaatgcgcctgttgttggtaatccggttcgtgacgatgtcttagcacttgaagcgccagcagagagattaaaaggcagagaaggtgctgtccgagtgctggttattggtggtagccaaggtgcgcgtatcttaaatcatacaatgccagtggtggctggattattaggagagcgagttacaatttggcatcaggccggcaaagggagcgaaaatgataccaaattacgctatcaaaatgaactttctaaaaattcagttaaatctgagtataaagttactgaatttattgatgatatagcgcaagcttatcaatgggcagatgttgttgtatgtcgttcaggtgcattaacagttagcgagattgccgctgcggggttacccgctatttttgttccttttcaacataaagatagacagcaatattggaatgcattgccattagaaaatgccggtgcggcgcgtattattgaacagaatgatttaacgccagaagcgatagctgacaccctagaaaattgggatagacatcagctaatgctaatggcagaaaaagcacaaagtgttgcgattacggatgctactgagcgagtcgctaatgtaattatcgaagtggctaaaaaataa

SEQ ID NO: 2896 - DNA, 1410 bp, Proteus mirabilis
aaatgggaacgtcctctgatgctaaagatttttaatactcttactcgacaaaaagaagaatttaaacctatccataaaggaaaaataggtatgtacgtgtgtggcatcactatttatgatttatgtcatattggtcatggacgtacatttgtggcatttgatgccataacccgctatttacgttatttagggtatgatgtgaattatgtgcgcaatgtcactgatgtggatgataaaatcatcaagcgtgcgattgaaaataatgaaacttgcgaacaattaacgacacgtatgttagcggaaatgcataaagattttgatgcattgaatatcttacgccctgattcagagccacgagccacacatcatattgcagaaattattgctcttaccgagacattaattaaacgtggtcatgcttatgtagcagaaaatggtgatgtgatgtttgccattgataccgatccggattatggcttgctttctcgtcaagatttagagcaactacaagcaggggctcgggttgaagtcgctaacgtaaaacgcaatcctatggatttcgtgctttggaaaatgtcaaaacccggtgaaccaagttggacatcaccatggggagaagggcgaccaggctggcatattgaatgttcagccatgaatggtaaagaattaggtcatcattttgatattcatggcggtggttcagatttaatgttcccgcatcatgaaaatgaaattgcacaatcaacctgcgctcatgatggtccttatgttaattattggatgcattccggtatggtgatggtagacaaagaaaaaatgtctaaatcactgaataacttttttactattcgtgatgttcttgcctattacgatgctgaaacggtacgttatttcttattatcaggacactatcgtagccaactaaattataccgaagagaacttaaaacaggcgcgtaccgcattagagcgtttatatacttctttacgtggcactgatgcaaatgctcaacctgctggtggtgaagcgtttgaagcgcagtttattgaagcaatgaacgatgatttcaatacaccagaagcctattctgtattatttgatttagcacgcgaagtgaatcgcttaaaaaccgtcaatatggaggcggctaatggtttagcagcggtgttgcgtaaattggccaaagtattaggcctattagagcaacaaccagaacacttcttacaaagtggtgcgcaagcagacgatgctgatgaagtagaaaaaattgaagcgttaattcaacaacgcaatgatgctcgtaagaataaagattgggcagctgcggatgccgctcgtgatgctttaacagcaatgggaattgtattagaagatggcccacaaggtacaacatggcgtcgtaatagctaa

SEQ ID NO: 2897 - DNA, 1185 bp, Proteus mirabilis
agaagaagacggcttatgaatcagcgatatgccattttagcagatagaacctttacacctgaaggtatccgttatctctgctatgtccatgttaatggtgaaaatattgaatcaatcaccacacaagcaccaacagattgcccagttattcgcttaaaaggaaaatcattattacccggttttgtggatatccatattcatggtcgtgaaggggctgatgtgatggatgcaacgcaacaaggactacaaactatagccgatgcgctggttaaaacaggggttgtggcttgggttgcaacgactgtcacagcaccgatggaggatatccgtcatgcgctattacaagtccgtgagtttgtatcaaaacctcaagcaacaggtgcgttgttactcggtagctttttagaaggcccttattttacagaacgccatcgtggttcacaccctgtgaaatatctcaaagcgccgaccatctgtgaattagaaacattactcgacagtgctgggggatcgctattgcgtgttgctgttgcacctgaagctgaaggtgcgatgaatgcgattgattggttggtcagccgaggaattaaaccaagtgtggcacatacagcagcaacttatgaacaagcttcacgagctttttcacacggtgctgattgtggtgtgcatctgtataacggcatgaccgggcttcatcatcgtgagccgggatgttgtggtgcagtgttatatcacagtgtattagctgaacttattgctgatggtatccatgttcaccctgtaatgatgcaactggcatatcgcatgaaaggatatcaacagattgccctaattacagattgtatgcgagcgggaggtttagctgatggtgattacacattaggtgctcaaacggtcaccgtcaccaatggacaggcaaaaactgccgatgggtcgctagctggtagcacttgcagtcttgatagtgcgttaagaaacatggtgcaacttgcacatattcctgagtgggaagcagttcaaatggcatcggcgatccccgctgagtatctcggcataggggataaattgggttatatcaaagcaggtcaacaagccagctttgccgtggtggatgagtgttttcatcttaccgatacattcatcagaggaaatcatatttactctgtatccggggataatgcataa

SEQ ID NO: 2898 - DNA, 951 bp, Proteus mirabilis
ttggtaggacggataatattgcgagataaaatgatgatcaaacaacggacattaaaacgaattgtacaagcaactggtgtggggctccacacgggtaaaaaagttacgcttacaatgcgtccggcgccagctaatactggggtcatctaccgtcgtactgacttaaatccaccggtggattttccagcagacgcaaaatcagttcgtgacactatgttatgtacttgcttagtgaatgaagatgatgtgcgtatatcaaccgttgagcatttaaatgcagcactggctggtttaggcattgataatatcgtaattgaagtggatgcacctgaaattcctattatggatggcagtgcagcaccttttgttttcttattgcttgatgcaggtattgaagagcttcgcactgcgaaaaaattcatccgtatcaaggaaacagtacgtgttgaagatggcgataaatgggcggaaatgcgtccttataatggttttaaattagattttactatcgattttaaccatcctgctatcgatgcaagtactcagcgttataaattagatttctctgctgaatcctttatgagtcaaataagtcgtgctcgtacatttggatttatgcgtgatattgaatatttacaatcgaaaggattgtgtttaggcggtagctttgattgcgctatcgtggttgatgactatcgtgtcctcaacgatgatggtttacgttttgaagacgaatttgttcgtcataaaatgttagatgcaatcggtgatttatttatgtgtggctataacattatcggtgaatttaccgcgtttaaatcaggtcatgcactaaataataaattgcttcaagctgttttagcaaaagagtctgcttgggaattcgtcacctttgaagacgaagcgaaaatgccagtggcatttaaagcgccatcgacagtttttgcttaa

SEQ ID NO: 2899 - DNA, 483 bp, Proteus mirabilis
attataacgctgagggaaatgaggatgtttcgtggtgcaacactcgttaatctcgacagcaaagggcgaataacagttccttcccgttatcgaacaacgctgaacgaggcttctgaaggtcaaatggtctgtaccattgatctcaatcagccatgtttattgctgtatacccttcctgaatgggaaaaaattgagttaaaactggcggcgctttcttccatgaaccccgccgaacgaagagtgcagcgtttattacttgggcatgccagtgaatgccaaatggatagcgcaggacgtcttttgttagctagcacgctaagacagcacgcggggctaaccaaagaggtcatgttagtcggtcaattcaataaatttgaattgtgggatgaacaggtctggtatcaacagatcaaagaagacattttggcagagcaaacctcacaggaaccgttatcgacacgactattggatttatcactttaa

SEQ ID NO: 2900 - DNA, 231 bp, Proteus mirabilis
aaagacatgcgaaaaaaccctatacataaatgtataaggttaataacgcattattcaggtttatattttagatattttaatagaagagaaaatttactgtttaagaggaaatattctcaacaattaattaactttgtgcacacgatgcatgtgctattgattataaaagaacagaactacagctatactccacaaaggcagagcattaaaatttcaaagaacaatcactaa

SEQ ID NO: 2901 - DNA, 897 bp, Proteus mirabilis
aaattttataggaatatcattatgaaaaaagttattggtgtttataaagcgcctcgtcaacattgggtcggtgatggcttccatgtacgctcactatttagttatggtgatcatggtaaatatttaaatccatttttattattagacagagctggcccgactgattttccagcctctcaaggccataaccgtggtgtaggcgaacaccctcaccgtgggtttgagactgtgactattgtctataaaggggaagtggcacatcacgattctacaggtgaaggaggagtgattggccctggagatgtacaatggatgaccgcagcatcaggtatattacatcaagagtatcactctgatgcctttaaccaagcgggaggcatacttgatatggtgcagttatgggtaaacctcccatctcatgctaaatcagcgcctgctggctatcagttactcaaagagagtgctattccagtgcttccattagcgaatgatgccggacaactgcgcgtgattgcgggggaatatcatcaaactcaaggggcggcaaaaaccttttcacctgttgacgtttgggatattcaattgaaaagtggtaaatctacgaccttaccaagcaaaaaagatcgctatgtgggattagtgatactccatggtagcgcctatcttgatagccaaactcaattaaatacgggcgatttggttattttagataatcaaggtggctcaattaatcttgaagccattgaagatgcggttgtgttatatcttagcggagagccaattaatgagcctgtagttggttatggtccatttgtgatgaacagcaaagatgaaattaggcaagctattgatgactttaaccaaggtaaatttggtcgtatcccaaacgaaatatga

SEQ ID NO: 2902 - DNA, 198 bp, Proteus mirabilis
tttatttatagaaatgctggtaataattttgcagattaccagcatttattcaaaggggaattacacgtagaaatagcgaataacgtggaagaaaataggggcggcaaagcacagggaatccattctatccatcataccgccgtggccttcaatcatagtaccgaaatcttttacgccactgtctctttttatggctga

SEQ ID NO: 2903 - DNA, 552 bp, Proteus mirabilis
tcgttgtgtagcagagaaaaaataaaaactgattttggagatagaaaggtgaagaatagaaaatttatttttatgttgatgctttacattaatggcctttttatttctcaaattggctttgcagaacctgttgctcgagataaatcattctttaatattaatagagcaaaaattgatttttataatcaaaatgaaaaaaatcaacatggttttatatatataaaaggctcatttttaaatgctccttgtgagcttatttcgaatgaaattagtttaaaagagctatacataaaagatattgatgtcgttattggtggttgtaatatttatagtgattttaaaaacagctcaaatagtaaacctgcgtttactagtgtgttaagtttcacaaataaaatcaacgataacgtagaaaatattgatataagaatgaatagattaaagcattataaagataatgttattttgaattacctcttttcagatgaaataaagagaaatattcttgaccggaagttaaatatattaactcttaaattgcagtataattaa

SEQ ID NO: 2904 - DNA, 1266 bp, Proteus mirabilis
cattctgtcaggagcgtcattatgaacgatgcacaagtgaatgagagtaaaggcaaagtcccttattgggtcaagctgacgattattttcttttttggttggattgcactgtatggtagccgtgccattgtcggtcctttaatggtgaatattggtgctgagtttgatcttaccaaagcgcaacttggctcaattatgagtattttctttattggttatacagcactgaacattccatcaggcataattggtgactatttaggtaagaaaaaagtcttagtcacgggtgttgtgctctttggtggatttaccattatcgcagggatgatgccaacttatgtcacctttatgtttgcatgggtgatggtcggggtattccaaggattctattatggtccacaatatggtttatcttcagaagctattccaaaacatcgtattacgctaggtagtgccattatcaatagtggtatggcgtttggtttatccatcggttactacatctctagtatttctgtcggtgagatggggatgagctggcgtgcaccattctatattattggggtacctattattatcattggtttgatgatgttatggataataaaagataaacctaaaacgaaagctacggattcggctcctaatgcaccaaaacagaaaacaaaactgacgtttaaagatttatttggtaaccgtaatattaaccttgcttatattactatcttctgttcaatctatgggttctttgttttagtcacttggttaccctattatcttgaaaccgagcgtggtattacaggaacacagatctctaccattgcatcactcatgccttggtttgctattcctggctcactcttatttagctggttctctgataaattaggccgtcgtaagcctgtgctattaattatgttaccgttgtctttggtggctattcttgctgtacctatgtcagattctatgccggtactgattggtgcactgatcttatacgggatcgtagggaaaattagtactaatccagtattagtggcggtagtggcagataattcaccacgccatgcattagggacatcttttggtgtgtataactgtattggtatgctaggttcagtatttgcccctacattaacgggttttttatcagataaaacaggaagtatggattccggcttctattttgctgctatcctgatttgcataggtattgtggcaagcttatttattaaagaaaatcctgacgccacagcgaccaactaa

SEQ ID NO: 2905 - DNA, 516 bp, Proteus mirabilis
aatataataagagagctagttatgaacacacctaatattgtctggacccgcattgatgaacgtttacttcatggacaaatccgcattacatggggtaaacatacggaagcaaacctaattttagtcgctaatgatgatgctgctgaaggtcccaatgctgcatttatgcaggcgggaatgaaagcatctgctggcggcgaatatgcggttcgctttttctctattcaaaaaactattgatgttattagcaaagcatctcctcgtcagaaaatttttgttctgtgtaataacccaactgatgtagcccgtttagttgaaggtggcgtgcctattactcattgtaatgttggcaatatgcattttcatgaaggtaaacgtcaaattgcgaaaacagtctctatcgatgaaaaagatcttagtgcttttaagcgtcttatcgaaaaaggggttacttgcacagtccaaaacacaccagatcaaactcctgttgatgtactaacactcgcatcagcctga

SEQ ID NO: 2906 - DNA, 873 bp, Proteus mirabilis
atgtcagcaagaattatagatgggaaaacgattgcgcggaccatcagaagtgaagtggcagaaaaagtaaaacaacgtattaagataggaaaacgtgcaccgggtttagcggttattttagtcggtgataaccctgcatcgcaaatctatgttgctagtaaacgtaaagcttgtgatgaggtaggatttatctctcgctcttacgatctaccggatactacaagtgaagcagatttactcaatctcattgatactctaaatgaagataatactattgatggtattttagtgcagctccctttacctgcgggaattgataacgtcaaagtattagaacgtattcatcctgataaagatgttgatggcttccatccttacaatattggtcggttgtgccaacgtgcacctaagctacgtccttgcacccctcgtggtattgtcacactcttagagcgttgcaatattccaatgaatggcttaaatgcggtaattattggtgcttcaaatattgttggtcgcccaatgagtttagagctactgcttgcaggctgtacaacgactgtcactcatcgttttactaaagacttacgttttcatgttgaacatgctgatttggtggttgtggcagttggtaaacctaactttattcctggtgaatggataaaacctggcgctattgtcattgatgtcggtattaatcgccttgaaaacggtaaagtggttggtgatgttgatttcgcacaagcctctcaacgcgcggggtggatctcccctgttccgggtggtgtaggtccaatgactgtagcgactttgattcaaaatacgttgcaagcctgcgaagaatatcacgatcctgatataggaaataattaa

SEQ ID NO: 2907 - DNA, 216 bp, Proteus mirabilis
gcgcaggggctgttgctgatgcagtactaccatttgacggtacatgcaaaaaattttgttgccagcctaccgcatatggtgtggctaaagaaaataaagctattcctattaatgtcttattcatttaaaccgtcctactttttaggattacataaacctcagtctctgatactcatcattgactctgttttaggtttagttataaacaatgcttaa

SEQ ID NO: 2908 - DNA, 525 bp, Proteus mirabilis
atgagaaaaagctttattgcaatgttgattgctacaacgtctatttttgtcgcgaataatgcattagctgcagatggaacaatcgattttacaggagaaattatcgataacgcatgtgaattagcagctggatctgatgctctaaaagttaatttaggtaaggtatctaaaacagcattacctagtgccggagttactgctgcggcaactaaatttacgattaaattaattaattgccctgcaacagtaagtactgcatctgttaaatttgatgcagagtcttattctggagacgatactgttattgcgctaaaacaagagtcgggagtggcaacaggtgtcggtattcaaattacggatgatgcaaataccgttgtccctttatttaccgcatctaaaacctatccattaaaagaaggtgttgaaaataatttagactttagagctcgttatattgctaaaacagattctgtcactgcgggtttagcaaatgcgaatgcaacatttactattaattataattaa

SEQ ID NO: 2909 - DNA, 207 bp, Proteus mirabilis
caacctaagagaaagcttaaaatgaatgatacagatttaatactagaaactgatgtttacaaatggttaggactgaagcgtacggcattatggcgactaaaaaagaagcatgaatttcctctccctgttttaaaccgaccagccaaataccgtaaatcattaattcaaaagtggcttgatgatggtggggtaaatagaaaaaaatga

SEQ ID NO: 2910 - DNA, 798 bp, Proteus mirabilis
atattcaggagaaagacaatggctttgaatggtaaagtaattttagttacaggtgctgctcagggaattggtcgtggtatcgcattacgtcttgctaaagagggtgccgatattgctctggttgacttaaaagcagataaattatccgatgtagcaaaagaaattgaagcgttagggcgtaaagtaacgacctttgctgcagatattagcaaccgtgatgaagtctttgcggctgttgaacatgctgaaaaaaccttaggcggttttgatgttatgatcaataacgcaggtattgcacaggtgaaacctcttgcagatgtgaccccggaagatatggatcggatcttcaaaattaacgttaatggtgtgatgtggggtattcaggccgcttctgagaaatttaaagcattaggccataaagggaagattattaatgcatcttctattgctgggcacgatggttttgccatgttaggggtttattctgccactaaatttgcagtacgtgcattaacacaagcggcagctaaagagtatgcgagcgcaggcatcactgttaatgcttattgcccgggcattgtcggcaccgatatgtgggttgagattgacgagcgttttgctgaaattactggagcaccaaaaggtgagacctataaaaaatatgtggacggtattgctctaggtcgtgctcaaactcctgatgacgtagctgcgttagtttccttcttggcaagtgatgattccgactatattacgggccaagctatcttaaccgatggcggtattgtctatcgttaa

SEQ ID NO: 2911 - DNA, 1140 bp, Proteus mirabilis
attaggcatggactatcacgcacgcaagggcaagttaatcagtctatctcaaaagtggttagcgcaacgtgtagaggtggcgcaatgattaccctatgttcaataaagggtattgcctaccaagtgaataattccctactggctggtggggagtcggttaaagtggacgcccttttatccatcttgaatctaactttaagttatagtcaatcagacaaactttcgtccgatcactcggccaatattttggctcagtactcggcaaaatcatttgctcagcaatcagctaaaactttagccgatgtatcagcgaaaacttacgccaatcaatcaatcctaaccaccaatggaggatgggataaaggtaaacactcaaaaagtgaggagtttacaccatttattaaaggtgatttttctcacctttctaaagaggcgaattatcctcactggcaaggtttaatcggggtcactacacaaggcagaattgagttttttgagtccataaaaaagggcggccaatcggctacccttgggaacgtcgatattaaataccgagcaagtgagaactatgagaatagtattcatcttgttatcggtaaagatgacaaccttgagttaatacaaaaatgtgcaatacatcacttgcacttatgggtaattgttggctatagtgatcaggcactagcaaaatctagtgtcagaattggcgttctgaatcagttactggcgacacatgacgcgccttgcgtctttttttgtgtccatgcctacgcacacccattaaatgcggtattatatcgcgctgaatctatggtggcggcagcagagcaaccgaaaggttggctggattccagtaactccagtaacgccaactctactgtcgtcaccacccccgaaattggcgtttcaagtggtgactccttaactaagttactggagatcatcgttatgatggcaacccctacccaaactcaattcaaatttttgtttctgagtattaaacgctcagatacaaccgctaaaccttgtcgtattgctgttacagcaccgaatgaacacgatgcaagactgatgcttgtacgtgattacattctgtcattcgctggtcgcttacctgttaaggaggtggctcatgcgtaa

SEQ ID NO: 2912 - DNA, 681 bp, Proteus mirabilis
atgaaaaatggcaaactctctttcgatgcaaaaatcatatcatcagtcttagtctctatctgccgttttttaaccgggatcagagccaaacaaatatctccgattgagaaagataaaccttgtatttattacgcaaatcactcaagtcatctagatggtttagttatttggtcttcacttgccccccatattcgcccatttgtgcaccctgttgctgcagaagattattggaataaaaaccgtttacgtcgttatctttctcgtcgtatctttcgtgcagttttgatcccacgccacgcgaataaaacaaatgttactgaaggaaatggtgaaacaacaactgcacctcagaaagtaaatgctcttacactgatgcaggctgttttagataaaggtgaatcgctaattattttccctgaagggacaagaggtaacggtgagtctattcaggattttaaagccggtctttggcatttgtcccgtaacaatccacaggctcaattagtccctatctatcttgaaaacttaaaccgcgtacttcctaaaggctctcggcttgttgttcctatcatttgtagtgccacatttggcccgcctattgagccgacacatgaaaatgaagataagactgaatttctattaagagccaaaagtgcgttagaggagttacatcatggatag

SEQ ID NO: 2913 - DNA, 1419 bp, Proteus mirabilis
ccgattaacggttgcacggttattgggggtgatcgcatgatagcgctttctctcgaaactattgcacaagtcactcaaggcgcgttgagtactattactcaaagccaagccaatcaattaatgatcaaatcaatttctaccgatagccgtaaaattgatgatgcttgtctgtttattgctttagcaggtgatcgttttgatgctcatgactttattgctgatgtcaaacaaaagggtgccgttgcggttttagttaatcggaaaatcgatgttgaatgtccacaaattatcgtaaaagacacccgtttagcaatggggcatattgccgcttatatccgctcgcttagcaatgctaaaattgtggcattaacgggctcttcgggtaaaacatccgttaaagagatgacggcttcgatactgcgtcactgtggtgaaaccttatatacacatggcaatttaaataatgatattggtgttcccctgacactctttcgtctaacccctgaacatcgttttgccgtgattgaacttggtgctaaccatattggtgaaatagcctataccgtggatatggttaaaccagatagtgcattggtcaataatctcttttctgcacatattgaaggttttggttccttacaagggattgctcaagctaaaggtgaaatattcactggcttaaaagagcaaggcacagccattattaatcagcaaagtaatgatgttgcgctatggcaacagcattttaattcacgtcaaactcagtggtctttctctttatctgcagacactcaggccgatttctacccaacggatatcgttgttaatcaactcaccaccgattttacattgcatacgccagaagggtgtgtagcaatcaccctacctttacctggtcgccataatattgccaatgcgttagccgcaagtgcgttagccttgtcggtaggggcgacattaacggatattcagcaaggtttagcggtactgaaagccgtacctggcagactctatcctgttgagttaacaacaggaaaaatagtgttagatgatacctataatgctaatgatgggtcgatgatggcagggctgcaagttttatctcaattaccaggatataaaatctttgtcgctggagatatggctgaactaggcgaggattcagaaaaatgtcaccgtgatgtgggacgttttgctcatcaagtcggtatcgatcgggtattaaccgtgggtcattacagccagtttattagtcaagaaaatgaaggcggtgagcatttttcatttaaagctgatttgcttacccaattaattccattattacagcagcatgatgttgtttcagttttagtaaaaggttcacgaagctcagcaatggaggatatcgtgaacgcattaaaggagtgctttgaatgttag

SEQ ID NO: 2914 - DNA, 738 bp, Proteus mirabilis
aaaaacattttccatcatcctttttttctgtttatttattgtacaggaagacagttatttatgtttacgccaccagcagcacctgaaaatgaatccgttttactcgcacgagcacaagcgctggctggttataccttcggtgaactcgccgcttttgcacagcttcctattcctgaaaatttaaagcgtgataaaggttgggtcggtatgctattggaatactatttaggtgccagtgccggcagtaaacctgaacaagatttttctcatatcggagttgagctaaaaaccatccctatcgaccgttttggtatgccattagaaacgacctttgtttgtgtagccgcacttacaggaaacagtgggatcacatgggagaatagccatgtaaaacgtaagctgtcgaaagtattatgggtgcctgtagagggagaacgggagatcccattagcacagcgtagagtcgcttccccgctactttggagccccaatcatcttgaagaagaactactgcgtcacgattgggaagagttaatggatatgattgtcttaggaaaagtagaaagcattactgcgcgtcacggacaagtattacaaattcgccctaaggctgctaacagtaaggcattaaccgaagccattggtgaaaatggacaacgcatcatgacacttccccgtggtttttatttaaaaaagaactttacagcgctactgattgctcgttatttccaactttaa

SEQ ID NO: 2915 - DNA, 1491 bp, Proteus mirabilis
aaaacgtcagggttatttttaataggagtcactatgggacttgcagccatcaaaaccaaccaactgatcgccggtgaaatagcacaatcaggtggtgtagaaaattatttaaaaacacaacagaacaaagggttattacgttttttaacctgtggcaatgttgatgatggaaaaagtaccttaattggtcgcttacttcatgatacgcggcagatctacgaagatcagctctccaccttacaaaacgagagtaaaaagattggtactcaaggtgaaaaattagatctcgctttgctggtggacggtttagcggctgaacgagagcaagggatcactattgatgtagcttatcgctatttttcaacagccaaacgaaaatttattattgccgatacgccgggacatgcacaatatacccgcaatatggcgacaggagcatcaacgagtacgctttctattctgctgatcgatgctcgaaaaggggtacaagagcaaactcgccgccatagttttattagcacactccttgggatccgtcacttagtggtcgcgattaataaaatggatctacttgattatcaacaagagatctttgagtcgatccaacaagattacctgcactttgcacaacaattaccgcgcgatctcactatcgaatttgtgcctatctctgcactggagggagagaatgtagtatctccttcattaaatatgccttggtatacaggaaaaacactgttggcattacttgaagatgcgccggttaaatttaaattaggggctaaatctcaaagattacgttttcctgtacagtatgtgaatcgtcctgatttagattttagaggctacagtggcacagtttcatcaggctctctttatcaaggacaacagatcaaagtattaccctcaggacagcgttcaaccattaaacgtattgtgacttttgatggcgatctgactcaggcgcaagtgggtcaagcgattacactgctgttagcggatgaaatcgatattagtcgtggcgacattattgttgatgctaacgatactactgctaatgttagcaatcatgcgttggtggatatcgtatggatgtcagaacaaccgttagtacaggggcaaacccttgatatcaaagtagcgggcaaaaaaagtcgtgccaaaatagagaatattcactatcaagttgatgtggataagctcactcaacaagtgaccgaaagtttagcgctaaatgccattgggcatgttgaagtgttatttgaagagccattggtgctggataactatcaacttaatgcacaaacaggagggcttatttttattgatagattaagcaatgtcacggtgggtgctggtcttattcgagaaattcgcgacaacgtgcaacccacaacttcccaatacgatgcatttgaaattgaactcaatcagttgatccgccgccattttccgcattggggcgcaagagacttactgggaggaaaatag

SEQ ID NO: 2916 - DNA, 1284 bp, Proteus mirabilis
cacgatgaaggcgaaggcagaacaataatgatcaaagcgacggacagaaaattagtagttggtcttgagattggtacggccaaagtagccacccttgtcggtgagatcctgcctgatggcgtagtgaatattatcggggtgggaagttgcccatctcggggtatggacaaaggtggcgtgaacgatctcgaatccgtcgtaaaatgtgtacaacgggctgtagatcaggctgaattgatggcagattgccaaatatcgtcagtatatttggcgttatcaggcaaacatattagctgccaaaatgaaattggtatggtgccaatttcagaagaagaagtaacacaagatgatgttgatagcgtggtgcatactgcgaaatccgtcaaagtaaaagatgaacaccgtgttttacacgtaataccgcaagagtacgccattgattaccaagaagggatcaaaaaccctgttgggttatctggtgtacgtatgcaggctaaagtacatctgattacctgccataacgatatggcgaagaatatagtaaaagcagttgagcgctgtggtttaaaagtggatcaactgatttttgcaggactggcttcaagttttgctgtgctaacagaagatgagcgcgaattaggtgtttgtgtcgttgatatgggtggcggaaccatggatatcgccatatataccggtggtgcattaagacatactcgtgtcattccttatgcaggcaacgttgtgactagcgatattgcttacgcttttggtacaccaccaaatgatgccgaagcaataaaagtgcgtcatggctgtgcattaggctctttagttggcaaagatgaaaatgtcgaagttccaagtgtcggaggtagaccaccaagaagtctacaacggcaaacacttgctgaggtgattgaaccgcgttataccgagcttctaaatcttgttaatgaagagattttgagtgttcaggaacaattacgtcagcaaggaataaagcaccatttagcggcaggtattgttttaacaggtggtgctgcacagatagatggacttgttgaatgtgctcaacgtgttttccacacgcaagtacggatcggtaaaccgttaaatattaccgggctaacagattatgcgcaggatcccttctattctacggcagtcgggcttttgcattacggtaaagaatcttactttggtgaggaaactgaaaccgaaaaacgctctgcagttagtggttggctaaaaaaactcactggctggttaaaaagagagttttaa

SEQ ID NO: 2917 - DNA, 1140 bp, Proteus mirabilis
aagggagaaggaagtatgaattcagaaagcccaattaagcatgtccgctgggcaatcatgtgttcggtaatcggatttgcattaacaggctgtgccgacacgccttatcgtcctgcaccgataacctctgtcaatgatagttcgtcaaatcgtaccgtttctacatcacctgttacaactaacagtaatgcaggagtggcaacacctattgaaagaggttcaactccgttacaaacaacgcctcctccttctattagagtgaataacacaaccgcgcagcctcaaagccagcctcgtacgcaaaatgttacccctcaaaatgtcaatacggatggtagcggacgcattgtgtataaccgtaattatgacaatatccctaaagggaattacagcggtaacacttatacggttaaacgtggcgatacaatgttttatattgcgtggatcacggatagtgatgtaaaagatttggcctcaatgaacaatattccagagccatatagcttaaatgttggacaagtacttaagattggtaaccgtcaagttaataccggtaccaataccaatgtaaatacttcagtaattaataaaccaagtagtgaaggcgttcagacggcacaaactaagccgtcaaataataatagctcaatggggccgttgatcacgaaaccaacaacaacgacaccgccaaagacaacgacttcgacaccaacaacttcggcaacaaccagtaataacacaacggcaacctctaaacctgcagccgcaacaggtaaatgggtatggccagcacaaggtaaaattattgagagctactcaaatgcacctggtggtaataaaggtattgatattagtggtacacgaggttcacccattgtggcaacagccgcaggtaaagtggtttatgcagggagcgcattacgaggttatggtaatttagttatcattaaacataatgatgaatatctcagtgcttatgctcataacgatacaatcttggtacgtgaacagcaaaatgtaaatgcaggacagcaaattgcgaccatgggaagtactggtactagttctgttcgattacactttgagatccgttataaagaaaaatcacttaacccaatgagctatttacctaaaagataa

SEQ ID NO: 2918 - DNA, 231 bp, Proteus mirabilis
atccctcgaggaggcgaccaaatgaaaacaatcaaattaaatgttggtcacttatctaccttggaagaagtcgaacacatcaacgaagaacttcaagcgttgttaatcccactgttaacagctgtagagaatgaagctgagacggatacgcattttatgctgagagcagtcaaccgcttagtgtgtgctcaaggaaaagaaatcacaaggttggtggaggtgatgaaatga

SEQ ID NO: 2919 - DNA, 747 bp, Proteus mirabilis
agtgcaggaggtgatatgagtcgattatcactttctcagttggtgttgctatcgattgaagagcagcgactggcgcttgatgaaatcaaccaacaattagagcaaaaaacggcgatagagcgggtgatttgggctttagaacatcttcctaaccagtttgttttaagctcaagttttggtattcaagcggcagtttgtttgcatttgcttaccagacaatatcccgatatacctgtaattttgacagacacaggttatctctttcccgaaacatatcaatttattgatgaattaacttcttcactacaacttaatttaaaagtatatcgcgctgaaatatcttcatcttggcaagaagcacgctatggcaagctttggttgcaagggattgaaggtatcgaacgttataaccaaataaataaagttgcgccaatggaaagggcattaaaggagttacaggcgaagacatggtttgcagggctacgacgccagcaatccaaaagtcgagagcatttacctgttttatccatagcgaaaggtatttttaagttactaccgatagtcgattgggataataaacaaatttatcaatatcttaaacagcataatttaccttatcatccattatgggaacaaggttatctgtctgtgggtgatacgcatacgacacgcaaatggcaagagggaatgagtgaagaagagacgcgattctttggcttaaaacgtgagtgtggattacacgaataa

SEQ ID NO: 2920 - DNA, 1083 bp, Proteus mirabilis
tccaagggaggcgctatgaagccggtttgtgttcttggtaatggacagttaggtcgaatgttacgtcaagcgggtgagccattaggtattgcggtatatcccgtagggcttgatgctgaacccgaagcggtaccttatcaaaagagtattattaccgcagaaattgaacgttggccggaaaccgcattaaccaatgagttagagcaccatgctaactttattaaccgagatatttttccattactcgcagatcgcttaccacaaaaacaactccttgatgagcttcatttagcgacggcaccttggcaaccattaacttcggctgagcaatggcctgagctattcaatcagctaggggagtttattatcgttaaacgccgtgttggtggttacgacggacgaggtcaatggcggatacacccaggtgacgaacaacaattaccagccgaaatatatggtgaatgtattgtcgaacaaggtattcctttctctggagaagtctctttagttggtgcaagaaatcgtcagggggattgtgttttttatccactcactcacaatcttcatcaagatggcattttacgcatgagtgttgcgctaccaaatcctcccgaggcattacaacaattagcagaggatatgcttagcaagatcctcaataaactaaattatatcggtgtaatggccatggaatgctttattgtcggtgataaattactgattaatgaactcgcacctcgcgtccacaacagtggtcactggacacaaaatggtgcttctattagccagtttgaacttcacttacgtgctattcttgatttaccgatgcccaaacctaatgtttgccaatcggcggtaatggttaatcttattggaacggagatcgacatcaaatggctatcattacctttagttcatctacattggtatgaaaaagaagtgcgtccagcccgcaaagtagggcatctcaacttagtacataataaccatcaagctctgcaaaagagcttaagtacattaagtcccctgctcgatgaagcctatcaatatccgattaaatgggcgctagaaaaattaagctag

SEQ ID NO: 2921 - DNA, 633 bp, Proteus mirabilis
tattttatgggattagatattgtcatgtttaaagatcaatttacaccacaacaaaaaatggatatttgcacttttgaagaaggtgatccgacggaaaacccttgggttaaagggaaacctgcccaaatacacattgaaattgtcccccataatcctaattggcttatacaatttaatgaacaaaaattgttaattcagaatgcattgtcagatatagcattatcaattgagcacataggatctactgcggttgcaggattggctgctaagccaataatcgatatcgatttaattatagaaaatcctaaagatgaatcgtcctatattccccaattagaggcattgggctatgaactcattattcgtgaaccttcatggtatcagcaccgtatgcttaaactgagtaatccgatggttaacttacatgtatttggaaaaaattgtcccgaacattggcgccacctattattcaagcaatggttaacaacacatcctgatgatttagccaattatgcgacgattaaacagtttgctaagcataatgtaaagacgactcaagattataacctgaaaaaacagagccttgtacgtgcaatttatcagaagatttttacctcattgattggcgactaa

SEQ ID NO: 2922 - DNA, 801 bp, Proteus mirabilis
ccatcaaagggtattgaaatgaagaaagttttaaaatgggtgttgattattcttgttgtgctaatcattattggcatatttgccggcaaagataaagatggttctgataaaaaaccagaagcagtaaaatcttctgaacaaaaaatagcaatgacagacaaagaatacaagatggctgagttaatcattaacaatgatgtgatgaattcactgaatggtaatgattcacaaataactacagattatattcgtgttacagctagagagatgcaacagacttatgctagcaatgaggcaagaggagataaaacctataaaggtaagaacattattattacaggcattattaaatccatagactcaagtattggcgatatacctgttgttagcttaaacacaggagaaatgttctctactgtaagacttcatctagcaaaaccatacagagatatggctgctgatttagataagaatcaaaaaataacacttgcctgtgttggtgacagcgtaattataggctctccagggctaaaagattgcaaaccggtacctgctgtcgcatcaaaaataacaaacgagcaaatgaagtttgttaataaatttattaagggaaacaatgaagtacctaatgaaataaagcaaatagtattacttgctaaagtattaggtaaagaaacaggtgatttctctcaatgccaagatattaactctcaatgcatgaatgactcagtaaaagtattaaagagtattagcaaagaaaaactacaagaagaagctaagttacttggcgttgaaatgtag

SEQ ID NO: 2923 - DNA, 273 bp, Proteus mirabilis
tattacggggggtacagttatagcaaagataatcataatctttactatggtgtgagcggtagcgtcgttgctcattctcagggagttgtttttggacagcaactgggagaaaccgcggcaatcgtagatattcctaatgcgggtgatattacgatattaaatcaagcgggagttaggactaataactcaccctatgcattaattccttatgtcacaccatatcgtaaaaatactggtcgagatcgatacataaagagtgcccgagaatgctga

SEQ ID NO: 2924 - DNA, 195 bp, Proteus mirabilis
atcgaagggggaagcatgagcaaacctattccattggacagagctgcatacaaggcgcagcaaaataattcattacttgccgttatcttagagttagcaagtaaagattgttcgcgggagttaatcgacctcgtttctattgcgtatgactttaatgcggaaatatgtgaatccctcgaggaggcgaccaaatga

SEQ ID NO: 2925 - DNA, 348 bp, Proteus mirabilis
gggaaggggggatatatgagaaaattgttatttatttgtttatttactgtcatactttctggttgcgaaaaaaatcaaaccctagatggctctaatgttgagtcattacgaatatcgattgtagaaatgcgcaattcattaccgcttgaagagcaacaacgctttgatgaagcaatagaattagccatgctaaatgatattaattttaatgatttagtcattgctgggcgcaataaaaatgctgatatgatcacgcgaaaaatgtgtcaatcgttagatggtaaaacagtcaatgagatcttctcacaagctgaagaaataaaagtacaaaaattagcattaaaataa

SEQ ID NO: 2926 - DNA, 189 bp, Proteus mirabilis
ttgggatttatagcacgccggttattcatatatgctcgttttatagtcatgtcagttccactgataggtagattaactggcttcataggagtgtttgttcttatgtcttattttacggtgatatttaattgtcatcgattccattcagctcatgctggtaaaacaccgtatgaagttttaaaagaataa

SEQ ID NO: 2927 - DNA, 432 bp, Proteus mirabilis
cggactattatcatgagtaaatctaatcttattgcctttcgtctccctgctgaactacaaaccctgtttaatgaggctgtatcgaactctggtagcgataaaacagcgtggatagtctccgctatcaaagagaagttaaaccgtccagacagtaatcctgacgctcgcatactgtcgctagtggagcgcctagaatcgtctgtcgcatctttaattgctggtaaggcagatatcccaccgtatacctataatgagtctgctgttgtttctgtggttaattctgtgctgtctgagggtgtaaccaatgggcgcattattgctgaacaaattaatgaggcaggctatcaaactaaggcaggtaaagcgtgggataaagatatttattcagcgtggaagcgccataaagatattactgacaagctggttagctaa

SEQ ID NO: 2928 - DNA, 939 bp, Proteus mirabilis
aaagaaattataaacgttcggaaacggataattatgaaaacaattgttattgctttaggcggaaatgcattattacagcgtggcgaagttttatctgctgaaaatcaatataaaaatattgaattaatgtcagagacaattaataaattagcgcaagagtaccgtgttgttttagtacatggtaatgggcctcaggttgggttgttagcattacaaaatcttgcttatcaagcggttccagcctatccgttggatatcttggtcgcggaaagccaggggatgattggttatatgatgatgcagaaaatcaatcaaaataatcctacgcaagcaattactacagtaatgactcgtgtttctgttgatattaatgatgaggcttttagagagccgagtaaatttattggtcctatttatgaggaagcagaaaaagaagaattaataattaaatatcaatggacatttaaaaaagatgggcaatattatcgccgtgtcgtaccttcaccagcacctcaaaaaataattgatatagaggcagtaaagcttttattagataaaggtcatattgttatttgtggcggtggaggaggtattcccgttaataatataaataatgaatttattggtagtgaagccgttatagataaagatttaactgcagctttaatttctcgtgagttaaatgtagagcactttgttattttaacagaggctgatgccatttataaaaattggggaacaccagaacaagctgctattcgtgaagcaacaccagaagaacttgcaccaatggcagtcgctgatggcgcaatgggaccaaaaatcatggctgtcagtgattttgtaaatgccacaggacaacaagctcatattggcgcattacaaaacattcaacaggttattgaaggtcagtctggcactttaatttataagtcttaa

SEQ ID NO: 2929 - DNA, 1761 bp, Proteus mirabilis
cacgtcgttatcagagggatgtttattaaaatgaaatcacaaactcaagcgcccttagtggttgaaggaaaactatctgatagtgaacgtatgaaaaaagagagtaatttcttacgaggcactattagtgatgatctacaaaatggtctaaccggtggttttgagggcgataattttttattaattcgttttcacggtatgtaccaacaagatgatagagatattcgtgccgagcgtgcccaacagctactagagcctcgtcatgccatgatgttacgttgtcgtttaccgggcggtgtcatcacaccaaagcagtggctaagtatcgataagtttgctagtgaaaatacgctctatggcagtattcgtattactaatcgtcaaacttttcaatttcatggcattttaaaaggtcatgttaaaccggctcaccaaatgctagcgtcaacaggccttgatgctcttgcaaccgccaatgatgttaatcgaaatgtgctatgtacctcaaaccctgaacaatcttcattgcatcaagaagcttatgaatgggccaaaaaactatccgagcatttattgccacgcacccatgcctatgcagaaatttggttagataaagagaaagtggcgacaacggatgaggagcctattttaggtgaaacctatttacctcggaaatttaaaacatcggtggtgatccccccttataacgatgttgacttgcatgccaatgacatgaattttattgccatcgcagaaaatgggcatttggttggttttaatgtgctagtcggtggcggccttgcgatgacccatggtgataaaaaaacctttccgcgtttagctagtgaatttggttatattcctattgataaaacattagcagtcgctgaagcgattgtgacgacgcaacgagattggggcaatcgtactgaacgtaaaaatgccaaaaccaaatacaccttagagcgtgttggtattgaaacatttaaacaggaagttgaacgtcgctcaggcgttatgtttgatatgatccgaccgtatcaatttactcaccgtggtgatcaaattggttggttaaaaggggttgataacaaatggtatctaaccttatttattgaaagtggtcgattaatcgataaacctaatgcgccgttaaaaacgggggttgctgaaattgccaaagtgcatcttggtgactttcgtttaacagctaatcaaaatttgattgttgctggtgtaccagaggcacagaaagagcagattgaggcgatagcgcgtcaatatggtttaattaatgatgaggttacaccgctgcgtaaacatgccatggcgtgtgtttcatttccaacttgcccattagccatggcagaagcggagcgtttccttcccgcatttaccgatacccttgataatatcatggctaaatacggagtcagtgatgagcatattgttgtacgtgtaacagggtgtcctaacggttgtggtcgtgcgatgttggcggaagtcggattggtgggtaaagcccccgatcgctataacttacatctaggaggaaaccgcatgggtactcgcattcctagaatgtatcgtgaaaatatttcatcacaagaaatcattgaaattcttgatactttaattggtcagtgggctatttcacgtgaattaaatgaaggttttggtgattttcttattcgcactgatgttatcaaacccgttgttaattcagccattgatttttatgaagtgcaggaggtgatatga

SEQ ID NO: 2930 - DNA, 246 bp, Proteus mirabilis
tttattgctatctttattataaattattttgaaggcttagattgttgtatggatagtgaggatgtttggttttatttcttgatgtgttattttcatgaacactattctgaacttatttcagttatttttattattagctttattggaattatttggggtattattcatgaaatgcgctggctatctgttttttttacactaccgctgttaatttttgtggttggactcattttttctaattcttga

SEQ ID NO: 2931 - DNA, 228 bp, Proteus mirabilis
ataatttatataaaaatgaggggacggcaaaaaatattgccgtttcaattacaaaataaaaacagtaatggcgaaattccattaggtaatggaaaaaatttatatatcgcggttaatggtaaaccattggttactgttccactaagaacacgagcatttagtaaattaggtaatgcaacaccggggacggtgtccgccaaaataacagcaacgcttatttatcaataa

SEQ ID NO: 2932 - DNA, 363 bp, Proteus mirabilis
atatcttatatgagtgataataatatatttttcgatatggttttgtcattcgaggcgattatgaataaaaaaatatcaaagatagttggcgcaagaataaaaatgttaagacaacaacatggtatgaccggcagtgagcttggtgctttattaggagtaagccagcaacatcaatcacgctttgaaaatggggagtgcaatattcatgtggatgtaatttacttattatcttatatttttaaagttaaattaaattatttttttcaggatataaatgattgttttgatcaagaaggaatagcctataaagaaagttattatcattctgagacgattgtcgaaaagtgtgaactttggcgctag

SEQ ID NO: 2933 - DNA, 834 bp, Proteus mirabilis
ccgattctcttatttgaatgttgcgcaggggtgaatgaatttactatgtcacaagcagcgctaaataataaagagataaaagagaaacgtcattctgatagaccgagtaatggtagctatttatcaggattaatcttcttcttatgtgtgattgctaccattatttggggcggaatacaagttgtgaattggatgaaagatgctaatcgtctgccgatatcaaagcttgtacttactggtgagcggcattacacaacgaatgatgatgtgcgtcaggccattttatctttaggccaaccaggcacttttatgacacaggatgtcaatatcattcagcaacaaattgaacgtatgccatggatcaggcaagtgaccgtacgtaaacaatggccagacgaattaaaaatccatctggtggagtatgtgccatttacccgttggaatgacacacattttcttgatagagaaggccgaattttcagtctgccaacgcgattggaaacacaaggaaattacccactattatatgggccgcaaggaagtgagaaaatggtattagcaggttatttagcaatgagagatcagcttcttgccagtaatctgaaattaaaagcagcatcaatgtcagctcgtcaaggatggcaattagtcttagacaatgatgtccgattggagttagggcgtaaggataccgaaaaacggattgctcgctttattgagctgtatcctatcttgcaacaacagactgacaaacgggttgattatgtcgatttacgttatgacagtggtggtgcagttggatgggctcctttattacttgatgtgaatgaataa

SEQ ID NO: 2934 - DNA, 447 bp, Proteus mirabilis
acgtttcatattaccattatactttggtctatgaaaaatgaaactaatattcgccgtggcagacattgtgtattcctgatgcacatccatttggtctttatcacaaaatacaggcgaaaaatatttgatcaggatgcaattgaaaaattgcgaggctactttgccagtgtttgtgctgattttgatgttgaactggttgaaatggatggggaacgggatcacgttcatttattgattaattacccgccaaaactggcgatatctaatctggttaacagccttaaaggggtatcgagtcgattacttcgacgtgatcgtccagatattgcccaacgtgattactacaagggggttctttggtcgccgagttatttcgcggggagttgtggtggcgcaccaatatccattatccgccagtacattgagcaacaggaaacacctagttag

SEQ ID NO: 2935 - DNA, 1278 bp, Proteus mirabilis
aatctacatatatgtgggggcataattgggggcattatcccgttcaatgaaaattggtgcccccagatgaagctaacagccagacaagtagagacttccaagccaaaagagaaagcttataaactttctgacggagggggcatgtatttagaagttgctccgaatggttctaagtattggcgtatgaaatatagatatgctggtaaagagaaaaggctggctttaggtgtatacccatcaatatcactcgcacaagctagggcgaagagagaagaagccaagcgcatattagcgttaggtgatgatccatctttagtgaagaaagcagaaaagagagagaaagaatctcaagtaaataatagctttgaaaaaattacgcttgaatggcatgactataaaaagccgaattggtcaaaaggttatgcggatgatttactagaagccttccagaaagatatctttccttatattggtaaagttagcattacagaaattaaaccgttagatatgttagaagtgcttcggaagttagaaaaacgcggtgtgttggataagcttaaaaagataaggcaggcatgtaaccaagtattccgctatgcaattgtgacaggacgggctgagtataatcccgcatcagaattagccggcgcactgtctactccaaaagctaagcattttcctcacttaaatgtgaatgagttacctgagtttttacaggcactatctgtatgtagtggaagtaagatcactcagattgcgacaaagctattaatgataacaggtgttcgtactattgagcttagagctgctgaatggtcagaaattgattttgataaagctatttgggaaattccaaaagaacgtatgaaaatgcgtcgccctcacatggtgccattatctacacaggccttagaattattcaaagaaatacaaaccataacaggaaagtttaagtatatctttcatggtaggaatgatgcttctaaaccaatgagtgaagcggccataaatcaggttatcaagcgtattggttatgatggtagagccacaggtcacggattcagacatacaatgagcaccatcctgcacgaacaaggctataactctgcatggattgagacgcagcttgcacacgttgataaaaactctattcgtggaacgtataatcacgctcagtatattgatggccgtagagaaatgcttcaatggtacgctgattatatggatactttagagaacggggataatgttgtgcacggtaactttaaacgcgcttaa

SEQ ID NO: 2936 - DNA, 771 bp, Proteus mirabilis
tttatgatttttgaagcttctttagtggctttatgggccttcttttgcggtatcgataagtacgacgtggcattaaatatccatcgaccattaattacagggcccgttgtcggtctgattatgggagatatgcaagtaggattaattgcaggtgctaccttagaacttgcatggttagggcttgtacctaatgccggagctcagccaccagatgtgacattaggcaccattgcagcagttgcttttgcggtaatgacaaaacaatcaccggaagttgcaatgggaataggtatgcctattgctgttttaatgcagatgttggtgattggtttctttgctatgactgcatttaccatgggtaaagcggatcgatatgcagaaaaggctgacggtgcggggatctctcgcttgctgattattacacttattgtccgttcactcctttatgctttagtcgcttttgttactgtttattttggtgaacatgctgctcaatggattgatgagaacacgccaaaagtcttattagaaggattaggtattggggcgaaaatggtacccgcaattggttttgcaatgcttctaaaaattatgtggtcaaaagaagtggccggtgtgttctttattggtttcgtgatgacaacctatctcaaactcccaattatggccgtcgctattttaggcgcatcagccgccgcactctacttcttctttagtggtaacaataaaaattcaagtcagcagaatgaggatttcgaagatggtatctga

SEQ ID NO: 2937 - DNA, 1974 bp, Proteus mirabilis
gtttctaatatgaaaataagtaaggtatgtattagcctcattttatacttaggctatgcagctttattatatgcagaaaataataatttagatgatatctattttgatccagattttttagagctgccaaataaagatattattgatttatcttcttttgagaataaccaacagctagcaggtgactattatgttgatatttatgttaacactaatttaattttaactaaaaatattagatttgataaagataaaaataatcagcttaaaccttgtttatcagtaaatgatctaaatgactttggggttaaaacaacagattatcctgggctttattctgaatatactagctgtgtcaatttgtctgcgataccagaagctaaaagtgaattagattttgattcacaaaggttatatttaagtattccgcaaattgcattatctaaaaacccaagaggatatatagagttagataatattgataatggtataaatgccttattactaaactatagttatagtggttctaaaaactatgatcgtaagaatggcagttcaaatacaacttcaaattatataaatttaagaccaggtttaaatttaggaccatggcgtttaagaaactacacaacatggtcgagtacaagtaatcagtcagggaagtggaacaccctttatacctatttatctagaaatataaataaaataaaaagtcagttaatactaggggatgggatatcttcatctgatgtttttgatagtgttccgtttcgaggcatgcaattatcaacagatgatgagatgtatccagaaagtttaagaggctatgcgcctatcattagagggattgcaaaaagtaactcgcaaataaccatcaaacaaaatggatatactatttatcaaactgaagtggcagctggcccttttgaaattaatgatttatatccatcaggtagtagtggggatttatacgttacgattaagggtgctaatggtagtgagcaacatcaaatcgtacctttcgcctctttacctgtattacagcgtgaaggtcatttcacttatagcgtaacgggcggtgaatatcgtgcttatgataataatgtagataaaacgaagtttggtcagtttacattagtttatggtttaccttatggcactactgcttatgggggaagtcagttgagtcaaaattatcaatcttactccctaggtgttgggaaaaatttaggctcatttggtgctgtttctgttgatgttacacaggctaagtcaacttttaatgatggaaggaagcaacaaggtcagtcttatcggtttagatataataagaatttgaacaatataggaaccaatattgctttagcaggttatcgctattcaacgagtggcttttatagtttatctgaagtgtttgatagttttcgtcgtactcattatagccctgaaattgagcaacgccgtcatcgtgcggagataacacttaatcaaaatttaggtgataaatatggctctttagctatcggatatatacaagaggattattggaacagcaaaagcaaaaaacaatcagcaacacttggttataataatagctggcaaggtatcagctatggaataaattatacctataataaaaatacagttaatcattcttatattgctgatcagaaaagacaaaatgatgatgaacatttgttggctttttcggtgaatgtgccctttagcgtatttgataatactttttattataattttaatgcgaatagtaacaataatagttcaagtacaggaagtgtaggtatatcggcatctcagttaaataatcgactaaattggagtgtgcaacaagcatttaccaatcaagatcaaggatcttctggaaatatcaatgcatcctacaaaggccaactaggtgatattacggggggtacagttatagcaaagataatcataatctttactatggtgtga

SEQ ID NO: 2938 - DNA, 606 bp, Proteus mirabilis
tctactaatatagttaacggcttgttaataaaatatcgattgaggatcattatgcagtggcggaatacatctactcgctatgggcacttgtcgcttcttttacattgggggacagcattaaccgtctatggcatgtttgccctaggattgtggatggtaaatttaggctattacgatagctggtatcattcagcccctgaaatacataaaagtatagggataattctatttattgttcttcttttccgagcaatttggcgttggatttctcctccaccaacagcattatccagctatagccgacttactcgcattagtgcccatgtggctcatatgctgttatatctaattttatttgccatcattataagtggctatttaatttctactgctgatggtcagccaatatctgtattcgattggttctcagtacctgctgttttcacaggggaaggggaacaagctgatttagccggtgatgtacatctttatttagcctgggcggttgttgtgttatcgctattacatgccgcgggtgcattaaaacatcactttatagataaagatattacattgaaacgtatgctaggcataaaaacacaataa

SEQ ID NO: 2939 - DNA, 996 bp, Proteus mirabilis
aaatacaatatagtgaataaaaatagtggcttatcttcaggagagattatgaaagtctggtctttaggtgatgcggttgttgacctaattccactgcaaaatatgcaatatgaagcatgtgctggtggagcaccagtgaatgtcgctgcaggtgttgcaaaattaggacagcaaagtggctttattggtcgggtcggtgaagatgcatttggtcactttatgcaaaaaacgttatttgatctcggtgtagataccagcacaatggaatttgatgagttacatcgtaccagtacagtcttagtttcgttgcaagaaaatggcgaacgagattttacttttttagttgcggactctgctgatcaatttcttaccaataaatcactgcctgtatttgaaaaagacattttacatttttgttcacttgctttagttaatccaatttgtcgctcgacgctagatagtgctattagtaaagtaaaaaatagcgactctttactgagtttcgatattaatttacgcccccaaatgtggcgtgatcatgaagaaatgcgtgcgatcatcgatgaatatgctcataaagcagatattttgaaattatctgaagatgaactgacttggatgactcaggaaattacgttagaaaatgcattaaaaaaattagctgattatcctgctcgtttaaaagtgatcacccaaggctctaaaggatgtttagtgttgacgcctacaacacaagttgccttgagtgcctttaccgtcaattgtgttgataccacaggggcaggtgatgcctttatgtctggattattagccgcagttgcagaatatggttttgctgatgatgaacaatatttattaaaaattattacgcaagccgcggcctgtggcgcattagcaaccactaaaaagggcgctattgctgcagcaccgagccgaaaagtattgcgtgaatttgtcaataaacaaccgccgttacatgtacgagatattttttaa

SEQ ID NO: 2940 - DNA, 3078 bp, Proteus mirabilis
ggagaaaatataatgccgatatttcgttttactgcgcttgcaatgacattggggttattatcaaccccctatcatgttattgctgccaccagcaatcctgcatttgatcccaatcatcttatgcaatcagaaatctatcattttgcacaaagtgatccattagctgatttttcatcagataaaaattcaacactaactttatctgataaacgtagcattatgggaaaccaatcccttttatggcaatggaaaggtggtagtagttttactttacataaaaagcttatagttcccacagataaagaagcctctaaagcatggggacgcgcttctacacctgttttatcattttggctttacaacgaaaaacctattgatggttatctcactgttgatttaggggaaaagctcaatgccaccagcgaagcccaagctggctttaaagtaaaactaaatttcactggctggcgtgctattggtatctctttaaataacgatcttgaaaatcgcgagatgactttaaatgcaacaaatacatcatccgatggtactcaagatagtattggtcgctctttaggtgcaaatgtcgacagcattcgttttaaagccccttctaatatcagtcagggtgaaatctatatcgaccgtattatgttttctattgatgacgcccgttatcaatggtctgattatcaaataaaaacacgattatcagagccggaaattgaatttcacactgtacaacctcaattacctgtaacaccagaaaatttagctgcgatagatcttattcgccaacgtcttatcaatgaatttgttggtggtgaaaaagagacgaatcttgctttagaagagaatatcagcaagctaaaaacggattttgaggcactgaatattcgccctctttcggatggaggaatgcaaggtcgacatcttatcaccgataaacaaactatcatctatcagccagaacagcttaattctcaagacaagcaactttttgataattacgtcattcttggtaactacaccacattaatgtttaatattagccgtgcttatgtgctcgaaaaagatccaacacaaaaagaacagctaaaacagatgtacctcttgatgaccaagcatctattagatcaaggatttgtcaaaggtagtgccctagtaaccactcaccactggggatatagttcacgttggtggtatatctctacattattaatggctgatgcactaaaagaagctaatctacagacagatgtctatgattctctactttggtattcacgagaatttaaaagtagttttgatatgaaagttggcgcaaatagctctgatttagactattttaataccttatctcgtcaacatttagcgctattattacttgaacccgatgatcaaaaacgtattaacttagtcaattcttttagtcattatatcactggtgccttaactcaagtaccaccggggagtaaagatggtttgcgtcctgatggtacggcatggcgacatgaaggtaattatcccggctactctttcccagcatttaaaaatgcctcacagctgatttatttattacgagaaacaccttttgctgtaggtgaaagtggctggaataacctaaaaaaggcaatgatttcagcatggatctatagtaatcctgaagttggcttacctttagcgggaagacacccctttaactcaccttccctacaatctatagcacaaggttactattggctcgcgatgtctgcccaaccagcgccagataaacagttagcatctatttatttagcaattagtggtaaatcgcgaaatgaatctcccactatttttggtgaagagataacgccagcgtcccttcctcaagggttctatgcctttaacggtggtgcctttggtattcaccgttggcaagacaaaatggtgacattaaaagcctataataccaatgtatggtcatctgaaatttacaataaagataaccgttatggccgttatcaaagtcatggtgttgctcaaatcgttcgcaatggctctcaactttcacaaggctatcagcaagaaggctgggattggaatagaatgcctggcgccacaaccattcatcttccgcttaaagaacttgatagccctaacccacacaccttgatgcaacgaggtgagcgaggatttagcggcacatcagcccttgaaggaaaatatggcatgatggcgtttgatcttctttatcccgctaatcttgcgcgttttgatgctaactttaccgctaaaaaaaccgtcttagcggcggataaccatttaatttttgtcggtagcaatattaatagcagcgataaagatcaccctgtggaaacaacgttattccaacatgctattacgcctgagttaaacactatttggattaatggccaaaaaatagaaggttttccttatcaaactacgctaaaacaaggagattggataatcgatagtaatggtaacggttatttaattactcaagcagaaaaagtgaatgtcagccgccaacaccagacttcggctgaaaataaaaatcgtcaacccacgcaaggaaattttagctccgcatggatcgaccacggtattcaacccaaagatcatagttatgagtacatggttttcttagatgcaacaccggaaaaaatggcgcaattagccgagaaattccgtgctaacaatgggttataccaagttattcgtaaagataaagatgtacatattatttacgataaactcagtcaaataacaggttatgcattttatcaaccagcagtcattgacgataaatggatcaaaaaagtcgataagccgtccatcgttatgacacatcaggaaggaaatatactgacggtgagtgctgtaacacctgatttaaatatgactcgccaaaaagcggcaacccccgtcaccattaatgtgacagtgaaagggaaatggcaacccacagctcaagacagtgaggtaaaatataacgtttctggggataataccgaacttattttcaccagttactttggcattccacaagaaattaaactctctcctctctcttga

SEQ ID NO: 2941 - DNA, 504 bp, Proteus mirabilis
gatctgaatatggttacttttcataccaattacggcgatatcgtgattaaaacatttgcagataaagcacctgcaaccgtagaaaattttttagattactgtaaagaagggttctacgataacactatcttccaccgtgttattaatggttttatgatccaaggtggtggttttgaacctggtatgaagcaaaaagaaactaaagccccggtaagaaacgaagcaaacaacggtcttgccaataatcgtggtacattagcgatggctcgtaccaacgatccacattctgcaacagcacaattctttatcaacgtagcagataacgacttcttaaacttccgtgcagaaaatgccaatggttggggatattgtgtatttgctgaagttgttgaaggaatggatgttgtagacaaaatcaaagccgtttctactggtcgcagtggtttccaccaagatgttcctcgtgaagatattatcattaacagtgttactgttagcgaataa

SEQ ID NO: 2942 - DNA, 438 bp, Proteus mirabilis
cttatgaatatagattgggttcactttacgccttggagctcggcattgggtgggctattaataggtttagcagcggctattttattactgtttaatggtcgtattgcgggtattagtgggattttaggaggggtattaaccactaaccaacaaggtaatgggtggcgatgggcatttttactcggtatgttgattacaccgacactattttatctatttgataaaccgttaacacctattatcgacgtttcaccttggcagttgatcattgccggtgtactggtgggagcaggtacacgtctggggaatggctgtaccagtgggcatggaatttgcggattagcacgattatcgcgtcgttctattgttgcagttcttgtctttatggtgacggcatttgtgactgtgtatattcaacgccatgtcatcggaggctaa

SEQ ID NO: 2943 - DNA, 600 bp, Proteus mirabilis
gtaatgaatatttctaatattaacgcattcgaacacagtgaacagggggtgatcctcattactgaagcagccaaccaagaggctatcagctataccgaagcattagaggcattaaacgatggtagctttgatggtgatctgatttttggctttgaattggttttagctatctgcaagggagagtgtgacggcttttttaatccaactaatcagcagcgtgtgatcttgtggcgttggattgtagccgcttcgtttgtcgcagagcaagcagacaataacgggacgcatcaagttgacaacggcggaggtaaaaccattaccgccgctatttatcgcaacaaacatgcagcgttaaccgtctatgccgcaagcgaacgtatgttactagctaatcacattgagggcgctgcttatgagcactatggggcagagaatggcgcaattatggcagtaaagatatatagggattttatcaatcttgagcctaaacgtggttgccgactatcagagcgagggcgtgaggggttatctgttcttcatgatgatctaattagggcgatagaagatggtgaatttagcgacaccgtaaccattcattaa

SEQ ID NO: 2944 - DNA, 993 bp, Proteus mirabilis
gtagcggatatgatcatattgtttgattcgttttcggcgtatgatagtaaggtctctttaacgctattggtggaaagtcatatgtgggctcagtcaggtgtcttattagccatttgctcctatattttatggggaataacccctcttttttatcggctattacccggtgctcaaccattagagttacttgcacaacgtcttatttggtctattcccctgttattactggttcgattatttattaaaaatagaactcgctggcgtgctgttctccaagatagacgctctatttttatgtgtttatttagttcattagcaatggcagtctcttggtgcacctttacttatgcacttacgcatcaacaagtcttagccgccagtctggggtattttattaatccacttttttctattgtattgggcgttatctttcttaaagagaaattaaatcctgctgaaaaatgggcggtaatattaatttgtgcaggagtgggatatcaattatggatgtatggtcaattacccatactggcactcgtgatgggaggagcatttgcgatttatggactcattcgtaaatttattcgttttgatgtcataacttcattatttattgaaactttgtggctaattccggtcgctataggggcgatgatttggctgattatgcgagatgaaagtgcgttttcttctgcagacaatttaactcgtttctattatattttaaccgccccagtgactattctccctttactgttttttaccgcagcaatcaaaagaaccaccttaaccgttattggtttagcacagtatattgaaccgacaatgcagtttttactggccgtattcctattccatgaagcatttgatgctgtgaaaggagtaagtttttcattgatttggttagggctattgtgttgtatttttgcgctgattagaaagcgcctgaatgccttaaaaattcataaaggtcagcatagccaaaaaatataa

SEQ ID NO: 2945 - DNA, 1431 bp, Proteus mirabilis
gatacgcgtatggattacctacccttatttgtggaattaaaacagcgcccagtattactggttggcggtgggcatgtcgctgcgcgtaaagccgtactgttattaaaagcgggcgctcggttacgtgttatcgcgccacagttatgtgatgaattgcatcttgcttatcagcaaaatcaaattgagtggattgctgggcaatatcaggcagagcatttacttggcatgatgttggtgatcgtggcaacagacgataaggtattaaatcaacaagtgtatctagatgcgcaagcacgccacatttttgtcaatgtcgtcgactctcaaccccaatgctcttttatctttcctgccattatcgatagaaatccgatattaattgccatttcatcagcgggcaaagcccctgttttagttcgtatgatacgggaaaagctagaggcattattgcctacctcattagggactatggcgactattgcggggaaatggcgcaataaagtgaaacaaaaactgactggttttcaagcacgttgccgtttctgggagcaagcgtttagcggcaaatttgcctcattagtggcaagtggtcaattaatacaagcgcaagcacagctcgaacaacaactgtctcatccagatagcccacaaggtgagcttgctttagtgggagctgggccgggtgatgccgggttattaaccttacgaggtttgcaagttatccagcaggccgaggtggtactttatgacagtttagtcagtgcagatatcttagaactggtgcgccgtgatgctgatagaatttgtgtgggtaaaagagcggggcaacacagtacgttgcaagaagaaatcaatcaattgatcgtgaaatatactcagcttggtaaacgagttgtcagactaaaagggggcgatccttttatttttggacgcggaggagaagagcttgaaattgcggtacaacatggcattccttttcaagttgttcccggtgttaccgcagctagtggggccagtgcttatgcgggtattccattaactcatcgtaactatgcgcaaagtgtcacttttatgactgggcattgccaatcaggggggatagagccagattggcaagctttagcgcaagctaatcatacgttagcaatttatatgggaacgacgaaagcagaacttattagccagcgtttaatagagcaaggtcgttcaccactcacccctattgccgtcattagttgcgctacatgccatgatcaacagatcttaacgggaaatttaacacaattagcgcaattagctaagcaagctcccaccccggcattattaatcgttggagaagttgctgcattacatcaccaacttgcgtggtttggtgatagacaaactcaacatacctctgccatccactcatctttggttcattttgcctaa

SEQ ID NO: 2946 - DNA, 2451 bp, Proteus mirabilis
ggaggagtcatgatctggcgttggttttggcgtgagtggcgctcgccggctttattaattgtttggctctctttagcgctggcggtggcttgtgtgctggcgttagggcgtattggtgatcgcattgataaaagtatttatgctcaaagtcgtgatcttatcgccggtgatttagtgctacgcgcctcgtatcctgttgatgaaaattggctagctgaagctaaaagaatggggctaacacttagtcgtcaaatgcaatttaccaccatgtcttatgccccagaaggtgatactcctcaattggcgttggtaaaagccgcggataacttatatccactctatggtgagctagaaactcagcccgcagggctaaaagcggagaaaggcacggcgttagtagatgcaaggttgctggcgcttttgggtatcaaggttggtgataatattgatgtcggtgatgccacttttacaattagcggtgtattagttcaagagcctgacagtggttttaatccttttcaaattgcaccgcgtattttaattaatcttgctgatgttgaagcgactggtgccgttcagccgggaagccgcttaacttaccgttatatgtttgcgggtaatgaagcattaattgatgaataccaacaacgctttgatcccttattaaaacctgaccagcgttggaatagcttaaaacaagataatggtgcgctatctcaatcaatggagagagcaaaaaactttttactattatctgcattattaacactattattggcgatttctgccgtcgcggtttcaatgacacattattgccgtagtcgacatacgctaattgcggtattaaaaaccttaggtgccgataatcatgcattacgtaaatggattatagggcagtggggggtgattattgttgcggctatcgtggtcggctcactggtcggttggggctttgaattagtattgttgcagattttagcaccggtattaccaaaaagtttacctgatgcgagctttatgccatggctatggtcggttggctctttactactcatcgcgttattgacggggttacgcccttatcatcaattaatgtcaacgcaaccttcccgcgtgttgagaagtggtactacggcacctagttggccactacgttattatttacccatcgttgcattgattgttgttggcgctttaactctgtttgccggaacgggtgttttattgtggtctattttattaggtatcgtcgtcattgctttcttgcttggcgtgattggttggcttggattatggcttttaaagcaatttaaatttaagcaattgagtgcccgtttagcggtgacacgtttattacgccagcctttccaaaccatgacgcaattagccgctttttcattatcctttatgctattgacgctattggttttgctgcaaggggatttattggaaaaatggcaacagcagttacctgaagatagtcctaactattttttgattaatatgtcaaagcctcaggtacagcagattaatacattattagccacttatcatgtggcaccgacagatgcttatccggttgtgttagcacgtttaacagcgattaatgatcacaatgcgaaagtgtgggcagatgcacgggatgcggggaataataccgtacgaagagagcttaatttaacgtggcacagtgaacttcctaaagataatgttattgtcgaaggctcatggcctcccgtcggtaatggcgtttcaatcgatcagggggttgcacaaaagttagaaataaagctgggggatgagctaacttttgttggtgatactcgcgagtttaaatctgttgtcaccagcattcgccatgtcgattgggaaaatatgcgaccaaatttcttctttattttcgcagaagaagggctaagcaatcagcctgaaaaatggatgagcagtttttattacaatggtgatggaagtttgatcaccgcattaaatcgacaatttcctacggtcagtgtgctagatacgggggcattaattcagcaagttcagcagatcttacagcaagtcagccgagcattagaaattatggttggattagttatgctgtgtggggcattgctattagtggcacaaattcaagtcggtatgacacaacgtcgtatcgagttggtggtttatcgaacattaggcgcgagtaagtcactattaagacgcacgctttgggcggagtttgccttattagggttaatggccggtttagctgcagcgataggggctgaagttgcattagggttgttgcaaaaatcggtatttaatttcccatggcaaccacaatggatgatgtggatagttgttcccgctcttgccgccgtattactttcactttgtggcagtattttaggggttaggctattacaagataaaggccaatatcgtcgtattcagggagaatag

SEQ ID NO: 2947 - DNA, 192 bp, Proteus mirabilis
tcaacacccattttaaaactttcttcatttcaataccctttgatggttaaacaaaactttacaattctatttaaccatcataaaaggggatcgcaagaaaaaacacaaaatattagtttaattgggatttatagcacgccggttattcatatatgctcgttttatagtcatgtcagttccactgataggtag

SEQ ID NO: 2948 - DNA, 198 bp, Proteus mirabilis
ggtatagccatgttacaacgagaagcaatagaagtcgttatgatggagttagcccaccagcaagggcaatcactcaacggacgtgatcgattagcgattagaacaggtgtagcacagacaatacaggctaaagaacgtcacagacgaagaatgacagcacctacctaccaatggacgaagccagcaccaaaaagataa

SEQ ID NO: 2949 - DNA, 948 bp, Proteus mirabilis
aggagttacatcatggatagtatcaacaatgaaattctctggatctttatcgggctattctcctttttaattattgccagtattattggtgcgatccttgcggcactcaaaggtcctacctcaaccattaccaatcttaattctcgaattaaagcttggtggatcatgtgtatcatttctgccgtcgctattagtattggaacaataggctcagttatcctcttcgccttaatttcatggcttgcattacgtgaattggttacattaaccccgactcatcgaggtgatcacgaagcacttttttggtgtttctttgtcgtgctgcctatccaatatattctcgtcggtgtgcaatggtataatttgctagccatctttattccggtttatgccttcttattaattccaacacgtatggcgctttccggagatactcatcactttctcgagcgcatggcaaaagtgcaatggagtgtcatgatagctatctattgccttagctacgctccagcattattaatgttaccgatagaaggctttgaaggacgtaatattaacttattactgtttttgatgatcgtggtacaaacttctgatgttttacaatatgtgtttggtaaactatttggcaaacatcctatcgtaccgaaattaagtcctaataaaaccatcgaaggtttctttggcggcattatttcagccagccttatagggatgatgttatggtgggcaacacctttcacatggtgggctgcttttttactctctttagtcatcacactcgcaggctttgctggcggtttatgtatgtcagccataaaaagagacagtggcgtaaaagatttcggtactatgattgaaggccacggcggtatgatggatagaatggattccctgtgctttgccgcccctattttcttccacgttattcgctatttctacgtgtaa

SEQ ID NO: 2950 - DNA, 711 bp, Proteus mirabilis
ttatccaacatcatggcgccattattccccataacatcactgattcattctattcactcatcaaggataaccatgagacagtcaattgttgatacactttcagtactgaaagtgatccccgtgatccaaattaatcgcgccgaagatgcaatttggctgggtgaactactaacccaaaatcaattacctattgctgaaattacctttcgtactccagcagccgccaaagcaataaagctgatgagagaacactttcctgagcttattctttgtgcgggtaccgtattaacagcgcaacaagctgatatagcaaaagaagcgggtgcaagctttgttatttctcccggttataatccaaaaaccgtcgattattgccttcataatggcattgatattgtgcctggaataaataacccaagccaaattgaagttgctcttgagcggggtttaaccttgctaaaatttttcccagcagaagcttctggtggagtaaaaatgctaaaagcaatggcggcaccttactctcaagttcaatttatgcctactggaggaattagtctaaacaatgttagtgattacctcgctatcgggcaagttatcgcatgtggtggcagttggattgctactactgaggcaattgataatcaagacaaacagactattgctcgcaatattcaaaatatccattcattacttaagaataaaggataa

SEQ ID NO: 2951 - DNA, 864 bp, Proteus mirabilis
gaggcaaacatgtatctggtttctactcgtaatatgctcaataaagcacagcatgaaaactatgctgtgcccgcttttaacattcataacttggaaactatccaagtggtaatggaaactgcggctgaaatggcatcacctgtgatcttagcaggcacacctagcacgtttgcttatgctggtagtgattatttaatttcgatttgccagcaagcggctgaacaatatcgcatcccagtagcactacatttagatcatcatgaaaatattcctgatatttgcaataaagtgatttcgggggtgcgatcagccatgatcgatgcttctcattttccttttgaagaaaacattcgcctggttaaagaggtcgtcaatttctgtcattattgggattgcaccgtagaagctgaattaggtcgtcttggtgggcaagaagacgatttaatcgttgatgcgaaagatgcgctatttaccgatcctgattcagcagtacaatttatcaaagccacgggaattgactcattagcggtggcgattggtacagcacatggtatgtataaacatgaaccacatcttgattttgatcgtctacatgccatccgccaaaaaacagagatccctttagtactacatggcgcgtcaggtattcctgatactgatgtacgtcattgtatcgacttaggtatttgcaaagttaacgtagcaaccgaacttaaaattgctttctctaacgcaattaagcagtactttttagataatcctgatgccagtgatcctcgccattatctagtgccaggtaaagcggcgatgaaagcggtggttgcagataaaattcgcgtctgtaaaagtgatgggaaactgtga

SEQ ID NO: 2952 - DNA, 951 bp, Proteus mirabilis
ggtacaagcatgagacgtcgagtcgctaccattacattaaatcctgcttatgatcttgtgggattaagtacccctattgaattgggtgaagttaaccgagtgacaacagcgggatttcatgctgccggtaaaggtatcaatgtagccaaagtattaaaaagccttggtattgatgtcactgttggcggttttttaggtaaagagaatcaagatggctttcaaaaagagtttagtgaagccgggattgctaatcgcttccaaatggttgaaggtcgcacacgtatcaatgtcaaactcactgaacccagcggtaaagtaactgattttaacttttcagggtttgaaatcactaaacaagattggactcgttttgtaaatgacacactcagctgggcgggtcaatttgatatgatttgtgtcagtggaagtgtaccaccaagtattgatttaaatgattttactgcttggatgaagcgactacgtagcgaatgtatgtgccttatttttgatagtagcagagaagcatttgtcgcggggttaaaagcgttaccttggttagtaaaacccaatcatcatgaactagaaatttgggcaggtagacccttacctgaactctctgacgtagtacaagctgcccatgaattacgccagcaaggtattgctcatgttgttatctcgttaggtgaacaaggcgctatgtgggttaacgcctctggtgcgtggatggcaaaaccgcctaaatgtgatgtggtcagcacggtaggtgccggtgactctatggtaggtgggttgatttatggtttgatgatgaggcaaaccagtgaacataccttacgtcttgctacagcaatttcagctcttgccgtcagtcaaactaatgttggaataactgatcgtgaacaattggcaagaatgatgaccgaagttgaattaacgccactaaaaatctaa

SEQ ID NO: 2953 - DNA, 189 bp, Proteus mirabilis
ccatttttaatatttctaatattgattttttttaaatcaattaagtggtttttcgtttctaactcacaaggtgaggctactactgatccatatacattaatattaacagtgttgcttaatgcgataggagaatatgaaaataataaaaataacgttagtgatttccacataacaccctctttttattga

SEQ ID NO: 2954 - DNA, 795 bp, Proteus mirabilis
ggttgcttaatggcgaaaaaaccgacttattcagtacgttttgtagcaggtcaacctgtagaaaggattgaacctagtctacctttaggccaaatagaagagatgctaccgattgggatgccactatatacagaaggcactttaaaaattgctgtttggaatatttacaaacagcaacgggtcaattggcgtagtatgctggaaacgcttgccaccgatactcaactattacttttacaagaagcgcaaacaacacctgaattagttcgttttgcgggtaaaaaccatttaattgctgatcaagttcctgctttagcctttcaacagcaccctgcgggtgttatgaccttatcaagttctcatcctatctattgttgcccattaagagaaaaagagccttttttaaggcttgctaaatctgcattaattacggtttatccacttattactggtgagcatttaatggtgataaatgtacacgcgatcaattttagtttcggtgttgatgtttatcaaagacaattaaacagcttatcgactcatatcatcgatcataaagggcctgttattttggcgggggattttaacgcttggagtcgtccaagagttaatgtgttaaagcgttttgctagaagattaaaacttaaagaagtgatctttgaaaaggatttacgcactcgcgcttttggtaagccacttgattatatattttatcgtggattatcactaaataaagcggaaatcttaatcacagatgcatctgatcataatcctttggtggcgaccttttcttaa

SEQ ID NO: 2955 - DNA, 861 bp, Proteus mirabilis
  unsure (241): Identity of nucleotide at the above locations are unknown.
acaaaattaattttaagagtgatttcatttattctagattgtgatgagaaaaagaatcatttagcatttattggcaactctgttatccattacaggacgaataacatgctattaaaaaaaatatttttagtgtcttttttattccctaccctctcttacgctaataccttaccaacatcaaatatagatatttcactacttcccaaccatgataatcttgcccgtttttcactcggtgacnatagtcaagcatccggtagcggtgccacagctataggtatcaatagccaagccaccaatactcgtgcggttgctattggttatggtgcattagccaatgaggaaaatacggtttcatttggcaatagtgaagagaaacaaacagcacgactcaccaatgtcagtgaaggtaaaaataatactgatgcagtcaatctggcacaaacaaaagcactacttagtaaaaataaaaggttaactgatagccaaataaatgtttttagaaatcaaactaataataacttaaacaccatcaaaaaaaccattcatgagtttgatgattattatcgaagacgacaagcatcaattaccgatgcaattgaagcactggataaaaaagttatttcattagaaaaaaaagtctatgcaggtattgcttcctcaattgccatgaccaatattccttatcttactcatcatacttttagtggtggcctcggtattagtaattatcgtactggcatagcacttgctggaggtatccaatatcagccaaataatgatatagcatttcgatttaactcatcaattaatagtgaacaagagcttatttttggcggcggattagcttatggctggtga

SEQ ID NO: 2956 - DNA, 537 bp, Proteus mirabilis
cgaaggttaatgagcattataaatttttggcgacaatttggcagacgatatttttggtcgcatctgctattagggatggtagcagcaggtattggtatgccttcgctggtgtctgcccatgctgaaaatccatcacaaacggatacaccttcctcacaaaatcgtcaaagccaagcattaatcgcttttgataatttattcttacgccagagtgtacagaatcctgcttcatccttcacctttaattactggcaacagcatgccgttaaaaatgtgattaagcagctctcttttgcttttaccattcattcacctgaattgatggtaaaagcaaaagatgagccatcacctgttgcgaatgttgctgaggtcatgcttgatacgctttatgcgttactgactcaagcgccatcttctaccctggttaatttaccgatttcccgtggcgtattaacggaaaatcgtatttcctatcataccggattatggcttgctcagatccgcggtatccgtgctggaccttacctaacagcttaa

SEQ ID NO: 2957 - DNA, 2196 bp, Proteus mirabilis
aaccatataatagtcataaggttatatctcatgaaaaataaaaatttgttatttttaagtgctgctgtcctttcagctatatatggctcagccgtagcggctgattgcgatagtactttaaccatttgtgaaaccgtaaacattaataatggcgatacagcgcaaataaataaagatgttaatgtatcacaaggtgacggtgtagtatttaatggctcatcaacagaatataaagctcaagcaattacaaaaaatattactgttactggtaatggagcaaatgcaattaaaataaatcagggcgctacttttagtagtaatattaatttaaatggcgctaacgttactagtgaaaatggtacagcaatattagttgaaggtaactttcctaaacgaggaacaggtgtttatattcgagatggcgctattatcagaggaaaaaccgcagcgattgattttagcactttaaaaacaggctttagaagtgatgttaatggcgagatccacggtgatattttagggaataatcatgtggataccaaaatcaattttgcttatcagggaggagcacaaaatgcattatttgacggctataaaattaccggtgttcctttaattgaaaaccatggcaatttaactattcaaggtaaagataaaaccattcaatgggaaggtaacttcatgaataaggaaaatagccagcttattttccgccttgatgataataccaatactgatgaaactatcttacatgttaccggcgatgtcacctttaaaaaaggtagccaagcaaaacttgattttaaaggcaccagtgttgataacatcattaataaagatattgtattaattgcttcagactcggcaattaaagatgaagcgggcattacagtgactgatgcaaatgccatagcgccagatatttcacctttattagaaaaaacagattcatggttagaaacgacaccaccaaatattagcggtggtgtcagtggtaatcaattaattgcgcgttatggtattagctacgaagggggggataattttattagcgctgctgaacgtggcaatgtcacagagaatggattagcagcagctaattttattattccaacagtattaaatgaatttaataatacacgtagccaaatttcagatgaagcattaagtttattagtcgccgctggtaataatgataataatattgctgcactatcaaatgatctggcgcccattgctgacggtagtgatattcaagcaggattaatcatggttgaagatatgcgcaacaatattgctcatcgctacttacgctatgataatcagctccccattgaagaaagagaaataggttggaatagctgggcaaatattctgtacggttatggtacgcaaagtcaacaaggtggaattaacggctacaatacttatcgcactggtattcaaatcggtactgattatgaaataaatcaagatgcgctaattggcgtttctttagcatataactacgctaaagccgatgctaaacaacgtaatgcaagcaaagaaattagccattttgaatttatgccttatgccggttggtatagtgatacattattcttaaacggtaatttaaatattggttattacactgtcgatagtgagagggatatcggtggtaatacgggatggcaaggaaataccaaagcaaaaggtgactactctggtgtgcaattaggctatcagattaacgctggcacctatttggattttgattttatccatattaaaccgatgctaacttaccaatatcaatggctcaatattgattcttgggaagaaacaggctctacattatctatgcgtacttatggccaacgctacgcagttaatcaattaggtggctctgttgctttatggaatgactaccaaacctcttatggcaaattaaccccttctcttaaccttcgttatatcaaagatattgcaggtaataacgatattaatcaacgccacagccttacctattttaatactggaggaagcaccttcgatattaaaggaaataccgttggtggtgacatcattagtgctgaattaggtgcaaaccttgatattacccaatcgttaaatttaggtacaacaatgggatatcagcgttatgacaaattcaatgaagggcgtatcggctttactgttagccagcgtttctaa

SEQ ID NO: 2958 - DNA, 1164 bp, Proteus mirabilis
cgagatataatgactacacacctttttacttctgaatcagtatcagaaggtcatccagacaaaattgcggatcaaatttctgatgccgtattggatgcaattttagaacaagatccaaaagcacgtgttgcctgtgaaacttacgttaaaacaggcatggtgatggtaggcggagaaattaccaccaaagcttgggttgatatcgaagagatcacgcgtaaaacagtacgtgaaatcggttataccagttcagatatgggctttgatgctaattcctgcgccgttatcagtgcgattggtaaacaatccccagatatcaaccaaggtgttgaccgcgcagatcctcttgaacaaggtgccggtgaccaaggcttaatgtttggttatgccactaatgaaactgacgttctgatgccagcgcctattacttatgctcaccgcttagtccagcgccaagctcaagtacgtaaaaatggcacactaccatggttacgtccagatgctaaaagccagatcactttccaatacgacaataacaacattgttggtattgatgccgtggttttatcaactcagcatgctgaagatatttcacaaaaagacttacatgaagcggtaatggaagagatcattaaacctattctgccaacagaatggttaaatgaacaaaccaaatatttcattaacccaacaggtcgttttgttatcggtggcccaatgggcgactgtggattaacaggtcgtaagatcattgttgatacttatggtggtatggcacgccacggcggtggggcattctctggtaaagatccttccaaagttgaccgttctgcggcttatgctgctcgttatgttgcaaaaaatattgttgctgcgggcttagcagatcgctgtgaaattcaagtgtcttacgctatcggtgttgcagagccaacatctattatggtcgaaacatttggtactgaaaaaatccctacctcacaactgatcttattagtacgtgagttctttgatttacgcccttatggcttaattcaaatgctggatttactgcatccgatctaccaaaaaacagcagcatacggtcattttggtcgtgctgaattcccttgggaagcaacagataaagctgagattttacgtgaagctgcgggtttaaaataa

SEQ ID NO: 2959 - DNA, 405 bp, Proteus mirabilis
ggtggcataatggaaaagaaaaaccacctatcacaggtggcttctcaggataacgtagcgtcgtctattctatcaaagaacccacctaaaaaacaccgtgcccgtttatatatgttaggtactggcattaatggttttacggagaatgaaatattaattcattgccgtttatcgtcaggccgtaattacccgaatgaattagagcgtttattgaatatcgaactagagcgcattgatgagcctaatcctgatggtatcggatcacattatcgttaccgctttaaaacggctcaagatgtgcagaaggttattaacttaataaataaacgtgctgaacaaggtaattaccaacccatagataacgcactcataaataatattttaagcctgtacccgacaaaataa

SEQ ID NO: 2960 - DNA, 204 bp, Proteus mirabilis
ctctcaataattttaccttgtgctggccatacccatttacctgttgcggctgcaggtttagaggttgccgttgtgttattactggttgttgccgaagttgttggtgtcgaagtcgttgtctttggcggtgtcgttgttgttggtttcgtgatcaacggccccattgagctattattatttgacggcttagtttgtgccgtctga

SEQ ID NO: 2961 - DNA, 492 bp, Proteus mirabilis
gtaggaataattatgactcccgcagtgaatttactggaaaaacaaaaaattaaatttactcttcacccttatgaacatgatgcgaatgtacataactttggtgatgaagccgttgaaaagttagggctagataaccgtcaagtgtttaaaacgcttctcgttgcgttaaatggtgatgctaaaaacctagccgttgcggtcaccccagtatcaagtcaacttgacttaaaacgagtcgccaaatgccttaaagctaaaaaagcagaaatggccgatccacaaatagcacaaaaagtaacaggttatttagtcggcggtataagcccattaggacaaaaaaagcgccttcccacggtgattgatgatcaagcacttaagtttgacactatctatgtctcaggaggtaagcgagggctggatattgaactaacggctgaagatttatgttcagtattaggtgcacaatttgccctgatccgtaaagaggattaa

SEQ ID NO: 2962 - DNA, 195 bp, Proteus mirabilis
ggtgaagtaatggcgaataaagagatagttttatcactggaagtaccccgcatgaaaataaaccgagtactgacgctcttaactgtttggcaagaagcaaatcaggacgaggaaacagcccatatgatagctattgccttcgctgccgtgaatgacgcactcaaggatattgattctgctatggagggtaagtaa

SEQ ID NO: 2963 - DNA, 1569 bp, Proteus mirabilis
gaggaagcaatgactgtttcccgtagaacttttatcaaaggtcttgccgccagtggggcagcaatctctgtttctacacctgctcttgctacttcaggtgactttacagcaagcaaacgcactcgaccagaaaatgcacctaacttattaattgtttttcctgatgaaatgcgagcccatgctctacagtttatgggagaagatccatcgattacaccaaatcttaataaatttgccaaacaagccaaagtaatgacacaaatggcatcaaattaccctctatgctccccttttcgaggcatgtttatgacaggtcagtaccctgtgcgtaatggtatcacaggtaatgcccatgattacggtggaaaagtaggtattgacttgtctccttacgcaaaatgctggtctgacgtacttaaatccttagattatagcactgggtatattggcaaatggcaccttgatgctccctatgagccttttattgaaagttacaataatccaatggaaggtcgttattggaatgaatgggctgctccagataggcgtcatggttttgatttttggtattcttatggtacttatgacttacacttgaaaccgatgtattgggcaaacgatacacctcgtgataaaccgatttatatcgatcaatgggggcctgaacatgaagccgatatggcaatcaagttcctcaaaaatgaaaataatcaatttagagataattcaaaacaatttgcattagtggtttcaatgaacccacctcactctccttatgatcaagtaccgaaaaaatacctcgatgcttatcaaggtaagacatcaaaagagttaaatacacgccctaatgtacagtgggacagtgaatatcaagaaggttatgggcctcaatatttcaaagaatatatggcaatggtcaacggtgttgatgagcaatttggtcgcattgtcgatgaattagaaaaacagggccttgcagataatactctcgtcgttttcttctctgatcatggcagttgcttaggatcaaatggacaagcaacaaaaaataatccgtatgaagaatcgatgcgtgtccctatgatgtttcgcttaccgggtaaaatcaaaccaggttttgatgatgcattaatgtcagcacgtgatatttacccaactattttagggttacttggtttatcagaatggatccctgattcagtagaaggcacagatcttgcagatagagtcatcacaggcaaaggcgacacagcaaactctcagctttatctttttattccttatggtgaaccttcattcggtaaacgaggtgtaagaacaaaaactcatactttggtgatagataggcaagatgggcaaccattaaaatatactttatatgacaatgtgaacgatccatatcaaatgaaaaatattgccaaagataatatgcctttaattgataaattaattaaagaagaattaaccccttggttagaaaaaacaggagattcttggagagcgactgagtttattacagcgacaacgaataaattaaataaaaaaatatcaatatgtgaagaaaaataa

SEQ ID NO: 2964 - DNA, 351 bp, Proteus mirabilis
ggaaagcaaatgccatataaaatagtgcgttatcaggacagaaaccaaaaagtaccctatcgagagtggatacaaaagcttaggaaacgagatcctcaagcggctgctaaaattgaagtacaagtaactcgagcatgttatggtaacttcgccgatcataaatttgttcgtgatggagtctgggctttacgaataaacttcgggcagggatatcgggtttattattcaatagaaaatgaatttattattcttttacttgttggagggaataaaagtactcaacaagcagatattgataaagcagtgaactatcttgaagattatcatgtaaggatgaaaaatgaccaataa

SEQ ID NO: 2965 - DNA, 1719 bp, Proteus mirabilis
gtaattaaaatgaacaagactaaaacaacccggttaagttttttacattactggcatgggttgggtgcctggaatttttattttttgctaaagtttgttttgctttggtatggttatttaaaatttgatgcatttagcaatttactctttctagcatttttattatttccactaccgaaaacattttggcataaattacgtaattggatagcgctccctataggagttatgcttttctatcacgacacttggctacctagtttttcaacggtattagaacaaggagggcagttaaaaaatttttcattctcttacctcattgaattagctgttaattttattaacttaaagatgatcggggtggcatttattttactggtagggtatctctttattgaacagtgggtaagagtgtcggtgtttattatcgcgggtgtagtgtggcttaatattagtggttttacccatttttcaggtgctatggcttctgctgtttctgccaatagctttactcagcaaaccaacacatctatcgatcagccacaacagcaaaatacagaaatattatcgacagctcagactagagcgcaaaataataacgtactgagttcaccttatccgccacaaaaacagccggctaataacaaagtgttagatgaatggcttgctcagttttatcgttacgaaaataaacgcagcacaccggctcccgctcagctctcttcttatgcacaaccctttgatattttaattattaatatttgttcactctctaccgctgatgcggcagccgtcggattacagcaacatcctatttggggtaactttgatgtgttatttaatcgctttaatagtgttgcttcttatagtggtcccgcttcattacgtttattaagagccagttgtgggcaaacacaacacgctgatttgtatgatcctgccgatatgcaatgcttattgatggataatctggctactttaggttttgagaagaaattggtgctcgatcataatggcgagtttggtcattatcttcaagaaattagggagttaggtaatcttaatgtgccgttgcaagatcaacgcgggctctctcatcaaattaccgcttttgatggctctaaaatctataacgataaagagactttagagcgttggttaaaagcacgagaaaaatcagatgaaaaacggacggtgacctttgtcaatttagtgtcacttcatgatggtaataggttcgttggcgaaaatacaacggctgattatggcaaaagagcctcagcgctacttgataacttaaatgcttttattaatacccttgataaacgtggcagaaaagtgatggtggtgattgttcctgaacatggagccgcattacaaggtgatacaacacagatgtctggtttgcgagatattccaagccgaagtattactacagttcctgtcggtattcgttttactggacttaaaaatcaacgtttacctcatacacctatgatgatcgataaaccaagcagttatttagcgttatccgattttattctccgtaatgtgaatggcgatatctttaatcaacccaccatagattggaatactttaacccgtgaattaccacaaaccgcgacggtatcagaaaatcaaaataccattgtggttgattatcaagggaaatcttatatcaaattgaatgaaggagagtggatagactaccctgattga

SEQ ID NO: 2966 - DNA, 411 bp, Proteus mirabilis
gggaataaaataatgagtgaaaataatttaagcccaaatgaaaaaccgttgttatctaatgaagataaaattcatttagaacatttactagaaaaaataaggcctttattagcattaaagcgcctagataatattgttgatttattatccttagcctcagataccgtcgatattatggataacgcaacggtagaaaaattggcggttgcttttgaagaaacattaattccggtttgggaattaactacggcctttaatatggctaaaaaagaatctctttatcaggataaaaaatataccttaggtgcgactttttcattattaaaaaatcctgacaccttaaaaggattaactattgtactaaggacattacaaattattggggaaaataatcagaaaatagaagtttaa

SEQ ID NO: 2967 - DNA, 363 bp, Proteus mirabilis
gaaagtaaaatgataaaagtaatgaggctcttccttcttataactactattggaataagttttttttcatctgcaggaagtactgtgacacttcaattttctggaaatataaaagccgcgacttgtaatgtttctggtagtaaaaatattaatattgatttgaaacagatgccagaaagtttatttaataaagtaaactctagttctgtttggaatgattttaatattaagttaatagattgttctccgggggtaaatcaagtaaagctgactttttctggaacgcctgataatgcagatgtgaataatttatataaaaatgaggggacggcaaaaaatattgccgtttcaattacaaaataa

SEQ ID NO: 2968 - DNA, 990 bp, Proteus mirabilis
gtaataaaaatgaaccatttgatgggtaaaagactttttttattaggtacaatcttctttttttctgctgacgcctttgcagcttgtattcaaaatcctaatttaaaaaatattcaggctcggatccccaataaaacctattcaattcaatatgatgatatagggacaagagtattagatgagtttcagattaattatgccaatgggcctattaaaacttatttggataagaatggggactgtggggatgcttctctttcaggatattatacaaatggatggatacccgataataataaagttgtaaaaaccaatattcccggtattggtatgaaaattaaattaaatagtttaggttttattaacctaacttggtctaaggttgagccgccaaactcaccttatcggataattaatccttcttggacggttcaaattataaaaacaggcagagtaacgcaatcaggaagccttcaatggggcaagattgctcaagcagtacaaaataatacacaacctaaaaacacaacttggaacttaacttcactttatttgcctcttaatgcaataaaaataaattcattaaaatgtactacaaaatcatcaaattataatattaatatggggacttggtatgatactcaatttaaaaatattggtgatgtcagtaaaagtgtagatgttcctattacattaaactgtgcggctggcactaacattaaagcgacagtgacaagtagtgctggatatatagatgcaaatacagggaaattaaacctatcgggcactaatcgagccactggtgttgccattcagttattagataaaaacaataacccgataaaactaaatacaaaaaatagtctacaaaatggggtctcctccggtgattatatatttggttggaaagcaagatatataaaaacaggtaataaaataacgcctggtagtgctaactcaacagcaacagtaaatatcttatatgagtga

SEQ ID NO: 2969 - DNA, 1209 bp, Proteus mirabilis
ggatcgaaaatgaccattttgggaacggctctgaccactaatgccacaaaagtgatgttattaggtgcaggcgaattaggtaaagaggtgatcattgaatgccaacgtcttggcattgagactattgcggttgatcgctatgccaatgcgccggcaatgcatgttgctcatcgccattatgtcgtcaatatgcttgatagcgaggcattaaaacagattataactcaagaaaaacccgattttttggtgcctgaaattgaagctattgctacatcattattagtcgaattagaaaataatggtcaaaaagttgtaccttgtgcccgtgcagtaaaactcactatggatagggaaggaatacgccgtctcgctgcagaaacattacacttactgacttctccttatcaatttgttgatgatgaagcggcttttagaaaagcggcggttgagattggttttccttgtattgtaaaaccggtgatgagctcatctggaaaaggacaaagtgttattcgttcagagcaagatctcactagtgcatggacttattctcaagaagggggaagagcagggcaagggcgcgtgattgttgaaaagatgatcccgtttgattttgagataacattactcacgattcgtgctattgatggtattcatttttgcgagcctattggtcatcggcaagaaaaaggcgattatcgtgcgtcatggcaaccacaaaaaatgagtgatattgcccttgccaaagcacaacatatcgctagtaaagtagtggagaatttgggcggttatgggttatttggtgtggaactatttatccaaggtgatgaggtgttttttaatgaagtatcaccgcgtcctcatgatacagggcttgttaccttaatttcacaagatttatcagaatttgcgctccatgtgcgtgcttttttaggctatcccatcggtggtattcgccaattaggtgcttgtgcttccgcggtgattttacctgagttgtctagtactaatattgtctatactgggttagaaaaagcgcttaaggcaaatcgacaaattcgtttatttgctaaacctgaaatctcaggacatcgtcgtttaggtgtggtgcttgctcatgccgattccataaaacatgctattgaagaggcgaatttaggtgcacaagcgattttagccgatgatggtgataaccatttatcgcggtga

SEQ ID NO: 2970 - DNA, 1485 bp, Proteus mirabilis
gatacgaaaatggttattgaaattgcatctaaaccacggcctaaactgccttatgagcaccctgatgtaaaaatttatcaacgcttatttaaagaaaacataatccggcgattagtcagaaaatcggcttatcaccgtcatgataatgctattgctgatttttttaaggatgagacacactctcttttttcgctctgtgaaagacttactcagtatattacagaagcttttcatcactatcaggtttggggttattcccatgcctattaccccggtagtcctggccaacaaaccgtcagaaccgatgcgctagaaggggttagtcgagtacttcctttacttgccgcatggacagtaaatagcaaaaaaagcacattactaggtttaaaccagcaaatttaccatttaccctcaatgataaaacaaagctttattcatggaacagatcctcttcataaaggctattggggaaaacttgaaaattacgatcaacgaatttgtgaggcatctgatctcgctcttactctttggatcagccgtgaatgggtttgggatacgttatcttcggagatcaaacagcaaataattaactggtttgaacaagttaatcactgcgaaattgttgataataactggcattttttcccactaaccgtccaatttgttattaaagcactgacaggtaaagataccattgcccattggcgttatgaaagattaaaagaattttatgtcggtgatggatggtttcgtgatggggcaaaaggtaattatgattactacaatgcgtgggggttttattattctctttattggctagcgcaaattgatccacaatttgatcatgattttattactcaatccctgaataattttaatcaacactacctttattttatcaccccaaaaggtattcctttttttggtcgtagtgcttgttatcgtcttgctgtttctgcgccattactcgcaggcgttgatttacaatgcccttttgtcaaagttggagaggctaaacgggcttttgaaagtagcttacgttattttatttctcaaggtgcactcaaaaatggcgctcccactcaagggctatttaatcatgatgctcgtttagttgataattacagtggtccagcaagctctttttggtcattacgggctgtcattatcgctctttattgtgctgatcgtattaatttatggcaagcaccatcacttcctttacctatcgaaaaaaatgactttcgtttcgaaatacccgctatccaagcatcaattatcggggtgaaagcaacacaagaagtcagtgttatttttcgagaggattatacacaacaacaatcacctttaactcgccgtttagaaaaacaaacgcgagtacaaaaaattacagaaactgtaattggacaatcaagacgccctaaaaacaacctattacgcaaaggagtcaccagttacagttctaaaatgacacatttcttctga

SEQ ID NO: 2971 - DNA, 186 bp, Proteus mirabilis
ttaatcgaaataggcagattttggggaatatcggcaaaagtcaaggctgtaaatcagaacagtgatctcacttttgcggagttatcccacaaagctgtggataacctagtgcaaaagcctgtttatgatctaaggataaccctgaacaacttatatcatttattattaaaacctcgattcacataa

SEQ ID NO: 2972 - DNA, 1068 bp, Proteus mirabilis
aacggagaaatctggtttgcgatacgtttggggctttcttttatctactatctgataattttccatgctgctatgcaccctctaaaacctcatctaacgtattttgaccaaataaaaaagctagaaaaacgaggaatgagttttgaggatctacctcctgagcaggcggtaaagaaaataatgaatattggatattacaggctatctgggtattggtatccattccgtaagttaaagttaatcccaccagtagcacccgatgaagccagacgtgaagaaacattccttgagggtacaacctttacaacggtatacgcacactatttatttgatgtaaaactaagaagttctattttttatggaatagaacgaattgaaacttatcttaaagcaaaaatagcttacgaactaggtaaagtatcccctacggcatacaaagataagaatatcatccaatacagacatcactaccgacatgatacatggctagaaaagttagattctttaatagagcgaaatagtgataaagattgtatacgatggaatttagataagtatggggatattcctatatgggctatcgttgatatttgggatttcggtacaatgtctcgcttctacggaatgcttgaagataaatacaaacatcaaatttgtaaatcgcttggctttctaaagcctaactcagcaaatgtaagagatggactgaaaacagcattagagcaccttaatacagttagaaacaggtgtgcccaccatgcgcgtttatggaataccgatttttcagactcaaaaattagcatcgatgtgttagataatattgatttaacagcctcgcgcttgtctccaaaaagccctgaactatcaagaatggcaggtatcatatttttaatatggagtctgaccaagagaataagttgtaattctacatggctaagttcagtaaatgatcatttagaaaaacatcagggcgttattccgtttaattcaatgggattcgataataacaatatctcaggattaaaaaatctattggataaggaaaaagaacaatcagcccaatcataa

SEQ ID NO: 2973 - DNA, 3036 bp, Proteus mirabilis
gaaaaaaccttttcaagaaagcaagttatcccatattacgccataatagaggtaatcgctttttatttggagatattgaccatggcaaaaactacgctactcgcactacaagggctttcatgctcccactgtgttaacagtgtaaaaaaatcacttgatgcccgcaatgatatagaacagtccacggtgactattcaatacgctaaaattgacagcgacgcaactgttgaaagcttaatcaaaaccattgaagaagccggatatgaagctcatctagccactcaagctgatgtaaaactaaatttgagtggacttaactgtatgaaatgcgttggtaaaacagaaaacgcgttgttagccgttgacggtgttgttgcggtcaatgtagacaaaacatcggctgaaatttttggtacagcaaacgcaaaagatttaattgccgccgttgttgctgaaggttttgaagcctcattagcaaacgaagaagaaaataaaccaaaaacgattgaactgactttatcaggcttaaattgtggtcattgtattaattcagtgaagaaagctcttgaagggactgatggggtagaaagtgcacaagtggaattaactcatgccacagtaacaggtacggcaaacacagagagtgtgatcacagccattcaaaatgctggttatgatgcaaaattagcaggagccaaccacccaaaaactgagccgctgacgcaaacggatgcaccactggaagcatcgtcagcggcgatttgtgatattccagtagaagaagccatccttgataataataatgctgatatcagtatcgatgatgatagcactcagctattaatcgacggtatgacttgtgcaagctgtgttagcaaagtacaaaaagccttacaaagtgtttccggtgttgaaaatgcacgtgttaatttggctgaacgtagcgcacttgtaacgggtcatgttaatcatgatgacctgattaatgcggtcgaaaaagcaggctatggggcagaaattattcaagatgatgtaaaacgtagagagcgtcaacaagaagtcgctgttgctaatatgaagcgttttcgctggcaagcagccttagccttagtcgttggtattcctgtaatggtatggggaatgatcggcgataatatgatgttaacggaagctaatcataatatctggttaactatcggtattattacacttgttgtgatgatagctgcaggtgggcacttttatcgtaatgcgtggcaaagcctaaaaaacggcagtgccaccatggacacgctcgttgcgttaggtacaggggcggcttggctctattcaattagtgttaacttatggccagaggtgtttcctgcccaagcaagacatctctattacgaggccagtgcgatgatcattggtttgataaaccttggtcatatgcttgaacaaagagcccgtcagcgctcctctaaagcattagagcgtctattagacttaacaccaccaacagcaagagtagtaacggataatggcgaagttgaatgcccattagcggatgtgaaacaaggtatgatcttgcgtttagcaaccggtgataaagttcccgttgatggtgaaatcacccaaggtgaagtgtggatggatgaggcaatgttaactggtgagccaattccacaacaaaaaagccttggtgatactattcatgcaggtactaccgtgcaagatggctcagtgctgtttaaagctgcagcagtaggcagtcaaactacccttgcccgaattatcaaactggtacgtcaagcacaaagcagtaaacccgaaataggtcaattagcagataaaatttccagtgtatttgttcctatcgtcgtcgttattgcgttaattgcaggggctatttggtacttttttggtccttcaccacaaattacttatgcactcgtcattatcacaacggtattaattatcgcttgtccttgtgctctaggattagcgacccccatgtcgattatttcaggtgtgggacgtgccgcagaatatggcgtattagtgcgtgatgcggatgcattacaacaagcaagccaattagataccttagtttttgataaaacaggtaccttaactgaaggcatgccacaagtaactgagatccacacattcaatcagataagtgaaactcaagcgctagcattagcaggcgcactagaaagtggctctaatcatccattagcaaaagcgattttaaccaaagctgaaggtattaaattaccgcaaataagccaatttagaactcttgcaggtatggggttaagtggtgaaattgacggcaatattgtgctgttaggtaatcctaaactaatgaaagaatctggcattgatataagtgagataaacgccttaatagaaaaccaatcagcgaaaggggtaacccctgtcttattggcgcaaaatgggaaaatagcggccctactttctattcgtgacccactgcgagaagataccgttagtgcattacagcgtctacatcatcaaggttatcgtttggtcatgttaactggagataaccctattacggctaatgcgatagctaaagaagcgggtattgatcaagtgattgcaggcgttatgccagaaggtaaagcgcaagcgattagtcaactacaggcagaaggtcgtcgcgtagcaatgattggagatggtattaacgatgccccagcactggctaaagcagacgttggtattgcgatgggtggtggcagtgatatcgccattgaaaccgcggccattaccttaatgcgccatagcttacatggtgttgctgatgcggttgagatctcaaaaggcacactgcgcaatatgaaacaaaacttgtttggtgcatttatatataacagtttaggcattcctattgctgccggtatcttatatccttttaccggtacattattaaaccctgtggttgcgggggctgccatggccttatcatcaatcactgtcgtcagtaatgccaaccgattattacgttttaaaccgaaaaaatag

SEQ ID NO: 2974 - DNA, 774 bp, Proteus mirabilis
ggaatattgatgctgaaaatattagtgagtaatgacgatggtgttatggcaaaagggatacagacactcgcaaaagccttacgccagcgttatgatgtacaaattgtcgcaccggatcgcaatcgtagtgcagcatccaattcattaactattgatagaccgttacgtaaacaacgacatgaaaatggtgatattgcgatagttgaaggtacccccacggattgtgtctatctcggtgttaatcatctcgtcagaccgcgtccagatattgtggtgtctggcattaatcatggccctaatttaggggatgatgtgctttactcaggtacggttgctgccgctactgagggccggttcttaggtttacctgcgattgcggtatcacttgatggcgaaacgcattttgacaccgcagcccaagtgacttgtgatgttttagctatgctacaacgagtacctttaagagctgggaatattttaaatattaatgtgcctgatattccgttagcggagattaaaggttttcgtataacacgttgtggaagtcgtcatgcttcacaacatgtttatacacaaacagatccaaaaggaaataccctttattggatcgggcctcctggcgaaaaaaatgatgtggggccggatacagattttgcagcggttgatgcaggttatgtttccatcacaccattacatgttgattcaacagcgtataaagcgcttgagttattaaaagattggttaaataaagcagaggtcgaaaaaacatgttaa

SEQ ID NO: 2975 - DNA, 999 bp, Proteus mirabilis
gagcagctgatgagccaaagtacgctaagagtagacgagttatatactgatgatattgatgagaacatggaagagttcgatgaagcagccgcaacaaaagaggctgaaaatgaatctgacgctcaagatgaaattgaactcattgaaggagtcaatcagcgtgcgttagatgcaactcagctctatttaggagaaattggctattctccattgttgagtgctgaagaagaagtattctttgctcgtagagcgttacgaggtgatatcccgtcaagacaacggatgatagagagtaatctacgtttagttgttaaaatatctcgccgttatacgaaccgagggttagctcttcttgacttaattgaagaaggtaatttaggccttattcgtgctgttgaaaagtttgatcctgaaaaaggatttcgtttttcaacctatgccacatggtggatacgtcaaactattgaacgtgccattatgaaccaaacccgcactattcgcctccccattcatatcgttaaagaactcaatgtctatttaagaaccgcaagagaattagcacataagctcgatcatgagccaagtgttgaagaaattgcgcaaacgctggataaaccggtcgatgatgtcagcaaaatgctacgtttaaatgaacgtatttcttctgttgatacaccgattggtggggattcagataaagccttactagatattatttcagacgaaaatgaagaagggccagaagcaaccattcaaaataataacctcaaggaaaatatcgtaaaatggttatttgaattaaatccaaaacagcgcgaagtattagcgcgtcgctttggattactgggttacgaggctgaaacattagaagatgttggtcgagaaattggtttgacaagagagcgggttcgtcagatccaagttgagggattacgtcgtttaaaagatattctgcaagggcaaggattatgcatagaggcactttttaagatgaactag

SEQ ID NO: 2976 - DNA, 279 bp, Proteus mirabilis
acatggctgattgagatcaatggtacagaccatttgaccttcagaagcctcgttcagcgttgttcgataacgggaaggaactgttattcgccctttgctgtcgagattaacgagtgttgcaccacgaaacatcctcatttccctcagcgttataatttacaccacattatcccacaaatccccacaaatagagtttacggatggtatgaaaacgttgtcaagccagttgtaggacgctttattgatatttacagtaattttataatctcatcgaaatga

SEQ ID NO: 2977 - DNA, 828 bp, Proteus mirabilis
ataattatgatcacttggttacttcttgctttatctttattgttattagggttccatcgcaaacttgcacttactactttagctataaccaccattagcgcatttataacaggtgttatcacttggtatgtacttccggttatattgagcttgattttactctcttgtgcatatcgccattacaaaaccaatcgtcttattgctactattgttattcttgcatttatcgccattattgttgggttaacttttcattttattcctggttttaataacttacgctacattaaacatgttccattagggcaatatagcccccctttctctttttatttcaatgccgataaagcattaatcccttttattttaatgatttttattcctacattatttaaaacggaaccagtaaaaaaagccaataaatatcaatgggttttactggctatggcgatccccgcactgttattattcgcaatggcattgggtggactcgctattgaattacatttgccacaatggctacccgcctttatgttagcaaatattttctttgtctctcttgctgaagaagcactatttagaggagccatacagcaaagtctatctcgctatttatctccctatctcgcgctatttattaccgctattttatttggtttagtccattttgccggaggaatattactcattatcttcgcctcattggcaggtattatttatggcttagcgtggatgtggagcggtaggctttgggttgctacactctttcattttgcactgaatctcactcacctgctctttttcacttacccttttaaaatcgcgtaa

SEQ ID NO: 2978 - DNA, 1428 bp, Proteus mirabilis
atgaacgtgatcccgttccccatccatttcaaccagttcaacatcaaaatcagcacaaacactggcaaagtagcctcgcaatttttcaattgcatcctgatcaaatatttttcgcctgtattttgtgataaagaccaaatggatgtgcatcaggaatacacaatgtctgccacggcgaatattagtttcatttttcatagaccaaagtataatggtaatatgaaacgtctacaagcctttacattccagttaagacccaatggtcagcaagagcgtgagatgagacgctttgcagggtcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaaacgtaccgcttttcctcgattcaagaaacgcggtaaaaatgacgcttttcgctatccgcagggcgtgaagctcgatcaatccaatagtcgtatatcattgccaaagttgggatggatgcgctacagcaacagtcgtgaagtcgtcggagaagtgagaaatgtcacggtcagtcagtcatgcggtaaatggtacgtcagcattcagactgagtatgaagcgacagaaccacaacctgaatcaacctcaatagtcgggcttgatgcaggcgttacaaaacttgccacgctttcagacggtacggtatacccgcccgtcagcagttttaaagtaaaccagcgaaagctggcaaggcttcaacggaaattaagccgtaaaatcaaattcagtgccaactggcaaaaacaaaagcgcaaaattcaacgtctgcattctcatattgccaatatcaggaaagactcccttcacaaagtcaccagcgaaatcagcaaaaaccacgcaatgattgtcattgaggacttaaaggtcagtaacatgtctaaatcggcaaaaggtacgacagaacggcatggacggaacgtaaaagctaaatctggtttaaaccgctcaatactggagcagggctggtatgaaatgcgccgtcagcttgagtacaagcagctctggcgaggtggtcaggtactggcaataccaccagcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcctgtgaagggagggtgcagtcagaccgcccgtcgaagcaggaactcgccgaggtgattcagacatcagtctga

SEQ ID NO: 2979 - DNA, 1518 bp, Proteus mirabilis
aatttgacgatactccccctacactggagattaaaaatgattaaattaaataatgttccatccgaatttcgtcccttagaaagctataaaatgttaattggcggcgaatgggtatccagtacatcgcaacaaacgaccaaaacctatagtcccgcaaccggtgagttattaagtgaatatccatcaggtacagctgaagacgtcgatcttgctgtaaaagcggctcgtaaagcttttgatcattggcgtaaaacctctcctgctcaacgccaagcgctattattaaaaattgctgaccgtttagaacaagagcaagaacgttttgcttggattgagtctcttgataacggtaaaccactcaatgaatcgaaaaacatcgatttacccgcctctattgaccattttcgatattttgcaggcgtgatacgctctcataccgatgagagtgctgtcttagacgaaaataccctgagtcttgttattcgtgagcccattggtgtcgttggacaaattattccatggaattttccattattaatggctgcttggaaattagcccctgccatcgccgctggagataccgttgttattaatccagccacactcacctcactttcattattagagctaggtcgtattttaaatgaaatattaccagccggtgttataaatattgttactggtcgtggatctgttgctggacaagctattctagaacaccaagacattgataaactagcatttaccggttcaaccaatgtaggttataccgttgcagctgcggcggcgaaaaaaatggtaccagccactttagaattggggggtaagtcagccaatatcgtcttccctgatgcgaatatgaaaaaagccgttaaatattccgcattagcgatattaatgaaccaaggacaggcctgtgaatctggctcccgtttattcttacatagagatattcatgacgcattcttaaaagagttaaaagcagaatttgagcgtatccgtgttggtgatccacttgatcctaatacacaaatgggtactcaagtcagccaagcgcaaatggataccattttaggatatgttgagctggccaaaaaagaaggtgcaaccatactcacaggaggtgagcgtattacgggtgaagggtttgatgatggcttttttgttcgcccaaccattattatcaatgccacaaatcaaatgcgtgtcgcacgtgaagaaatttttggccctgtattatgtgtgatcccatttgataatgaagaagatgttattgaaatggctaatgactctgaatatggccttggtggtggtgtctggactcaagatattaaccgcgcactacgagttgcaaaagccgttagaactggccgtatgtgggtaaatacttatcatgaacttcctgctcatgcaccatttggcggttataaaaaatcaggcttaggtcgtgaaacgcataaaatgatgttagatgcctacagccaagtgaaaaacatcttcattagtaccaaagaataa

SEQ ID NO: 2980 - DNA, 870 bp, Proteus mirabilis
gcatgccagatgaacatgaaaattaaaaaaatattaaataacagtgttgtgatctctctggatgaagcagaaaaagaaattatcgtcatgggaaaagggattgcctacgccaaaaaagtaggtgatgagataacatctgaacaaataaccaaaaaatttatcttaagtcctaaaaattgtccgcagagagtgctcgatcttttatcgaatattacgttagattacgtagaaattgcggacaatattattcagtatgcaaaagaaaaaatgaccttagatacacaagatagtatctatattgcattgattgaccatattcaagccagcattgaacggtataaagaagggacttttataagaaataaaatattgtgggagataaaaaatttttatagtgaagagtttgatattggtctttatggcttaaaattaattaatgatagatttaacatttcaatgccagaagatgaagcaggatttattgcattacatatcgccagtattagaacaaacgataatattcagcaaacctacaaagtgacccactttatccaaagcattactaatatagtcaaatattatttaaatatagagtacgacataggatcgttaaattatcgtcgttttgtgacacaccttcgctatttctccatccgattattttcacaacctgaaaatgatcacgaacctttagaaaatgagttactcgatataataaaagacaagtaccatcaaccttatatgtgctgtttgaaaataagtaaatttattaaagataaatataattgcaccttagatgacaatgaaattttatatctaataatccatattgcaaaaattgcagaggataataaaaagatgaataaataa

SEQ ID NO: 2981 - DNA, 1044 bp, Proteus mirabilis
cgaggagagatcgagcagatgaatgaagaattaatcatgaaatactcaattggtatcggcatagctttggcgtgttttatcgcctttcttgccatatcttttttacatgataaacaaaaaaaacgtcgtagaaacataattattcacatcatccaagctattttgctttgtagtttagtggctattgtaagccaatattgtgaaatggcggtggtagattttaaactacactttatctcttttcagatgattaatttctttagctatcttgctatcgcattaatcctgatgagaaaatttttcttactcattaatttattagaaaaatcacaaattaaaaaaggcagtgatcccacctcagcccgtattatttcgcgtatatttaaaatcactcttcttgtcatcatgatcttactgttcggtgagcattttggcatgagcttatcgggcttaatgacatttggtggcttaggcggtattgccattggtatggcaagtaaagacgttatgagtaaccttttttcaggtgttatgctctattttgatcgcccttttaacattggtgattgggtacgttcacccgatcgcaatatcgaaggaactgttgttgagattggctggcgtatcacgaagataatgacctttgatcatcgcccgttatatattccaaactcagtattttcctccattagtgttgaaaaccccggcagaatgaccaatcgacgtattgaaacagaattagggttacgctatgaagattcggacaaagttggggttattgtcgaagatatccgcacaatgctacaacaaaacgacaaaatcgacaccaaacagactttattggtctattttaatcaattcgccgattcatcattaaatattatggtgtactgttttaccaaaaccacagtatgggcagaatggttagatgcgcagcaagaagtttatttaaaaatgattgatattgtgcatcaacatggcgctgacttcgccttcccatcacaaactgtatatattgaaaaatcatcgcctgtatcaccataa

SEQ ID NO: 2982 - DNA, 1305 bp, Proteus mirabilis
acattcaggatactgcacccgttctatggagtcaggatgccagtcacgcaacaaaattttggtcctatctatcagtggagcatactgatactgctaggtttagtgtactttctcgctaccgcaacaacatttacctctttaggtgtggttctacctagtatgatagctgaactagagtggaactggacacaagctggccttggttttactttattgggcttaacctgtggacttgcgagctttttacccactttacttatccgtaaattaaacgtccgcttcacactcctcattggactgattatttttgtcagtggattctattttctatatgaaaccaataccatcacacgctactttcttggtaccgccttacttggggtaggttttacgctattagcaaccgtaccgagcacttacgtgctatcgcgtctatttgaaaaacagtcttttgcttttggtgtctattttactattggtggattgggaggagttgcaggcccttggatctattttttagccacacacctttggcacacatggcgtatgcattggctcatttcagctattattctatcaattattaccctgctgactattttagtattacgagaaggctcagcagaaaaagcgcatgcgaaaaaaatcagtcaattacaaagtagcaaacgtatttatcaaaccaaagcgatatggaccgcacgtcatgctttacgaacatggcaattttatgtcattgctgccacttacaccgcttttctatggtgcgggatcacagtaaatagttttgcagttgcacatattattgaaaatggttttagtgaaactattgctgcaacgctactgagcaccatggcttttatcaatgcattctcacgattagccggtggggcgattggtgaatggttagagcctaaaaaattactgattgccagcttaacgattattattatcggtctattagcactgagtatggctaatagttggatctacctaatgctatttaccctttgtgtggggatcggttatggtatgaccttcttagcctcaagtgtattactggctaactattttggtcgcgcaccttatttagaactattttcggtgatgaacctgatctcaacattggcctgtttagcccccttctttgctggggctattaaggatatttcaggcagcttcacacctgcatttttaattctcactatccctgttttagttattttggtgatcacactatttatgcgcccaccaatttatcctaacttccaacatgccagtgaaaaacataatgcgccaagataa

SEQ ID NO: 2983 - DNA, 840 bp, Proteus mirabilis
cagaggtacttcttcatgatctatgctgatttacatgttcacacaaaccatagtgatggtgtttgtgaaataaaagatgtccttgaaaatgcatttagaaacggcattaagactattgcgatcaccgatcacgatactaccaatcattatgacgaaatttaccgagaaggggagcgtcttggattaaatatcgtcaaaggtgttgaaatgagttgttatgactttgacgtttataaaaaagtccatgtagtgggactttggcttaacgaaaaaacgcccaacgttgacaagctgtgtgataacactcttaactgtcgtgatcagtttcaccgagaattaatattatctctcaatcaacaaggctacgatatttgttatgaagatgcgaaaaagttctcaaaatataatatcgtttttaaaatgaatatattccaagcattgagagaaaaatatccagaggaaatgaccaaagagcgttataaacaactttttggctctaaaacaaaaatagaaacagacttaaaaatggggtatatccctgttgatgaaggaattgctgctatcttacaagacggtggtattcctatacttgctcacccatgtgtctatgacaactatgatgaaatagaaaaatatgtccagtttggattgaaaggattagaaataagtcattctagaatgaaacctatcgactatgaactgacccaaaactatgctaataaatttggtttgctaaaaagtggcggtagtgacttccatgatcctgcgttacttaaatttggcgattttggcctaaatcaaacacaatttgagaccttaaaaaaggacgcaaataaataa

SEQ ID NO: 2984 - DNA, 642 bp, Proteus mirabilis
tattcgcacttttgcaacagtatcataacggagaacctaatgaataaattcacacaacacactggaattccagtacctttagatgctgccaacgtggatactgatgcgattattcccaaacaatttttacaaaaagtcactcgcacaggatttggtaaacacttatttcatgattggcgatttttagatgatgaaggcacccagcctaacccatcatttattttaaatcagcccatctatcaagatgcttctattttattggcgcgcgagaattttggttgtggatcttctcgcgaacatgcgccttgggcgctcacagattatggctttcatgcggtgatcgcgccgagttttgctgatattttttacggcaattcctttaataaccagttattgccaatcaaattaagtgatgagcaagttacccagttatttgattgggtaacagagcatgctggtacgcctattaccgttgatttagttgcccaacaagtgatcgctggtgaattatgcttctcatttgaaatcgatgcatttcgccgtcattgcatgattgagggattagacagtatcggattaacgttacaacaccaagcagagataagtgcttatgaagctaaacaaccagcttttatgcgttaa

SEQ ID NO: 2985 - DNA, 687 bp, Proteus mirabilis
tatttttttgtaaaaaaaatgaataatgaagaaaaaaatcgtcgtcctataaaagcaagacaaaccaactgggcaactcgctgtagtcgctggctgcaaagcaaaggcgccacccccaatgggatctctttatttagtatcctattcgctgctatctccggtttgtttctctactttgctctcgctcactcccaaggcctacttcaatcaatccttcttattttaggtgcattagctatccagggtagacttatctgtaacctactcgatggtatggtcgcagttgaaggcggattaaaaagtcctgctggtgccgtttataacgaactaccagaccgaatagctgatacattgattattattggtgtaggttatggtttatccatcacttttcctatcgctattaccttaggctgggtagccgctttctttgcggtaatgacagcttatatccgtgtattaggtggtagttgtgggttagaacagcgttttacggggccaatggccaagcaacatagaatggcattattaaccggtattgccattatctctgcatttattcccgctgaatggggagcatggctctgtttagtctccctgtggatcattatcttcggctcagtacttactaccattttgagaactcgccaaattttacgcgatttaacacaaggagttgatgaatga

SEQ ID NO: 2986 - DNA, 861 bp, Proteus mirabilis
tcacgttttgtaataacacggtcgtcagggggcaatatgcaaattcaagcacttcaaaccagtcagcatatctttgcttttgaaggtgagtttaaatgtgtcggcatttatgaacatgctttgaattttatttgccctcagcaacgcttaatcacttttcatcggcaaggaagaggattaagcccgatggggtggctactgaaacaagccgattttgattctctggctaagcagtgtcatcccgctttgaaaatgcggatgaaaaacaatcaaatcgcaatcgcagataatatgacattgattgccggtgatagtgaaaatttgcgtttacaagataaagcgacattagatttacgatggttagagagttttttttctctattatctccggtgatagcgacaggactctatgggccattaaaaaactatcgtcaaatcgcccgacttgatgaaattaagttattaacaaagttattttatcatcaattgtctggaaaagcggttaattgggcgatgtttattggtaaaggtccagggttaacaccgagttcagatgatatgctggtgggaatgttatttgcgcattatttagcagagccagaaaaatcgattgaacatttttttaatgaaacaccaccattatcgtcattaactacgatagtgagtcaacattatttggaatacgccacacggggaatattttctacctatcttattcaactaggtaaaaaaataaaaaataaagagattatttttaaagatatgttggaaatactctctatcggtcatcattccggtgcagatactttactgggattatggattggttatcaaattaaacaacaacagcgtatagattaa

SEQ ID NO: 2987 - DNA, 735 bp, Proteus mirabilis
tattgctttgttatttatcctctaaaaaggaataattttatgaaaaaagtattacttagccttactatgctggcgataatatctacgccagtgttggctaaatcccctgtagctaacttaaaaatcaacggtgatattaagccgccaacttgtactattaatggggcgacacaaagtgatgtcctttttgattatggaagaataagcccatcacttatccctcaatcgaaaatttactcttactctggcattgtagctcataatgtcgttacggttgaatgcgatgcaaaaacatatttaacatttgttgcgtctgatacttatggtgacacggaattaagtgttaataatacgtcagaatggtttcatttagttgataaagcaaatcctgaaaatacagttggagcggctgatttcatatggagtgatgctacggtcgatggtaaaccagcatttatttcacgggcaaacgatgttgcaattacaggaaaaagctacaacaacgtcctatacaaagggccaactaatggttggacatcagaacaacaatcaggtgttgataaaaatgccttggctctaattccaggtgaagttttccaatcaaatttcaggcatggtaattcaaatggtacctttattttatctaaagatgaattaagtaaaaaaggaatagatttatctaatggtttagattttatcggggaggctgttctcacttttaactttggtgtctaa

SEQ ID NO: 2988 - DNA, 633 bp, Proteus mirabilis
ctgatgaacttcaagaaccttttccgtcgacatacttgtttccttatcgtcatgatgatgtttagctttaagtctatcgctgctgatacctttttgatctttggtgacagcctaagtgccggatatcgccttcctattgaaagcgcatgggcgcaacgcctcgcggataagtggaaattaacttatcctgaaataaatgtcgtaaatgcaagcatcagtggcgaaaccgcatttcaaggtcaaaataggctccctgatttattaaaacagcaccaacctcgttgggttttgattgaactgggtgcaaatgatggcttacaaggctaccctgtagcccaaacgaaagaagcgttgcaaaacatcattacccaagtaaaagaagcgggagcaacgccactctttatgcaaattatgatttcgcctaattatggtaaacgctatacgcaatctttttctgcgatttacccacaattggcgaaagacaatgctcttgagcttatcccattttatatggagcaaatagcagataaacctgagtggatgcaaaacgacagcattcacccaaatgaagcggctcagccttttattgctcaatggatggataaaaccctatccccttacctaacacgttaa

SEQ ID NO: 2989 - DNA, 981 bp, Proteus mirabilis
tgggaaactgtgaaaataaatagaactgtcgccattattggcgaatgtatgatagagctaagtggccaaccttttttgccacaacaacagcgttttgggggcgatacattaaatacagcactgtatttagcgcgcctcattcctacattacatccgcaatatataacaggtttaggcactgataattacagtgccttaatgcaaaaagcatgggaaaaagaggggatcaactgccagtcagtgatcaccattcccgaaaaacttcccggtttatatgccattgaaattgatacttgtggtgagcgtagcttccattattggcgtagtgatgccgctgcacgttatattgcaacggacaaccgttttgcaacacatctagataccttgcccgacgatagtgttatctaccttagtggtatttcactggccattttaacgccgaaaggaaaagaagcgttaatcacgcaattaatccgccttaaacagcgagggagcaccttaattgtcgattcaaactatcggcctcgtttatgggatctaatacctcatgcgcaagagtggttcgaaaaactatatcgactcagtgatatcgctttagtcaccggagatgatgaacaagctctctggcaacaacccagccttactgagcaaaaaattgtcgaacgccttcatcaatggggcaataaaaacgtcattgttaaactaggagcaaaaggggctttctggtctgatggtgaaaatactggttatatctgccccaaaccgatacagcatgtcatagacactacggcagccggggattcttttaatgctggttttattgctgcatggctacaaaactaccctttgcctacatgttgtttatggggaaatacattagcaggattagttatccaacatcatggcgccattattccccataacatcactgattcattctattcactcatcaaggataaccatgagacagtcaattgttga

SEQ ID NO: 2990 - DNA, 471 bp, Proteus mirabilis; identical to SEQ ID NO: 1406

SEQ ID NO: 2991 - DNA, 1089 bp, Proteus mirabilis
agcggtggtgttattaatcaaagagtctttatcttaatgagtgatttaccagaacttcattggctacatggcaaaccgacagcgacagggcgattaaaatcgacaccagaagattttaaggtcagcgaagatctcggctttaccttagatggtgaaggcgaacacgtgatggttagagtcagaaaaacaggttgtaatacggcttttgtggctgaaaagttagctaaatttgccggtattcatcctcgagatgctagttatgctgggctcaaagacagaaatgcggttacggaacaatggttttgtttgcgtatgccgggtaaagagatgcccgactttagtcaatttacgttagaaggttgcgaaatattaacaaccacccgccagcaacgtaagctacgaattggtacattaaaagggaaccatttcaccttagtattacgtgatatctccgatgtgacatcggtggaaactcgtctagtagagatacaaaaacaaggggttcctaactattttggtgtgcaacgctttggtcgtaatggcgacaatttacgccaagcatggcgttgggcaaccaatgaaattcgggtaaaagagcgtagcaaacgtagcttttatctctctgctgcacgtagtgcgatgtttaatcatctggtgagccaacgacttgagcgtcatatttatactcaagtgctttgtggtgatgcgatgcaattgcacggtaaaagaagttggtttgtggcagaagaagcggaacttgcccaaacacaaacacgctatgaagagcatgatatacatattaccgctccattgccgggtaaaggtgacttaggtacacaagctcaagcactgatatttgaaaccgacaacttagctgactacgaagcattatggtcattagcacaacaagagcgagttgataccactcgccgtgcgattaatttgctaccagaaaatatgtcatggcattggctagatgatactacggtttctttatcgttctttttgccagcaggaagttttgccactagcgttgtccgtgaattgatattattagggaatattgatgctgaaaatattagtgagtaa

SEQ ID NO: 2992 - DNA, 510 bp, Proteus mirabilis
aaagagggtgttatgtggaaatcactaacgttatttttattattttcatattctcctatcgcattaagcaacactgttaatattaatgtatatggatcagtagtagcctcaccttgtgagttagaaacgaaaaaccacttaattgatttaaaaaaaatcaatattagaaatattaaaaatggtcaagcatcagactggatagatttttctataaaattaaaaaattgcccagttaatacagagaaagtcactatgattttaagaggccaaagtgttcctaattattcggaatattttattaatagtgggacggctaaagatatagcactaaatttagcaatgcaaaataataaaggtattgtaaaaaataatgataaattaatgacggctgttaataaatataaccataatgctgaatttgctttatcggcaagaatggttggctatggaaataatataacggtgggatcatttaagagccatcttgaatttactcttatttataattaa

SEQ ID NO: 2993 - DNA, 234 bp, Proteus mirabilis
tgcttgtacgtgattacattctgtcattcgctggtcgcttacctgttaaggaggtggctcatgcgtaatccccaacctaacgatttctacacgcataaaaataatagcgaaaccgtcaaagttctatcggttcaattcaaccgtgtgacatttcagcgagacggctttgatagtcctgtcattgttccattaagccagttcagcaacgaatacacctatgcagggagggcttaa

SEQ ID NO: 2994 - DNA, 1668 bp, Proteus mirabilis
accatgagcttatcgtttaaattatctgcatgcgcactgacagtgactttagcaatggcgcctgtgatgtctcaggcatgggaaaaagataaaacttaccaaattaccatcctacatactaatgatcaccacggtcacttttggcacaatgatcatggtgagtacggtttagctgctcaaaaaaccgtcgttgacaatattcgcgatgaagtcgctaaaaatggcggtagcgtattgcttctgtctggtggtgatattaatacgggggttcctgaatctgatttacaagatgcagagcctgattttaaagggatgaatcttgtcggttatgacgctatggcgctgggtaatcatgagtttgataatccactcgaagtgctacgccaacaagaaaaatgggctactttccctttcctttctgcgaatatttatcaaaaaagtaccggtgaacgtttatttaaaccttatactatttttgataaacaaggagtgaaaatcgcggtattaggtttaactaccgatgatactgtgcgtattggtaatcctgctaacttccctgatactgagttccgtaaaccggcagatgaagcgaaaaaagtcgttgaagaattacgtaccacagaaaaacccgatattattatcgctgctacccatatggggcattatgacgatggtaatcatggctctaatgcaccgggtgatgttgaaatggcgcgtgctttgccgaaaggctatttagatatgattgttggtggacactcacaagatccggtgtgtatgtctcaagagaataaaaattacaaacaagcagattatgttcccggcacgccttgcgctccagataatcaaaatggcacatggattgttcaagcccatgaatggggtaaatatgtaggtcgcgctgattttgagttccgtaatggtgagttcacattaaaacactatcagttaattccaattaacttaaataagaaagtgaaaaaagaagacggaaccactgagcgagtttactacacagaggagatccctcataaccctgaaatgatgaaattactgaccccttatcaagagaaaggtggtgagcaattgaatgtgaaagtgggggaagttgttggtaaattagaaggcgatcgtagcaaagttcgttttgaacaaacgaatatggcgcgtttactgttatctgctcaggcggagcgtgcaaatgctgattttgccattatgagtggtggtggtgtacgtgattcgattgaatctggcgatattacttataaagatgtattaaaagtacaaccctttgctaacgaactcgtctatgttgatttcaaaggtgaagaagttgaaccttacctatccgcagttgcttgcatgaaagtagactcaggcgcttatgcacaattttacaatgtaagtttaaccgtagatgcagattgtaaagtgagtgatgtaaaaattgcgggcaaaccattagataaaactaaaaattatcgtatggcgacattaaactttaacggtattggtggtgatggttatcctaagattgattcacacccaggatatgtcaataccggttttgttgatgcagaagtgttaaaaggttatatcgaaaaacactcaccactaaaagcggctgattttgaaccgcaaggcgagattgtgtataaaaaatag

SEQ ID NO: 2995 - DNA, 681 bp, Proteus mirabilis
actcaatcagttgatccgccgccattttccgcattggggcgcaagagacttactgggaggaaaatagtgacgatacatcaagatattgtctggcatcctcatcaaatagggttaaaagagcgtgaagcacaacaggtacacaaaggatgtgtactttggtttactgggttatctgggtcaggtaaatcaacactggctgatgcgctagagcaaaccttatatcagtactcgacactccatgcgcctatccgcacctatttattagatggtgataatctacgccatggtttatgccatgatcttgggtttagtgaacaagataggcatgaaaatattcgccgtgtaggggaagtggctaaattaatggttgatgccggattaattgtcttaacagcatttatttctccttatcagcaagatagacaacaagtaagagaaaggtttgctcaagggcgatttattgagatctttgttgatacacctttagccctttgtgaagcacgtgatcctaaaggcctctatcaaaaagcgcgacgaggagagatcaaacagttttccggcattgattcaccttatgaaccccccactgcgccagaaattcatttagacggctcactcgcgattaatgagcttacacaacaaatcctcgcttatttacagcaacaacaaatttaccgctaa

SEQ ID NO: 2996 - DNA, 270 bp, Proteus mirabilis
atgaccccagtattagctggcgccggacgcattgtaagcgtaacttttttacccgtgtggagccccacaccagttgcttgtacaattcgttttaatgtccgttgtttgatcatcattttatctcgcaatattatccgtcctaccaattattatacttataattggcaggacagtttagcacaaaaagcggagatgccaatctttttgacgattaatcagcctgttttcttaagaaagcagggatatctaaataatctggctctttgttag

SEQ ID NO: 2997 - DNA, 1929 bp, Proteus mirabilis
agcaaaccagtctttaagtcgtgctctgatcgtgcgataccctcttattcattaaaaaagtccaaccacaataacagcaccgatgcagtgcaatgtttttttaaggcaggatcgatgagcaatcaacccccattattatcaatgcttccattaacacaggagcaattgaataaattacaggatgtgacgaaagacttaactccagcccaatttgcttggctttctggctatttttgggggcaattcaatcagcattcatccactaaagatgaactggtaagtgtacaaagtcaggttccccaacaagaaaccatcaccgtgatatcagcatcacaaactggcaatgcacgtcgtttagctgaacaattacgcgataaattggttggtaatcaacttaatgttgagctctatagtgcgagtgaatataaatttaagcagatccacaaaacgacaaccttaattattattacctcaacacagggggaaggtgaacctcctgaagaagccatcgcattttataaatatttgcactctaaaaaagccgcgccaatgaagcaaacggcttatgctgtactgagtctcggcgatagtagctatgaacatttttgccaagcaggtaaagattttgatcatcaactggcgcaacttggcgcgaccagtctattagaaagattagatgcagatgttgattatcaagctgacgctgataaatggataactcagctgactgatattttaaaaatacgtgtacctgagcaaaacactcaagtattgcaacaaacacaatcaggaacaaccgacagtgtcgataccgcacgctaccatcgtgatgcaccttttagtgccactttattaactaatcagaagatcaccggtcgacattcagataaagatatccgtcatattgaaatcagtctagcaggctctgaattgcaatatcttcccggagatgcactaggagtatggtttaagaattcggaagaaaaagtggatgagcttattaccctattatggctaacgggggatgagcaggtaaatgttaaatcacaaacattaacgttaaaagaagcattattgcatcatgttgaattaactcaaaatagtgcaccaattattaaagcgtatgcccaattatcccgccacgaagagttattatcgctggtggctgataaaagcaaacttcagcaatatgcgcaaacctacccaattaatgaaatggtacgtcaatatagtgcgcaacctaatgctcaagagtttattgatatattgcgcccattaactccacgtctttactccatcgcttcatcacaacaagaagttgatgatgaagttcatcttaccttaggtgttgttcgttataacgtcgatcagcgtgcttatacaggaggtgcctcagggttcttagctgatcaacttcaagaaggcgatacagtaaacgtttttattgaacgtaatgatcattttcgtttacctgaagataatcaagtccctgtgattatgattggcccggggacggggattgcgccttttagagggtttatgcaacaacgtgaaagtgaaggtgcgacggggaaaaactggctcttttttggtaatcctcactttgtagaagatttcctttatcaagtggaatggcaacgttatgtcaaaagcgggttgttaacacgtattgatttagcatggtcgcgtgatcaagccgataaaatttatgtgcaagataaattacgggaacaaggtcaggaaatttggcaatggttacagcaaggtgcttatctctacgtttgtggtgatgcatcaagaatggctaaagatgttgaacaaacattgttagaaatagtaatgacccatggcaataaaaatattgagcaagcagatgattatttaagtgagctacgtttagcacgtcgttatcagagggatgtttattaa

SEQ ID NO: 2998 - DNA, 1710 bp, Proteus mirabilis
atatgtgcagttacatatattaaatgcgttaaggatattataatgatccatgcttttattaaaaaagggagctttcaggattccgtcagcctgatgataatttcccgaaaattaagtgaagcccctgaggtggaagaaatttccgtcatgatgggaacaccagcgaataaatctctccttgatgtcaccggtttttggcatgacatttttaacgaagcgacaccgaatgatatctgtgtttcgattaaagctgaatcagacgatcccgctattatcgagactatctccagtgcgttagaagaagccttagctgatattgctaacggtcaaaaaagtggtaataaattaaccactgtacgtagctggcgtacggctaaacaaaaaagtcctaacgctaatatgttgcttatttctattgccggtgagtatgcggcagaattagctgatacgggattagaagatggctgtaatgtgatgctattttccgataacgtctctattgctgatgaaaaagcattaaaagaaaaagccgccgctaacggattgatagtcatggggcctgactgtggtacggcaaatattgctggcgcacctttagcctttgctaacattgcaccgaaaggctctattggtatcgttggtgcatcagggacaggaattcaagagatcacctcacaaattgtattacaacgccaaggggtttctcatgcaataggtctggggggacgagatctcagcgagcaaattggtggcattagtgctatcacggctattaatatgctggcggcagatcctcaaacccgtgtgattgcttttgtttctaaacctcccgcgcctgcagtacgtgaaaaaatcattgcagaaatgaagcgtcataataaaccgatagtggcgcaattcttaggaacaacaccagagaaatatcaagacgataatatctattttactcgcaccttagacgaaacggcgcgtattgcggctacgttagcacgtgttgaagatagtgctgctcagttacctaaagtgacaggtaaaaagattattggattatatgcggggggaacattagcggcagaatgcgcgatgttgttatctgagcaactcaatgtggcggtagataacgaacataagcaaggtacgatgctcgatgcacaagggcataaaattattgatatgggcgatgatttttatacccaaggcaaaccccatccaatgatagatccttctactcgcaataaatttattagtgaattaagtaataagcatgatattggcgtattactggtcgactttgtgattggttatggtgcaacgtcagatccagcaggtgcattaattcaagaaattaaaaaactaaatgaaaaacgtggtgaagctaatccactgatcactatcgccactattaccggtacgcaggaagatcctcaaaaccgtagtgagcaacaaaaacagctacaagatgcaggtattattgtgatggataccttgccagaagtcgtactgttagccaaagaattaatccagccacatccagtagaagccgctgctgaaatttcaccacttttaaatgggatctccgtgatcaacgccggattacgcagttttgctgacgatctgcaatccagtggtacgcctgttgttcattatcaatgggcacctgtcgcaggtggtaataaaaaactggctgaaatattaaagaaattgaaataa

SEQ ID NO: 2999 - DNA, 378 bp, Proteus mirabilis
gtcaagagagttttgatgataaccaccatctttaaagattttcagtttgaagctgcgcaccacttaccccatgttcccaaaggccataaatgtggacgtttacatgggcattcatttttagtgagattagaaatcactggtgaagtagatgcgcagtcaggttggctaattgattttgctgatgtgaaagccgcatttaaaccgactcttgataggctcgaccactattatcttaatgacattgaaggtttagaaaatccaaccagcgaagtactggcaaaatggatttggcaacaagttaaaccatcactccccctgttatccgccgtgatggttaaagagacatgtaccgcaggatgtatttatcgtggtgagtaa

SEQ ID NO: 3000 - DNA, 333 bp, Proteus mirabilis
cctacattggttgaaccggtaaatgctagtttatcaatgtcttggtgttctagaatagcttgtccagcaacagatccacgaccagtaacaatatttataacaccggctggtaatatttcatttaaaatacgacctagctctaataatgaaagtgaggtgagtgtggctggattaataacaacggtatctccagcggcgatggcaggggctaatttccaagcagccattaataatggaaaattccatggaataatttgtccaacgacaccaatgggctcacgaataacaagactcagggtattttcgtctaagacagcactctcatcggtatga

SEQ ID NO: 3001 - DNA, 1110 bp, Proteus mirabilis
tggtggttggttagctcgataatcttatggagaactaggatggaacacgctaatacagaggctttacaaagagatctcgtgttacaaaatatgaaacgggtttatcgttatcaatcggctcatcaagttcgtagtgttcgtcgccgtagtggtaaaactcgttttattaaagatacagattgggaacgcggtgttttatggacctgtgtaagtgcggcatggcaagcgacacaagataaagagtaccttaatggtgtgttaaattacaccttacatactggatttagaacaggtcctaatgcacgttttgcggatgatcatgtttgcgctcaagcttatttggcgataagtcctttgtttgaacaatctgaaattcttgaaccgacgattaaagcgtttgatatcatgctaaatgatccaaaaccagggcgtgaagactggtggtggtgcgatgctctttttatggcacctcctggttttgctgctttggctgaaattattagcgaacgacgttatttggattatatgcataccgcttattgggatgctattgaacatttacgtgatgctgaaactggacttattttccgcgatcaccgctatattcctgatggtcagggaaatgaaatgcgtgaagctaatggtgaaaaagtattttggagtcgcggtattggttgggttttggcttctattcctcgcattcttcaatatatgcctgatgattatcatgagcgcgatcgttatataacactgtttaaacaattagcgcgttctatcctagattaccaacatgaagatggtttttggcgcaccagtttattagatcctgataatttccctgcacctgaaagttcagctacggcgcttttttgttatggacttgcatggggaataaatcagggtgaattaaataaagaagaatattttcccgcattacatagagcgtggtcagcattacaatcctgtattcatgataatggcatgattggttgggtacaacttccggcatttaatccgcgagaggtaaagtttgagcataatatggattatggcgctggagcatacttattagcgggtagtgaagtattaaaaatgacgttaaataattag

SEQ ID NO: 3002 - DNA, 1005 bp, Proteus mirabilis
tgcagagtggtgttgatacatcactctttatctatcatattgatttatatgttgcttgttaaaataagtaacagaggtaatggcatgaaaaattgtacgttaggtaatgagactgataattctttgatctcaaatgcatttggttttttacgttttccactgaattttcaaccttatagcagtgatgctgattgggtgatcactggggtgccttttgatatggcaacttcaggtcgtgcaggtactcgccatggacccggcgctattcgccagatttcgactaacttagcgtgggaaggacatcgctggccttggcacttcgatatgcgtgaacgcctcaaagttgttgattgtggtgatttagtatttaacttcggtgatgcgcaagatatgagtgataagctacaagctcatacggaaaaattgctagcagcaggtaaaagatgtttaacctttggtggtgatcactttgtgacattacctctattacgtgctcacgctaaacactttggcaaaatggctttggtgcattttgatgctcataccgatacttatgctaatggcagtaagtttgatcacggtacgatgttctatcatgctcctaatgaaggtttgattgatccacagcattcagtgcaaattggtattcgtaccgagcatgacactaataacggctttactgtcttggatgctgcacaagttaatgatcgtggggttgatgatttagtcgcgcaaattaaagagattgtgggttcacttcctgtttatttgacttttgatattgattgccttgatcccgcatttgcaccgggtacaggaacaccggttgtgggtggattaaccacggataaggcgctgaaaatgctgcgtgctctacagccgttaaatattgtaggcatggatttagttgaagtatcgccagcgtatgatcaatcagatattactgcccttgccggagcaaccattgcacttgatatgctatatctgcaagcggctaaaaaataa

SEQ ID NO: 3003 - DNA, 2310 bp, Proteus mirabilis
gatctatgggtaataataatgaaaaaatattttctactattcgccttacttatgctttccggtttagcttatagtgatgacgaaaaagaagtgccagcggttataacggaacaacctttcataacggttgaagaagagaaaatcactttaacatcaccggatcagataatcccatctcgccaagaaacacgactatttgcaacaacagcacctacttatggagctctaaaattacaaggcgctagccctgatggttatctagaatttggtgttcgtagtgatgaatatgtttcacaggcaatattagatctagagtttaccccctcgccttcattactgcctatagaatcacatcttaatatctatttaaatgatgagatcatgggcgtgatccccctgaaaaaagaagatctcggccataaaaaccacattacattaccgctcgatccacggtttattcaagattttaatcatttaaaatttacttttatcggccattaccgagaaatttgtgaaaaccaagccaataccaccttatggcttgatatcagcaaaaatagccaactgcatctcacctatcaatcattgaaattgagtaacgaattagccaatttccccgagcctttctttgatagtcgcgattttggtacttttaccttacctatggtgtttagccaatcccctaatcttacccaacaaaaagcagcgggaatactcgcttcttggtttggtacacaagtcgattggcgccagcaacactaccctgtgtattacaatcagttgcccaatcaacacagcattgtatttgccactaataaacagcgccccgactttcttaatacacatgccaatgtcaatgctcccaccattgaattagtctcacacccaacggatccttatgtaaaactgctgttagtaatgggtcgtgatgacaatgacttaattaccgccgtcaatggtattgcccggggacaagttatttttagaggggataccgtcaccattaatgatgtcaatctattggcaccacgtgaaccttatgatgcacctaagtgggtacaattaaataaaccaatctactttaataccttgcaagattatcaaggtcagttgcaatctcgtggactagagcctgctcccatcacactcaatatgaccttacctcctgatttatttatgtttaataatacaggactacagatgcaattgcgttatcgttataccgctccggcatttcaagatgattctcgtatgtcgatttcagtcaatgatcactttatcaaagcctaccctttagagagagataaaaaagagaactttattgtggcttatctaccgttaattcaaggttggatcgaaaacaaaaatctcctcaatatccccgcggtaaaattaggtgaacgtaatcagatccgtttctcttttgactatacaaatccgatccccggaggctccgttgatcaatgtattacttatcacccagtccctaacacggtagcattagatgaattatcaagctttaattttactggtaactatcgccactatattgctctacctgatttgcgtgtttatagtcatgctgggttcccatttagccgttatgccgatttgtcagaaacccttatttatgtcaaccaatccccttcacctgagcaattaacaacgttattgatatcattaggtaatattggtgcacaaactggctatcccgcgttaaatgtctctttaactgcatcattagaggaattatcaaaacaagaagctgatttattattaatcgggacaattcccccagcactcaataatgataaacagatgaatgtcttgattgataaagcacgtagcgaaattacactgccatcacgtgaaatcaccatttttagtcataccaattatcaagatctagataagcgcccagatagcagaacatctttaacatcaaccggatcactcggcactattattggttttcaatctccgttcttttcacagcgtagtgtcgtggcgctattagccgatagtccccaaggttatcgattattaaatgaagcgataagtgatagtggtaaacgtgatgcaatgcatggctctgtagtattagtcagagagtctggtgtccatagtttacgtgttggtgatacctatttcgtcggttatttaccttggtgggaagaggtttggtatgtttttgcttcgcatcctatttggctagggttagctgccattgtcggtattgtgcttatttctcttcttatttggcgagcaatgaaaataagaagccaacgtcgtcttgcggataaggagtaa

SEQ ID NO: 3004 - DNA, 2532 bp, Proteus mirabilis
ttaaggttattagccaatatgaacagagagaatatgagtggaagatctacaagcattttggcaactatattatttataatttattctcaaaatgtatattctgtagagtttaacttagatgttgttgactctaaatctaaagataatattaactttgctaggtttagtgaagccggttatattttaccgggtaaatatcagcttaacttagtacttaatggacaagggatcggttcatcaacatatactgttaacgtattagaaagagaaaataaatctcaagatgaaaataaaaaactgttatctcaagcctgtttaacaggtgatattatttcatctttaggattaaaggaaaaaatagaaaataatctaccaacatggaatgatggaaaatgtattgacttattaagcctagatggtgttgaagttacaacaaaattaaatgaaggtatattatcaattaaaatacctcaaatatggcttgagtatacaagtgctacttggttaccaccatctcgctgggatgatgggatctcaggtttgatccttgattataatattaacaccaatgttaatatccctcatgaaggaagcaatacgcaaagtatttattacaatggtactgttggttataacttcggtagctggcgtattcgttctgattatcaagggaattataatcgaacctctggtgatgcggaaaacaataaagatttattaaattttactcgagtttatggatatcgcgcgatccgcagtttaaagtctaacctaaccatcggtgaaaactttataaactccaatatatttaattcctggcgttatacggggattagtttagaaagtgatgatcggatgctctctcctcaactaaggggatatgcaccacaagttacagggatcgctgaaactaacgcaagggtagttgttaagcatcaaggacgtattctttacgattcaacagtacccgcaggtccatttgccattcaagatttagacagttcggtgcgtggtaaattggatgttgagattattgagcaaaatggaaagacgaataaatttcaaattgatacagcctatgttccttatttaacaagaccgggacaagttcgttataaggttgttgcaggacgctctagagataaattacataatacagaaggacctatatttggtacgactgaagctgcttttggtttaagtaatgcttggactatgtatggtggtaccattttcgccggtgattataatagtgtagcacttggggttgggcgcgatatgttcgctttcggtgcggtatctgccgatattacacaatcttatgctcgattacctgatcgtggcactatgcaaggtaagtcatggcgagtcagttactctaaacgttttgataatttggatgcggatgtaaccttcgctggataccgatttaatgaacgtaattatatgacgatgcaaaattatttagatgcacgttatcgtgatgattttactggaaaagagaaagaactctatacagtaacctttaataaaggtctttctgaatataacacatcaattggggtgcaatataatcatcagacatattgggatcaaagtaattccgattattattctattaacttaaataaatatatggatgtttttgcagttaaaaatatttcattaaatttatctgcatcgagatctaaatactatggcaaagataatgatgtcttctttgcaagagtcagtattccattagagaataatagaggatttataaattatgatggctcaagaaattcggggaactatacgcataatatagggtactttaataccactgaagataacttagctaattataatttaaatgtttcaacgacatatggcgatgatatggatagtagttcaagcttctctggctattatggacgctatacttcaatcgctaatattaatgcgaatgccactatctcaaataaaaatacctcatcatttggtttttctgctaatgggggcttaacgattaccgctaaaggagcagcacttcacccagatggatttaatggtggtactcgcttattagttgatactgaaggtgttgcaggagtaccagttgatggtggccgtgtaacaaccaataattggggttatggtgttgttaccgatattaatagttattatcgcaatgaaacaacgatcgatttaactaaattacctaataatatagaagcgacacaggcgattgtagaatcttcattaactgaaggtgctattggttatagaaaatttgaagtgttaaaaggtgagaaggcctttgcaataattaggttagctgataactcttatccaccatttggttcaataattagtaatgctaaaggacgagagctaggaataattagtgatgatggttttgcttggctaacaggtattaacccaaatgaagaaattagagtatcttggggagctgaacaacaatgtgtcgctaaacttccaaataaaatagaaccgagtaataagatattattattgtgtgaaaaataa

SEQ ID NO: 3005 - DNA, 378 bp, Proteus mirabilis
atttttctatttaaatttattaatgagaataaagtaagtggtaatttacatatacgaaggtggcttttcatgaatatcgataagaatagaggatctgattctttattattaaggaagaatattggaaattttattagagaatctcgtatacgtaaatctctaacaggagcccaattaggcgaattacttgatgtgagtcagcaacaaatatcaagatatgaaaatggaataacaagtatcaatattgaaacattagatatgatattaaaattattggatgctgactggtctgagttttatcgaaaagttcttgtcgtagatattataaaacataaattaaaaaatagtgattcgtttccattctatttgcgtgtttag

SEQ ID NO: 3006 - DNA, 453 bp, Proteus mirabilis
ctgtgtatattcaacgccatgtcatcggaggctaagataatgaccaaattaattgcttttattagtggcctattatttagtgctggattgatcatcggtggtatgagcaacccacaaaagatcttggcatttttagatattcgtggggattgggatccgtcattgttatttattatgggggcggggcttatcgtcagtgctattagttaccaaattgcacgtcatcgtcaacaaagtttattagcctgtcctctggccattccaactaaaacagtgattgataaacctctcgtcttcggcagtatcttatttggtttaggatgggggcttgcgggtatttgccctggccccggtttggtattagcggggggtggttttacccaaggtgtattatttgtgtcagctatgattgttgggtggctaattattgggttaattcgcaaaccacaataa

SEQ ID NO: 3007 - DNA, 366 bp, Proteus mirabilis
attaacatattattaaaaagtatattgattatggagtttaccatgacacaacgagttcaacctgatttattggaagccatgaaattagcggctaatgaagcctctagtatgctgaaaacgctaggtaatggtgatcgactactcttattgtgccaattaagtcagggcgaaaaaagtgtcagtgaattggaagaaagtttagggatccgccagcctacgctttctcaacaacttactgtgttaagaaatgaagggcttgtgaatactcgtcgtgatggaaaacgtattttttattctattgctgatgaaaaagtattggtgctattaaatacactttatcagctatattgtcctatagcaggttaa

SEQ ID NO: 3008 - DNA, 261 bp, Proteus mirabilis
ccttatacatttatgtatagggttttttcgcatgtcttttcatatcacattaaggaaaatactatgaataatctgattaggctttcagaggttttgcgacgcacaggttacagcaaagcttggatttatagattaattaaagaaaatgactttcctaaacaagttaaaataggagcccgttctattgctttcgttgaatcggaagttgatgaatggattgctaataaaattgctgaatcacgttctggtgaggtggcataa

SEQ ID NO: 3009 - DNA, 3087 bp, Proteus mirabilis
aggagcgcattcgcgttccttttttattttgcaggaaatctgattatgctaataaaaaattctttagcttatgcgattacactaagtttctgcttatccttacccgcacaagcattaccttctctttctcatgaaccttttggcgatctttatctttttgaagatgaaatgccaaataccttgagcacctcaaatgaccatcagctatcactaagtaaagagcatgctaaagatggcgtacagtcactcaaatggcagtatcaaccccaatcaacattaacacttaataatgaagttaattatcaagatgataaaaatacagcaacaccactcacttttatgatgtggatttacaatgaaaaaccacagtcaacgccccttacattacaatttaaacaaaataatcaagtagcattaagttttaaaacggaactgaatttcacaggttggcgaggtattgcagttccttttcgtgatatgaaaggctcagcaacaggcaaattagataaattagtcattactgcaccagatcaagcaggtacgcttttttttgatcaaataattatgagcgtacctttagataatcgttggcctattcctgactatcaaattccatatgttaataatgcagtaaatacaatggtgagtaaaaattggagtgcattattgatgtacgatcaaatgttcacagcgcattatcctacattaaattttgcgactgagtttcgcgatgatcagcctgaagtggcatctatttatcaacgttttgaatactatcaaggtgtcagtcgtgataaaaaaatcaccgctgaaatgatcgacaaaaatttagcattatggaaaaaattagccttagaacaacatgctgatggctcaataaccgcaaaagcccttgatcatcctaatcgccagaattttatcaaagtcgagggggtctttagtgaagaaacccaaaaagcattacttgatgccaacatgctaagagatgtaggcaaaacgcttcttcaaacagcgatttacttgcgtagtcgctccttatcagcaatcgatagaaaaaaattagaaacgctctatttattaggcactcgttacgttcttgaacaaggtttcacacgggggagtggttaccaaattattactcacgtaggttatcaaacaagagagctttttgatgcatggtttattggtcgccatattctagcaaaacataatctgttagcaccgacacaacaagccatgatgtggtataacgcaacagggcgcatatttgaaaaagataatgaaatcgttgatgcaaatgtcgatattctcaatacccaattacagtggatgataaaaagtttattgatgttgccagattatcaacagcgccaacaagccttagcacaattgcaaagttggctaaacaaaaccattcttagttctaaaggtgtcgctggtggctttaaatctgatggctctatttttcaccattcacaacattatccagcttatgccaaagatgcatttggtggcttagcgcctagtgtttatgccttaagtcattccccttttcgtctttcatcaccagcacatgcacgcttaaaagatgtattattaaaaatgcgtatctataccaaagaaacacaaattcctctggtattaagtggcagacatcctacggggttacataaaataagtattgatcccttcaaatggatggctcttgcaggtacgcccgatggtaaacaagagctagatactacattagcagccgcttatgcaaaattagcaaacaaagatagctttgaaggtattaaagcagaaaatgaaccggtaggtgcatgggcaatgaattatgcttcaatggcaatccagcgtagagcatcaataacagcgccacagcaaagctggcttgctatcgctcgtggttttagtcgttatttagtgggtaatgaaagttatgagaataacaaccgttatggtcgttacttgcaatatgggcaacttgaaattattcctgcggatttaactaaatctggttttagtcatgcaggttgggattggaatcgatatccaggaacgactacgatccaccttccttatgatgaactagaagcaaaactaagccaattgccaagtgcaggcatagaagaaatgttgctttcaacacaacgttattctggtgccaatacactaaataataacagtatgtttgccatgaaattacatggtcacagtaaatatcaacaacaaagtctaagagcgaataaatcctatttcttatttgataatagagtgatcgcattaggctctggtattgaaaataacgataaacaacatacaacagaaacgacactgttccagtttgctgttcctaagttacaatcaattataattaatggtaaaaaagtgaaccaactcggtactcaattaaccttaaataatgccgatacattaattgatccggcgggtaacttgtataaattagctaaagggcaaacggtagaatttagttatcaaaaacaatactctgttgatgacagaaattcacaacaaacagaacaattgtttgcaacagccgttatctctcacggtaaagcccctaaaaatgcaaattatgaatatgcaatagccatagaagcacaagataataaagcgcctgaatacaccgtattgcagcataataatcaacttcatgcagtaaaagataaaatcacgcaagaagagggatatgctttttttaatgccaccgaagtcaattcatctcaagctttattattatcaagtgattcccccactatggtaatggtaaaaaaacaaaaacaacaattaacgctaagtattgttaatcctgatttaaatttatatcagggtattgaagctgaccaaattgataataagggtaaccaggttgaagtgagtgtttattctcgccaatggcttacagccgatcctcaaccaataagtagtacagttactgtaaaagggatttggaaattagccacaccacaattaggtgttaatattagatatcaaaataataatacgctaattacaacaacgactatacaagcaataccaataacagtttatttaattaagtaa

SEQ ID NO: 3010 - DNA, 198 bp, Proteus mirabilis
atttctcaatttgtgagtaacaaaataaaaagggggcataattgggggcatgatacaaaattgaatgaaattaagatgtttataatcaatataatacgtctttatattgaatcctgtaggggccatttaaaatcaacaccttatgcgatttttaaaaaaatctgcgagatatgcgggtcaagtaacgggtcaaattag

SEQ ID NO: 3011 - DNA, 537 bp, Proteus mirabilis
caagagcaattaattatgattgaatggattagtgctcagccagcacttttctggctttgtcttggtgtcttactattaatcgccgaaatgctgggcactgcaggctacttactatggtctggtatggccgcattatgtgttgcattaatcgcatggatcttacctattggttggcccattcaaggtattctatttgcattactcaccgttattagtgcaatcctttggcgtatctggcttaaacgcaaaaagttatccaaagaagcagaaaacctaaaccaaaaaagccaccaacttattggtataaaagcagttttgttatcggatactgaaaatggttttagtcgcataaagcttgctgatgggagttggcgagtctattctgacacgccattaaaagcaggtgatacagtcaaagtgattgctattgatggtatcaccttgcacgtcacctcattttctcccaccactcgctcggcatcatcaacacagcatgctgctgttattgatgatgacaacaaccagaaagatgattga

SEQ ID NO: 3012 - DNA, 711 bp, Proteus mirabilis
aattgtaaatttttgtttaattatcataagggctttttgatgaaaaaaatatttatggttgccgttatatcttccttattagttggctgtaaggttgatttagaaacgaaaataaatacagataacttattgtctagtgagcaaaatattgttaaaggagatattaatttcgaagtctcttcatgtaatgattttgaagactcaaggaaagagtctaagtcattgatagaattaaaaaataaagttcctgagattttcagagatgcggaatatgttgaatgttataagcaaaaacttaattcattcgcccatttctcaatacctgttggtgttggcaaggttgaagacggccaaaacactgttgatacggatctaatggtcttctcttacaaagagatattggcgggggtttatgcttcagaaggggtaattaaaaggatcaagcaagcagaaaaaaattcacatcaaaagatggattttagtatcagcattattcttatgcccggtaacgtgaaaatggataaggtagttgcgttaggcgtgacatttactggagatacatctaaaaatgatccagtattaataagcagaattaaatttggcaataaaccactgacttttaaattatcagatgtgtcagtaaaccaattaatgcaatacggtatggttccattcttagtaactcctgaatatttcacactatataagtaa

SEQ ID NO: 3013 - DNA, 201 bp, Proteus mirabilis
ttttacttttctctgtcaactaaattgggctgtgttgataacagtattgaaacgccactcgacgttaataaacagtcacttatttgggacgactctgcagttatagaggacggttctattctcgtgagaatacgtgagatagaagaagcacagaaagcggaaaaaatgcagacagaaagaagaggaagaaagctaggatag

SEQ ID NO: 3014 - DNA, 966 bp, Proteus mirabilis
gcaaaattttctgccacgtatctattaggaagcactatgaaatatcaagatgtaacaaaaaccccctgtgagaacgcttattttctagtctttaatcttattaactcatcggaaacccgccctactcttatcgacttttgtaataatctatcaggtcttcttcgtagtatgagaacccgtttccctgaattagacgtaagttgtgtgatgggatttggtgctgatgcatggtctaaactattccctaatcaagctaaaccgcgagaattaaatacctttaagcaaatcaacggcgatgtgtataccgcagtatcgacacctggcgatctgttttttcacatacgggcactaaaggtatccgcttgttatgaattagccgcaattattagccaaaaattaaactctattgccacctcagaagatgaagtacatggtttccgctattttgatggtcgctcaattattggctttgtggatggaacagaaaatcctgagtttgaagatgagcgtgtcgcttatgcggttattggtgatgaagatccactgtttaccggtggaagttatgcatttgtacaaaaatacattcatgatatggcggcttgggaaaaccaatctctcatcgagcaagaaaaagtgatcggtaggcataaattcaatgatgttgaactaactgatgaagaaaaagatccaggctcacacaatgtcgtcaccaatattcaagatgaaaacggtgatgatttaaaaatcgtacgagcaaatatgccgttttcaaatccctccaaaaatgaatatggtacctattttattggttatgctcgctatttctcaacaacaaaccgtatgttagaaaatatgtttgcaggaacacctgaaggacataccgataaactactaaaatttagtacccccgtcacgggcacattattctttgtcccatctccggcgtttttagatgatatagaataa

SEQ ID NO: 3015 - DNA, 2760 bp, Proteus mirabilis
gggggcgtttcaatgaagccgattgatgttatccgtgaggtgaagctgaaagctaacggacaatggcaagctatattatctcaccttggggcagaagtgcccctaaacacgcacacggcttgccctgcttgtggtggtaaagatcgttttaggttcgacaacaaagacgataacggcacgtttatttgtaatcagtgtggttcaggtgatgggttggatttagtgcaaaaaatattaggtggcagtgtgaccgaggcagcgtatgaggttgctaacataattggcattgatacccgttcagcgtgtccaccagcctaccgctgttctgagataaaagcacaacaagacgaactgaaagcacagcaagccgaaaaacaagctaacgagaagagagagaagcataaacgctttattgaacggtataaccgcactattgccaatgttcaacgtgggggatctgactatctcaaggctaaggggctgcatggttttgaaatggatttattacaggacggttctcttatcattccattattggacgctggtggcgttattactggcgcacaaactattaagcctaatggtgataagcgtttactgtcagatagctcaaagtcaggcagttattaccccatcaatgagactgtaaacgtctctacggtgattatcgctgaaggattagcaaccgccctaacgtgtcacttaatccaaccagaagcgcacacagttgcggcaattgatgcgggaaacctcattcatgtagctaaggtaatgcgagttaagtatccagagagcaagattattattgctggggataacgatattaagccagaccaagacaatacagggaaattagcggcagaaaaggcagctaaggcggttaatggtgtcgcagttttacccccaactgatgataaagccgattgggatgactaccgcctatcacacggtattgaggcggcaagacaggcatttaatggccaagtggatcagcaagcaggtgaaatagtggaagagaataacgtgatccacattgacgcaaaaaagaaagtcagacctcacgatgacttagccccattttttgataagcgtcatggtggtttgtattacatcgaacgcaagcaaaacaatacgacgggcgagattgacgaaaaagaaacgtggttttcggatgaaatggctacggtaggtattggctctgatggcaaagacagctatttagttatcgagatgaagcaagaaggtagcaaccgcataatttatgaagccattccgagacgtgaactaggttcgcctcaagggtgggggaggttacgctcccgtggcgttaatattacaacaaagcgtggtcaattggatttattagctaactaccttcaacggaaaggaaagcgcgacgaatggacgatcacacataccgcaggttggcatgatggagcgtatgtgatgcccgatggtcatattattggtacacctagccgccctgttgccttttgcggcggaacgtctgccgttgcgggttatatcgtcaggggaaccgctgaaagctggcggaagaatgtcggtaatttaatgaaaggcaaccaatctatgattttaggtggtttagttgcgttagctgccccactgaactcattatcgggcggtagctcgtttggcattcacctattcgctcaatcctcagcagggaaaacaactactgtagaagcggcttcaagtatctacggtgtacccgatgaactgaaattaacatgggatgcgacaaagtacgggttaacgattgaagccgcctctcgaaatgatgggtttatgccaattgatgaaattgggcagggtaacgatgtgcggcatgtcgcaggaagtgcctatagtttattcaatggtacggggcgcattcaaggcaataaagacggtggaaataaagccgttttacgttgggcgattgtcgcgttatcaacgggtgaggaagattttgaaacttacctcattcgaaatggtgttaccccaaaagcagggcaattagtgcggttggttagtgtgccatttaccgatactgtcgagtttcacagccttgatgatggtgatttgcattcacgagcaataaaacgcgcatcaacgcagcattgcggggcggttggtagagcatggattgagtatttagccaacaatcaggacatagccaaccagaaagtaaccctcaaagagaacgaatggttatcgagtttacctgaggaagcatcgccgcaggttaaacgagtcgccacccgttttgccatgttagacgctaccgcagagctatcagcctcaattacgggttgggatagtggcgaatgtggccgatttattcgtaatagcttcaatgaatggctagagaactatggcacaggaaaccgagaaaaataccaagtcgttaaacgggcaagggattttattcaacgctatggattaaatcgctttcagccatacacctatgggaagcgcaacggagatttagaccgagtttacgcaggaagaataacaaaccttgcgggttatttggtttccggtcgcagagaggacggcaaggacgaatatcacattatcccgtcagtgttcgaagatgaaattctctcaggcattcaaaagaaactgggagccgaggcactcgaagaggcgggtatgttagttagaccagaatcaggccgcgtagacggtaaaactatcagcattaacgggagtcagcagcgatttgttgtcttaattgatagtgaggaagaataa

SEQ ID NO: 3016 - DNA, 786 bp, Proteus mirabilis
tttgttgaattaatagtgtgccttgatataaatactataatgaatataccaaactcaacttttcctattgtggcggttattcccgctgccggcataggtagtcgaatgcaagcaacctgcccgaagcaataccttaaaattggcagattgactatccttgaacatactattaatgcgctattaaaacatccacgcatttcgcaaattattgtcgcaattaacccagaagatgactatttttatcacctagcccttgctaaagataaacgaattattgtcgttaaaggagggggacaacgtgctgattcggtattatcagggcttcgctatattacagaacatcttgcgcaaaatacatgggcgctagttcatgatgcagcaagaccctgcctgtcctttagtgatttggataatcttattcaactcattgatgataaccatcttgatcctcaattttgtggtgggatcttagcctctcctgtgcgtgatacgatgaaacgtagtcatcaacaagataaccatattgaaaaaacagtggcaagagacacgctatggcatgctttaacgccacaatttttcccagcggccttgttaaaacaaaatcttgaaaacgcattggcacaaaacgtacccattactgatgaagcatctgcgatggaatttggtggatatgaacccttattagttaaaggccgtgcggataatataaaagtcacacaaccagaagacttggctcttgcagaatttttcctctctcgacaaattaccagcataaggaacacataa

SEQ ID NO: 3017 - DNA, 525 bp, Proteus mirabilis
gtaatgtcttctcaagttggtctcaatacctcatcccctcgtatcgccattgtgatgggttcgaaaagtgactgggcgacaatgtgtcatgccgcagaagtcctagacgcgttacaacttccttaccatgttgaaattgtttccgcacaccgaacaccggataaattatttcgtttcgcagaacaggccaaagagaatggttttgacgtgattattgcgggtgctggcggtgctgcacatttaccggggatgttggcagccaaaaccttagttcctgtattaggggttcctgtacaaagtgctgcattaagtggtgttgatagcctttattctattgtacaaatgccgaaaggtattcccgttggcacactggctattggtaaagcgggggctgctaatgccgcgctacttgccgcacaaattttagcattacactctgctgatatttttaatgcattaacacaatggcgagcaacacaaacacaagaagtccttaatcaccctgatccaagggaggcgctatga

SEQ ID NO: 3018 - DNA, 1062 bp, Proteus mirabilis
tttatttattcatcatcattgccgaagcctaaaggcttcggtaaggaagcaatatccatgacgatgccaacagctctttgtcctaatcgtatgcaagttcactctatccatcaggaaaccccggaagtgtggacactgaatttaattaaccatgatttttatcgctataaacccggccaatttgcactagtcagtattaataatagcgatgaaacgatgcgagcttatacgctctcgtcttctccgggattaagtccttttgtctctttaacggttcgtcgtatcgacaatggggtggggtcaacgtggttaacatctcaagttaagccgggtgattatctctggttatcagacgcacaaggggagttcacctgtgcagatagagaaggaacgcgttatttaatgctcgctgcggggtgcggtgtgacccctattatgtcgatgacgcgttggttgttaaataatcaacctaaagcggatatcacggtcatctttaatattcgcgaacagagccaatttatttttgaaaaagagtggttagagttagctaatgcttatccctataatctcaattttattatgatgcctaagttgccggatgataagggaatttttagtggacgtatttctcaagaaaaactagccgctttagtgcctgatattgccagtcgtactgttatgtgttgtgggcctaatagttatatggaagatactgcgcgttttgccaaaaatcttggtgtttgtgcagagaatatttttatggaacgttttggtgatgagccaatgtgtgttgatgaagcacaacaacttactatgactattcgtcatccgttaaagcaaattaacgtaccggtggggatgacattattaacagcgatggaagaaaacagtgttcctgttttggctgcttgtcgtgctggagtgtgtggtagctgtaaaacacgcattgtgaaaggtgattatgaggtcaccagcaccagtactttaactgctgatgagatagcacaaggttatgttttagcttgtagttgtcgattaacaggtgatgttgaactagcctaa

SEQ ID NO: 3019 - DNA, 1248 bp, Proteus mirabilis
gtgatatattcatttgatcatatttcagttatatataaacttatcttttctcattttttaaccattttagtcttgtgcactaaaatggctgataaacggacgctgcattacacaaatttaggcaggaaaatgaatagtaagctttcaaaaccacaatcttcagaagttgataaagggcatttcgacgatttttatctaaaacagaacgatgaaatcgatctgtttgagttattttctgttctttataaatcaaaatttgtcattattgggatcacacttttatttgctatcgtaggttttactgttgcgagctttctgccccagaaatggacaagccaagctgctattacaaaaccaatgttagatgagatgaagcagttaagagctaccttaaatgatttaagcttggttgatgttgatactggcgtaaatgcttcttctgtttaccaaaaatttatcaataactacaattcccgtgtattacgtgaagaatatttagtcaatacggattactataaaaacttattggctaagatggacgatcctacgccattggataaacgtaaattaatcgaaactattgttactaaagatattaatttaaaagcatcagacagtaaaaatagtgatgaagaatttagtggcgaaattaacttaagctttactgcgccaacttctgaagaagcttacgatttgctgtcaggttatattcgctttatttctactaaagtacgggtagaagtgaaagacgaaattgatgatcaaattgagcgtaaattaaaccatgcgcaaaaagcgtatcaaatggatttagaacgtattgctaatgcgcgtaatgttaatgttcagcgcttaaaatatgcactagaaattgccaatgctgcgggagttaaaaagcctatttctagtgaaggcgcacaaattaaagatgatcctgattactccattgccatgggggctgatgcacttagtagtaaattagcgataacagaagcgattactgatcctacaacggtcagttctgaattaaaaaaccgcttatataatatccagcagttagaacaaataaaattgggtgatctgcaatttgttcctttcaaatatatgctaaaaccttatgaaccaactaagaaagatgcgcctaaacgtgcattaatcttagtcggtgccgcatttgttggttttatcctttctgtaatgggtgttttactgggctatatggcaagaaatcgccgtaaaacagcgtaa

SEQ ID NO: 3020 - DNA, 588 bp, Proteus mirabilis
cgctttaattcctacgttaaatataaaggtaaaaatatgaaattgaataaattagcgatgttcgctattgcatcaatggctttttctgcgactgttgctcaagcggcttcaggtgatggtactattactttcactggtaaagttattgatgcaccttgtggtattgctaccgaaagtgctaaccaagctatcgattttggtcaaatcagcaaaagcctattagagaaagatggtatttctcaagttaaacaaatcccaattaaattggttaattgtgatttaactaaagccggttctgatactggtgctgcaggttcttataaaggcgtaaaagtaacctttaatggaaatactattactggtgcaacagaagagttagcaacaactggtaatacagggactgctattgttatttcaggaacaacaactggttcaatggttaaattcaatgaagcaggtgaattacaagcactgggtaataatgataatacgctgatgtatacagcttgggctaagaaagcaacaaacggaacaattgctgaaggtgagtttaacgctacaacaaacttcacattagcctatgaataa

SEQ ID NO: 3021 - DNA, 603 bp, Proteus mirabilis
tcgtgcagctcgccaagcaggtcttggtggcgagattatctgctacgtagcttaattcgggaggaaagaatgtctcgtgtggcaaaagcacccgtcgtcattcctgccggcgtagaggttaaactcaacggtcaggtaattacgattaagggtaaaaacggcgagcttactcgtactatccataatgcagttgaaattcaacatgctgacaaccaactaactttcgcaccacgcgatggttatgctgatgcatgggcacaagcgggtactactcgttcactgctaaatgcaatggttgtaggtgttaccgaaggcttcactaagaaactgcaactggtaggtgtaggttatcgtgcgtctgttaagggcaacacagttaacttatcagtaggttattcacatccagtggaacaccaactgccagcaggcatcactgctgaatgtccaacacaaactgaaatcctactgaaaggtgcggataagcaagtgattggtcaagtagcagctgaactgcgtgcttaccgtcgccctgaaccttataaaggtaaaggtattcgttacgccgacgaagttgtgcgtatcaaagaggctaagaagaagtaa

SEQ ID NO: 3022 - DNA, 666 bp, Proteus mirabilis
tactctggattattctctcgtcagatatacctgctcactgctatgcttttctatattacaattacagcaaagtaccgccacaatattcgtatgaggtcaatcatgagccattccactattagaagttacttacacttatcaccttccattgctaaagatgtttatattgacgtgacagccaccgttattggtgatgtacgccttagtgaagatgtcagcatttggccaatggttgtgatccgcggtgatgttaactatgtcagtgtaggagcaaggactaatattcaagatggctcagtgctacatgttacacatgcatcagaaaatacccctaatggttttcctctcatcatcggtgatgatgtgactgttggacacaaagcaatgttacatgggtgtacaatcggaaaccgagtattagtcggcatgggatcaattttacttgatggtgcaattattgaagataatgtcttgatcggcgcaggaagcctagtaccaccaggtaaacgactagaaagtggttttctttatttaggtagcccagtaaaaaagatccgcccactcacgcccgcagaaatacaacactttatctactctgctaataattacgtaaagtggaagaacgactatttatcaacggctcattccgccattgataaacagtaa

SEQ ID NO: 3023 - DNA, 264 bp, Proteus mirabilis
atgaatcaatccattcaatttcctgatcgtgagcagtggcttgaagatcaaaatagcgttcttttccctatcatggtcaatggaatgttatttgattgccaaatcaccgaacaagagctaaaggcacgctttggtgataatagtaatggtctttgtttgtttaaacagcatcgatgggaaattgaagaagaatttgaagagttggctaagctgtatgaagtgtcaactcttcatccattttactgtttatcaatggcggaatga

SEQ ID NO: 3024 - DNA, 219 bp, Proteus mirabilis; identical to SEQ ID NO: 887

SEQ ID NO: 3025 - DNA, 351 bp, Proteus mirabilis
tcatttacgtttataaaaaatagttggagctctggtctcatgcagaaccaaagaatccgtatccgcctgaaagcttttgatcatcgtctgattgatcaatcaactgcggaaatcgtagagactgctaagcgcacaggtgcgcaagttcgtggtccaatcccactgccgactcgcaaagagcgtttcacagtgttgatttctccgcacgttaataaagatgcgcgtgatcagtatgaaattcgcactcacaaacgtctggttgacatcgttgagccaaccgagaaaaccgttgatgctctgatgcgtctggatctggctgccggcgtagacgtgcagatcagcctaggttaa

SEQ ID NO: 3026 - DNA, 642 bp, Proteus mirabilis
gaggttgaaacaatgattggtttagtcggtaaaaaagtaggaatgactcgtatcttcactgaagatggcgtttcaatccctgtaaccgttatcgaaattgaaaacaaccgtgttactcaggtcaaagatctagagaaagacggttatcgtgcaattcaggtgactacaggtagcaaaaaagctaaccgtgtactgaaacctgaagcaggtcattttgctaaagctggcgttgaagctggccgcttactgcgtgaattccgtctgaacgaaggcgaagaatacactgtaggtcaaagcattagtgtagaaattttcgctgacgttaaaaaagtcgacgttactggaacatctaaaggtaaaggttttgctggtactgtaaagcgctggaacttccgtactcaagatgctacccacggtaactccttgtctcaccgcgttccgggttctatcggtcagaaccagactccgggtcgtgtatttaaaggcaagaaaatggcaggtcaactgggtaacgaacaagttaccgttcagagcctggaagtagtacgtgttgacgctgagcgcaacctgctgctggtcaaaggtgctgtcccaggtgcaactggcagtgacctgatcgttaaaccagctgtcaaggcgtaa

SEQ ID NO: 3027 - DNA, 1164 bp, Proteus mirabilis
tgcatggatgccagagaaatatggataagacttaatgttgtttcaagattgccagtaaataaagcgattaaggtggtggaatacttacaatcattgacgcaactaaatcgtaaagtgttactagaatgtggcctatcagaacaacaaagtcaccaatttatgaggcttcaggcaaattgtgtcaaaagtacattaaagtggctagataaaaatgaatcatcactcttaacaatttctgattcagattatcctttgctattaaaacaaatatcttctccacctcttttgctttttgttgcaggtaataaagagcatttaaaaagcacacaaattgcattaattggtagtagagatgctacacagtatggaactaagtgggcgacttattttgcacaacagctcgtgaaaaataaattcacaattacaagcgggttggcgcaagggattgatggtgttggacatcgtagtgctttaaaacatcatggcgtcactattgctgtattagggagtggtttagaacaaatttacccatcatttcatcgtcgactagcagagcaaatcaaagagtcgggtgttcttgtttcagagcatctcccgatggcacctcctttagctcgtcatttcccgcaaaggaatagaattattagtggattgagttcagctctcttaattgtagaagctggcataaaaagtggatctttaatcactgccaattatgctctacaacaaggcaaagaattgtttgtgttacccggattactcggtgattcacactttgaaggaaatcatcagttgctaaaacagggggcgaatttagcctcttcgccagatgatattatggaatatttaaatagctctttgcagtggttaatctttaatcataatgatgatttacaggacgagcatatcgcagaggttggctcagctaccaacaataaaaaagagtccagcaatatgccattagaaattgaaaaacttacacccactcaacagcaatcaataaatttgatattgcctttgttaggttttgataaagctatcccgattgatattattgcgaataagagcggtttatccacatcagatttagctcctcttttattagagcttgagcttatcgaaaaagtcgctattgtggcgggtggctatattcgattggaataa

SEQ ID NO: 3028 - DNA, 618 bp, Proteus mirabilis
tgtgcgccagcaaattgtgtggcaagcaacaaacaaaaagagaagaacatgaataacgaagtatcacctgtaaataatacaattatagaagcactgcaaaataatcaagttattgcctatccaacagaagctgtgtttggtgtcggttgtgatcctgatagtgaaagcgcggtaatggcattacttgagttaaaacagagagccattgagaaagggcttattttaattgctgataactatgaacaattaaaaccttatattgatgataacgcattgactcaagaacagcgggagcggatgtttgcctcttggccaggcccaatcacttgggttattccagctaagtcaacaacgccaaaatggctaacagggcggttttcttccttagctgtaagggtcacggatcaccctattgtgaaagcattatgtgtggcttatggcaaaccattagtatcaaccagcgcaaatttaagcggacttcctccatgccgtagtgttgaagaagtaaaagagcagtttcgtcaccgaattgctattgtaaatggcgaggttggtggtagaaaaaacccttctgaaattagagatgcactaacaggtgagctatatcgacaaggataa

SEQ ID NO: 3029 - DNA, 831 bp, Proteus mirabilis
agaacaatggcaattgttaaatgtaaacctacgtctccgggccgtcgccacgtagttaaagtggtaaacccagagctgcataaagggaaaccttatgcgccattgctggaaaagaacagcaaatccggtggtcgtaacaacaatggtcgtatcactacccgtcatatcggtggtggtcacaaacaggcttaccgtattgttgactttaaacgcaacaaagatggtatccctgcgacagtagaacgtctggaatatgatccaaaccgttcagctaacatcgctttagtgctgtatgctgatggtgaacgccgctacatcctggctccaaaaggcctgaaagcgggtgataaagttcaatctggcgttgatgctgctatcaaaacgggtaacaccttaccaatgcgtaatatcccggttggttctaccgttcataacgtagaaatgaaaccaggtaaaggtggtcagttagctcgttcagctggtacttacgttcaaatcgttgcgcgtgatggtgcttatgtcactattcgtctgcgttctggtgaaatgcgtaagatcccttctgattgccgtgcaactatcggtgaagtaggtaactctgagcacatgttacgcgttctgggtaaagctggtgcaagtcgctggcgtggtattcgtcctaccgttcgcggtactgcgatgaacccagtagaccacccacacggtggtggtgaaggtcgtaactttggtaaacaccctgtaacaccttggggcgttcaaaccaaaggtaagaagactcgtaaaaacaaacgcactgaacactttatcgttcatcgtcgtactaagaaataa

SEQ ID NO: 3030 - DNA, 858 bp, Proteus mirabilis
caggtgagctatatcgacaaggataatgatgctatggaaaaatatgtagtgatgggcaatcccattgaacatagtcaatctccttttattcatcagcttttttcgaaacagtcaggaattgattatgaatatgggcgtttactggttccattaggcgaatttgataaagtagcaacgcaatttttttctcaaggtggacgtggagctaatgttaccgttccttttaaggaagatgcttttcgctttgtggataaattaacacaaagagcacaagcctgtggtgctgttaatactattttaaaattagatgacggcacgttattaggtgataatactgatggtcagggcttaattcttgatttagctaggttggattttattatccccggaaaaatattatcggttcttgttattggggctggtggtgctacacgagggatattattaccattattaaattataattgtgatattactttgactaatcgcactgttgaaaaagcacaacaattagcacaagaatttagccaatttggtacaattagagctagtgctccacaaaatgttacagataaacattatgatctaattattaacgcctcttcatctagtatgacggacgatattccacctatacctgatagtgcttatggttttaaaactgcttgttatgatttgtattataaggcaggtatgacttcttttttataccatgcattaaaaaatggtagtacacgcttatctgatggcctaggtatgctggtagggcaagccgcttatgccgttgagttatggtatgagcgagtacctgatattaatccaacaataaatattttaagagaaaatttgaataaatga

SEQ ID NO: 3031 - DNA, 648 bp, Proteus mirabilis
tcgttaaaccagctgtcaaggcgtaacgtcgaggagataggaatggaattggtaatgaaagacgcgcaaggcgcgctgactgtttccgaaactaccttcgggcgtgactttaacgaagcgcttgtgcatcaagtagtcgttgcatacgctgctggtgctcgtcaaggtactcgtgctcagaaaactcgtgctgaagtttctggttcaggcaaaaagccatggcgccagaaaggtacaggtcgtgcacgttcaggttcaatcaagagcccaatttggcgctctggtggtgttagcttcgcagctaaaccacaggaccacagtcaaaaagtaaacaaaaagatgtaccgcggtgctctgaagagcattctgtcagaactggtacgtcaagatcgtctgatcgtcgtagagaagttctctgttgaagcgcctaaaactaagcttttagcacagaaactgaaagatatggctctggaagatgtactgattgtcacagcagaagttgatgagaatctgtatttagcagcacgtaacttatacaaagtagacgttcgtgatgcagcaacaatcgatccagttagcttaatcgccttcgacaaagtcgtcatgactgctgacgctgtgaagcaagttgaggagatgctggcatga

SEQ ID NO: 3032 - DNA, 201 bp, Proteus mirabilis
agaacctgccatgttgcgaaacatagcctgacgatggctgctgttgcggttcaattgacgaccactcttacgatggcgcatgaccttatccttctcagtaaaaccttaacctgtgatcttattcatcagcgatacttgcaggtggccaattctcaaggcgcatacccagagataaaccacgcgacgccagtacgtctttaa

SEQ ID NO: 3033 - DNA, 351 bp, Proteus mirabilis
tctctctggcacctgaagtactctaaggagcaggcaatggcagcgaaaatccgtcgtgaagacgaagttatcgtgctaactggtaaagataaaggtaagcgcggtaaagtaaaacaggttctttcttctggtaaagttatcgttgaaggtatcaatctggttaaaaaacatcagaagccagtaccggctctgaaccaaccaggtggcatcgttgaaaaagaagctgcaattcaagtttctaacgttgcaatcttcaatgcggcaaccggcaaggctgaccgtgtaggttttagattcgaagacggcaaaaaagttcgtttcttcaaatctaataaagaaactatcaagtaa

SEQ ID NO: 3034 - DNA, 384 bp, Proteus mirabilis
cggagcactaaaatgatccaagaacagactatgctgaacgtggccgacaactccggtgcacgtcgcgtaatgtgtatcaaggttctaggtggctcgcaccgtcgctacgcagatgtaggtgacatcatcaaaattaccattaaagaagcaattccacgtggtaaagttaagaaaggtgatgtactgaaagcggtagtggtgcgcaccaagaagggtgttcgtcgccctgacggttctgtcattcgcttcgatagcaacgcttgtgtattgttaaacaacaacagcgagcaagttattggtacgcgtatttttgggccggttactcgtgaacttcgtaacgagaagtttatgaaaataatctctctggcacctgaagtactctaa

SEQ ID NO: 3035 - DNA, 1326 bp, Proteus mirabilis
cagatggctaaacaaccagggttagattttcagagtgctaaaggtggtataggtgaactaaaacgcagattactgtttgttcttggtgcactaattgtctttaggattggctcttttattcctatccctggtattgatgccactgtgcttgccaaattgctcgatcagcaaaaaggcaccatcattgaaatgtttaacatgttctctggtggtgctcttagccgtgcttctatctttgcgctgggtatcatgccttatatttcggcatcgattattatccaactattatcagtggttaaccctcggttagcggagattaagaaggaaggggaggccggtcgtcgtaagatcagccaatatacccgttatggtactttggtgctggcgatattccaatctattggtatcgcaacaggcttaccgaatatgccaggaatgcaaggtctggttattaatccaggcttaccattctatattacggctgttgtgagcttagtcacagggacaatgttcctgatgtggttaggtgagcaaatcactgaacgtggtattggtaacggtatctcaatcattatctttgcaggtatcgttgcaggtcttccacctgccattggtcaaaccatcgagcaggcgcggcaaggcgaactgcacttcctcctgttattgttggttgcagtattggtgttcgcggtaactttctttgttgtttttgtagaaagaggacaacgtcgtatcgttgttaactatgcaaaacgtcaacaagggcgtagaatatacgcggcacaaagtacacatctaccacttaaggtaaatatggcgggtgtaataccggcaatttttgcttcaagtattattctgtttcctggtacaataacctcttggtttggcgatggtacaggatggggttggctgacgacaatttctttaaatttacagcctggtcaacctatttatgtgttactatacgctgctgcaatcatcttcttctgtttcttctatacggcgttggttttcaacccaagagaaacggcagataacctgaagaagtccggtgcatttgtaccaggaattcgcccgggagagcagacggctaaatatatagataaagtgatgacacgtttaaccttaatcggtgccctgtacattacctttatctgtctcatcccggagttcatgcgtgacgcaatgaaagtacctttctattttggtggtacttccctcttaatcgtggttgtggtcatcatggattttatggctcaagtgcaaactctcctgatgtcaagtcagtatgagtctgcattgaaaaaagcaaaccttaaaggctaa

SEQ ID NO: 3036 - DNA, 393 bp, Proteus mirabilis
acaatggcaaaagcacctattcgtgcacgtaagcgtgtaagaaaacaagtctctgacggtgtggctcatatccatgcttctttcaacaacacaatcgttactattacagaccgtcaaggtaacgcgttgggttgggctactgccggtggttccggtttccgtggttctcgtaaatctactccgtttgcggctcaggttgcagcagaacgttgcgctgaagctgttaaagagtacggaattaagaacttggaagttatggtaaaaggacctggtcctggtcgtgagtcaactatccgtgcattaaacgcggctggtttccgcatcactaatattactgatgtgactccgattcctcataacggttgtcgtccaccgaaaaaacgtcgcgtttaa

SEQ ID NO: 3037 - DNA, 963 bp, Proteus mirabilis
caggaaaaaaacgtgtctgattcattacgtattatctttgcgggaacacccgactttgcagcccgacatttagctgctctgttatcaactcaacatcatattgttggggtattaacgccaccagataaacccgcaggaagaggtaagaagctgacgattaatccagtgaaagaactggcattaactaataacattcctgtttatcaaccgacatcgttaaaaccagaagagaatcatgagtggatcaaagcactacaacctgacgttatgattgttgttgcttatggtatgattttacccaaagcagtacttgatatccctcgtttgggttgcttaaacgtccatggctctcttctacctaaatggcgaggtgctgcacctatccaacgtgccttatgggcgggcgatacagaaactggcgtcaccattatgcaaatggatgttggtttagatactggcgatatgctttataaagcatcatgcccaattactcatcaagacacgagtgcttctctttatgctaaattagcagagctggggcctaaagcactaattaatacattagatcttatcattagcggtgagttaaaagcggaaaaacaagatgatagcctagcgaattacgcagaaaagctatcaaaggaagaagcaaaaattaattggtcgttatctgcacaacagatagaacgttgtattagagcgtttaatccatggcctatgagcttttttatgctcgatgatcagccggtgaaagtatgggaagcgcaagttatcgcgtcggataataccaatcaaataccaggtacattattgaaagcagataaaacaggcatttatattgtaacaggtgaaggcattttaaatatcaccaagcttcaaccatcaggtaaaaaacctatggcatcagccgatttcctaaattccaaacgagattggtttacccctgggaaaatcattcaataa

SEQ ID NO: 3038 - DNA, 1275 bp, Proteus mirabilis
ttcactatgaaaacgtcatacaacttacgcagtattgcagcaaaggcaatagctcaagttttagatcaaggcttatcattaagttcggtgatccctgaattacaaaaaaacatttcagataaagacaaagcgctcttgcaagagctctgctttggtaccttacgtaccttaccccagctagaatggatcatccaacaactaatggataaaccactgaaaggtaaacaacgaattttacattacctcattatggtcggtttatatcagctcctttatactcgagttcctgcccatgcagcactcgctgaaactgttaatggtgcgatcgcactgaaaaaaccacaattaaaagggttaattaacggtgtattacgccaatttcagcgtcaacaagatgtattaatggaacgtttccaaaataatgatagccgttatttgcacccttcttggttactcacacgaataaaaaatgcctaccctgagctatgggaaagtattattgaaggaaataaccaaaagccgccaatgtggttacgggtaaatcaaatacatcattcacgagaacagtacttagcgctgcttgaaaaagaagggatcagcgcgttctccgatgaccaccaccctaatgctattcgtttagaaacaccttgtaatgttcacctgttaccgggatttaatgaggggtgggtcacagttcaagaccgcagtgctcagcgttgtgcagaattattagcgccacaaaataacgaacaaattcttgatttatgtgcagcccctgggggaaaaacaacccatatcttagaaatagcccctaaagcgcatgttctcgccattgatatagatgagcaacgtttagccagagttaaagaaaatctaaaccgcttaaagctacatgccacagtcaaaagtggtgatggacgttatccagagcaatggtgtgcaaatatgcaatttgacaggatcttacttgatgctccttgctcagcaactggcgttatacgtcgccatccagatatcaaatggctacgtcgtaatgaagacatagctcagttagcgcaaattcaaaaagaaatattacatgctatatggccatacctaaaatcaggcggcacattagtttatgctacttgttctattttaccggaagaaaatagccaacaaattgcagccttcttatcgtcaatgcaagatgctcaatgtgactatcagcatcaatgcttaccggagcaatatagcggtgatggcttcttttatgcgctgatcaacaaaaaatga

SEQ ID NO: 3039 - DNA, 501 bp, Proteus mirabilis
aaagactggaagcaaaggagcataaaaatgaaaggtgataaaaaaatgatagcccaccttaataaattattaggtggtgaacttgttgcaattaatcagtatttcttgcatgcccgtatgtttaaaaattggggatttactcgccttaatgcgatggaataccatgaatctattgatgaaatgaagcatgctgataaatatattgagcgtattttatttttagaaggtatccctaacttacaagatttaggaaaactcaatatcggtgaagatgttgaagagatgttgcgttcagatcttgaactcgaactagggggagcaaaagacttacgtgaagctatcgcttatgctgattcaattcatgattatgtgagcagagatctgatgctagaaatcttaacggatgaagaagggcatatcgattggattgaaacccaactggagcttattgaacgtatcggactgcaaaactatcttcaagcgcaaatgattgaagagtga

SEQ ID NO: 3040 - DNA, 411 bp, Proteus mirabilis
ggttttactgagaaggataaggtcatgcgccatcgtaagagtggtcgtcaattgaaccgcaacagcagccatcgtcaggctatgtttcgcaacatggcaggttctttagttcgtcatgaaatcatcaagacaactttgcctaaagcgaaagaactgcgtcgcgtcgttgagccgctgattactcttgccaagaccgacagcgtagctaatcgtcgtctggcattcgcccgtactcgtgacaacgaagtcgtggcaaaactgtttacagtattaggtccgcgttttgcgagccgtgcaggtggttacactcgtattctgaagtgtggcttccgtgcaggtgacaatgctccaatggcttacattgagcttgttgaccgtgctgattctgaaacagaagcagctgctgaataa

SEQ ID NO: 3041 - DNA, 438 bp, Proteus mirabilis
gagatgcgtttaaatactctgtctccggctgaaggtgccaagcatgcgcctaaacgtgtaggtcgtggtatcggttctggcctaggtaaaactggcggccgtggtcacaaaggtcagaaatctcgttctggcggtggcgtacgtcgtggttttgaaggtggtcagatgcctttataccgtcgtttaccaaaatttggttttacttcacgtaaatcattcgtgactgcggaaatccgtctgtctgatttggcttatgttgaaggcgatgtaatcgatctgaatgcactgaaagccgcaaacgttgttggcccacagattgaatttgcaaaattaattctgtctggcgaggttaaccgtgcagtgactattcgtggtctgcgtgttaccaaaggtgcccgtgcagcaatcgaatcagctggcggtaaaattgaggaataa

SEQ ID NO: 3042 - DNA, 186 bp, Proteus mirabilis
acgaaagcagaatacggcgcagtgcgttacctagagtgtggccgaagcctcgctctaatggctcaagggtcaccttggcgtgcgtcgaactcacttgctcgatatcaaccaggcgcggttttagaaactctgtcacagaaccctgcattgtgtcctctctttggtgctaagccttacttggagtaa

SEQ ID NO: 3043 - DNA, 1008 bp, Proteus mirabilis
caccaaagagaggacacaatgcagggttctgtgacagagtttctaaaaccgcgcctggttgatatcgagcaagtgagttcgacgcacgccaaggtgacccttgagccattagagcgaggcttcggccacactctaggtaacgcactgcgccgtattctgctttcgtctatgccgggttgtgcggtaacagaggttgagattgatggtgtactgcatgagtacagcaccaaagaaggtgttcaggaagatatcctagaaatactgctcaaccttaaggggttggcggtaaaagttcatggtaaagatgaagtaattcttactttgagcaaatctggcattggccctgttattgcagccgatatcatccatgacggtgatgtcgaaatcgtcaagccgcagcacgttatctgccaccttacagacgaaaacgcatctattaatatgcgtatcaaagttcagcgtggtcgtggttatgtgccggcttctgcccgaattcattcggaagaagatgagcgccctatcggtcgtttactagtagatgcgtgttatagcccagttgagcgaatcgcttatactgtggaagcagcgcgtgttgaacaacgtaccgacttggataagctggtaatcgagatggagactaacggtactatcgatccagaagaatcgattcgccgtgcagcgactatcctggctgaacagcttgaagcttttgttgacttacgtgatgttcgtcagcctgaagttaaagaagagaagccagagttcgatccgatcctgctgcgcccagttgacgatcttgaattgactgtccgctctgctaactgtctgaaggcagaagcaatccactacatcggtgatctggtacagcgtactgaagttgaattacttaagacgcctaaccttggtaagaaatctcttactgagattaaagacgtactggcgtcgcgtggtttatctctgggtatgcgccttgagaattggccacctgcaagtatcgctgatgaataa

SEQ ID NO: 3044 - DNA, 270 bp, Proteus mirabilis
gaaggcgggtgcgtaatgaccgataaaatccgtactctgcaaggtcgtgtggtaagtgacaaaatggaaaaatctgttgttgttgctatcgatcgtatggtgaaacatccattatatggtaaattcatccgtcgtacgactaaactgcatgtacatgacgagaacaacgaatgtggcatgggtgacgtagtagaaattcgtcaaacacgtcctatctctaagactaagtcttgggcgttagttcgcgttgtagaaaaagctgttctgtaa

SEQ ID NO: 3045 - DNA, 417 bp, Proteus mirabilis
tcaatgtatcgcatcggccaaattgcaaaattagcgaatgttacaacagatactatccgtttttatgaaaaacaaggattgatggaacatgatagacggacagaaggtggctatcgtctgtatacagaacaagatttgcaaagattacgctttattcgttatgccaaagagttaggctttactctggatgctattactgagttactttcaattagagtcgatcctgcgcatcatacttgtgtagaatcaaaacatattgttgatgctaggctagcagaagttgaggctcgtctaaaagaaatggaaaagatgcgtgattctttaaaaatgttaagcaatgcttgctgtggaaccgctcatgaaagtacatattgttcaattctagaaatacttgaatctggagcgacaaagcaataa

SEQ ID NO: 3046 - DNA, 204 bp, Proteus mirabilis; identical to SEQ ID NO: 1188

SEQ ID NO: 3047 - DNA, 282 bp, Proteus mirabilis
gccatgccacgttctctcaagaaaggtccatttattgacctgcacttgctgaagaaggtagagaaagcggtggaaagcggtgacaaaaagcctgttaagacttggtcccgtcgttcaacgatctttcctaacatgatcggtttgaccatcgctgtccataatggtcgtcagcatgttccagtttacgtttccgacgaaatggttggtcacaaactgggtgaattcgcgccgacccgtacttatcgcggtcatgcagccgataaaaaggctaagaagaaataa

SEQ ID NO: 3048 - DNA, 423 bp, Proteus mirabilis
ggagagtcgctgatgttacaacctaagcgtacaaaattccgtaaagtgcataaaggccgcaaccgtggcttagctataggtacggatgtaagcttcgggacttacggtcttaaagctgtgggccgtggtcgtctgactgcacgtcagatcgaagcggcacgtcgtgcaatgacccgtgcagttaagcgtcagggtaaaatctggatccgtgtgttcccagacaaaccaatcactgaaaagccgctcgaagtccgtatgggtaaaggtaaaggtaacgtagagtattgggttgccttgatccagccaggtaaagtcctatatgaaatggatggtgtgcctgaagaagtggcccgtgaagcatttcagctagcggcagcaaaactgcctatcaaaaccacctttgtaactaagacggtgatgtaa

SEQ ID NO: 3049 - DNA, 183 bp, Proteus mirabilis
acagcgtcaaggctaaattattgcatttttttcttgcaaagttcggttgagctggctaaattagccagcccaatcatttataatcatacagtattgtttgagtatcctgaaaacgggcttttcagaatagtactgtataaagttaatttaggagtgcatagtggcccgtatagcaggcattaa

SEQ ID NO: 3050 - DNA, 399 bp, Proteus mirabilis
agacagatgagcatgcaagatcccatcgcggatatgctgacccgtatccgtaacggtcaggccgcgaataaagttgcggtcacaatgccttcctccaagctgaaagtggcgattgccaacgtgcttaaggaagaaggttatatcgaagattttaaaattgaaggcgacactaagccagaactggaaatcactttaaaatatttccaaggtaaggctgtagtagaaagcattcagcgcgtaagccgtccaagtctgcgcatctataaaagaaaagatgagctgccacaagttatggcaggactgggcatcgctgttgtttctacctcaaaaggtgttatgactgatcgtgcagctcgccaagcaggtcttggtggcgagattatctgctacgtagcttaa

SEQ ID NO: 3051 - DNA, 639 bp, Proteus mirabilis
gatagttggagaaagaaaatggcaagatatttgggtcctaagctcaagctgagccgtcgcgaaggtacagatttatttctgaaatctggcgttcgggcgattgacaccaagtgtaaactggaacaagcaccaggtcagcacggcgcacgtaaaccgcgtctgtctgattacggtgttcagttacgtgaaaaacaaaaagtacgtcgtatttacggtgttctagagcgtcaattccgtaactactacaaagaagcaacacgtctgaaaggcaacacaggtgagaacttacttactctgttagaaggtcgtctggataacgttgtttatcgtatgggctttggcgcaactcgcgcagaagcacgtcagatggttagccacaaagcaatcatggtaaatggtcgcgtggttaatattgcttcttatcaggtttccccgaatgacgtagtcagcgttcgtgaaaaatcgaaaaaacagtctcgtattaaggctgctttagagctggctgaacagcgtgaaaagccaacatggctggaagttgatgctgctaagatggaaggtgtgttcaaacgtattcctgaacgtactgacttgtctgcggacattaacgagcacctgatcgtcgagctttactccaagtaa

SEQ ID NO: 3052 - DNA, 201 bp, Proteus mirabilis
agaaattctggggtaatgaccatggctaagactattaaaattactcaaacacgcagtttaatcggccgtctgcctaaacataaggcaactatggctggtttaggtctgcgtcgcatcggtcacactgtagaacgcgaagatacaccagcagttcgcggtatgatcaacttggtttcctatatggttaaagttgaggagtaa

SEQ ID NO: 3053 - DNA, 315 bp, Proteus mirabilis
ggagatgctggcatgatccgtgaagaacgtctgctgaaagtactgcgcgcgccgcatgtatctgaaaaagcttctatcgcgatggaaaaatcaaacaccatcgttctcaaagttgctaaagacgcgaccaaagcagagattaaagcagctgtacaaaaactgtttgaagtcgaagttgaaagtgttaacactctgctgatgaaaggcaaagtgaaacgtcacggtcagcgtattggtcgtcgtagcgactggaaaaaagcttacgtcaccctgaaggaaggccagaatctggacttcgtcggcggcgctgagtaa

SEQ ID NO: 3054 - DNA, 240 bp, Proteus mirabilis
acgccccaaggtgttacagggtgtttaccaaagttacgaccttcaccaccaccgtgtgggtggtctactgggttcatcgcagtaccgcgaacggtaggacgaataccacgccagcgacttgcaccagctttacccagaacgcgtaacatgtgctcagagttacctacttcaccgatagttgcacggcaatcagaagggatcttacgcatttcaccagaacgcagacgaatagtgacataa

SEQ ID NO: 3055 - DNA, 213 bp, Proteus mirabilis
gaggtttttatgtctagcaaatatcagcaccaaaaaggtgtgatcaaagataatgcgttagctgcacttgttcatgatcctttatttagacaacgggtagaaaaaaataagaaaggcaaaggcagctatatgagaaaggcaaaacataataagaaaggtaactgggaggccagtgataacaaatattttcaattgttatcactggccttttag

SEQ ID NO: 3056 - DNA, 417 bp, Proteus mirabilis
ggggtggttatggcttttttcaaagagtttcgtgaatttgcaatgaaaggcaatgttgttgacatggcagtcggtgtcatcattggtgcagcattcggaaaaattgtttcatccttagtagctgatgtgattatgcctccattaggcttactcattggagggatcgattttaaacaatttagtttagtactaagagaggctcatggggatatacctgccgttatcttaaactatggtgcctttatacaaactgtttttgattttgccattgtcgcgtttgctattttctgtgcgattaaattaattaataagatgcgcagacaagaagaagaacaacctaaagcaccacctgcaccttcagcagaagaaactttattaacagaaatccgtgatctattaaaaaatcagcaaaaataa

SEQ ID NO: 3057 - DNA, 363 bp, Proteus mirabilis
ggtaacactatggataagaaagcagctcgtatccgtcgtgcgacccgcgcacgccgtaagctccaggaactgggtgcgactcgcctggtggtacatcgtacccctcgccatatttatgcgcaggttattgcaccaaacggttctgaaactttggtggccgcttctactacagaaaaagctatcattgagcaactgaaaaacactggaaacaaagaagcagcagcagtagttggtaaaattgttgctgaacgcgctctggaaaaaggtatcaaatcagtatcatttgaccgttccggtttccaatatcatggtcgagtccaggcactggcagatgctgcccgtgaagctggccttcagttctaa

SEQ ID NO: 3058 - DNA, 243 bp, Proteus mirabilis
tgcggatccttcgccgcccgtggtgaagaaaatgaggtcgttattatgtatgtctgtctgtgtcatggtgtgagtgataaaaaaattatctctactgttcataaacatcaaattcgaacaatcaatcaattgcgtcaaatcctacctgtaggcagttgttgtggtaaatgtatacgtcaagctcgtcaacttatagatgatgaacaacacctcctttatcctcaaatttctgaagttgcataa

SEQ ID NO: 3059 - DNA, 822 bp, Proteus mirabilis
cgaaggtccttctatgaagcgcattatgcctcgtgcaaaaggccgtgcagatcgtattctgaagcgcaccagccacatcactgtggttgtgtccgatcgctgagactctggagactagcaatgggtcaaaaagtacatcctaatggtatccgccttggcattgtcaagccttggaattccacatggtatgcgggtaccaatgaattcgctgacaacctagacagcgattttaaagtgcgccagtacttaactaaagaactggcaaaagcatctgtatctcgtatcgttatcgaacgtcctgcgaaaagcatccgtgtgactattcacactgctcgcccaggtatcgttatcggtaaaaaaggtgaagatgtagaaaaactgcgtaaaaacgtagcggatatcgctggcgttcctgcgcaaattaatatcgccgaagtacgtaaacctgaactggacgcaaaattagttgctgacagcatcacttcacagctggaacgtcgtgttatgttccgtcgtgctatgaagcgtgcggtacagaacgcaatgcgtttaggcgctaaaggtattaaagtggaagtaagtggtcgtttaggcggcgctgaaatcgctcgtactgaatggtatcgtgaaggtcgtgtacctctgcacactctgcgtgcagatatcgactacaatacctcagaagcacatactacttatggtgtgctcggcgttaaggtatggatcttcaaaggtgagatcctgggtggtatggctgcggttgaacaggcggaaaaaccagccgctcaacctaaaaagcagcagcgtaaaggccgcaagtaa

SEQ ID NO: 3060 - DNA, 567 bp, Proteus mirabilis
ggtaagacaatggcaaaaataatgccgtttacgcatccatctgagcaagaaaaatgtcctgaatgtggcagtgatttaattataagaaatggtggccatggcccttttctaggatgttctgcttatcctaattgccattatattaaggcgttgaaatctcaaggcgatggacaggttattaaagtattagaaggacagccttgccaatgttgtggcgcagatttagttttacgacaaggtaagtttggcatgtttataggctgtagcaattatcctgcttgtgagcatatagaacaaattgataaacctgatgagactgtgattcattgtcctcagtgcgagaagggcaaattattacagcgtaagtctcggtttggtaaaatattttatgcttgtaaccaatatcctgaatgtcaatttgtactaaataataaaccgattaatggtgagtgcgaatattgtcattatccattattgatggaaaagaggtcttctcaaggagtaagattagtgtgcgccagcaaattgtgtggcaagcaacaaacaaaaagagaagaacatgaataa

SEQ ID NO: 3061 - DNA, 1386 bp, Proteus mirabilis
gaactgacgatgaaaattattatcttaggcgcaggtcaagtgggtggcactctcgctgaaaatcttgtcggtgagaataacgatattactgttgtcgatactgatgctacccgtttacgtcaacttcaagataaatttgatttaagagttgtaaatggtcatggatctcatccgagagtcttaagagaagcgggggctgaagatgcggatatgctagttgccgtcacaaattctgacgaaacaaatatgatagcatgccaagtcgcttatactttatttaatactcccaataaagttgctcgtatccgagcctctgaatttgttcgtgaagcagataaactttttttaccagaagcaattcctattgattacctcatctccccggaacacctcgttatagattatatctataaactaattcaataccccggtgccctacaggtagtaaactttgctgaaggtcaagtcagtatcgtggcagtaaaagcctactatggtggatcacttgtgggtaatgcactatccactctacgtgatcatatgccacatattgatactcgtgttgcggctatctttcgccaagatagacctattcgccctcaaggatcgaccattattgaagcgggtgatgaggtctttttcgtggtggcatcacaacatattcgcgcagtaatgagtgagctacaacgattagaaaaaccttataaacgcattatgattgttggtggcggaaacgttggagcaggattagcggcaagattagaaaaagattatagcgttaagctgattgagcataatcaacaacgtgctaccgagttagcagagctcctccatgatactatcgtgttttatggtgatgcatctgatcaagagctactcgctgaagagcatattgagcaaatcgatgtctttattgcactcactaatgatgatgaagcaaatatcatgtccgcaatgctcgcaaaacgtatgggggcaaaaaaagccatggtacttattcaacgcagtgcttatgttgatttagtccaaggtggagtcattgatattgccatctctccgcaacaagccactatttcagcactattaggtcatgttcgcaaagcagatattgtcagtgtctcctcattacgtcgcggtgttgctgaagctattgaagccattgcacatggtgatgaaaatacctcaaaagttgtcggtagacgtattcaagatatcaaacttccgccaggcacaattatcggcgccattgtccgcaatgaagatgtcattattgccaatgcaagtcactcaatagaacaaggtgaccatgtgatcatgtttattacagataaaaaatatgttcctgaagtagaaaaactgttccaacctagtccatttttcttataa

SEQ ID NO: 3062 - DNA, 342 bp, Proteus mirabilis
gaggaagagatggaaactatcgctatacatcgccacgctcgttcttctgctcagaaggttcgcctggtggcagacctgattcgcggtaagaaagtgtcgcaagctctggaaactctgacctataccaacaagaaagctgctggtttagtgaagaaagtactcgagtctgctattgctaatgcagaacacaacgatggcgctgacattgatgatctgaaagtagctaagatctttgttgacgaaggtccttctatgaagcgcattatgcctcgtgcaaaaggccgtgcagatcgtattctgaagcgcaccagccacatcactgtggttgtgtccgatcgctga

SEQ ID NO: 3063 - DNA, 204 bp, Proteus mirabilis
gacggtgatgtaatgaaagcaaaagagctgcgcgaaaagagcgttgaagagctgaacactgaattgctgaacttactgcgtgagcagttcaatctgcgtatgcaggcagcaagtggtcagttacaacagtctcatctgttgaaacaagtgcgtcgtaatatcgcacgcgttaagactttactgactgagaaggcgggtgcgtaa

SEQ ID NO: 3064 - DNA, 516 bp, Proteus mirabilis
ggtaggagtgtaagatggctcacatcgagaaacaagctgggcgaactgcaggaaaagctgatcgcggtaaaccgcgtatcgaaaaccgttaaaggtggtcgtatctttagcttcaccgctcttacagtagttggtgatggtaatggccgcgttggttttggatatggcaaagctcgcgaagttccggcagcaatccagaaagcgatggaaaaagcccgtcgcaatatgaaaaccgtcgctttaaacaacggtactctgttccaccctattaaaggtactcatacaggttctcgcgtatttatgcagcctgctcatgaaggtactggtatcatcgcaggtggtgcaatgcgtgcagttctagaagtggctggcgttcgtaacgtactggctaaaacctatggttccacgaatccgattaacgtcgttcgtgcaacactggacgctttagatagcatgaagtctccagaaatggtcgcagctaagcgtggtaaatccgttgaagaaattctggggtaa

SEQ ID NO: 3065 - DNA, 366 bp, Proteus mirabilis
gagtgcatagtggcccgtatagcaggcattaacattcctgatcataaacataccgtaatcgctttaacatcgatttacggcattggtaaaactcgttcacaggctatctgtgaagcaacgggtattgctgaaaatgttaagatcagtgagctgtctgaagagcaaatcgacaagctgcgtgacgaagttgccaaatacgttgtagaaggtgatctacgtcgtgaagttaccctgagcatcaaacgtctgatggatcttggtacttaccgtggtttacgtcatcgtcgtggtctaccagttcgcggtcagcgtactaagactaacgcacgtacccgtaagggtccgcgtaagccgatcaagaaataa

SEQ ID NO: 3066 - DNA, 519 bp, Proteus mirabilis
attatggcagtattacacgtattacattatccagacgagcgccttcgcaccattgcaaagccagtcgaaaaagttgatgccgaaattcaaaaaattgtcgatgatatgtttgaaacaatgtatttggaagaaggtatcggtttagctgcgacacaggtggatatccaccagcgcatcatcgtcattgatatctctgaaacacgagatcaaaaactggtactcattaatccagaacttcttgatcaggaaggtgataccggaatagaggaaggttgtttatcaatacctgaacaacgcgcatttgtgcctcgtgcagagcgcgtaaaagtaagagcgcttgattacaacggacaaccttttgaattagaagctgatgacttactcgctatttgtattcaacatgagatggatcatttagttggcaaattatttgtggattatttatctccattaaaacgccaacgtatccgccagaaagttgaaaagctcgataagagaagagcaaaagcgggacaatag

SEQ ID NO: 3067 - DNA, 318 bp, Proteus mirabilis
ggcagggcattcatggctaagaaatctatgaaagcacgtgatgtaaaacgtgcgaatttagctgagaaattcttcgcaaaacgcgcagaactgaaagctatcgtttcagatgtaaacgtatctgatgaagatcgttggaatgctgttctgaaactgcaaacactgccacgtgattcaagtccttcacgtcagcgtaaccgctgccgtcaaactggacgtccgcacggtttcctgcggaaatttggcctaagccgtattaaagtccgtgaagccgctatgcgcggtgaaatcccgggccttagaaaggctagctggtaa

SEQ ID NO: 3068 - DNA, 618 bp, Proteus mirabilis
gttttagattcgaagacggcaaaaaagttcgtttcttcaaatctaataaagaaactatcaagtaatttggagtatacgatggcgaaactgcatgattactacaaagacgaggtagtccaaaaactgatgtctcagtttggttaccattctgtcatgcaagtccctcgggtcgagaagatcaccctgaacatgggtgttggtgaagcaattgctgataaaaaactgctggataatgcagcagctgatttagcagcaatctcaggtcaaaaacctctgatcaccaaagcacgcaaatctgttgcaggcttcaaaatccgccagggctatccgatcggctgtaaagtgaccctgcgtggcgaacgcatgtgggagttctttgaacgtctgatctctattgctgtaccacgtatccgtgacttccgtggtttgtccgctaaatcattcgatggacgtggtaactacagcatgggcgtgcgtgaacaaatcatcttccctgaaatcgattacgataaagtggatcgtgttcgtggtttggatattaccattactacgactgcgaaatctgatgatgaaggtcgcgcattgttagcagcgtttaacttcccgttccgcaagtaa

SEQ ID NO: 3069 - DNA, 1680 bp, Proteus mirabilis
atttttaactcctgtatgggggaaaacatggttgcattagataaagatttgcaatcccgacaactggctcgcgagctagttcgtaatgcgaaaaatgcgcaacaacaatatgcgaaattttcgcaggaaaaaatcgacaatatagtcaaacacattgcatttgaagctgctcgtcacgcagaagagttggcaaaaatggccagcgaagagaccggctttggtaaatggcaagacaaagtactgaaaaatacctttgcgtcattgcgtgtgtatgaacatatgaaagacctaaagaccattggcattatcaatgacgataaagtgaaaaaagtcatggatgtgggggtacctttaggggttattacagcgttagtgccttccactaacccaacgtcaaccattatctataaaaccctaattgcactgaaagcaggtaatgcgattattttttcaccgcaccctaatgcgaaacagtgtagtttccgcgcgctagaaattgtcaaaaaagccgcactagaagcgggagcacctgagggaattgtcgatggtgtgacattgctgacattggaagcgacaaaagaattaatgcacagcaaagatgtgtcattaatcttagctactggcggtgaaggaatggtgcgtgcggcttatgcatcaggcacaccaactatcagtggtggtcctggtaatggccctgcctttatcgagcgtagtgcggatatcaaaaaagcagtgagcgatatcatcaccagtaaaacatttgataatggcgtgatctgcgcttcagagcaatccatcatcgtagaacgttgcatttataacgaagttcaccgtgagctattagcgcaaggtgcttattttatgaatgatgaagaagcagcgaaagtcgcttctatgttattgcgcgctaatggcacgataaatcctgcggtggttggtaaagatgctatctatttaagccagcgcgccggttttactgtacctgctaatacccgcgtcttgattgcactacaagatactgtttcaccgaagaatccctattcacgggaaaaactgtgcccaatcttaggtatgtatattgaagaagattggcaatcagcctgtcatcgtgtggtgcaattgctcactaacgaaggcttaggtcataccttagtgatccatacccaaaatgaagatgttattcgtcagttctctttagaaaaacccgttaatcgtattttaattaatactccggcggcattaggtggtattggcgcaacaaccaatattactcctgcgttaaccctaggttgtggtgcggtaggtggtggttctagctcagataacgtcggcccgatgaatttactgaatattcgtaaagtcggttatggggtacgtagtgttgaagagttaaaacaaccttgtccattagcacaagaagctgctcaacctgctgtttctagcgcaaattaccacaccagcattcttgatgatgatcgttttcgttcaccttctttaacccctgttcatgcggaatgtgcaacagcacaacgtcaaacacaaggtgatgatcgctttggcgcgtccccttatacaacgacagtcagtgcgtgtgcacaacaagtgattgagcaaggtgagatcaccgaagagaacgtggagcgcattatcaaagaagttctcggacgtctgggtaaataa

SEQ ID NO: 3070 - DNA, 1896 bp, Proteus mirabilis
gtaatgccgtcaccctgtgtgaataaaggaagcactattatgaacccgaaaaatcatgaccagtttcagaacaacttcgccgcattaaacgaaaccgtacaacaagtgactgaacgtattgttgctcgctcacaaataactcgtcgcgcttatctgaaaaaaattgaagctgctaaaagccaaaccgtacaccgtgcccagttagcttgcggtaatttggctcatggttttgccgcctgtcaaagtgaagataaaaatttacttaagaatatggttcataatgatatcgccatcattactgcatataacgatatgttatccgctcataaaccttatgaagattatccacaaaaaattaaagcggcattgcatactgttggcgctgtaggtcaagtcgctggtggtgtgcctgcgatgtgtgatggtgtgacacaagggcaagatggaatggagctatcactgctaagtcgcgatgttattgccatgtctgcagctgtcgggttatctcataatatgtttgatggcgccctttatttagggatctgcgataaaatcgttccagggcttactatggcagcactgtcattcggtcatctgcctgcaatttttgtccctgcaggtccaatgaccagtggtttacccaataaagaaaaggtgcgtattcgccaactgtatgcagaaggcaaggtcgatcgtaatgctttattagaagcagaagcagcctcttaccatagtatgggaacttgtactttttatggtacagcaaactccaatcaaatggtgatggaagcaatgggcttacatttacctggctcctcttttgttcatccagatactccattacgtgaagcattaacagaagcggcagcaaaacaaattgtacgcttaacagaaaactcggggaattatttacctattggtcaattagttgacgaaaaggtgattgttaacggtattattgtgctgttagccacaggtggctcaacaaatctcaccatgcatttagtggcaatggcacgggcggcgggcattatgattaattgggatgatttttctcaattatcacaagttgtgccattaattgctcgtatttatcctaatggtccggcagatattaaccaattccaagcggcaggaggccttgctcttattattcgtgaattactgaaaaaaggcttaattcatcgcgatgtcaatacggtggcaggatttggtattgaacgctataccttagagccgtggctaaatgaaggtaaacttgattggcgtgaaggtgcaatacaatctttagataaagatgtgattgccgatatcaataagccattctcttcacacggcggaacacaggtgatggaaggtaatttaggtcgagcagtgatgaaaacgtcggcggtgcctgatgaaaataaaattattgaagcacctgctgttgtgtttaatagccaacatgatattgccgctaaatttagcgccggtgaattgaataaagattgtgtagtcgttgtgcgttatcaaggtccccaagccaatgggatgccagaattacataaactcatgcctcctttaggggtattgatggataaaggctataaagtggcattagtcacagatggccgtctttctggtgcatcaggtaaagttcctgccgctattcatgtaacaccagaggcggtaaacggtggactattagcaaaagtacaagatggtgacattattcgtgttaatggcaaaacaggtgaattaacactcttagttgatgaacaaaccttagaagctcgccaaaccgaaatacctgatctcagcgcaaacaatagcggttgcggtcgtgagttattcgttaatttacgtcgccatttatcaggtgctgaacaaggtgcttgctgtattgatttttaa

SEQ ID NO: 3071 - DNA, 207 bp, Proteus mirabilis
ccattttctcctttaaattcatttgaatatgaacttttaaaagccaattcctttggtttattttctaatggttttgatacattcataaaagtaaatgatactataaaaaatgcaataacaaatataaatgatacaatgatttttctattaattgtccatttttttgaatttaaatcaaaagatgttatagacaaatcatctttatga

SEQ ID NO: 3072 - DNA, 198 bp, Proteus mirabilis
gaaaaactgttcaatatgtgtatttaccgcaacaaaaacatcaggttttttaacctgatgtgtataaataacctttccttctgccgcttgagttggcaaaaagaagctataaaaaatgataattccaatgatacagtaaattttattttttatgttcataaagatattggccaattcgccgaaattcagttggtgtaa

SEQ ID NO: 3073 - DNA, 1347 bp, Proteus mirabilis
aaagtgagtactaatatggaaacggcttcctcaaaaacagagacaacaagctatcccgcaactagtgctggcgctcgccgagcaggtatgacagaagaacaatggcgtgcagcaattaaatttgacggcaatgatgtgggctgggttatcatgagtatcggtatggctatcggtgcagggattgtttttttacctgtacaggttggcttaatgggattgtgggttttcttactttcctccgtgattggttaccccgcaatgtaccttttccaacgcctatttattaatacgttggctgaatctcctgagtgtaaagactacccaagcgttatcaccggttatctcggtaaaaactggggtattttattaggtgcactctattttgtgatgttagtgatttggatgtttgtctattccacagctatcacgaatgacagtgcttcttatctacaaacttttggtgtgactgacggtttattatcagaaaatccgttctatggtctgattttaatctgtgcgttagtggctatttcttctcgtggtgaacaattactgtttaagctatcaagctttatggtaatgacaaaactactggttgttgcggcattaggtctttcaatgattggtatgtggcatctgtataatgttggcgcattaccacctgccggacgtttaattaaagaagccattatcacactaccttttacattaacttctattttgtttatccaaacattaagcccaatggttatctcttatcgtagtcgtaaccaaaatcgtgaagtagcgcgtcataaagcattacgtgcaatgaatatcgctttcggtgtgttgttctgtacggtgtttttctatgcggtctccttcacattagcaatgggacatgatgaagcagtaaaagcttatgagcaaaatatctctgcattagcgattgcggcaaaattcttccctggtggttgggtaaccgtagtgagtgtgatgctgaatattttcgcagtaatgaccgcattctttggtgtctatctcggtttccgtgaagcaacacaagggattgtgatgaatattctgcaacgcatgatgcccgttgaaaaaatcaatgaaaaatgggtacaaaacggcattatgatctttgctgtgctgttagcttggggcgccattattctcaatgcaccagtactgagctttacctcaatttgtagtcctatctttggtatggtcggttgtcttatccctgcatacctagtgtacaaagtaccgatgttacataaatacaaaggcgcatcactttatctgattatctttacgggtttgctactttgtgtttctccgttcttggcattctcatag

SEQ ID NO: 3074 - DNA, 342 bp, Proteus mirabilis
ataaggataaccattatgtttaccggattcttatggctggcgctgtctattggttctgaaatcacaggcacctcaatgattaaaaagaccaatggctttagtaaattagccccctctgttttagtgattgccgcttactgtatttgctatttcgccttaacacgtgcaatgggctatatccctgttggtgtggcatattccttgtggtgtggatttggtattgttggggtaacattagttgccatgattttatataaacaaaaacccgatctacccgctatattctcaatggcattgattatctctggtgggataattatgaataccttttcaacgatgtaa

SEQ ID NO: 3075 - DNA, 444 bp, Proteus mirabilis
acgaggataacaatgaaaattgatcctttccgcgcacagcaggtatataactctccttcgactttatctagtgctaacaatatttcgagaaaaggatcagatcctattatcgaaaatttgaaactgactttttatcaagatttaagcaaagcggatcttagccatgctaatgatattcttactttattagaccaatttgatgtcaaagatggaggcaatcaaacgttaaaagagaagcgacaaatagccttattggtttatgctcaccaacaaagtgaattagagcatcatgaaaataaaaacttgattaatcaagcactcgtttcgcgactctcttatcaaggtttttatcatcaagtcaccctagaattattaggtatgattgataacaatgatgaattcgaaggtttttttaagcctgatagggtgacattttcattgtga

SEQ ID NO: 3076 - DNA, 1383 bp, Proteus mirabilis
aggaatacaacaatgaaagataatactgcaacaccttcatcaccttttactatcgccaaatttggtggcactagcgtggcaaattttgcggcgatggaaaagtgtgcagatattatcttaaaacagaaatcagtccgtgtggtggttctttctgcttcagcggggatcaccaatttgcttatcgaacttgcgacaggtgttgaagcaacacaaagagccgctttattggctcaagttcgtgatattgaatacgccatcatcaatcaactatcacaagcagaaattatttctcaagaaataaaccgcttattggaaaatattgaaatgctgtcagaagcggcagccttggcaacttctgatgcgttaaccgatgagttagtcagccacggtgaattgatgtcaacgttattgtttgttgaactgttacgtgaaaaaggaataagtgcagattggtttgatgtcagaaaagtgatgaaaaccaacgatctgttttgtcatgctgagccagatatggcgcaattaactgagttaacacaaagtttaattcagccccgtttaacagaaaccgtgattgttacccaaggttttatcggacaagagcctaaaggaaaaaccaccaccttagggcgtggcggaagtgattatactgcggcactgattggtgaagcattagggatgtcacgtgtcgatatttggactgatgtgcctggtatttatagcactgatccaagaatagtcccgcaagcacatcgtattgatcatattgcttttgatgaagcggctgaaatggcaacctttggtgctaaaattctccatcccgcaacattattacctgcagtgcgtagtgggatccctgtgtttgtcggctcaagcaaagcaccagaagaaggtggcacattggtttgtgcacaaactgataatcctcctgtgtttcgtgccattgcactacgtagaaaccagacactacttaccctgcatagtttgaaaatgcttcatgcccgtggctttttggcagaaatatttaccattttatcacgccaccatatttcggttgatgtgataaccacatcagaagtcagtattgctttaacattggataccacaggtaccactagctcatcaggcagtctgttaactaatgctttattaacagaattatccgcattatgtcgcgtggaagtagaagaagatctggcattggtcgctatcattggtaattcactatcgcaagtaaatggcttaggaagccagatttttggcactttagaggattataatattagaatgataagtcatggtgcgagtacccataacttatgtttattagtggatggcaaagatgcagataatattgtcagaaaactacacgatacgttattttaa

SEQ ID NO: 3077 - DNA, 3750 bp, Proteus mirabilis
gataaaaaaacaacgaacttgctatataacgaaaataacaacaacacaatattctttggtagaggaagcaatgtgaccatgataactcagcagattacgcaagcattagccaaacgtatcttagtccttgatggcgcaatgggaaccatgatccagcaatatcagttggcagaagaagattaccgaggtgaacgttttgcccattggcaatgtgatgttaaagggaataatgaccttttagtcttgacgcagccgcagatcattactgaaattcataatgcttattttgaagccggtgcagatatcgtagaaacaaacacctttaatgcaacctctattgccatggctgattatcagatggaagggttatgtgcagaattgaatgaagaggctgctaaacttgccagagcctgtgctgataaatggagtgcattaacgccagataaaccacgttatgttgcaggggtattagggccaaccaatagaacagcatccatttctcctgatgttaacgatcccgcatttcgtaatatctcatttgatacattagtgatggcttatcgagaggcgatctgcggactcattaaaggaggggtggatttaattatggtggaaaccatttttgacactctaaatgctaaagcggctatttttgcgattaaatgtgagtttgataatcttaatattgaattaccggtgatgatctcagggactatcactgatgcgtcaggtagaacattaacagggcaaaccacagaagcgttttatcactcactacgtcatgccgacgcgttatcatttggtttaaattgtgcgctagggccaaaagaattacgccaatatattcaaactctctcccaaatatcagaaacttatgtcagtgctcaccctaatgctggcttacctaatgcctttggcggatatgatttagatgccaatgagatggcggaacaaatcaaggagtgggcgcaagctgggtttcttaatattgtcggtggttgttgtggcacaacccctgcccatattcaggctattgctcaagcggttgatggcatagcacctagaacattacctgtcattaaaaaagcctgtcgactctcaggtcttgagcctttggtcattgatgataattcgctgttcgtcaatgtgggggaacgaacgaatgtgacaggttcggctaaatttaaacgtttaataaaagaaggtaattaccaagaagcccttgatgttgctcgtcagcaagttgaaaacggtgctcaaatcatcgatatcaatatggatgaaggcatgttagatgcgatagaagcaatgacacgttttcttaatcttattgcgggtgaacccgatattgccaaagtcccgattatgattgactcgtcaaaatggcaagtcattgaggaaggattgaaatgtattcagggtaagggaatagtcaattcgatttcgatgaaagagggggaagccctttttattgagcatgcaaaattagttcgtaagtatggtgctgcagttgttgtgatggcatttgatgaaatagggcaagcagatactcgagagcgaaaaatagaaatttgtcggcgtgcgtatcatctattaactgaaaaagctggatttccaccagaagatattatttttgatcccaatatttttgctgtagcaacgggtattgctgaacataataattatgcggttgattttatagaagtttgtgcggatattaaatctcaactgccttatgctttaatttctggcggtgtttctaatgtgtcattctcttttcggggcaatgatcccgttcgggaagcgatccactccgtttttctctattacgctgtaaaaaatggtatggatatggggattgtcaatgctgggcaactcgctatttatgactcattagcggatgaactacgtaatgcggtagaggatgttattttaaatcgccatgcagagagtactgataatttactggcactcgcagagcgttatcgtggtactaaaagtgaggaacagcactctacgcttgcgcaatggcgacaatgggaggtcgaaaagcgcctagagtacgcgttagtgaaagggatcaccgaatttatcattgaagatacagaagcgtgccgccaacaagcttcgagtcctatcgaagtgatagaagggccattaatgaatggcatgaacacagtgggcgatctgtttggtgaaggtaaaatgtttttaccccaagtagtaaaatcggcacgggtgatgaaacaggccgtagcttaccttgaaccttatattcaagcgacaaaaaaagcaggcagctcggcaggaaaagtgttactggcgacagtaaagggagatgtccacgacattggcaaaaatattgtcggagtggtgttgcaatgtaataactatgaaattatcgatctgggggtcatggtaccttgcgataaaatcttgcaaacagccattgacgaaaatgttgatattattggattgtctggattgatcactccatcactggatgagatggtgaatgttgctaaggagatggaaagacgcggtttttctcttcctttaatgattggtggtgcgacaacatcgaaagcgcacacggcagtaaaaattgaacctaattacagccacccaaccgtttatgtgcagaatgcgtcaagaacggtcggggtggtcgctgcattattatcggccacacaaaaggctgattttgtcgctaaaacacgccgtgaatatgaagtggtacgtcagcagtatgcgagaaaaaaaccgcgtacgcctcccgtttccttagcgacagctcgtgccaatgcattgcagcttgactggcaacactatacgccacctaagccgaaccaattaggggtacaacaagttacagccaatattgaaactttacgtgagtatatcgactggacgcctttctttatgacttggtcattggcggggaaatatccacgtatattagaagatgaggttgtcggagaagaggcaagacgcgtttttgcagatgcgaatgccatgttggataaactcagccgtgaaaaattactgacaccgaaaggtatcgttggtttattccctgctaatcgccttggtgatgacattattatttaccaagatgaaacgcgacagcatgagttattacgttgttgccatttacgccaacaaacagaaaaaaaagagtaccctaactattgcttagcagactttattgcccctgtggatagtggtcttgctgactattttggtgcttttgcagttaccggcggtctagaagaagatgcactcgctaatgggtatgataatgctcatgatgattacaataaaattatggtaaaagcgctatccgatcgtcttgcagaagcttttgccgaatatttgcatcaacaagtgagaaccaaaatttggggttacagtcctgacgaagcgctctctaatgacgagttgattagagaaaaatatcaaggaacacgacctgcaccgggatatccagcttgcccagagcacacagaaaaagcaaaaatttggcaactgttaaatgtagaaaatcgcattggtatgaagcttactgatgcttatgcgatgtggccgggggcttcggtatcgggttggtattttagtcatcctgaaagtaaatattttgccgtcgctcaaattcaaaaagatcaggtagaagattacgccaaacgtcgtggtatgagtatgagtgaagttgagcgttggttagcccctaatttaggttatgagccttaa

SEQ ID NO: 3078 - DNA, 273 bp, Proteus mirabilis
ctttggaaaacggtatttacaaaacgctgttctgctggaatatgggtaatatcctgtccatctaggataatttgtccatcatccgcgtcttctaagcccgcaattaaacgtaataccgtcgtcttaccacagcctgaagggccgagtatggttaaaaactcgccatggttgatagtcagatcgaggcgggaaatgatttgttttccgtcgaaacctttacttaaggattttaattcgactagtggtgtcagagatgttttctcagtcatttaa

SEQ ID NO: 3079 - DNA, 258 bp, Proteus mirabilis
tttatggctgcgagtcttgttgaaacagatgtaagttcaattagtaaagttgaccaatattttcataaacctgtgaaaacccaaagctatgagttatctgaagccttagaagcattaaaagctgatacatctaatgccgcggcattagccgaatatcaagccaaacttgccgaatataatattacacgtaatgcccaatctacatcaatcaaagtcattaaagatctagcaatgagtattattggtaatatgcgttaa

SEQ ID NO: 3080 - DNA, 1290 bp, Proteus mirabilis
ataatgaacgcccgatttctaatgtttcataacgcagcgcatcctttacgaatacaaggaaatattttagaagtgatgttacgtgatgtttttattggggaggtctgccaactaaaagagaatattttcagtgaaaatattctcggtgaagctattgttattgggtttcataataacatagcaatattaagtatgatgggaagcgctcaaggttactctttacaaattatagttgagccaacaggaaaaacattttcagttgccctaggcccacatatattaggcagcatgattgatagtaaagggaattgcttattacgatttaatacagaaatagcagagaagacctttaataccttatgtcctatcgaaggtcggccacctttgtttagtgataggctgcctattacaacactatttaagtcaggtatacgtgctattgatggattattaagttgtggattggggcaacgaatggggatttttgctagtgcaggaacgggtaaaacgatgttaatgaatatgattatccgttttgcacaggccgatgtttttgttattggcttgattggtgaacgaggaagagaagttacagagtttattgaagaattaaagcaacataagcgatgtgaaaatacggttttaatttgctcaacttcagaacaatcagcggtagaaaggtgtaatgcggctttagtggcaacaacggttgccgaatattttcgtcaacaaggaaaaaatgccgttttatttattgattctatgactcgttattgtcgagcattaagggatatcgcattaacagcgggtgagttgcccgtacgtaaaggatatccagcatctgtatttgataaacttcccgctattttagagcgtccaggggtaacaaaaacaggctccattacggcattttatactgttttattagagagtgatgatgagccagatgcgatcggtgaagaaattcgttctattttagatggacatatttatttatctcgaaaaatagcagcatcagggcactatcctgctattgatgtattaggtagtgtgagtcgggtttttcaacaagtcactgatagtaaacaacaaaaatctgctttaaaaataagacaaatattgatgcgattacaagatgttaagttattgcaagaattaggagaatatcatgaaggagataaccaattaaatgatatcgcggtaagaaaacaagccaagatagaaagctttcttactcaatcctttaaagaaaaagtcgattttcaacaaacatttggaacaaatgtatga

SEQ ID NO: 3081 - DNA, 1011 bp, Proteus mirabilis
gtaattcaagcaattaccccgattctgttttactatcggctatatagagaaaaacttaaatctgaaggtataaacatgatatccagtacatcaaaaggaacactctatggcattgtggcgatattcctttggagtaccattgttgggttaattcgcaatatcagtgagtattttggtgcggtagggggtgctgcgctgatttacacaacgggaacgctatttttgattttgatcttaggggtgcctaagttatctctttttcctaagcgttaccttgcttggggggcacttttatttgttagctatgaaatctgtttatcgctggcgctaggatttgctagtgatagagcacaagctatagagcttggcatggttaactatttatggcccagctttacactggcattagcggtattcttaaataaacagcgattctctatcctattgattgtgggtttattatgctcattcagtgggcttgtttgggttgttagtggtgataatccactgacaatagaaagcttatggaataatatttgtcgtaaccctctcagttatattttggcgtttatcggcgccgtgttatgggcattttacagtaatgtgactcgtcttatttcgggggggcacaatggtattgtgcctttctttttcttaacggcattggcactttgggggcaatatattttttctgctccaatcgagtgggtggttaatgtaaaaagtatctcactgttacttattactggggctgcgatagggttagctaatgcggcgtggacggcaggaatgatcagcggtaatgtgacattattagcgacgctttcttattttactccggtaatttctacggctttttcatccctactactctctacagcactctctttttcattttggcaaggcgttatgatggtgacaggcggctctttaatttgttggttagcgactcgtcaaaaaatgacaaaaatgccaaaaacgagcaaatcgaatgtaaaacagggttcttaa

SEQ ID NO: 3082 - DNA, 336 bp, Proteus mirabilis
atttttaaggctgatgaaatgattgatagcagcaaaacgattaattttcgtataggacaacgaatacgtcacttgcgaaaaaatttaaaatattcggggaaactatttgccaaagagttaggcataagtcagcaacaactttcacggtatgaacgaggaacaaataggatcagtattgagtttgtttatttaattactgaaaagtttgatgttcatatcagctatttcttacaaagtaactatatgattaatattgagcaacaacgaaatatacaagaaaaaaacagcctgctgattgccgaggcttgtataaaaaatggcactaatcgcccttaa

SEQ ID NO: 3083 - DNA, 201 bp, Proteus mirabilis
acaatatttctattttatttacaaataataaattttcattttaaaatttacttaaatgccccctttcagcgtgcttttttgcttaacaaaaagccatttttcgtttcattttataaaaaaactgtccataaaatacattttatgaaacatcatcttataagtataagtacgctatctttttacgatgcatcagataaatga

SEQ ID NO: 3084 - DNA, 696 bp, Proteus mirabilis
tattattattattttttaaggaaatttatgagtattgcatcctcttatgatatttgtcacattgttaaaaataaagtaaaaaataaattagatctatttttacatacaaataaatatttaaatcagctacgaagtgaaatagtgtcactaaaaaactctaacaatactcctgacagtttaaatataaataaacaaccattgataggaaaaggacttagtgaaatagaaaaaaatattgaatttattgataggatacttgatcaggaaaataaaaatctacaacaatataaaagagatttgaattcattcaagacaaaacacctaccgtatccttcttcccaaaaggatattacaaatatgaataaaacattattatctaatatttcaaacaagataagtaatataaaggatataaaggatgatttaataaaacagcgtactgaattaaataatcgtagatcattatctaaaatcaccacaatagattttttatattacgttgaacataaaccattttatataaaaaaggaaaatatatctttcagtgaaattgatattcaatgcattcacaacatgaagaaaatatatgacaacatatggtttaaaaatgtagaagataatttaaaatcaaaattatattctgatattatcaaaaaaatagataaagaaaaaccattaaataaagtagttacgtaa

SEQ ID NO: 3085 - DNA, 1134 bp, Proteus mirabilis
aaacttcactatgggatcggcggtaaaatgaataagaaattgacgttaactttatgtgcctcactatttttattaagtgcaggggcaatggtttatgcaacaatgggatctgatgaagatgaaacacagccatttgcttatccaccaacaaaagtggcattagcaaccgcgcaatctgctgaattacctaataccatgcatggtgttggagaattggaagctgctagacaagtctatttagcggcagaaacaaatgggcgcatcgccacgatccactttgcatcaggacagaccgtcaccgcgggacaaatcttagtaaaattaaatgatgagccagagcaagcggaattattacgcctacaagcacaactaactaatgcagaaaaactttattcaagaactcgccaactttatagtaaaaatgtggctgcagcagcacaattagatagtacgttatcagagcgcgatatgattgtagcctctatccgtgaagtgaaagcgcgcattgcacaaaaaacaattaaagctccctttgatggtattgtcggcataaaactcgtgcatgaaggacagtatctaaatgctggggaacgtgttgcctcattagtggatgcaagccacttaaaacttaacttttcactcgatgagcaagtggcgccacagctttcaactcatcaacctattaatattgcagttgatgcttatcctaatcaaacatttaccggctcacttaatgccatagaccctcttattggcccttctcgcactgtgcaagtacaagccattttaccgaataccgataacaaattaaaagcgggcatgtttgctcgtgttcaagttacctcccctactcgtcatcaggcattaaccgtaccagagacagcggttacttatactgcctatggggataccgtgtttgtagcgcaatctgacaatcaaaaaaaccttatcgctaagcgtgtctctgtgaaagttggattgcgctacaacggccttatcgagatcaaagaaggcttaaatcagggagatcaagttgttacctcagggcaaatcaaacttagtgatggcacctcaatagcccccatagagcaagatacgttaacactggcccaatctactactcgtcaaccataa

SEQ ID NO: 3086 - DNA, 195 bp, Proteus mirabilis
gcttatctatacgcattaaacggctatacgcctgccatttattgtgcgtcatacttccctccaattttagctccccctaactactgcttatatacaggtgatgcaggcaaaaacacctcagttaataataaaggtttatctgaaagctggaaacgggaacgacgtaaccaatgtccattttgttgcccaatatga

SEQ ID NO: 3087 - DNA, 864 bp, Proteus mirabilis
tatggacagtatttctggagtgtaagtatgaccgtctcccctaccaataaaaaagctcgtaagccaaaaacacccgcaactcaaagtactgcacaaggtggccccgttcagtcattaagccgtggcttaacattattggaatatatttccgaatctccaggcggtattgctttaactgatttagcttttcaagcaggactacccaattccactactcaccgcttacttactactttgcaacaacatggttttgtacgccaagtaggtgatttaggtttatgggtagtgggcactcatgcctttattgtcggtagtagctttctgcaaacccgtaacctactggttatggtgcaccctatattgcgtcaattaatggaagattcaggtgaaaccgttaatttggctattcttgatcaagttgaatttgatgcggtgattgtcgaccaagtacaatgtaatgcattaatgagaatgtctgccccaattggcggcaagttgccaatgcatgcatctggtgcaggtaaagcatttctatccactttaccggaaaataagttactcccccttttacagaaaaaaggtctgatggcctataccccttataccaaaaccttaccttccgcattaaaagagaatttagaacaagctcgtaaacaaggcttctcttttgatgatgaagagcatgcattaggtttacgttgtattggcgcttgtatctatgatgaacaccaccagccttttgccgctatttcactctctggccccgtatctagaatgacagattcacgcattacggaattaggtgcactggtgataaaagcggctaagcagatcagccgtgaatatggtggtgtaaaaagttaa

SEQ ID NO: 3088 - DNA, 1353 bp, Proteus mirabilis
attatgagccagaacaataattctcatttatggtcgcagtttattcgtcaattacgtgaaggtgttaagccagcagtaggttgcactgagccgatttcattggcattagctgcggcaaaagcaaccgcattattagctgagcctgttgttggtattgaagcgtgggtttcgcctaatttaatgaaaaacggaatgggcgtaacagtaccaggaacgggaatggcgggattacccatcgcggctgcattaggggcgacaggaggtaatccagatgctggccttgaagtattacttacagcatcaccacaatctatcgctcaggctaagacattggttgctgaaggaaaagtgacggttggcgtgaaaacgccatgtagtgatgtactctactccgaagcaaaagtatatggtcagtcaggttatgccattgtcagtattgctaaagagcatacccatgttgtgcgctgtgagtgtaatggcaaagttgtttttgaggatgataaaacgagtttgactcatgccggggatagcgtagaagaaaagccttttgcgacggtttgtgctgaagatatttatcgctttgcactcaatgtacctatagatcaagtcgcctttatgcttgatgcggcttatctaaatggtgctttatcagaagaagggctaaaaaatagttatggattggcgatagggcggacgctggtttcacagcaagagaatggcttattaggtaaggatttactgagtgaaatcatgataagaacgtctgccgcttcagatgcacgtatggggggcgctgtattacctgctatgagtaactcaggctccggtaatcaaggcattgctgcgacattgccggtaatggtagttgctgaatttattcaagcagatgacgaaactttattacgggcattagttttatcgcatttaatggcgatttatgttcatagccatttcccacctctgtctgcattgtgtgcggcaaccactgcatcaatgggggcggctgcgggtatggcatggctactgactaaagacttcaccactgtaagtatgtcaatcaacagtatgattggtgatattagtggcattatctgtgatggcgcgtcgaatagctgtgcaatgaaagtatcaagtagtgcagcgagtgcgtataaagccgttttaatggcgatgcaaaatcaaagtgtagcgggcactgacgggattgtcagtgatgatgttgatagttcaattgcgaatctctgcgcattagccagtcgtgcaatgcaacatacagatattcaaattattgagatcatggaagaaaaagcacgccgtaatgccggggaaaagcagcaagctgtcaatgcataa

SEQ ID NO: 3089 - DNA, 249 bp, Proteus mirabilis
aggctcccacacggcaaggtttttgaaaccaattttagagcgtggttattaatagcacacggtttacgcacttcttgtctaaacgctacaaattttgtttgtagcgtttttctttataaaaaggaatttgatattttattagagaaattaattctattagataaaactattcttttttcgtcagtcacgctgatagccgctttttatataattaacactctttttataaaaaaaagaataaatagttaa

SEQ ID NO: 3090 - DNA, 363 bp, Proteus mirabilis
aaccaaggtctgcgtttaaaaaatcaccacgcagacatgatgggtaactgtaaaccgttaaacggcttcctggaggaaataaaaatgggtgatgcattaggtctgattgaaactaaagggttagtggcatgtatcgaagccgctgatgcgatgtgcaaagccgccaatgttgaattgattggttatgaaaacgttggttcaggtctcgtgactgcgatggtgaaaggcgacgtaggggcagtgaaagctgcggtagattcaggtgtggaatcagcgcaacgggtgggtgaagtcgtcacatcacttgtgattgctcgtcctcacaatgacatcaacaaaattgttatcaaacacaaggcatag

SEQ ID NO: 3091 - DNA, 636 bp, Proteus mirabilis
ctgtataaacaaacagggggcggaatgaaagcattaactgcaaggcagcagcaggtttacgatttggttcgtgatcacatttcgcaaacgggtatgccaccaacacgggcggaaatcgcttcccaacttggttttcgctcacctaatgcggcagaagagcatttaaaagcacttgctcgcaaaggcgtgatagaaattgtctctggtgcatctagaggtatccgtttgctacttgaagaagagcctgaaggcttaccattaattggacgagttgcagccggtgaaccacttttagcgcaagagcatatcgaaagccattatcaagttgatcctatgctttttaaaccgagcgcagattttttactgcgtgttaatggtatgtcgatgaaagatatcggtattatggatggcgatctacttgctgtgcataaaacacaagatgtccataatggccaagtgattgttgcacgtattgaagatgaagtaactgtaaaacgatttaagaaagtcggtagtaagatagaactgcacgcagaaaatccagagttttcacctattatcgttgatttacgtgagcagagctttactgtggaaggattagcagtaggggttatccgtaacggcgaatggctgtaa

SEQ ID NO: 3092 - DNA, 1827 bp, Proteus mirabilis
ctcaaattgcagtcgataatggttttagttcagcatctcatttttctaatgaaattaagacattatttggtattacaccaactgaatttcggcgaattggccaatatctttatgaacataaaaaataaaatttactgtatcattggaattatcattttttatagcttctttttgccaactcaagcggcagaaggaaaggttatttatacacatcaggttaaaaaacctgatgtttttgttgcggtaaatacacatattgaacagtttttcctagtgctatcagataaattaaataaaccttttattctaagcagcgcagtaaaaaaagagcggatcagtggaaaatttgatatttcttcacctgaagacgcctttgaattaatggtaaaacgtttgtcattactttattttaatgacggagaatctatttatatttatcgcgataatgagatacagcaacagctatttcaagtgaaaaatatcagcttgagtaaactgaaagagtatctacaagatgttggattatatgatctccgctacccattacgtgcaggtcacgatcagcgtactttttatctctcaggtcctcctatttatattagcctagttaaggctgctgctgagcttttggataatgatgtacaagaacaaattaatgaaaatatcaataatcaagttccaaccggaagctctcgttatggcgatgagtttgtgcagatatttccattaaaaaacacttttgtacaagatagaacctatatattacgtgatgaaaaagtggttttaccaggtataacaacggttttgcaacagctatttatgccatcgggagagaaagaaaaaacagtcagaagagcgcgtgagattatcgaagataatgataaatatcaggatgataaaattaccaacgatatacaagatactcattcaccgattatcactcaaatgggcaaatataatgttgaactcgttcctttacctggatcaaatagcctgttggttaaaacgagtcgagaaggtttagctttagttagctcacttatttcacaattagataaaccgaaaagacaagttgaattgtcattatggataattgatatttctaaaagtaaagccgatagtttgggggtgaattggcaggggagttatggctcgggtaaaaatacatttttctttaataccgctagcttaagtgctgtatctggttttagttttttaagtaaaatcaaagcactcagtgaggaaggggaagctaaaatggtttctcgtcctattttgttaactcaagaaaatacccccgccatatttgataataacaccaccttttatacacaaattaaaggtgagcgagttgcttcattagaatctacaacattcggcactatgatcagtgtgttgcctcgtattagtaatactaaccaagagattgagatgattatcaatcttgaagatggcgccgagaaaaaaagtgatgatgaagatagagaagaagggattgaaaaattacctgttattaatcgcacaaatatcagcaccgtggcccgagtttctgaaggcggtagtttattaattggtggatatacacgagaagataacataaaagcagaaaacaaaattccttttttaagtgctatacctttagttggccgagcatttagctatcagtcagataataataaaaaaatggtgcgtatttttatgttacaaccgcgtttattagataaaactgatacgcacggattggactctttaactgaacacccatttttaccgatggataaaaaaacatctcaagcgctaaaacaaattcaggcatttatgaggtga

SEQ ID NO: 3093 - DNA, 204 bp, Proteus mirabilis
ttgcctaggcatccaccgtgtacgcttattcgcttaacctcacaacccgaaagtgtctctttcaaggactatctgggtggtgatggctgcgcagattacatttcttcgttgggcagtgctcgcaatgctcacatacttaagtatgctgcgcttgctgtgcgctgtccgcctcgaactgtaaattgctcgctcatcccactttga

SEQ ID NO: 3094 - DNA, 426 bp, Proteus mirabilis
tacatgcctaactcaattgcacgtattcttgaaagccaaacattatggattgtcgcaagagtgctaattctattgttatttttatcatcgggttttgccaaggtatttgattatgagaatagtttggcagagatgcgtgcagcagggttaaaccctgattggttttttaatctcgccagcgccattgttttattcgccggatcgattttagtcctttttgatcgttacctatggttaggtgctggcgcattagccactttcttatttttaaccattgtgattgtacatacgttttggaatatgaccggcgataaagcgatgttatccatgtattttgcgatagagcatacctctgtgattggaggactaatggcaaccgcaatggctagccacttcagagcattatggaaaaaattcaactcataa

SEQ ID NO: 3095 - DNA, 204 bp, Proteus mirabilis
gaaaaagctaaatctagtctatatacaaaaagtgctatttctaggttagccctttatgtcttaagccgaactcattatgcggcgtccttagcaggcataaatagtcaatgtttccgtcgatgggggacagagggaatattcgcaagaatacgtcgcaacgctcgcccaatatttattgagcgagaaagtaatgtggatttttaa

SEQ ID NO: 3096 - DNA, 453 bp, Proteus mirabilis
caaatgagtaaagagaaaatagattttaatcgagcgctcacggttggcgaagtggcaaaacgcagtggtgttgcgatttctacactgcatttttatgaagaaaaaggattgataaaaagttctcggagccctggaaatcagcgccgttacccgtcagtggtactccgttatgtggcaattattaaagcagcgcagagtacaggtattccattaaaagaaattcaggaaatattagggaaatatccaccaaatagtaaattaactgcagaacaatggcatgaaatatcaacggattggaaaatacggctcgatgagcgtattcggcgtcttaagcgattacgtaatggacttgatcactgtattggctgtggatgcctatcattaaatgattgcccattacgtaaccctgatgatattttaggggaaaaagggcctggtgctcaaatgttatga

SEQ ID NO: 3097 - DNA, 267 bp, Proteus mirabilis
accatgatcctcgcaaaggtaatcggacacgtagtcgcgacacaaaaaagccctgaactgaaaggaagcaatttattaatgatagcgaccttagatgatgagcttaatccactgaaaaataaaacctatgttgcagtggatagtgtgggtgcaggtatcaacgatgtggtgttggctgaagaatacttcgcactaaataaagatcgttacaaggcgatgtccgtggttgccattgttgagaaggtttatcgggacagtaaggagtaa

SEQ ID NO: 3098 - DNA, 1341 bp, Proteus mirabilis
ccaatgctcaaaaatctacgttataaaacaaaagtaaaaataaaaaatagaaaaggagcattggttatgaatattgaaaggaaaatactagtcaaactaaaaaatatacattcacttgatcaaaataaaaaactattacgctctggttaccataatcaatataatacatttttatctaatatttcttttgttccagtattatcatcatcacaattaccacctaaaaatcatctttctcttacatcaaatcatttaaatgattactattatttaaatttacctaatgataacacatatacattagatgaaattattaaaatattaaaacaacatcctgatatagaatatgtgcaaaaaattccaaaattacctgtacagccacctaatattacgccggatttaactcgccatcagcattatttaaaaaccccaaaaataaaatcaaatgaaataaacgggttaggtattatagacgcttggaataaaaatgcttatggacaaggtatacaggtggccgatattgagtgggattttgatttatcacatcccgatttgttagctaataatatcacgccactttttcctttaactgaaaaaaccgatcaagccgaccatggtacggcagtggcggggttaattatggggaaaaaagacggtaaaggtattactgggcttgcttataaattagatatgttttatgccatatcagaattaagcagtggtcgtattgaagcaattattgccagtaaacagaaattacacgcgggtgatattgttttatatgagatgcagacagtttgtgaacatcatgcttatgttcctgctgattatgaaatgcatatctgggaggcaactcgtacattaacagaagcggggattattgtgatcatggctgccggcaatgggggggttgatctcgatttacctttttatgatagctatcgtcaacgtagcgataaccactctatacgtgtcggtgcgggctcgccttatacgttaaatcgtttacctttctcaacgcatggctcccccattcatgtgcaagcatggggagaagatgtgaccactgccggatatggtgatctttttcatggtgacgggaataacaaatatacggctaattttagtggaacatcatcagcctgtgcattagtcgcgggggcggctgcggttattcaatcttggtataaagataaaaccaacacggtgttaacgccaatagagatgcgagagctactgattaaaacaggaacctatccatcattaaatgaaaagataggccctttgcctaatgtaaataatgccatcttacatttaaaaaatttaatccaatataattaa

SEQ ID NO: 3099 - DNA, 624 bp, Proteus mirabilis
  unsure (77): Identity of nucleotide at the above locations are unknown.
aaatgtggcaaattcctttacccggtgggctttagccatgattggcaatctgatgctcgccattttacccaagaagnaaataccttagtctttgcgtttattgccgcccttatcattatttatttggtattagccgcacaatatgaaagcttggttgatccattgattattttgattacggtaccactctcaatttgtggtgcattagtgccattagctttaggtatggtgacattaaatatctacactcaaattggtttagtcaccttgataggacttatcagtaagcacggtattttaatggtggagttcgctaatgaattacaagttcataaaaatctaaatcgacgtgaggcgattattgaagcagcaaaaatccgcttacgccctgtcttaatgactacggcagcaatggttatcgggcttattcctctgctatttgccagtggtgctggagcgaatagtcgctatggattagggttgattattgtatcaggtatgttagttggcacgctatttacgctgtttgtattacccacaatgtacagcttcttagctcgaaaccatcaagtcagcgctcagactgagcgtcaaaaacaattacagcaaatcagtgagcaataa

SEQ ID NO: 3100 - DNA, 879 bp, Proteus mirabilis
ggggagctaaaattggagggaagtatgacgcacaataaatggcaggcgtatagccgtttaatgcgtatagataagcctattggagcgctattattactttggccaacgtattgggcattatggatcgccgctaaaggctttcctgactggcatatcctgattgtatttactctaggtgtgttttccatgcgtgccgctgggtgtgtaataaatgactttgctgacagaaaaattgatggcaacgttgaaagaactaaaaatagaccattacctagtggtgctgtaacggagaaagagagcaagattatctttattgtcttggtgctgttttcgtttggattagtgcttacgttaaataccatgaccatttggttatctattgccgcacttgcactcgcatggttttatccttttgtaaaacgttttagtaatttgcctcaattaattttaggtatggcctttggttggtctatccctatgggatttgctgcagtttctgaaacactacctttagtatgttggttactctttttggtcaatattatctggtctgttgtgtatgacactcaatatgccatggtcgatcgcaatgatgatttaaaaataggggtgaaatcgacagccattctgtttggtcgttacgataaaatcattattggtattttacagttagtgatgttggcattattagtggcgattggcgttttgctgaatatgaaagggatctattattggtcattgttactcgtgacagccctgtttatttatcaacagaaattaattgctgaacgggaaagagccccttgttttcaagcgtttatgaataataattatgtcggttttgttttatttgcaggtattttatttaattatttctaa

SEQ ID NO: 3101 - DNA, 183 bp, Proteus mirabilis
ctaccaataaagaattttttaggggatgttacagagcgaggtaatatagaagacataactaaattcctttatttagattttgctacagtaagtagcagaattaacatttatcttacccctcatcagaattcgaatctagtaaactctgtaatagatattatcaatatattctatttagtttaa

SEQ ID NO: 3102 - DNA, 2115 bp, Proteus mirabilis
ttattggcaaagtttatgatttataagtttctattagcaataaaaaacaaaccagaacttatcgtactatcagtgatgatactggttataatgatgttaattatacctttgccaacttatttggtcgactttcttataggtttaaatattactattgcaattcttatctttatgagttcattttatattaaacgtatactgaactttatgacatttcctgcattattgcttataacaactcttttccggcttgctttatcaataagcacgagccgtcttatattattagatgccgatgcaggagagatcattacctcatttggtgagtttgtcattggtgaaaatcttgttgtaggttttgttgtcttttccattgtgaccatagtgcaatttctcgtgattactaaaggatctgaacgagtagcggaggtcgcggctcgtttttctttggatggtatgcctggaaaacaaatgagtattgatgctgatttaaaatcagggatcattacgaatgaagaagttcagatcagaaggaaagagttaggacaagagagtcaattatatggttcattcgatggtgccatgaaatttataaaaggggatgcgatagccggcattgtcattatcttcgtgaacttaattggtggcatatcggtaggtatggctcaaatggggttatctattacagaggcattacatacatatacacttttaacgataggggatggattagttgcacaaattcctgctttacttatctctattagtgccggatttattgtaacacgtgtcggtggtgaaaataataatttgggctatagcattatgaatgagctattggcacaagattttgctttgcttgttacagctattttggcttttggtatcggttttttaccaggatttcccacacctgtttttcttattttatctgtaatgcttggcgtttacttttttaaaataaaatggaagagtagtaaaaaagaatataaaacagaagatgaaaaagataatcataatgctactaatgccgacagtaaaaaaggacttatgtcaaatttattttctggtaaacatggggaagaagtagataatagtttattaacagaaaatattaccttatcacaagctgaaactttgccattaatcatcactctttctactaagaaaaaaccatatttaacaaaaatagtttttgaaaaatggttacaaaaagaatttattttacaatatggtatattattaccagatattgtgattcactattcagataaaatagatgacgataaaattattattttaattaacgaagttaaagcaaaagaacttaattgtccttttcctctttttcatatagaaaatcctaatgatgaattgctctctttaggctttaacttaataagtattgaagatgataataaaacccattattggattgagcgtgatgatgaatctaaattagcgccattaggttacaaagcggaacgttcagaaagttacttttatagaaaattctctgatctgatcacattaaatattacagagtttcttggtattcaagaaacaaaagatatccttgataaattagaaaaaagtgcccctgagcttttaaaagagtgttataggcaagtttctattcagaggataaatgatgttttgcaacgattagtacaagaaaaaattcctattagaaacataaagactattatagggggcttagttcaatgggggagcaaagaaaaagatcccgtgctacttactgaacacattagaacgcttcttgctcgttatattagttattttttttcaaccgatgggaagtttaatgcaattatcttatctaacgatatggaagagataattcgtagtggaataagacaaagttcttctggcacattattgaatttagaacctgctgaattagatatgataatagaaaaaatatctatggttattgatgatattaaatatattcaggattatatatttttaacatcaatagatataaggcgttttgtaaaaaaactaatagaaactcaatatcctcaaataccggtattatcttatgatgagataacatctgatattgaaattaatgtattacaatctatttag

SEQ ID NO: 3103 - DNA, 339 bp, Proteus mirabilis
catcaacaaaattgttatcaaacacaaggcatagtctttgccttaggagaacgtatgggtgatgcattaggacttattgaaactcaagggctagtggcatgtattgaagccgctgatgcgatgtgcaaagccgccaatgttgaattgattggttatgaaaatgttggctcaggtttggtcactgcaatggtaaaaggcgatgtgggtgccgttaaagccgctgtagattctggcttagaagcggctcaacgtgtaggtacggtggtcacttcattagtcatcgctcgtccacataacgatattcaaaaaatcgttgcccagtacaaagtgactgaataa

SEQ ID NO: 3104 - DNA, 795 bp, Proteus mirabilis
gaaggtagaaatagaatgataggacggttattgcggggtggatttatgtccatcatttacgcgtatctttatatcccgattatcattctgatagttaactcttttaactcatcacgtttcgggatcaactggaaaggctttaccactgactggtataccattttattaaataatgacagcctgctacaagctgcagggcattcattaacgatggcagtcacctcagcaacctttgcgacgttgattggttcattggctgcggtggcgctttatcgttatcgttttcgtggtaaaaagtttgttggtggtatgctgtttgtggtgatgatgtcgccagatattgtgatggcgatttcattattggttttatttatgctattaggcatttccttagggttttggtcattactggtgtcgcatattaccttttgtctgccttttgtggtggtcacggtctattcgcgactcagtggttttgatgtcaaaatgcttgaagccgctaaggatctaggggcgggtgaatttactattttacgtaaaatcattatgccattagcgatgccagcagtagcctcggggtggttattaagctttacgttatcgatggatgacgtggttgtctcttcttttgtgactggaccaagctatgaaattttaccattaaaaatttactcaatggtaaaagtgggtgtttcaccggaagtgaatgcactggcaaccatccttttagggctatcattagtattagtattaattagtcagttgatcttacgagatagaactggcaaagcgtaa

SEQ ID NO: 3105 - DNA, 2556 bp, Proteus mirabilis
  unsure (2545): Identity of nucleotide at the above locations are unknown.
caggagtgtttcatgaaattcactgatatttttgtgcgacgacctgttttagcgttagtagttagcaccttgatttttttactgggcgcatttgcgttcagtaaactacctattcgccaataccccatgttacaaaactcaacgattaccattgcaacagactaccctggcgcatcgtctgaactgatgcaaggttttgtgactcagcctattacacaagccgtttcctcggtggaaggcgttgattatatttcttcatcttcagtacaaggaaaaagttttgtcacggtaagaatggagttaaatcgcgatccgacacaagcattaacgcaagtgatggccaaggtcaatcaagtacgttataaattgccagaacaagcttatgatcctgtgattgaactttcttctggtgaatcaaccgcagtcgcttatgttggcttttccagtgagcaaatttctattccagaattaactgactatctatctcgtgtggttgaaccgatgttttcctccattaatggggtcgccaaagtacaagtctttggcggacaacaactggccatgcgcgtatggctagatactgataaattagcggggcgaaacttaactgctagtgatgtcgctgatgccattcgccgtaataattaccaagcggctcctggaaaggtcgaaggtgagtttgttattgcgaatgtttatgtcaataccgatttaaccaatgtggaagaatttaaagatatggtgatccacaatgatggccataatcttatacgtctacgtgatattggcaccgtcgagctaggtgcggctgctactgaaaccagtggcatcatgaatggcaaaaaagccgtcttcttaggcctatttccaacaccaacaggtaacccgttaatcattgttgatggtattcgcgaaaaccttactgatatagaaaaaacactcccaccaggtgtaaatgtggagctggcctttgaaacttcacgttttattaaagcttctattgatcaggtggtgcaaacattaattgaagccattttaattgttattgctgttatttatctctgcttaggctcattacgttctgtaattattcctgtgcttgctatccctttatctatgttgggggcagccggattaatgttggcatttggttttagtattaatttgcttactttgctagctatggttttagccattggattagttgtcgatgatgcgatagtggtggttgaaaacgtacatcgtcatattgaagagggattatcaccagtgcaggccgcattagtgggggcacgagaggtcgcggggccggttatcgccatgaccatcactttagccgctgtttacgcgccaatcggtctcatgtcaggattaactggtgcactgtttaaagaatttgccataacacttgctggtagtgtcattgtatcgggtattgtggcattaaccttatctccggtcatgagctcattaatgctcaaaccgaaagaaaatgaaggcaggatggctaaaatagccgaatatacctttgataaattggcatattactatagctatttgcttaatttttctttaacccatcgctggttaaccgtcgttttcgccttagccgtgtttgttagcttgccgtttttatatagccagacaaaacaagagttagcacctttagaagatcaagcgagcgttttaaccgcggtaaaagcaccacaacatgcaaatcttgcctatgcggaacatttcaatcagaaactggatgatatttatatgagcctaccagaaacagacagcacatggatcatcaatggtactgatggcccttcagcaagctttggtgggattaattttgatggttggaaaggtcgtgatcgtaatgccaatcaaattcaggcagacctacaaaatcgtgttgcggatgttgaaggaagcagtatttttgcttttcaattagcatcattacctggctctgtcggcggattacctgtccaaatggtgttacgtagcccattaggttatcccgttttatttgacacgatggaagagatcaaacagcaagcacgagaaagtggtctatttgtcgtagtggatagtgatcttgattacaacaaccctgttgtgcagatcactattgatcgtgccaaagccaatacccttggtattcgcatgcaagatattggcgaatcactatccttattagtgggtgaacactatatcaatcgctttggtatggatggtcgctcttatgatgtgatcccccaaagtatacgtcaacaacgtttaactccggcagcacttgcagggcactatattcgtactcaagataacctgttaattccattatcaaccgtggtcaatattaccactcaagttgaacccaataaattaacgcaatttaatcaacaaaatgccgctatatttcaagctattccggcaccgggtgtcaccatggggcaagctgttgcgtttcttgaaaatgtggcaaattcctttacccggtgggctttagccatgattggcaatctgatgctcgccattttacccaagaagnaaataccttag

SEQ ID NO: 3106 - DNA, 1116 bp, Proteus mirabilis
atgactgagaaaacatctctgacaccactagtcgaattaaaatccttaagtaaaggtttcgacggaaaacaaatcatttcccgcctcgatctgactatcaaccatggcgagtttttaaccatactcggcccttcaggctgtggtaagacgacggtattacgtttaattgcgggcttagaagacgcggatgatggacaaattatcctagatggacaggatattacccatattccagcagaacagcgttttgtaaataccgttttccaaagttatgccctgtttccccatatgaccgtatttgaaaatgtggcttttggtctacgtatgcagaaaacacctgctgcagagatcaatagtcgcgttatggaagcgttacgtatggtgcaactggaggactttgcccaacgccgtcctgctcacctttcaggtggtcaacagcaacgggttgcgattgcacgggcggtagtcaataagccgaaggtattgttgttagacgaatcattgtctgctctggattacaaattacgtaagcagatgcaaaatgagctaaaagccttacaacgaaaactggggatcacctttattttcgtcacccacgatcaggaagaagcactgactatgtcagataggatcgtggtaatgaaagaagggcgtattgagcaagacggcacgcctcgagaaatctatgaagagccaactaatttattcgttgcgcaatttataggtgaaatcaatatctttgatgcacgtgtcctacatcgtattgatgagacacgtattagagcggatgttgaagggcacgaatgcgatatttatacgcaattacctgttactcaaaatcagcaactgaaagtgttactcagaccagaagatctgcgcgttgaagagatacacgatcttgaaaaccttccgggacttatcggttatgttcgtgaacgtaactataaaggcatgacgctagattctgttgttgaaatggaaaatggcaagatggtgatggtgagtgaattctttaatgaagatgatccggatgttgatcactcgttagaccaaaagatagcggtaacttgggttgagagctgggaggtcgtgctggctgatgaagaaaacacgtaa

SEQ ID NO: 3107 - DNA, 183 bp, Proteus mirabilis
cccagagagaaaattcagtgcattggtgccaaactgaattttgggttttatcagaaactcactcatgtcgttattactccttactgtcccgataaaccttctcaacaatggcaaccacggacatcgccttgtaacgatctttatttagtgcgaagtattcttcagccaacaccacatcgttga

SEQ ID NO: 3108 - DNA, 552 bp, Proteus mirabilis
accttttgtgaaaatgacacaggagtgccaataatgcacaaattaatgcttattgtagcgttgtcattactgtttaccactaagggatctgcttacgatacattggtacacattaatgccagagtaacaggaaacacatgtacggtagagacaaactcaaaacgtattaccgtaaaattaggccaaatcgccacaaaagattttatttctacgacgataacgcaacaacgtacgcctgttatcccttttagtattaaattagtcgattgccaacctgaagccagtgctgtgaaggtcagttttaatggtcgtgccgatcctattgataacgccttactcgccattgatgcaacgggtgccaagggagttgccatttccattatggataactcaggagcttccatcgatattaacgataaaagccagtcttataccttattgcctaaccaagataataccctgcaattttatgctcgctatgtagcgactcaacttcctgttcaagccggatcggcgaatgcaacagcaacctttttactggagtaccaataa

SEQ ID NO: 3109 - DNA, 297 bp, Proteus mirabilis
ataacgaaggaaataaatatgaaagaagcactcggtctagtggaaaccaaaggtctagtcgcttgcattgaagctgctgacgcaatgtgtaaagcagccaatgtggaactgattggttatgaaaacgtcggttcaggtttagtgactgccatggtgaaaggcgatgtcggtgcagttaatgcagcggttgagtctggtgttgaggcggcaaaacgtatcggcacagtagtgacttctcgtgttattgcaagaccacataacgatatcgagaagattgcagagcaacataaagcctga

SEQ ID NO: 3110 - DNA, 546 bp, Proteus mirabilis
ttacttttactattcttggaaatactaatgaaaatctcagggaaacttttatgttttttatcggccctgatttttatcttggtcgccacttatgcagcaacaagattattaactatcaaaaatgaaggtatgatggtttgttcaacaaagggcattatgcgctttgaaaatatggaagatgagaatgtgaatggcaatattcatttctcttttggtgctaatggcaaaggctctattgtggttgaggggtatactacctctaaagcgggttggctctatttacaacgttatgtgaaatttgattacaccacaaagcgggtttcccccaccgagcgtcactattttgtcagtcaatgggagtctagtgcctcctcgattgatgagtctcccgatgttatttttgattattttatgcgtgaaatgtcagatagtcatgatggattatttattaacgcacaaaagctaaatgaaaaaacgttattactcagttcgctcaattccccactctatatttgtaccttaaaacctggcagtaaattcgattaa

SEQ ID NO: 3111 - DNA, 1158 bp, Proteus mirabilis
tctttaatacttatctttctggctgtatcatacttaacaacttgctatgttatactactcctttatttctacctttatgttcatcagggtagtcgccatctaaatcgacgaaagaattacagcatgtcagaaaatacagaacgcaataaaacaacagaaaatcaccctattaatgataataaaagaacagataatttgaatcgcttctctgttgcacctatgctcgattggactgatcgccattgccgttatttctttcgccagcttaccaaaaatactttgctgtatactgaaatggtcacaacaggtgccattattcatggcaaaggtgattatttaaaatatagcaacgaagagcacccgatctcattacagcttggcggcagtgatccacaagcgttagcgcaatgtgcaaaattggcacaagagcgtggatatgatgaaattaatttaaatgtaggttgcccttctgatcgggtacaaaatggacgctttggtgcttgtttaatgggtgaagcacaactcgttgcagattgcgtgaaagctatgcgtgatgtggtcgatattcctgtgacggtaaaaacacgtattggcatcgacaaccaagatagttatcaatttctatgtgattttattgataccgtcagccgtgataataactgcgatacctttattattcatgctcgcaaagcttggttatcgggattaagccccaaagaaaaccgcgaagtgcctcctttagattatcctcgtgtttatcaattaaaacgtgatttctcgcatctcactatggcaattaatgggggaattaagtcactagaagaggcgcaggagcacttaaaatatatggatggtgttatggtaggtcgcgaagcttatcaaaatccatcaatattggctcatgtggatcacgtgctttttgataatcagttacctgttgctaatgccgtcgctgccgtaaaagccatgtatccttatattgaaaaagagctctcacaaggcacttatttaggtcatatcacccgccatatgttgggaattttccaaggtattcccggggcaagacaatggcgtcgtcatttaagtgaaaatgcccacaaacaaggtgctgatttaaccgtgctagagaatgcgctcaagtttgtgaccgaaaaatag

SEQ ID NO: 3112 - DNA, 183 bp, Proteus mirabilis
ggtatgagttgggtttacatttttcattcacaatactctcttaagattacaatccgatattctcagattgtagcctgtcatttaatagttacggtcaattctttcttatttgataatattcgtcaaaaccattcaacaaatctagtattaattacttacataggcaaaaccgataatctttga

SEQ ID NO: 3113 - DNA, 1044 bp, Proteus mirabilis
atgaaaaagtggtcctctgtacttgctgccagtgtaatggcattaagtattggtacagcatcggctgatgatggtaagacaatctatttctataactggacggaatatgtaccgccaggattgctggaacagtttacaaaagagactgggattaaggtgatttactccacctatgaatctaacgaaagcatgtataccaaattaaaaacctataaagatggtgcttatgatttggtggttccttcaacttattttatttctaaaatgagtcatgaggggatgctacagaagattgataaatcgaagctcagcaattttgataatcttgacccaagtttattacataaatcattcgatcctcaaaatgactactcaatcccttatatttggggagcgactgcgatagggattaatagtgatgaagttgatgtaagtagcattacttcatgggctgatttatggaaaccggaatataaagatagtttactgttaacggatgatgcacgtgaagtattccaaatggctttattaaaattaggctattcaggtaataccacagatccaaaacagattgaagaagcctataaagagttacaaaagctgatgcctaatgtactggcttttaattcggataatcctgccaatccttatatgcaaggagaagtgaatctagggatgatctggaatggctctgcatttattgcgcgagaagccggtgctcctattgagttggtatggccaaaagagggcggtatcttctggatggacagcttagctattcctgcaaatgcaaaaaatgttgaaggtgcgcataagcttatcgacttcttattacgccctgaagttgctgcaaaagtggctgaaaatatcggctatccaacacctaatttagcggcacaaaaattattgccaaaagctatcacaaaagatagctcactttaccctagtgaagagattatcagtaaaggcgaatggcaaaatgatgtgggtgaagcgacggttttatacgaaagctattaccaaaaactgaaagcgggtcgttaa

SEQ ID NO: 3114 - DNA, 219 bp, Proteus mirabilis
agaattctgcttggcggccatagcgcggtggtcccacctgatcccatgccgaactcagaagtgaaacgccgtagcgccgatggtagtgtggggtctccccatgtgagagtagggaactgccaagcattaaataagacgagaaagccaaccctctgggttggcttttttgcgtttagaagatcgtattttaccttgagtcatgctaacacttttttatag

SEQ ID NO: 3115 - DNA, 2568 bp, Proteus mirabilis
tcacagcatcgttttcaaccctgttggtcaaaaaccatggttaataagaatactaataaagatatcgtttattttctctttccaagtgtcattgcattgtcattgacgctgtccttttcatcatatagcgcaaaccgatttaatcctgcatttttggctgactctcctgatgccgtcaccgatttaagttattttgaagcaggcaaccgcattaaacccggtgattatcttcttgatattgtttttaatcatgagtatctgcgtagtgaaaatattcattttattagtcaagataatcatgttattccttgtttaaatcgagatgattatcaatcactcgggatcaatattaaactatttgctgattttgagaaattctcggcaaatgaatgtattgatattgaaaaaatcattccagattctgttgttaattatgatattgagaaacaagctttaaatattcaagtccctcaagccgcgttagatctgaaagcgcgcggttatattccaccagaaaaatgggataacggtataacagcaggtattttaaactacacctttagtggcgctaatagctggggaaattctcataataatagctactacttaaatctacgtagtgggatcaatattggtgcttggcgattacgcgattattccacttggaattcgtcaaacgggaaaaaccaatggaaccatatcaatacctatctgcaacgcaatattgtgtcattaagaagccaattacaaattggtgatagttatacctcatcaacactttttgacagtgttaattttcgaggtatttcattagaaagtgacgacactatgctacctgatagccaaagaggatttgcacctgtggtcagaggtattgctaaaggcaatgctaaagtggtgatccgccaaaacggttatgtgatttatcaaacctttgtttctccgggtgcttttgaaatccgtgatctctatccaacgtcaaatagtggcgacctctatgtcaccattgaagaaaatgatggtagcaaacacagctatgttgtgccttattctgctgtacctattttacagcgagaaggccaaaaacagtttgtcatccaagccggtgaaatacgccaaaataaccaacataaaaaacctcgctttatacaaggtcatcttatttatggcttaccctatgacaccactgtctatggcggtgcattagcaacaaaagattaccaatcttatgccctaggagcaggtaaaaatatgggtaccctaggtgccttctctaccgatatcacctttgctcatagccaattgccaaataactcaacatcagatggttattctttacgttttctttatgccaagtcgttaaaccaatttggcacaaactttcaattgctcggttatcgttactctacttcgggtttttacacattagatgagacattaaatacacgtatgtccggttatctgtatgaagataatcaaaaaaaaccgttgagttattttaatttgcataatcgcaagaaagggagcctacaaattaatttatcacaacaactgggggattatggctctatttttatgatgaccaactggcaaaattattggggaactaatgagaaaaatgtcctagtacaaaccggctacaatggcaatattaaagggctctcttataacgtcatttatagttataacagaatgatgaatagtggtcagcgtgaccaaacattgtctgtgggtctttctatcccattacaattgctaatgccgacaagttatcaatccatcaatagcacctatctcacatataattacagccacaataataacggttactcgacacataatgcggggattgctggtacattattggaagacaatacccttaattacagtgttcaacaaggttatagcaatcaaggtggaaactataccggtagtgcggcgttgggttatcaaagtcgctatggcaatttaaatgctagctataactatcatcaagatgctcaacaaattaactatagcctcgctggaggtatgctactccatagtggcggattaaccttaagccaacccttaagcgctaatgccattttagtagatgctcgtaatactgcggatgtaccgattgataatgcgacaggggtttatactgactggcgagggtttgccgttattccctatgctaccgcttatcgacaaaatcgagtggcattagacaccaccgcattacccgataatgttgaaattgagcaaaacattaagcaagtgatcccaacacaaggcgccgtcattaaagttcagtttgatgctaaaaaagggtatcgcttattactgacgctacaacaccaaggtcgcccactcccttttggggcaatagcaactgataaacaaaatcatctgtccggtattgttggcgatgatggcttgctctacttatcgggtgtccctgattcaggaaaattagagatccgctgggggcataatgcctctcaatactgtcaagtgaactatcaattacccgcctctcaacttgatgaaccttttgtgaaaatgacacaggagtgccaataa

SEQ ID NO: 3116 - DNA, 2985 bp, Proteus mirabilis
gaacaggatcgacattttattgtcttaatatggcaaattttcattatcattcagtttcaatatatatactgtatatccattcagctagttttgtgtcataattatccgattctttctttttcggcgactcacttaatccgggatatattcatggataaaatcgaagtacggggcgctcgcacccataacctaaaaaatatcaatttggtcattcctcgcgataaacttattgttattacgggactttctggctcaggtaaatcctctttagcctttgatacgctttatgcggaaggccaacggcgttacgttgaatcgctttcagcttatgctcgtcagtttctttccttaatggaaaagcctgatgttgatcatattgaagggttatcgcccgctatttcgattgagcagaaatcgacatcacataacccacgctcaacggtcggcaccattaccgagatccacgattacctacgtctattatttgcacgtgtgggtgaaccgcgctgtcctgatcacgatatccctttagcggctcaaacggtaagccaaatggtggataatgttttagcgcaacctgaaggtaaacgcttaatgttattggcgccaatcgtaaaagagcgcaaaggtgagcatgtaaaattactcaataatcttgctgcacaaggctatattcgtgctcgtatcgatggtgaagtgtgtgatttatcagatccccctaccttggagttacagaaaaagcacaccattgaagtggtcattgatcgctttaaagttcgtgacgatctggctcaacgtttagcagaatcttttgaaaccgcattagagctttctggcggtactgctgttatctctgatatggacgatagcagtgctgaagatatcgttttttctgcaaactttgcctgtcctatttgtggttatagcatgagtgaactagagccacggttattctcttttaataaccccgcaggtgcgtgtcctacttgtgatggtttaggggttcaacaatttttcgatcctgatttggtgatccagaatcgagaaatttctctggccggtggtgcgattaaagggtgggatcggcgcaatttttactatttccaaatgttgcgctcattaggcgagcactatcattttgatgttgaagccccctttgactcattacccgacaagatccagaaagtgattttatccggttcaggtaaagaaaatattgaatttaaatacaccaatgatcgaggggatgttgtggttcgccatcatccttttgaaggggtattaaataatatggagcgccgttatcgtgaaacagaatcgagtgcggtgcgtgaagagttagctaaatatattagcaatcgtccttgtgcctcttgtggtggtactcgcttacgtcgcgaagctcgccatgtgtatattgaaaataccacgttacctgaaattgccgattacagtattggtcatgcgatgagctttttccaaaatctaaaactcagtggtcagcgagcgaagattgccgaaaaagtattaaaagagattggtgacagattaaaattcttggtcaatgtgggattaaattacctcactctttctcgttcagcggagacattatcaggcggcgaagcgcagcgtattcgcctagcaagccaaattggtgctggattagttggggtaatgtatgtacttgatgagccttcaattggtttgcatcaacgtgataacgatcgcctactggaaacgttgatccacttgcgtgatttaggtaacacggtgatcgtcgttgagcatgatgaagacgctatccgtgccgctgatcatatcattgatattgggccgggtgctggcgttcatggtggtgagatagtcgctcagggtacactggaagatattgttaataactccaactcattaaccggtaaattcttaagtggcgaacgccgtattgctatccctgaaaagcgtgttcctgttgatcgcgaaaaaatgctcactattttaggggcgaaaggtaataacctaaaaaacgttaatttaaaaatacctgttggtttatttacttgtattaccggtgtatctggctcgggtaaatcaaccttaattaatgatacgttattccccattgcccaacgtcaattaaatggcgccactaatagcgtgccagcaccttatttagacgttgagggattagagcacttcgataaagtgattgatattaaccaaagtcctatcggtcgtacgccacgttccaaccctgcgacttataccggagtatttaccccgatccgtgaactttttgctggtgtaccagaatcacgaactcgcggttatacgccggggcgctttagttttaatgtgaagggggggcgttgcgaagcttgccaaggcgatggtgtattaaaagttgaaatgcactttttacctgatgtgtatgtgccttgtgatcagtgtaaagggcaacgttataatcgtgaaacccttgagattaaatataaagggaaaaatattcatgaagcgctagatatgacaatcgaagaagcgagagagttttttgatgcggtgcctgcattagcgcgtaagctacaaacattgattgatgtgggactctcttatattcgtttaggacaatctgccactacgttatcgggtggtgaagcacaacgggttaaattagccaaagagttgtcaaaacggggtacaggccaaaccctctatattttggatgaaccgaccacgggtttgcactttgccgatattgagttacttcttgatgtgctccatcagttgcgtgatcagggtaatacgattgtggtgattgagcataacctcgatgtgatcaaaaccgctgactggatcgttgatttagggcctgaagggggcagtggtggtggtcagatcttgatatccggtacgccagaacaagttgctgactttgaaggctcccacacggcaaggtttttgaaaccaattttagagcgtggttattaa

SEQ ID NO: 3117 - DNA, 627 bp, Proteus mirabilis
ggaacataccgactggtcggtattatcctacgcatgaatacaaccgcacatcaccgaaaaaaagatcctatccgcgtccaagagcagttattagaagcggcaagtattattgtggcgaatgaaggaattgcttctttatctttaaatgccgtagccaaagaagcgggtgtcagtaaaggcggattattgcaccattttcctgggaagatagaactgatacaggcggtattcaaacgcttactcggtattatggataaacgaattgcgttaattatggccaacgatccgatagaagcagggcgcttttctcgcgcttatttaacctatatttctgatctcaaacagtcagatgaaagccgccaattggcaatactttctttagctatgcctaacgagccaataatgcgtcaatgttggcgtgattggatgttaggccatttagccaaaggcgataaacttgataatagctacttaggtacgttaattcgttatgctgccgatggcctttggttatcagaactcacagaaggccctacgatttcacaacaagagcgtagtgcattagttgaaagattattaaaaatgacatttgaatatatggccgacacagcaaatcagtcatgttaa

SEQ ID NO: 3118 - DNA, 915 bp, Proteus mirabilis
atatatggccgacacagcaaatcagtcatgttaattaggatgaatgagggcacaatgaaatacagaataaatgcctcaatttattacgacgcaacggatggcgcgatatcgttagaaaaaggtgacgttgatacacatctgtctattaccgctaatgcgttactcttttattttattcaaaatcccggtgtagtaaatcgtgatgaagtattaaaacgcgtgtgggatgacaatgggctagtttcttcaaatagtaatttaaaccaatatttaagtttattgcgtaaaacatttcgtcattatggtattgaaaatattattgtcactatcgccaaagggcgactagagtttaatcctgatatctctgttgaattaattgatgactcaacactgttacctgttacgcaaacaaatgagcacgaaggtgaagcaaataaaagtcataccgcatcacccattgagacatcgttatcatccgagcctgataatctagatagtgaattagaaaaagagcctcaattatcggtaacatcgccacaaaaaccagaaatttgttggtatttagccagtattggttttttatttggcgccatatttcttgtggtgatcatctttttaaatcagcatcaatcaaagcctatcacattaacacctctcacccataatgattgtgaattactctctaacgaggccatgattaactcctctgtcagtgataattatattcgcaattttgacgctgtaagaaagaagcttaatttacagtgtgtgaaaggggagcgctttgtttttttctatggtgataaattacaaactaatggcttagggcgtgtctttttagcgcattgcgctaagaacgaagataatccatttagctattgcgataattacttttactattcttggaaatactaa

SEQ ID NO: 3119 - DNA, 525 bp, Proteus mirabilis
tatagtttacgccaagctgacataaatagttgtagcctcttattagcaatacttcgaaagcataacagaaagtctttcgtagatctgtggtgctgtgacaatattaatagagaaaagtggcaaaataatcgtttgttttcgatagagtttattatggctaatcaaaataaaggtcttacccgaatcattaaagctggtggctattcatatcagggcttacgcgccgcttggatcaatgaagcagcttttagacaagaagctattgtgaccttaatagcaattatccttgcattttttatcgatgtcagtgttctagagcgcattttattgattggttcagtcgtccttgtcgttattttagaactggtcaatagtgctatagaagctgtcgtcgatcgcattggtacagaacgtcatgaattatcaggacgagcaaaggatatgggatcagctgccgttctcgtcgctattatattgggattatttacttggggaaccattctttggcatcatttttttgcataa

SEQ ID NO: 3120 - DNA, 696 bp, Proteus mirabilis
attatgctacgcttgttacctgacaaccttttaaaatatacctgcgaaggtgtattaatacgagctcactatatacgacagctcgataatattcataaaacaacattagcgaccaagcaggcagcaaaaaaaatgctgcatcactttaatcataaactagataaacttcgtaataagatagctaacgaagcttatgctaaaggattacaggttttattagctgatataataagattctcaattgaatatcaagaaaaatttgtacaatatgaatttcagcaacgagaacaactcgtcgcaacgatcggggaattcttagattcacctgaaatacaagttaaactcactcaatatctgatgtcatctgttcctcttgagcaaaaagtaacactcgatattcccacaacactacagcgctattttgagagtgaactcgacaatagcaatattaagttaaactgccataacaacaagaccattgctattcataccggtgatcaaattactttttttgatcctgccatatttctcaacgatctaagaacacaatttcatcggcctttttctgaaacttatcaaccgatttttgagcaaaacatcaaacaactgctattaaactttatcaatacatttaccccctcagacgatctttcttcaagaaagccaattttaaacgaggataacaatgaaaattga

SEQ ID NO: 3121 - DNA, 1320 bp, Proteus mirabilis
cttctatttagatgctacctatatgataagaacaaagggattgctatgaaacttgagacactttctgttcatgctggttattcacctgatccaaccaccaaagctgttgcggtgcctatttaccaaaccacctcttatgcatttgatgatacacaacatggtgctgatctatttgacttaaaagtacctggcaatatctacacgcgtatcatgaacccaaccaatgatgtattggaacaacgcgttgccgccttagaagggggaattgcggcagttgctgtggcatcgggtatggccgcgattacttatgctatccagaccattgcacaagtgggcgataacattgtgtcggttgcgaaactctatggtggtacatataacttaatggcacatacttttccccgtattggtatcgaagcgcgttttgccccccatgatgatctgctggcacttgaagcgttaattgatgagaaaaccaaagcggtattttgtgaatctatcactaatccaagtggtaatattgttgatattcaagctctcgccactgtggctcatcgtcatggtgtccctttaattgttgataatacggtagcaacgccttacctatgtcgcccttttgagcatggtgctgatattattattcactcactcactaaatatattggtggtcatggtaactctattggtgggatcgtcgttgattcaggtaaatttccttgggctgaacataaagatcgttttgaaatcctcaatacaccggatgtctcttatcatggggttaattatgttgaacactttggtgcggctgcttatattgcgcgatgccgtgttgccccattgcgtggaacaggagccgctctttcgccatttaacgccttcttaattcttcaaggtctagaaacattagcgttacgtatggagcgtcatactgaaaatgcgcaaaaagttgctgaatatttgcaaaatcatcctcaagttgtctgggttaaatatgcaggtttaaccagccacccggagcataatttagcggtacgttatatgtcaggtaaacctgctggtattctctcttttggtatcaaaggcggtgccgaagcgggtgcgaaatttatcgatgcattgaaattgattgtgcgtcttgtcaatattggtgatgctaaatctttggcttgtcatcctgcatcaaccactcatcgccaactcaatgatgaagagttagaacgcgcgggggtttctcgtgatttaattcgactttcaattggtattgaacatatagacgatattatcgctgatctagaacaagcattaaacgccagtttttaa

SEQ ID NO: 3122 - DNA, 537 bp, Proteus mirabilis
gatcatcatagttgtgatgatgaaagaatgtttaaaaaatccataattactcacgcacctattcactggttatcagatgaagagcgtgaagaagtcgcagaaaataccttaagttggctgctggaattaggttcaatgacacgacgttttgagcaacattgccatcaagtgacggtaatgccatatcaagaaggttttattgaatatatcgagcctgctgatgaacaaaagtgtttaccttatagccgacgctattggctaagagaaatcgtcctttgtggggataatgtaccttggttattagggcgaacattagtgccggaagagacattaacgggtgaagatcgccaattagtgaatttgcgtacggtgccattaggacgttatctgttccaggaaacaaccttaagtcgtgattttattcatattgggcaacaaaatggacattggttacgtcgttcccgtttccagctttcagataaacctttattattaactgaggtgtttttgcctgcatcacctgtatataagcagtag

SEQ ID NO: 3123 - DNA, 1260 bp, Proteus mirabilis
acgaacaatagcacacaagatattgtatctatctggcacacaaaaagtgattggagaataaaagccgtgtttcaacaggttgaagcgtttgcgggagatccgattctctcattaatggatgtctataataaagatccacgtcaagataaaattaacctaagtattggtctttattatgatgaagaaggcaaaacccccattctaggcactgtgtctgtggcgcgtcagcagcttaatgcgatgacaccaaccgcaacactgtatttgccaatggaaggactcgccccttatcgccacgaagtacagactctcctttttggtgctgataacccgcttattgcagacaaaaagattgctaccatacaaacattaggtggctccggagcgctaaaagtcggcgcagattttctacatcgctattttccaagctctgaagtttggatcagtgatcccacttgggacaatcatgcgtctatttttgcgggctccggttttaaagtaaattattatccttattttgatcccgaaaccaaaggggtcaaattcgatgcattaatagattgctttaaaaagcttcctgaaaaaagcatcgtactgatgcacccatgttgccataatccaacaggatccgatctcaccaaagcacaatgggatcaggtcattgagatcctcaaagcgcgtcaagcaatccctttccttgatattgcttatcagggatttgctgaaagtttagatgatgatgcttatgcggttcgcgctatggcaaaagcagggttacctgtattagtcagtaactcattctctaaaatcttcgggatttatggggaacgggcgggtggcttatcgattgtatgtgataacgcgaaagagtgtgagcatgtattagggcaattaaaagcgggcgcacgtcgtatctattcaagtcctgctaactatggcgcacaactggttaatcaagttttatcagatcatgtattaaccgcacaatggcaaaaagaagtggctcatatgcgtgaccgcatcaaagagatgcgtgtaactttagttaatgccttaaaagaagcattacctgagaaaaactttgatcatttattaacacaacgcggtatgttcagttataccggcttttcaccagagcaagtagatagattacgtgaagagtttggtatttacctgattggtacaggtcgtgtttgtatggcgggtgtcaataacaataatgtgcagcgcattgcacaagcctttgcagctgtcagttaa

SEQ ID NO: 3124 - DNA, 606 bp, Proteus mirabilis
gcctgtatcagaaaaaaggacatgatgatgagttatactttgtatcttcagcaaaccccaacagttggcactaaagttccttttccttctttagccaaaggaaattacccattaaatgaagttatcattaatgcgtttttaaatctgatgcaattaacagggaatttggatacagatgcattattagatgaaaaaatgtttgataagatttggcttaaggctgaaatgacaccggcgcgcatggaagaaattggtgactatatttatcatcatattcctacacatccagcccccctagaagaagaaatcacactatttaagcaagctatgcaagaagaagaggcattgttagctaaagagagtgaaaaagaagggtgtattccaatttataagtttgctacaaatgatggttggattgtgacaccgaaagagtgtgagattattgcctcagcacttacagctaagcttcttgaagataaccatgtatttgtggaacaagtggctaagatgtctcatattgcctatcgctcgttagaaatcgcgttgattgattttggtaaatttaatcaatttgctaaaaaatatggtggttatcgggtatattaa

SEQ ID NO: 3125 - DNA, 1140 bp, Proteus mirabilis
tatatgttaagaataatgcctaatgtaagtgcaaaaattaatagcataagaaattttttaggaataaaagatcccacgggaaatcttaatgtcagtagtgttaagaatagtagcgctatatggtataaaaaagatttatctgaaaaaaaaacacctgttctctatatgcgacaaaatatcaataatgtaaataatatacaaagattagtatctacagaagttcttaacaaattatattatgatgaaaactcacctcaatatgatgaaaataattatcaatgtgtacctaattctagatatagagtacgatattgtaaaaaaactttaatagaatctaatggggtattattacctactaataatgtgagtgttaagaactctccttatacgactattgcaagccaatatcctcttaatgataaagagagtttaaaacattattttaatatgttatttgataatgatataaagacagtttatgttttagcctcggataaggatattaaatgggacttctcaaaacctgatagtgaatatgataaaatcaattctaagcagaaagggtttaaatactttagagagggtttttattcagataatataaaatcttgccactttaagaagtgggatttcagttattttgaaataaaagataacaatgggggatataaaattgtagataataagaatggagataatgaaattttactaaatgaaagacagttagattgcaaagtatatattaagagattgactaaaaaaggttgtgataaaaagaaagatataaaatttgtacatatttataattgggaagatcatacagcaatagatgcgataaaattaaaaaatacaattgattttattggcaagaaattcacaataaacccaacaaaagaaaatatagctgtccattgtcttgcgggattaggaagaacaggggagtttattgctttaatggaaatgatgaaaatgatagaggcaggaaatacaaaaacaaaaagcttagaaagtattctcgttcatttaagggaaaatcgcagtagggaggtacttaaaaggaaatcacaagttgatgagctgattaagtttgcaataaatcataacattcctttagtcaatgataatattgaaataaaataa

SEQ ID NO: 3126 - DNA, 894 bp, Proteus mirabilis
cttgggttgagagctgggaggtcgtgctggctgatgaagaaaacacgtaaactatttcaaaacatcgttattactggtgttgtgggttggttaatggtgttcgtcttcttaccgaatatcatgatcatcgccaccagttttttaacccgtgatgatgcgaatttagtcgagatggtttttacgctcgataactattatcgcttatttgatccaatgtatgcagaagtattactgcactctattaatatggcattggtagcgaccttagcttgtttaatattaggttatccttttgctttttttctggcaaaaatgcctaagaaaatacaaccattactgctgtttttattaatagttcccttttggactaactcacttattcgtatttatgggttaaagatttttctcagtacgaaaggctattttaatgagtttctattgtggatagggcttatcgataaaccgctaaggatcatttataccccagaggcggtagtattagggttggtttatattttattaccttttatggttctgccactctattccagcattgaaaaactggataaaccctgtttggaagcggctcgagatctcggtgcgaataaattacagacctttattcgtattattatcccattaactatgccggggatcatcgcaggttgtttattggtaatgttacctgcgatgggcttattctttgtggcggatttaatggggggcgcgaaaaacctacttattggtaacgtaataaagagccaattcttaaatattcgcgactggccatttggggcagctaccagtatttgtttaacactggtgatggggttaatgctatttgtgtattaccgagccgtaaaactactgcataagaaggtagaaatagaatga

SEQ ID NO: 3127 - DNA, 555 bp, Proteus mirabilis
tcacgtctgagagcatcctatcctatgaatgaagagaaattgctcgctcaggcagaaaagatctgccagaaacgaggtgttcgcctgacttcacaacgtctggcagtattgcgtctgatcatgcaacaacctaccgcaatcagcgcttatgatttattagatttattacgccaagtagagcctcaagctaaaccacctaccgtatatcgtggattggaatttctacttgaacaaggttttattcacaaaatagaatccaccaatagctatgtgctttgtcatcattttgatgatgctgagcatacatcggtgatgttaatttgtgatcgttgcttatcagtcacagaaaaaagtagtcataaaattgaaggggcgatcagtacgctcgctaaagataatggctttcatttacgccatagtgtgattgaaattcatgggctgtgcgctcagtgccatgaagcccaagcctgtacacatccggaaggttgtcaccatgatcatagtatggatgataatcttaagcagaaaaaaaccggtgactataagcctcgttaa

SEQ ID NO: 3128 - DNA, 579 bp, Proteus mirabilis
gcgagaatgagtaatctgactgctgaacaatttaaattgatctctaatgtaatgtatgaaccgttaagttatatccattcagactacgatgtattagcatcgccaaaagaaaataccctatggcaaaaaatagctaatcgtcatttaattgggcaatatcaacttatactgcatattgattgtgagattgatactaccgtagaaaaaatatttactcattggcacactcttcctcgttgtgctttatttttaggttatttttattctcgtcatacgctattagcacaaaattattatcatttagaacctgcattaaaagcctttttagctctctatcctatgttaaataggactgtcgatagcaaaatattactgtcactaaaagatattgcccccatagatattggctatcaattactatttaattttattaagctaatatcgaacgcactagctcaacgttttaaattacttttttcaccaaaatctttatcaattaatattgaatttcctaaatcacttgttttatctcctacactttttttactggtattaaattatgctacgcttgttacctga

SEQ ID NO: 3129 - DNA, 297 bp, Proteus mirabilis
gttttacggaggttatgtatggctattgcacctattattcccgttaatttaaccaaagaactacaagatacaagtgatgatagtttatcgactatcatggtaaatggcattattagtagtatgcaatatgaaaaaaagatacaagaaaagttaacaacattaagccaattaggtgatgcccaaagttatacgaatttacaaatagaacttagcgattattcaattacgatgagcttagcgagtacgttagcaagaaaatctctcaatattgtggaaacactacttaaggctcaatag

SEQ ID NO: 3130 - DNA, 435 bp, Proteus mirabilis
aaatttaggagtcttattatgtccccaaaagcaaaatcatggctttggatgctggcggttattatttcagaaacctcagcaacctcgaccttaaaaatgtttgataatagtgaaggaataacaaagacattattattaggattaattattgttctttatattgtttgttattattcattatctcgtgcagttaaaaatattccagtaggcttagcttatgccacctggtccggaaccggtatcttagttgtatctactttaggtatggcattttacggtcaacatcctgatacggctgctattattggtatggcagttattgccagcgggatcgtcattatgaatctattttcgaaaatgggttccgaagaagagccagaagaaacgacggatttatcgaatataaaacagactgtatcgtcagtgaataaataa

SEQ ID NO: 3131 - DNA, 183 bp, Proteus mirabilis
attatttttggaaaatgccaaataagactattttatttattaaaacaaaagcgagtgatagcaatcttcgtgaaaacgaataaattgccatatattcacttaagtcaaatttacaaaaattataaatgtggtaaaaaaaatagagaaatcgttttaaacgatcgttttttgctggttttatag

SEQ ID NO: 3132 - DNA, 972 bp, Proteus mirabilis
tgcagatttggaggcgtaaagatggagacggcagcagaaataagagggcggatatttaatatccaaaaatactctatttatgatggtgatggtattcgtactctggttttcttcaaaggctgtaatatccgctgcccttggtgttcaaacccagaaggtcttagcagtgaatttcaggtgatgtactctcgcgataaatgcgtggattgcggtaaatgtgttgatgtgtgtccggcaggtgtgcattacatgacaaccaatgagcaagggcagcaagttcatcgcgttgatcgtgccgttgattgtattggatgccgtcaatgtgaagaagtgtgtctttctgatgcactggatattatgggtaaagatgtctctgtatctgaattgatggacattatcatgcaagattacgacttctatatctcttccggcggtggtgtcacaatcggtggcggcgaaatgagtttacaaacggattttgctgtagctctgctacgtgaatgtaaaaagatgatgatcaataccgcggtggaaacacaagcaaccactaatgtggctaattatgaaaaattagcgcaagtcgttgatcagtttctaattgatatcaaacacattgatactactcagcataaagcattatttggcattggtaatgagaatgtccgccgtaatttagagcgtttgatggatctcggtgcaaatgtggttatccgtatgcctttagtgcgaggttataacgactcttatgatgcgattactggtgcaattaactacgccatggcgttgtcaaaacgcggtaatcttcagcgcatcgatattctaccttatcaccaatttggccgtaataaataccaaaaattggagatgatctaccccattaaaaacgatccgggatatacgccagaagagctcgatcgcttagaagccttctttaaacaatttgattttgagatccgtcttgtccgccactaa

SEQ ID NO: 3133 - DNA, 1614 bp, Proteus mirabilis
aagattttaggggaatgcagaatgtcacaatcattaactacagaagcattaagcttcaccaaaccttttggaatagccgaaaaagagatattaaatcatgatgttgagtcatttttaactgatttggtcagtcagttttcagaacgtcgtgacaccttattagcagaaagagaaatttggaaacaaaaagtggataatggaatgcttcctgattttatttcagaatcagattccattataaactcagaatggaaagtgaatccaattcctaaagacttgcaagatcgtcgggtcgaaattacaggccccgtagatcgtaaaatggtgatcaatgcattaaatgctaatgtaaaagtatttatggcagattttgaggattcacttgccccgacatgggataaggttattgatggccaaattaatttacgtgatgctgtcaaaggaacaatttcctacaccaatgaacaaggtaagtgctatcaactaaaagcatcgcctgcggtgttaattgctcgagtcaggggattacacttgcctgagaagcatgtgctatggcagggaaaacctattcctgggtgcttgtttgattttgccttatatttttaccataactataaaacattacaggcaaagggcagcgggccttatttttacattcctaaattacaaacttggcaagaggcaaaatggtggagtgatgtttttcatttcactgaaaaacgcttcggtttagccagcggaactattaaagccacagtattaattgaaactttacctgcggtatttcaaatggaagagatcttattccatatgaaagagcatattgtgggccttaattgtggacgttgggattatatctttagctatatcaaaacgttgaagaattaccctgatcgtgtgttaccggatagacagggtattactatgactcaacctttcttaagtgcttattcccgactacttattcaaacttgtcataaacgtggtgcatttgcgatgggaggaatgtctgcttttatccccagtcgctctgcggagcaaaatggtgtcattttacaaaaggtatttgaggataaagagcttgaagcaactaatggccatgatggtacttggatagctcaccctggattagccgaaacggtgttatctgcgtttgatgcggtattaggagagcgagcaaaccaacttgatgtacaacgtcatgaaaagatcaccgcagacatgttattggccccttgtgaaggtgaaagaaccgcaacaggaatgagagcgaatatccgtgttgctgtgcaatatattgaagcgtggatctcaggtaatggttgtgtgcctatttatgggctaatggaagatgccgccacggcagagatatctcgaacctctatttggcaatggatccgtcatcaaaaaccattatcggatggacagattgtaacaaaagcgctttttcgcaacatgttgaaagaagagctggaggtaattcgccaagaagtgggtgatacccgctttgagcaaggtcgttttaaagaagcagcgaccttaatggataacattactacccaagatgaattagtcgattttctgactttaccgggttatcaacttttaaattaa

SEQ ID NO: 3134 - DNA, 3450 bp, Proteus mirabilis
agaacatcaggagagcctcacatggccaaatattctttgacgccacgcgtaaaaatgctggcagaacgtttagtttcacgtaacagttctattagcacagagcgtgcgacgatttttgattcattagataacaatattgccggtgtaccccaagcgattaaacctgcacaacgcttttatcagtttattcgtcattttccaagctatatcgctcaagatgagcttattatcggtagccaatcctcaacaccacgtggtgcgattttccacagcgaagaagaagtgcgtagtgactctatttatcgctttttaagtatcaataatagcgttgcatcacctgattatatgctggtggtgaatcaaggtttcttagccatcaaagcacaacttgaagatagaatgagaagcattggtagtgcggtaaatcgtagcagtatggatgaagccaatttctgcaaatcggcgatttatgcatgtgatgcggcactttattttgcacaactactgtcagctaaagcagaaaatttagccgcaatggaaggtaatccataccgtaaagctgaattattagaaagtgcggctattttacgtaaagtacccgccaagccagcagaaacctttaaagaagcggtacaagttttctatttattacagcttattcttcatctggagaatggtagctacgctatcaacccaatgggctttgataaagcactatacccattctatcaacgtgatattgaccaaggtcgtttaacgccagcacaagcttatgagattgttgaaagtctttggctaaaactggctgagctatccgaagtgcgcgcaacgaaagaagtcgatggctatccgatgtttgatgccatgacccaaggtatcgatattaacgatcctcgcgtcagtattaacgaactttcagaaatgttgttatcagcgcgcgctaatctatcagcattacacagttcactacaagtccgtttatataacggtcgtatgaatacaccaccgcaatatgcttcaccttcagccaatgttgttacaccggcgaccgcaaatggtgagttgactgtaatggaaggcttaactccccgcctacagcgcctgcgtaatcgttatttagaggctcgccctagtgtttcaatttatagagcattagcctttactgaaattgctcgcaataaccctggtttaccccctattttattgcgtgctaaagctttccgccgtgcttgtgaaaccgcacctatcttaattcaagatgaagagcttattgtgggacatccttgtgggaaaccgcgtgctggcgctttctctcctgatatcgcatggcgttgggtacgtgatgaactcgacaccatgagcacgcgcccacaagatccattccaaatttcagaagaagacaaaaaagtcattcgtgaagagatagtgccattttgggaaggtcgctctttagatgaaatctgtgaagcgcaataccgcgaagcgggtgtatgggagttcagtggtgaaacctttgtcagcgatctctcttatcatcaaatcaatggtggtggtgatacttgccccggttatgacgtgctgttattcaccaaagggatgaacggtattaaagccgatgcacaagcgaaattggctgaattaagcatggaaaatcctgctgatattgaccgtatctatttctataaagcgtcgattgaaagttgtgaaggggttatcgcttatgctcatcgtattgccgagcatgcccgagaattagcctctaaagagagtgagccacaacgtcgtgaagagttattgaccattgctcaagtcaatgaaaatgttcctgctaatcctccaaaaacattgcaagaagcactgcaaagtatctggactgtagagtcattgtttgaagttgaagagaaccaaacgggactttctttaggtcgcttagatcaatactgtttcccaatgtatgaaaacgacattaaaacaggtcgtttaacgcgtgaacaagcactggaaatgatgcaggcctttatcatcaaatgtgccgaattaatgtggatgtctagtgaacttggcgcaaaatattttgccggctatcaaccctttatcaacttaacggtggggggacaaaaacgctcaggtggcgatgcttgtaacgatttaacttacttgattatggacgcagtacgctttgtgaaagtgtatcaaccttcactggcttgtcgtatccataaccaatcgccacagcaatatatggaaaaaatcgttgatgtggtcaaagcgggaatgggcttccctgcctgtcacttcgatgattctcatatcaagatgatgttgcgcaagggcttcgactttgaagatgcacgcgattactgcttaatgggctgtgttgaaccacaaaaatcaggtcgtatctatcaatggacatcaacgggttatacccagtggccaattgccattgaatttgtattaaatcgtggtcgtatggtgctgtttgatagctaccaaggcttagacaccggcgatttacgtgatttacgtacttatgaggatttcgatcgcgcggttaaagagcaagtcgcacatattattcgtttatcagcaattggtacggttatcagccagcgcgttcaccgtgacattgccccaaaaccactcatgtcgctattggttgaaggttgtatggagcaaggtaaagacgtgacagcgggtggtgcgatggttaaccacggaccgggtctgatcttctctggtttagccacttatgtcgattctatggcggcaattcgcaaactggtttatgaagacaaaaaatataccttagagcaaatacgtgacggcttattagctaattttgaagggcacgaagagttactgcgtgactgtttaaatgcaccgaaatttggtaacgacgatgatgttgttgaccaatatgcgttagacattaccgaatggactgaacgtgaatgccgtaaatataaaatgctctactccacatttagtcacggtacattatctatctctaataacacgccaattggtgaattaaccgcagcaacaccaaacggccgtttagcatggaaaccattatcagatgggatcagccctacacagggtgcagataaacatggcccaactgccatcattaaatccatcagcaagatgaatgttgaaaccatgaatatcggtatggttcataactttaaattcctcaaaggcttgctagataccaatgaaggacgccaaggattaattaccttattaagaactgcctctattttgggtaatggtcagatgcaatttagctatgtcgataatgaagtactgaaaaaagcccaattagagcctgaaaagtaccgtgatttaattgtccgggttgctggctacagtgcgtacttcgttgaattatgtaaagaagttcaggatgaaattattagtcgtacagtgattgaaaaattctga

SEQ ID NO: 3135 - DNA, 246 bp, Proteus mirabilis
cgttggacaggaacccttggtcttccggcgtgcgggtttttcacccgcattatcgttacttatgtcagcattcgcacttctgatacctccaacatacctcacagtacaccttcgcaggcttacagaacgctcccctacccaacaacactacgtgtcgctgccgcagcttcggtgcatggtttagccccgttacatcttccgcgcgggccgactcgaccagtgagctattacgctttctttaaatga

SEQ ID NO: 3136 - DNA, 567 bp, Proteus mirabilis
ctctcttttatttttaccaaggtgatttttgtgaaagacgccgtgatcctcgttgataaaaatgacaatgagctaggaaccatgcccaagctggaggcacatattactggtgccttacatagagccttttcattatttattttcaattctaagcaacaaatgttgatccagcaacgagcactgactaaatatcactctggtggcctatgggcgaattcttgttgtagccatcctttacccaatgaacctctatcacaagcaatacatcggcgtttaaatgaagaattaggtatgcagtgtgatatgcaacctattggtacgattttatataatgagaaagtcacggatgatcttattgagcatgagtttgatcatctttttttaggctttagtgataaaacaccactgtgtcatcccgatgaagttatggatcatcgttgggtttcattaaacgagctttatcatgatgtagaaaaacaccctgaaaactatagtgcatggttctgccatatattaatggctcttggtatagagcagtttactcgatggagtaaaaatattacttag

SEQ ID NO: 3137 - DNA, 687 bp, Proteus mirabilis
atatttattatgaaaaagatatttgcttttattatttttttattcccacttattgcttattctaatggtgtttcattaggtgctacgcgtattatttataattctaatattaaacaaactaatcttgttgtgactaactcagataaagagaatagttttctaattcaatcatgggtatctgataatcaaggtaataaaaataatgattttattgttacccctcctttatatattcttgacgctaataaagagaatgctttaagaattatgtatacaggtgaacctttacctgcagatcgcgaaagtttattttggatgaatgtcaaagctattccttctttagatgaaaagcttgccaatgaaaatacactacaaattgccatccagagtcggataaagcttttctaccgccctagtgggttatccgcttatactgaaaaatatgccaatgaagtgactttttcctataaaaatggggagttaattgcccataatccaacaccttatcatattactatggtcaatttagccacagtcgacagtcaacttccttcaagtattatgattaacccattttcacaattaacattaggaaaagttaatcagaatgctcataccatttcattccaaaccattaatgattatggcgcacagactcctgttttaaaaaaagaaatcgttcattaa

SEQ ID NO: 3138 - DNA, 1086 bp, Proteus mirabilis
ggtgatattatgatcggaccaattaatactgcaacttcgacaaatggtgccagcaacagtattagtaaagaaagtcagcaagacatagaatataagcaaccacaaataaacgaaagtgaaaattatcaaaatcaattaatagaaatatctgatgatatgtctatggtggcaactcttttttctcagcgattaggaaaattattagacaaaaaagccaataaagggcaagaagctttatatattgcagaagatggtgctgatgagaaacttgataaggtgatgcttcaatttagaaaatcggggagaagtttacaggaattattgcaatatttacgtaaaatgttccctgatcctagtgatctcgttatggttttacgagaattacttaggaaaaaaaaattaggtgcacaattagatgcaggtattgaaaatgagatcaataggttacttgcaggtgaggagggtaagcaaattaaggcgggcattaatattgctctccaagctaaagcctttgctaaattactttgtttagatgcatcagtattaagagacctttaccgtagctacattattctggatattgaacctatttattttttcaaaatgtggatagaaaaatatgatataaaaaaatgttcaattattttgaattttctaacacagagcttgatttgtgatatgaaatcgttaatgccaagttgctcccaaagttcagagtttggttatcttttggaaaaggtaaataaattacgattattatatagctttatagaaatgaatatagaaaatttagttaaagaagatttaaagagttttataaaagaagatgatttttatcaactaactattaatggaatgatatctccagaacaaatggaaaaatatttaatatcacttatggataatcaatggaaaggttattttattaaaataaaaatgaggttgctacaacagttaaagacaatgttcaataaatatcctgaattattatacttatctgatgattttagaaatgaatgccaaataatgatacaaaaaattatagataattatattaagcaagagcaatatcaattaagaaaataa

SEQ ID NO: 3139 - DNA, 1356 bp, Proteus mirabilis
actgcaaatataaaacatcatcactaccagatttataggagttattttatgtctatgagtagatcagagcagattgcccaattagaaaaagagtgggaacaacctcgctggaaagggatcaaacgtccttatagcgcagaagatgtcattaaattacgaggttccgttaaccctgaacataccttagcaagacgtggtgcgcaacggctttggtcatcattaaatggtaagtcgaagaagggatatgtcaatgcattaggtgctttaacaggagggcaagcattacagcaagctaaagcgggattagaagccatttatctatctggttggcaagtggcggctgatgcgaatactgctgccagtatgtaccctgatcaatctttatacccggtggactctgtacccaatgttgttcagcgtattaataatacgtttagacgagctgatcaaattcagtggtcaaatggtatcggccctcagcataaagattatattgattttttccttcctattgttgctgatgcagaagcgggttttggtggtgtacttaacgcatttgaattaatgaaagcaatgattgaggcgggtgcagcaggcgttcactttgaagatcagttagccgcagtgaaaaaatgcggtcatatgggcggaaaagtcttagtgcctacgcaagaggctgtgcaaaagctggtggcagcacgtttagcggcagatgtttcggatgttcctaccttattggttgccagaactgatgcggatgcggctgatctcttaacttcagattgcgatccttacgatagttcatttttaactggtgagcgtaccactgaaggttttttctgtactcatgcaggaattgatcaagccattagtcgagggcttgcttatgccccttatgccgatttggtttggtgcgagacttccacccctgatctgaaaatggcggctaaatttgccgaagcgatccatgataaatatcccggtaaaatgttagcgtataactgctctccatcttttaactggaaaaagaatcttgacgatagcacgatcgcccatttccaagatgagctttctgcgatggggtataaattccagtttatcactttagcgggtattcatagtatgtggttcaatatgttcgatttagcgcatgattacgctaaaggtgaaggtatgaaacactatgttgaaaaggtacaagaaaaagaatttgctgcactatcgaaaggctacaccttctcatctcatcaacaagaagtgggcaccggctattttgataaagtgacgacgattattcaaggtggtatgtcatctgttacggcattaactggctctactgaagagcaacaattctag

SEQ ID NO: 3140 - DNA, 1101 bp, Proteus mirabilis
agaaataacatgaaagcggcaaccgcagtaatagatcgccgcgctctgcgtcacaattttcagcatgtgagagactatgcaccacatagccacctgatagctgtcgtgaaagcaaacgcttatggtcatgggttattagaaacagcatatactttaatggatgatgctgattgttttggcgtagcacgtatcggtgaagccttaacattacgtagtggggggattgtgaaacccatcctactacttgaaggcttctttgatgctgttgatttacccattttggtggttaaccatattgagactgttgttcatagtgaagagcaactcgaagcgttagaaaatgccgatttagaagaacccgtaaaagtctggatgaagctcgatactggaatgcatcgtttaggcgtccgtcctgaagaagctgaggctttttatcaacgactttgtgcttgtaaaaatgtccaacaacccgtcaatttggtcagtcattttagtcgcgcggatgagcctgatattcctgaagtcacacaaaatcaaattcagctatttcaagcctttatccaagataaagcgggtgataaatctatcgcagcttctgcgggaattttattttggccacaagtccattatcaatgggttcgccctgggatcatcacatacggtatctcaccaacgggtgataacagaacaggtaaagactttggtttaaccccggcaatgacactaaaaacgagccttattgcggttcgtaaacataaagcaggtgaacccgttggttatggtggtacatgggtaagtgaaaaagatacttatctgggtgttattgctatcggttatggtgatggttacccacgtagtgcaccttctggcacccctgtttggatcaacggtcgaaaagtgccgattgttggacgcgtatccatggatatgatcagcgtcgatttgggatctgagctaattgatcgtgtcggtgatgaagctattttatggggagatgtgctacccgtagaagaaatagccaaatatagtggtattagcgcgtacgaattaattaccaaattaacttcgcgcgtcattatggaatacctagacgaacaatag

SEQ ID NO: 3141 - DNA, 570 bp, Proteus mirabilis
gaacatttaatgaaaaagttattattatctgcaattattacttcagcaatggccataattgctacacctgccctagcagaagatactggtacaccagcaccaacagaagttacagttaatagtggtactattaactttgaaggttctgtcgttaatgctgcttgtggtgttgatagtagttcaagtaaccaaactgttcgtttgggtcaattccgtgtcgctgaattcactaaaaaaggtgatgaaacaggacgtattccttttagcattaaattaaataactgcgatattactgtttcatcattagcagcaattacctttaacggtacagcttctgatggtgatgcaactgcattcgcattacaaggcagtggcgcagcaaccaatgtagcgttaaaaattaccgattcaagcagcaaaaatgttgttccaggacaaccttcttcaactcaaaaattaatcgaaggtgaaaaccaattaaattataacgcttctcttatttctactgatgatacagtgaaggcaggtagcgcaaacgttacaactaactttatggtgacttactcttaa

SEQ ID NO: 3142 - DNA, 1110 bp, Proteus mirabilis
catgaattaattaacatttattattgggttaactctatgctgtattatatttatgttctcagtggtcctttaaaagggataataacgcctttgctgcctaatcaatactcattaattctacatagtaaagaacatattgaaaataaaatagaaaatgagaaattaacactttacattccttgcaacaagaaagaacatgaaaagataattacgattatgcttgatgagcataatacaaaaaataataaatataaaatagaagatggtttaatttctaaagaaattagcaaagaactaccattagaactcgataagcctatatatatcaataattttcctattttcttaattagtcataaagatgatttgtctataacatcttttgatttaaattcaaaaaaatggacaattaatagaaaaatcattgtatcatttatatttgttattgcattttttatagtatcatttacttttatgaatgtatcaaaaccattagaaaataaaccaaaggaattggcttttaaaagttcatattcaaatgaatttaaaggagaaaatggttatttatgtatttacactgaaccttactcttctaaaaatttaataaaagatagtgattcaaaaacaaaaatttcatttttgaacaaagaaaaaattatcaaattagcaactaataataaaattcacgttactttaaaagacaacactaaacctatagtgagttttttttattataataaaaatgaaaagttaaaaatcattcaagccatcaatgacaattttcccaaaaattgtcagccaatcataaaagaattatcaattgctaaaattgttgaagagataaacaagctaaatttcactaaaacaataggatatactattgaagaaaaaaataacggcttaatttttatctttgatgataagctaagcgtaaatgacaaagaaaaatttaatgcttatataaaaaaacaggcagctttttttggaagaaaatttattttttatcgtgaaaataaagttaatatcaacttgaaaaataaagcaatgctacaagaagataatggatatatttttcttgataatcagcatcgttattttcctcaaggataa

SEQ ID NO: 3143 - DNA, 2622 bp, Proteus mirabilis
ttagccataataaactctatcgaaaacaaacgattattttgccacttttctctattaatattgtcacagcaccacagatctacgaaagactttctgttatgctttcgaagtattgctaataagaggctacaactatttatgtcagcttggcgtaaactatattataacacattgaatttaccactgaaattgttggtaaaaagtaaacgagttccgactgatcctatcactgagttaggcttagatacgtcgcgatctttcctttatgttctgccttatcactctaaagcagacttactgacattacgtcagcaatgtttatctcttggcttgccagatcctctgcaacccatagaaattaacggaaccaaactgccagcctacgtctttattgacgatggtcctagagtattccgttactactctcccgatccgcgtaaagattcagtgaaaacattccatgcttatcttgatgctcatcgtaacaatccgcatcttgatattgaaatgttacctgcttcagtgatgttcggtcgctcaccgggtcgagaaggtcataatggtgtcccccatttgcgcttattaaatgggatccaaaaatttattgccatcctctggctaggtcgagatagttttgtccgtttctcgccgaccgtatccatgcgccaaatggcgaatgaacatggaaccgataccagcattgctcgaaaacttgcgcgtgtggcacgtattcacttttcacgtcagcgtttagcagcagttggcccaaaactacctgcacgccaagatctcttcaataaactattggcatccaaagccattgaaaaagccattgaagatgaagcaaaagcgaaaaaaattacgcttgataaagcacgtaaaaatgccactgatatcatggaagagatcgccgctaatttctcttatgaagcggtacgaatgactgatcgtgtattaagctggacatggaataagctctatcaaggtatcaacgtttttaatgcagaacgtgtgcgccaacttgcgcaagatggacatgaaattgtctacgtaccttgtcaccgtagtcatatggactacttattgctttcctatgtactttatcatcaaggattagttcccccacatattgctgcgggtattaaccttaatttctggccagcaggaccgattttccgtcatttaggggccttctttattcgtcgaacctttaaaggaaataaactttattcaaccatcttccgggaatatttaggtgagttattctctcgaggctactctattgaatattttgttgaaggtggacgctcccgtacaggtcgactgttagatcctaaaacagggactctttcaatgaccgtgcaagccatgttacgtggtgaaacacgccctatttccatcgttcccatttatattggctatgagcatgtcatggaagtagccacttatgccaaagagttgcgtggtgcgacaaaagagaaagaaggttttatgcagatgatcagaggattacgtaaactacgtaaccttggtcaaggctatgtcaattttggtgaacctatttcgctatcacaataccttaatcaggcagtgcctgactggcgcgacgatattgatcccattgagccacaacgtccaagctggttaaatcctgcagttagtgcgttagcggataatattatggttaatattaataatgccgcttcgattaatgcgattaaccttgtctctacggcattgctagcgtcccgtcagcgagcactaactaaagaacaattattagagcaaatagattgttatctacagttactgcgtaatgtgccttactcatcagatatggttgtccccgataaaagctcagagacattattagcacacgccttgcaaacagataaattccaagttgagcaggatagtcttggtgatattattatattgcctcgtgaaagtgccgtattgatgacttattatcgcaataacaccattcacttaatggttacaccatcattaattgcgagcattgtcttgcatcacgagcgtattcaccgtgatgacttaatgaaacaggtagaattaattttccctcttatcaaagctgagttgtttattcgctatgaaaaagaggagttacctgatgtggttaatacactgattagtgaactttgtcgccagcgtctaatttgctgtgctgatgatggcatattacggatcaatccagcacgtattcgcccattacagcttttagcagcaagtgttagagaaacgctacagcgttatggtattacgctctctctactcaattttgctcctgaaattagccgtgcactattagaaagagaaagccgcattttggcgcaacgactttctgtattgcatggtattaacgcacctgagttctttgataaagcggttttctccactttagtttctacactgcgtgaagaaggttatcttaaagataatgaagatatcctcaaagcagatgcctctgcactttaccaagttattgcgaaattaatgtcaccagaaattcgtttaaccattgagagtgtaggcgttactgaagataacaattcagcacaagcgattgaggaaaaccctgagtccagcatggataagtag

SEQ ID NO: 3144 - DNA, 714 bp, Proteus mirabilis
ggtgaggtaatggacaatcaattaattgaacggattgttgcagaaatagaaaagcgtataaaaaagccggtgttgttagttttaacaccggcgccgggatatcgtgatgaaatctatcaacgcattagccatttttccactgtacgggcttctatttttgttaccacacaggcacagcaatgccatgatttatcgcagtggtgccatgtaggggatatcactaaagccgatgagtttgatccccataggttatctgcttatcaggcattatttattccctattttgacaaaaagctggtgggggaaattattaatgggttaatgattagtgaagaaggaacacttattcattccgcattggctaaaaatattcctattattgcattaccttacttttgtcagccaaacagtgaaattaatgaaattttaggtttaaaccaaaatgaacactataacttagtgctaaaacagaatattgaacgattaatatcaatgggtattactttttgctcaataaatgaagttgaagataacttaaaaaagaatgcttttgatcacaagttaaaatttattaataaaacggaaacaaaacaactgaataataatcgctatattactttgaagcaagtaatgagcaaccctgaaaaataccaattatcacaagataaattaaccgattctgctattgaatatttaaaaagtttgaaagattaa

SEQ ID NO: 3145 - DNA, 441 bp, Proteus mirabilis
tgtattacaatctatttaggagtgattatgtcttttgatcttgctagcttacttatggatgcaatgaatgttattggtcggaatgatttattttcaggggggaaatcaatcgataaccattcaaccattaccattagtttaggtgatatgccagatattaatttattggttgttgacgaggttcctatgatttggtcggtgctttgtgattatgatgaaaaattacttacacaaattagtgccgaattattattagatagcatcaataatcaaacagaaagtttttaccctggacaaccggccttggtgagaattgaggactctttagaattaagagcatcatttatgccaattgcattgcaaaatggagaaagcatggcaagagccattgatgactattttcaaattatgaatagtatacatcaacggtttattggctaa

SEQ ID NO: 3146 - DNA, 1170 bp, Proteus mirabilis
taccctgcaattttatgctcgctatgtagcgactcaacttcctgttcaagccggatcggcgaatgcaacagcaacctttttactggagtaccaataatgacacgctctttttctttcttcacattgctggtttctcttctttgtatcccgagccaaatggcatgggctattgcagatccattagtggtaacccctccacctatgaattttgatggtgccgccgatggtactcccgcaggaacgcccatcacatcaacttggataggtgaaacctctgtccataatggtttcaaatgtgagaagaaatttttgcaaaaatgttgggttgaaaccctctatgctaatgctactggttcaaaaattagcgggatctactattacgaaggtagtaatcgttatcctgtttattcactccccggagttaaaggtatcggctatgcttttggtttaaaagataacaatgatagtgttgcttacgtacctattgatgttgataacggttcgggtgcaacggtgatttatcctgcagtaggctctaccgttaaccataatgtggatcgcgtttcactgaaaggcaaagtcgtctttgtggtgacagataaacatcttgagactggcgtttataacattccatatacagttatcaccaatacatggtctgaatatggtggaggccataaaggcaataatacctctatcgtagcaattaaccccgtcactattactattaaagctcgaggctgtaccgtaaataccaaaaatctcacctatgaattaggtgatatctcaatgcgagatatggcagccattggttcaacatcaaaaagtcaggctaaacccatctctgttacatgcgatagtaatgtgcatttatatgccagcatgaccgatcagtctacctattctaataatacagatatcctcacactgacatcagactctgatgcttctggtattggtattcaatttttctttaatgataatccaactcccgtggtgtatggccctgatatcagtgcgataggacaacctaaccaacgtttactccatataacaacttctaacaacgaaaactacatattaaacctgtcaactcgctatatcacgactgggacactaaaaccgggtaaagcaaacggattagccagtctcactttttcttatcaataa

SEQ ID NO: 3147 - DNA, 651 bp, Proteus mirabilis
gacaataaaatgtcgatcctgttctcaatggagaaattcattactcatcatattcaaattttagcttacgtgataaacttcatcgcttatgatttcaaaaaatttactttcgcaggagtacctcacatggcgagcagaggcgttaacaaagttattcttatcggtaatttagggcaggatccagaaatccgttatatgccaagtggtggtgcagtggcaaatctgacactagcaacttcagaaagctggcgcgacaaacaaaccggtgaaatgaaagagaaaaccgaatggcaccgtgtggtcattttcggcaaactagcagaaattgctggcgagtatctgcgtaaaggttcacaagtttatattgaaggtcaattacaaacacgtaaatggcaagatcaaagtggtcaagatcgctacagcactgaagttgtggtgaatatcggtggcacaatgcagatgttaggtggccgtggtggtcaagataatgcaccttcacaaggccaaggcggttggggtcaacctcagcaaccacaagcatcacaacagtttagtggtggcgcaccatctcgcccagcacaacaacccgcagcggcaccagcgccaagtaatgaaccaccaatggactttgatgacgatattccgttctga

SEQ ID NO: 3148 - DNA, 1728 bp, Proteus mirabilis
ggtcagttgatgacagctgaagacttagtcgctcaaacgatcttacaaggctttgatgcacaatatgggcgttttcttgagataacgtcaggtgctcaatatcgttttgagcaagcagattggcatggtattcaattagcgatgaaagagcgcatccgcttatacgataatcatgttggattagttgtggaacaacttagatgtatccgacatgatattgataaagaaagtgttttcttacaaaaagtcaaagagcgatacacacaattattacctaactatccccgttttgaaattgctgaaagtttttttaattcagtctattgtcgtctatttcatcatcgagagcttaataaaaaaaacttattcgttttttcatcacaacctgcgtatcgttttgcgcaagcccctcgccctttatcaagaacgtttgttatacaaagtgatttacccgcattattgcaagatattttatcgcgcctacctttgcgtttaccgtggcaaaataaatcgcgagatattcaatttatttgccaaacgctctatgcgcaatttagccatgaggaattacaaaatgcggtatttcacattgctaatgagctattttaccgtaataaagcggcatggatgattggtaagatagcgataaataatcaattcattcccctgttattacctattcataatattgaacagcacttagttattgatacctgtttaacgacaatagatgaagccagtattgtttttggttttgctcgttcttattttatggtctatgcgccatttcccgcggcattagtaacatggttacgggatattctccctgaaaagtctattgcagagctctatatgtcgattggttgtcagaaacatggcaaaactgaatattaccgtgaataccttgcttttatgaatttttcatcggaacaatttattgaagctccgggggtaaaaggaatggtgatgctcgttttcacactgcctacttacgatagagtgtttaaagtgatcaaagataggtttgcgccacaaaaaacaatgactgcagagcgtgtcaaagagtgctatcgcttggtgaaagaacatgatcgtgttgggcgaatggcggatacgcaagagtttgagaactttgttattgataaaaagcggatcagtaacgacttaatggcgatcttagaacaggagatccccaataaattagaagatctaggtgataagttactgatcagccatctgtatatggaacgccgtatgacgccacttaatatctatatggagcagtgtgacgataaacagttaaaagcagtggttgaagatcatggccaagcacttaaagagttgattgccgcaaatatttttcctggtgatatgttatttaagaattttggcgtgacacgtcatcatcgcgttattttttatgattatgatgaaataagttatatgacagatatgaatttccgtgctattcctcccgctcgctatcctgaagatgaactggccagtgagccttggtatagcgttgctgaaaatgatgtttttcctgaagagtttcgttactttttatgttgtgataagcaagtatgtcattattttgaagctcaacatcgtgatcttctttcacctgaatactggcaacaacagcagcaaagaattaaacaagggtatattgaagatgtttacgcctatccacaaagtaaacgttttattgataacgatatcggttaa

SEQ ID NO: 3149 - DNA, 651 bp, Proteus mirabilis
aaaataatgattaatcaacaactaatgggaaaaattctcactcgtttaaatatccccaatgtgggaatgggcataaatcaagggatcgctattcctgttggtatttctaatcggcatgtacatctttcacaacaagatgtagatgcgttatttggtcacggctatcagatcaccccgtttaaagatctaaaacaaccgggacaatttgccgccaaagagtgtgtgatggtagtcgggcctaaaggctctatcagtaaagttcgtgttttagggccggttcgtccacaaagccaattagaaatttcaaaagcagattgttttgcattaggtataaaggcacccgtgcgtagttccggtgatttggcaggctccggtaatgcggttttaatggggcctgcgggatatgtggaattaaaacagcaagtcatttgtgctcagcgtcatattcatatgaataatattgatgctagagcgttaaatgtgaccaatggtcagaaagtgcatgtaaaaacagagggtgaacgtagcctgatttttgatgaagtgattgtgcgcgtcagtgataaatttgcattggaatttcatattgataccgatgaggcaaatgcggcaggagttagaaataacgacagcgtgtttattgtcagctaa

SEQ ID NO: 3150 - DNA, 270 bp, Proteus mirabilis
aggagtgccttcgggaacgctgagacaggtgctgcatggctgtcgtcagctcgtgttgtgaaatgttgggttaagtcccgcaacgagcgcaacccttatccttttttgccagcacgtgatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataa

SEQ ID NO: 3151 - DNA, 222 bp, Proteus mirabilis
ataaaagcctttccctttataattttagtcgttttatcatcgtatattcttattggatattcatcatttaaaggaatgcacatgaataataaattccctgataaaatatttttatcgccacttatttttatatcatttattaacatggtaaatacctcagcctatacttataatctattaagggttcaaaaaaacaaactatttttcaaaatgttattatag

SEQ ID NO: 3152 - DNA, 516 bp, Proteus mirabilis
gagagaaagatgaacagtttaggtgtgattgaaacacgcggattaaccgctgcgatccaagctgctgatgcggcttgtaaagctgccagtgttgaaattatcggttatagaaaaattggatcagggttagtttctgtctgttttcaaggtgagatcagtgcggtaaaaacagcggttgagcatggtgtagatgtggtgagccaaaaagagttggttatcggatcactcgtcatagcaagaccagaaccaagtgttatcaccaaattgctgacaataaaaggtaagaaaaaaagcgctgttattagtgaagaaacacaacagaatgcactcaaaacgctggctgaaaacagggttgaaactgtcatgaagcacgaaagtggagatagtgacgcgacaaaagaagttgcagatagactggctcaaaatagtgcccctgaaactaaagcaatgacagcagataaagcaccaagcagtaaaaaagagagtaaacctgaaagccgtaaaggtaaaaaataa

SEQ ID NO: 3153 - DNA, 657 bp, Proteus mirabilis
ttaggaaagataaagatgaatcattggaatacaagtgcagagtctgtactaaaatcagggcccgttgttcctgttattgttattaatcatattgaagaagctgtacctgtcgcaaaagcgttagtcgccggtggcgtaaaagttttagaagtgacactacgtacagactgcgctattgaagctattcgtcgcattgctaaagaagtaccagaagccattgttggtgcagggacagtgatcaaccctcaacaattagcccaagtcacagaagcgggtgcgcaatttgccattagcccaggcttaaccgatgcgctattaaaagccgcggtagcaggctctattcctcttatccctggtatctcgactgtttctgaattaatgctcggtatgagttacggtttaaatgaatttaagtttttcccagcagaagctaatggtggcgttaaagcattaaaagcaattgcaggaccattctcacaagtacgtttctgcccaaccggcggtatttcgcctgaaaactaccgtaactaccttgcactggaaagtgtactttgtatcggtggctcttggttagttccgagtgatgctgtgaaagcaggagattatcaacgtattactgagctagcaaaagaagctgttgctggcgctcaacattaa

SEQ ID NO: 3154 - DNA, 1071 bp, Proteus mirabilis
cgatcatttgtcattatctctacaggtcgttacaacgctggtttatataatcctaggtcaatcatcaatcttataaaggagattacgatggctaaacgcattcagtttgcagctcatggtaatgccgatgtactcgagctaacttcatttacccccgcccctctaggcgataacgaagtacaggttgccaataaagccattggcattaattatattgatacttatgtgcgtagcggattatatccagtagagcatttcccaagtggcttaggaactgaagctgccggtgttgtgattaaaacaggcgctcatgttacttcacttaaagaaggggatagagttgtatatgcacaatctccattaggcgcctacagcgatacgcataatgtaccagaaaataaagtagctcgcctgcctgataatatctcttttgaacaagccgccgcctcttttttgaaaggattaacggtttattatctattcaatgaaacatacaaattacgtgcaggggaaacctttttattccatgcagcggctggtggcgtcggactaattgccagccaatgggcgaaagcgattggcgctaaaatgattggtaccgcaggcagtgatgagaaagtggctaaagctaaggccgcaggtgcatggaaagtgattaactatcaaactgaatctattgttgaacgtgtccttgcgctcaccaataaccaaaaagtacccgttgtgtatgattctgttggcaaagcaacttggttggattcgttgcactgtttgcaacgccgaggcttaatggtcagttttggtaacgcttctggtgcggtaacaggggttgatttaggtattcttaataaattgggttcactttatgttactcgtccttctatttccggctacattacgacgcgcgaagagttagatgcagcaagtgaagcactatttacgttaattggtcgtggtaaaattgatgtcagtgtgccagataatcagaaatttgcattagctgatgctaaagccgcacaccgttatcttgaaagtcgtcaatctcaaggttcaagtctattgatcccatag

SEQ ID NO: 3155 - DNA, 1647 bp, Proteus mirabilis
atgaaaaatgtaaacccaactcataccttagcttggaaggcattagaagaccattttgccgtgatgaaagatacagaaatgaaaacactgttctctcaagatccatcacgctttgacaccttttcaagaacgttttcagaccaaattctagtcgatttttcaaaaaaccgtatcacccaagaaacattagataaattacaggctctggctaaagagtgtgatgttgctggtgcgataaagagcatgtttagcggtgaaaaaatcaactgtacggaagatcgtgcggtactccacaccgcattacgcaaccgtagcaatacaccggttatggtcgatggcaaagatgtgatgccagaagtcaatgctgtattgcataaaatgaaagtatttagtgagcgtgtgattagtggtgaatggaaaggttacacaggtaaagcgattactgatgtggtcaatatcggtattggtggctctgatttaggcccgtatatggtgacagaagcactgcgcccttataaaaaccacttgaccatgcattttgtttctaatgttgatggcacacatattgctgaaaccttgaaaaaatgcgatccagaaacaacgctattcttgattgcttcaaaaacctttaccacacaagaaaccatgactaatgcacactctgcaagagattggttcttatctgcggctaaagagagtgcttttgttgcgaaacactttgttgcgttatcaactaatagtgctgaagtagaaaaatttggtattgataccgcaaatatgtttgagttttgggattgggttggtggccgctactcattatggtcagcaattggtttatccattgtattatctattggttatgacaactttgagcagttactgtccggtgctcatgctatggataatcactttagaaccactgaagctgaaaataatattccgatgatattggcgcttattggcatttggtataacaatttttttggtaccgaaactgaagcgattctgccatacgatcaatatatgcaccgttttgctgcttacttccaacaaggtaatatggaatccaatggtaaatatatcgaccgtgatggaaacaaagtcagttaccaaaccggacctattatttggggagagccgggaactaatggccagcatgcgttttatcaattaattcatcaaggaaccaaactgatcccttgtgattttattgcaccagcgatcagccataatccattatctgatcatcatgcaaaactaatgtcgaacttctttgcacaaaccgaagcattggcatttggtaaaactcgtgagcaagtcgatgcagagtttgcctcagcaggaaaagatcccgcaaccatggggtatgtggcaccatttaaagtgtttgaagggaatcgtcccaccaactccattcttttaaaagagatcactccctattcattaggtgcgttaattgcgatgtatgaacataaaatctttgtacaaggtgtaattttcaatatcttcacctttgaccaatggggcgttgagttgggcaaacaattagctaatcgcatattgccagagttaaaaggtaaggaaagtgttaacagtcatgatagttcaacaaataatttaattaatcgttacaaagcatggcgttaa

SEQ ID NO: 3156 - DNA, 471 bp, Proteus mirabilis; identical to SEQ ID NO: 1406

SEQ ID NO: 3157 - DNA, 1227 bp, Proteus mirabilis
ataaagatcgttacaaggcgatgtccgtggttgccattgttgagaaggtttatcgggacagtaaggagtaataacgacatgagtgagtttctgataaaacccaaaattcagtttggcaccaatgcactgaattttctctctgggttaactgcccgccgcgcatttgtggtgacagataaagcaatggtgaagtttggctttgcagataaagtcactgaaaaattaatgcaacgaggtattgagtttcaaatctatgatgatgttgcatcagatcctgatatttcagccattgtcagtggtatgaaaataatggatgcccattatcctgatttggttatcgcactcggcggtggatctgttatcgatgctgctaaagccgttatgtactccctctggcatacccgtaaagagcacagtagaagtaaaccgcagtttattgcgatccccacgaccagtggtactggctctgaagtgacctctttttcagtgatcaaatcacgcagtgaaaaactggtattggtcgatgagtttatgttgcctgatatcgcgatcctcgatcctgaacttgtgaaatctgtacctcctgcaattaccgctgatacgggtatggatgtcctttgccatgcattagaagcttatgtgtctaaagctgcatctgatttttctgatgcgatggcagaaaaagcagtcaaattagtgtttagccatctgcttgattgtcatcatcaaggggataacttacttgctcgcgaaaaaatgcacaatgcatcttgcatcgcaggtatggcatttactaatgcgtcgttaggtattacacacagtcttgcccatgcattaggcggtgtttttcatgtccctcatggccgtgcgaatgcgttattgatgacacatgttattgcctttaatgccaatcttcatggtgattgtaatagcgaagcagcgaagcgctatgcctaccttgcccaaagtttaggattacctgcgcagacggtaaaagaaggcgttatcagccttattgtcgccattaatgtattgaaagatgaaatgggtatgccgaagagtattcgcgataccggtgtcagtgaagcggacttttatgcccgtttaacggaaatggtcggacaggctttacgcgatagctgtacgccgacaaatccgcgtgacgtaaacacacaccaattagaaacattgtatcgtcaggcatttgccggtgtatcacacagttaa

SEQ ID NO: 3158 - DNA, 255 bp, Proteus mirabilis
gggttatccgtaacggcgaatggctgtaatttgtatctaattcattcaatacaaattattgtaccagatgcgctgaaacctcgtcctccagtttatcagggcggggagaacgtcaaaaagatgcagatgatatgtaaaaacataaaatcatctgcattttctgtttttaatttatacaaaaaaacatatgttccgctgacttttatcttttatctgcttaacgaggcttatagtcaccggtttttttctgcttaa

SEQ ID NO: 3159 - DNA, 1440 bp, Proteus mirabilis
ttgatattttttcgactttgtgcaggatttatggccagaaacaagaccactgacaagctaatgtctgagataaaagatcgccaaatggaagggttgaagcttcccccccattcgctagaagccgaacaatcggtgttaggcggtctaatgatagataacgagcgttgggataatgtctccgagcgtgtcactgccgatgatttttatagccgacctcatcgcactatttttgcgcaaatgcagcgtttacttgagctgggtaaacctattgatctgataaccttatcagaagcactagaacaaaacgcagaattagaaagcgttggaggctttgcttatttagcagaactatccaaaaatacgccaagtgcagccaatattaacgcttatgccgacattgttcgtgagcgtgctgtcgttcgcgatatgatcaaagtcgccaatgaaattgctgatgctggatttgatccccaaggacgcaccagcgaagatctgctcgattttgctgaatctcgcgtctttcaaattgccgaaacccgcgccaataaagatgaagggccaaaagcaattgatgccattttagaagaaaccgttgaaaaaatagagcaactctaccaaaaacctcatgatggtgtgacgggggtatccagtggctatcaagatctggataaaaaaactgccgggctgcaaaaatcagatttaattattgtcgcagcacgtccttctatgggtaaaaccaccttcgcgatgaacttatgcgaaaatgcggcaatgacggaagaaaaacctgtacttatctttagcttagagatgccaggtaaccaaatcatgatgcgtatgctcgcttcattgtctcgcgtggatcaaacccgtattcgtactgggcaacttgacgatgaagattgggcgcgtatttcaagtaccatgggtattttgcttgaaaaacgtaatatgtatattgatgattcatctggtttaacccccaccgaggtgcgctctcgtgcccgaagaatttatcgtgaacatggcggtttaagcctaatcatgattgactacttgcagttaatgagagtaccttcattatctgagaaccgaactttagaaattgctgaaatttcacgctctttgaaagcattagctaaagaattacaggttcctgttgtcgctctgtcacagttaaaccgtagtttggaacaacgtgctgataagcgcccagttaactctgacttacgtgaatcgggctctattgagcaagatgccgacttgattatgtttatctatcgtgacgaagtttatcacgaaaatagcgacctaaaaggggtggcagaaattatcattggtaaacagcgtaatggccctatcggtacggtaagactaacctttaatggtcaatggtctcgctttgataactacgcaggccctgcttacgacgacgaataa

SEQ ID NO: 3160 - DNA, 1116 bp, Proteus mirabilis
aggaatttagttatgtcttctatattacctcgctctgtaacatcccctaaaaaattctttattggtagtcaattacttgcttctgttggtaattatatgaaagatttcggagataatgcttttattatcagcgatgaatttttcctagaaaaagtaaataaagaagctttgtcgtcaattaaagaaaatgggctatctggtttcgttgaaaaatttaattacgaatgtacagaagctgaagtggatcgcttgggtaagattgttgttgaaaataaagcgaatgttattatcggtatcggtggtggtaaaacattagacgtatctaaagcggttgcttattatcatcacctccctgttattttattcccaacgattgcttctacagatgcaccttgtacagcactttctgttctttataaagaaaatggtgaatttgataaatacttattcttacctcagaaccctgatatggtgattgcggataccgcgattattgcttctgcaccacaacgcttcttctctgcaggtgtcggtgatgctttagccacttattttgaagcacgtgcttgctatcaagctgatggacttaatttagttaatcaacgtccatcacgtacaggtttaggtctagcacaattgtgttttgaaatattgagtgaaaatattgataaagcaatggatgctgtgcgccataaaattaccacacaagctttagagcaaactattgaagcgactatttatttaagtggtgtgggggctgaagcaggtggtttagcagccgctcatgcggtcaataatggtatgtctgcagttgcttccttacatcatgtgcaacatggtgaaaaagtggtatttggattattaacacaattagtgttagaaaatgcgccacaagaagaaattgatgaagttattcgtattatcaaagcggctgaattgccattaacgcttgaagatatgggaatgaaagagtttattgaaagtgaatggcgtaatgtagcgaaaattgcttgtgcagaaggtgataccatgggcaatatgccgatgaaagtgactgaagaagatgtctacaacgcaatgattgcagcgaatgcattagcgcatcgctataaataa

SEQ ID NO: 3161 - DNA, 765 bp, Proteus mirabilis
ggctcaatagtaatgaatagacggtatttgttattactatttttatgttgcttacttcctttattaaacggttgtaaggatcaatcactgctcactaatttaagtcaaaggcaagcaactgaaattcaagcggtgttacagaaacaccaaataacaagtactcgtactgcgttaggaaaaggattatttgagatctcagttaaaaaggaaaatatagggattgctattcaaatattagaagaatatcaattaccaacaatttctcgtattgaaattacacaattatttccatcagatgcattagtttcatcgcctcaagctgaaaaagcacgtttaatttcagccattgagcaacggttagaacaatcattattaaccattgatcatcttatcgatgcgagagtacatgtcagttatccactatcatcaaatgatcgtataacgccaacacctcatgcttctgctttagttttctatgaagatggcatgatagatagtgatcagctaagtgacgatgttcgtgcttttatccataatgcttttaatgatatggatgagagtaatattactgttttattatatccacggaatatcaataaatttacgatattaaataatcaacttcaccaagataatacgacatcattgagtagctcttggttactcatagggttatcaataattagtttaattataataattatggtcatattgattatttatcgtcgtaaacaagtcaataaaatggtaagcgagaatgagtaa

SEQ ID NO: 3162 - DNA, 771 bp, Proteus mirabilis
gctgaggtatttaccatgttaataaatgatataaaaataagtggcgataaaaatattttatcagggaatttattattcatgtgcattcctttaaatgatgaatatccaataagaatatacgatgataaaacgactaaaattataaagggaaaggcttttatttataattcaaaaaatgaaaatgttatttttcaatcagaaaatcagtcatggcgtattgaaaagagatcattttttatttgtgccagattattggcatttattgattatgctagagatttttcaaaaatgacagcagttggcactaattttgatattaatcaacaaattttttatataaaagaggggagtggaacattagaacatctgattattaatgaggcactgaaagatgaaagccaattagaacctctttttgtgacaataagacacagtgaaagttactggcttatattacatctgattagttatttggatgagaaaaaaagcaatattgcacaaataggtgaacgatatggtgtatcagggacacattttagacggctgtgtaaacgttatttaggtaattgtggtaaaagtcaattacgttcatggcgtgcggcatcttctattttgacaacgctatcaacagatgaatcattgactcaaattgcagtcgataatggttttagttcagcatctcatttttctaatgaaattaagacattatttggtattacaccaactgaatttcggcgaattggccaatatctttatgaacataaaaaataa

SEQ ID NO: 3163 - DNA, 522 bp, Proteus mirabilis
gactcggtttccctacggctcccctatacggttaacctcgctacagaatataagtcgctgacccattatacaaaaggtacgcagtcaccccatcctcaaatgtcccgcttgcctttgcgttcaatcttgcccgattttttaacttccgttgctcgtgtacttctaggtacactgcgcgacggcttgaaaaaatcgaccaaccttgttagcaaattcggcgctattttcggtgatgttcttgcatcactcagtgcgaggcacttgagtgatggggctcctactgcttgtacgtacacggtttcaggttctttttcactcccctcgccggggttcttttcgcctttccctcacggtactggttcactatcggtcaatcaggagtatttagccttggaggatggtccccccatattcagacaggataacacgtgtcccgccctactcgtcgagttcacaacaacagcatcttcagatacggggctatcaccctttactgccggactttccagaccgttctcctga

SEQ ID NO: 3164 - DNA, 975 bp, Proteus mirabilis
attcaggcttctagatgtctagatgtttttttagaggttattgagatgccaatcagagtaccagacgaactacccgcagtgagttgtttacgcaatgagaatgtctttgtcatgacatcaagtagagcgagtattcaagatattcgtcctttaaaagtactgttactcaatctgatgcccaaaaaaatagaaacagaaaatcaatttctacggttgctctctaatagtccattacaaattgatatccaattattgcgtattgattctcgtgttcccaaaaatacacctgttgagcatcttgatactttttattgtgattttgcccaaattaaagaacagaattttgatggtttgattgtaacgggagcaccattaggtttagttgaatttgaagatgtggcttattgggaggaaataaaagaaatcattacatgggcaaaagagcatgttacttcaacactttttatttgctgggccgctcaagcaggcctaaatattttatatgacttacctaaatataccttaaaacaaaaaatttctggggtatatcgtcatacaacatgtgatcctttcgcgttactgactcgtgggtttgatgaaacattctttgctcctcattcacgttatgctggttttcctgttgagtttattcaacaaaatacagatttagaaatattagcaacatcagagcaagcaggggcttacctattcgcatctaaagataaacgtgttgtctttgccacaggtcacccagaatacgatcccaatacattagctgacgaatatcatcgtgatgttaaagctggattagcaccacaactacctgaaaattattttcccgataataatcctaataaaaaacctcttgtatcttggcgtagtcatggccatttactctttgcaaattggctaaattattatgtttatcaaattacaccatttgatctggcacagatgaacccaactttagattaa

SEQ ID NO: 3165 - DNA, 513 bp, Proteus mirabilis
cgaaaatattcggcaaccgttgttgccactaaagccgcattacacctttctaccgctgattgttctgaagttgagcaaattaaaaccgtattttcacatcgcttatgttgctttaattcttcaataaactctgtaacttctcttcctcgttcaccaatcaagccaataacaaaaacatcggcctgtgcaaaacggataatcatattcattaacatcgttttacccgttcctgcactagcaaaaatccccattcgttgccccaatccacaacttaataatccatcaatagcacgtatacctgacttaaatagtgttgtaataggcagcctatcactaaacaaaggtggccgaccttcgataggacataaggtattaaaggtcttctctgctatttctgtattaaatcgtaataagcaattccctttactatcaatcatgctgcctaatatatgtgggcctagggcaactgaaaatgtttttcctgttggctcaactataatttgtaaagagtaa

SEQ ID NO: 3166 - DNA, 219 bp, Proteus mirabilis; identical to SEQ ID NO: 887

SEQ ID NO: 3167 - DNA, 597 bp, Proteus mirabilis
tcactaatgttgaagaacccaatccatttacgtttagaaaagcttgaaagttggcaacacttaacgtttatggcgtgcctgtgtgagagaatgtatccaaattatcaggtattttgtcgcgaaacaggatttactgatccaaccctgtatcgtcgtattctcgatctagtttgggaaactttaacggtaaaagatgcgaaggtgaattttgattctcaattagagaaattagaagaagctattcctgatgcatctcagtttgatatttatggtgtctatcctgcaatcgacgcctgtgtggcactgagtgagcttattcattctcgtttaagtggtgagtcactcagtcatgctattgaagtgagcaaaatttcggttggaactgttgctacacttgaaatgacacaagcagaaagagaaatgtctgaagaagaattaaaatctcttgctgcggtcactgaagagttcgatattcaatgggaaatttatcgcctacttgttgagtgcgaagaaagagatattgaactaataaaaggtctgcgtacagacctgcgcgaatctggaatgagcaatatcggtatagaattaacgcactaa

SEQ ID NO: 3168 - DNA, 1149 bp, Proteus mirabilis
cccattaacccaatatttagaggctttctaatgaaaacattttctgattattggcaacaattagattgggatgacatcacgttaagactgaatagtaaaacttgtgaagatgttgaaactgctttatctcatcatactttaactcttgatgattttatggcgctgatctcccctgctggccgacattatttagagccaatggcacaacgcgcccagcaactaactcgacaacgttttggtaatgttgtcggtttatatgttccactgtacctctctaatttatgtgctaatgattgcacttattgtggtttttcaatgagtaatgccatcaagcgcaaaacattaaatgaaaacgaaatccttgctgaatgtcatagcattcggcaattaggttttgatagcctgctactcgttacaggagagcatcaaagaaaagttggtatggattatttccgtcaatatataccgcttattcgccagcagttcagtttattaatgatggaagtacaacctctggcgacaaatgagtacgctgaattaaaaacgctcggtattgatggtgtaatggtttatcaagaaacctatcatgaacccacttatcagttgcatcatctaagaggaaaaaaacaagattttcattggcggttacaaacccctgatagattagggcaagccggcattgataaaattggtttaggtgcactaattggtttatctgacagatggcgtaccgattgttatatggtggctgagcatctgctatttttacaaaaacgttactggaaaagtcgttactctatctcctttcctcgtctacgcccatgtgctggtgggcttaatcctgcatcggtaatgagtgaagcagaattagttcagttgatttgtgcttttcgtattttagcccccgatgttgagctttccctttcaacacgtgaatcgccttactttcgcgataatacagtacctttagccatcaataatatcagcgctggctctaaaactcagcccggtggttattctgatagtcatgaggagttagagcaattttcacctaatgataatcgtcatgtcagtgatgtaattaatgccctcaaaacacgaggattacagcctgtatggaaagattgggataactatttaggtcgttaa

SEQ ID NO: 3169 - DNA, 696 bp, Proteus mirabilis
ataaggttcactcgaatgacaaacataacgaaacataagatcgctatttttgatttagatgaaacactgttagccggagattctagctgtttatggacaaattacttgtgggagaaaaagagagtcactgatcctgcttttttagctttagataaacaaatgatcgctgactattacgcagaaaggctcaatataaataagtacttacaccaacatttatcttattttaatcagcataatattgaagaaataaatcaatgggttactgattttactcataccataatcaagccattgctctatcctcaaggcattaataccataaacctataccgacaacaaaatatccccgttatcattatctctgcaactatgtcttttctggtacatgcgattgcaaaacaacttaatgctgatatttctatgggcattgatatgcagataaaaaataatcattatacaggccatattgagggtattcctacctttagagagggtaaagtcactcgactcaatcagtggaaagaacaaaacaacattaataattcttatatttatttctatactgactcagccaacgatctccctttatgctatcaagcaaatgaggttatcaccattaacgccgatgaaagattaagccaaatagcaacagaaaaagaatggcaacagtgctactggcagttaaataaataa

SEQ ID NO: 3170 - DNA, 4302 bp, Proteus mirabilis
ctacactggtttaaaggggtgaatgacaggggtcatttgcctggcaggtctaactccgacaggagccatttcgtgaaagacttattaaagtttctgaaagcgcaaaccaagaccgaagagtttgatgcgatcaaaattgctctggcatcacctgatatgatccgttcatggtcatttggtgaagttaaaaagccagaaacaattaactaccgtacgttcaaaccagaacgtgacggccttttctgtgcccgtattttcggaccagtaaaagattacgaatgtttgtgtggtaaatacaaacgtttaaaacaccgtggtgttatttgtgagaagtgtggcgttgaagtcacacaaactaaagttcgtcgtgaacgtatgggtcacatcgaattagcttctccagtggcgcacatctggttcttgaaatcactgccgtcccgtatcggtctgctgttggatatgccactgcgcgatattgaacgtgtactgtattttgaatcttatgttgttgttgaaggcggtatgaccagccttgaacgtggccaaatcttaacagaagagcaataccttgatgcattagaagaattcggtgatgaatttgacgcgaagatgggtgctgaggctgttcagaacttgttacagagcatggatctggaacaagagtgtgaaacgctgcgtgaagagttaaatgagactaactctgaaactaaacgtaagaaactgactaaacgtatcaagttacttgaagcattcatgcaatcaggcaataaacctgagtggatgatcttaactgtactgccagtgttaccaccagacttacgtccactggttccacttgatggtggtcgttttgcgacttctgacttgaacgatttatatcgtcgcgttatcaaccgtaataaccgtttaaaacgcctgctagatttagcagctccagacattatcgtacgtaacgaaaaacgtatgttacaagagtctgttgatgcgttattagataacggtcgtcgcggtcgtgcaattacaggctctaacaaacgtcctctgaaatctttggctgatatgatcaaaggtaaacaaggtcgtttccgtcaaaacctgttaggtaaacgtgttgactattctggtcgttctgtaatcaccgttggtccatacctgcgtctgcatcagtgtggtctgccgaaaaaaatggcacttgaattattcaaaccatttatttacggaaaactggaaacccgtggtttagcgacaacaattaaagccgctaaaaaaatggttgagcgtgaagaagcggtagtttgggatatcttagatgaagttatccgtgaacacccagttatgctaaaccgtgcaccgacacttcaccgtttaggtatacaggcgtttgaaccaatcctgattgaaggtaaagctattcagttacacccactcgtttgtgcggcatataacgccgacttcgatggtgaccaaatggcggttcacgttccattgacattagaagcgcagttagaagctcgcgcgttgatgatgtcaactaacaatattctgtctccagcaagtggtgacccaattatcgttccttcacaggacgtggtattaggtctttactacatgactcgtgattgcatcaatgccaaaggtgaaggcatggtgttaagtggtccaaaagaagctgaacgcgtttatcgcgcaggtttagcctctttacacgcgcgtgttaaagtacgtatcactgaagagatcaaagatggcgaaggtaatatcaccactgaaactagcttaaaagacactacagttggtcgtgctattttatggatgattgtaccaaaaggcctaccttacgcactggttaaccaaccattaggtaaaaaagctatttctaaaatgctgaatacctgctaccgcgtaatgggcttaaagccaacagttatttttgctgaccaaatcatgtataccggttttgcttacgcagcacgttctggtgcttcagtaggtattgatgacatggttatccctgcgaaaaaagcagagatcattgccgaggcagaagcagaagttgcagaaattcaggaacagttccaatccggtctggtaacagcgggtgaacgttacaacaaagtcatcgatatttgggctgctgcgaatgaacgcgtagctaaagcgatgatggaaaatctgtctacagaaactgtgatcaaccgtgatggtgaagaagaacaacaagtttccttcaacagcatctttatgatggctgactccggtgctcgtggttctgcagctcagatccgtcagttagcgggtatgcgtggtctgatggctaagccagatggctccattatcgaaaccccaatcactgcgaacttccgtgaaggtctgaacgtactccagtacttcatctcaacccacggtgctcgtaaaggtttggcggataccgcactgaaaacagcaaactccggttacttgactcgtcgtttagttgacgttgcacaagaccttgtcgtaacagaaagcgactgtggtacaaccgaaggtgtaatgatgactccggtcattgaaggtggagatgttaaagagccactgcgtgagcgtgtattaggacgggtaacggcagaagatatcctgaaaccaggtactgcagatatccttgttccacgtaatacgctgttaaacgaaaaactgtgtgatctgttagaagaaaactcagtagacagcgttaaagttcgttcagttgtaacctgtgacacagactttggtgtatgtgctaaatgttatggtcgtgaccttgctcgtggtcatatcatcaacaaaggtgaagctatcggtgttatcgcagcacagtcaatcggtgagcctggtacacagttaacgatgcgtacgttccacatcggtggtgcggcatcccgtgcggcagcagaatcaagcattcaggtacgtaataaaggtacactgaaattgatcaatgcgaaatttatcaccaacactgctggtaagttagtgattacttctcgtaatacagaattacgtctgattgacgaattcggtcgtacgaaagaaagctataaagtaccttatggtgctcaattatcgaaaggtgatggcgaagctgtaaacggtggcgaaacagttgctaactgggatccacataccatgcctgtggtgagtgaagtttctggtattatccgttttgctgacatggttgatggtcaaaccattactcgtcaaacggatgaattaaccggtctttcttcactggttgttctggatactgcagagcgtactggtagcggtaaagatttacgtccagcattgcgcatcaccgatgcacaaggtaatgatgtattaatcccgaatacagatatgccggcacagtacttcctaccaggtaaagctatcgttcaattagatgatggcgttgctattaatgcgggtgatacgttagcacgtattcctcaagaatctggtggtactaaagatattaccggtggtctaccacgcgttgctgacttgtttgaagctcgtcgtccgaaagagcctgcaatccttgctgaaatcagcggtattgtttctttcggtaaagaaacgaaaggtaaacgtcgcttagttatttctccattagatggtagcgatgcatacgaagagatgatccctaaatggcgtcaacttaacgtatttgaaggtgaggttgtggaacgcggtgatgttatctccgatggtccagaatcaccacatgacattctgcgcttacgtggtgttcatgcggttactcgctatatcactaatgaagtacaggaagtttaccgtttacaaggggttaagattaacgataaacacattgaagttatcgttcgtcagatgctacgtaaagtgactatcgaaaatgccggtagctctgaattccttgaaggtgaacaagttgaatacgctcgtgttaaagtttcgaaccgtattttagaagaagaaggtaaagtaccagcaacatactctcgtgacctattaggtattacgaaagcatcactggctactgagtctttcatctctgcggcatcgttccaagaaacaacacgcgtactgactgaagctgctgttgcaggtaaacgtgacgaattacgcggtttaaaagaaaacgttattgtgggtcgtctgatccctgcaggtactggttttgcgtaccatcaggatcgtatccaacgtcgtcaacaacaactgccaacggatgaaactgaagcaacaatcagtgcagatgaagcttctgctaacttagcagaattgctgaatgcaggtttcggcggttcatcaaataactaa

SEQ ID NO: 3171 - DNA, 384 bp, Proteus mirabilis
attttaggaacaattgttatgtctatctctaaagacgatatcttaaatgcagttgctgaaatgtctgtaatggacgttgttgaactgatcactatgatggaagaaaaattcggtgtatctgctgctgcagctgttgctgttgctgcgggtccagcagaagctgctgaagaaaaaactgaattcgacgttatcctgaaaggtatcggcggtaacaaagtagcagtaatcaaagcagtacgtggcgctaccggtcttggtctgaaagaagctaaagacttagtagaatctgctccagcagctctgaaagaaggcgtaagcaaagatgatgctgaagctctgaagaaagctctggaagaagcaggtgctgaggttgaagttaagtaa

SEQ ID NO: 3172 - DNA, 798 bp, Proteus mirabilis
ctggctttggcaaaggtactggtcatgtctttaatcttgggcacggtattcatcaagatgttccaccagcgcatgctggagcatttattgatgcggttcaccgtctatcgaagccttatcatcaggataatgattaatactcagcaattacgtcaagagcagacagagaaagctcaacagattatcttaaccgaccaatttatggcaccaacttatattgcaggtgccgatgtcggatttgaaaatagcggtgcggtcactcgtgccgctattgttattatgcattatccctcctttgaaattgttgaatatcaaatagcccgtattgcaacattactaccttatattcccggactcctttcattccgtgagtgtcccgcgttattagaagcttggcagggcattaagcaaaaaccgcaacttgtttttgttgatggtcaagggatcgcacatcctagacggttaggggtggcaagtcattttggactcttagccgatattccaaccatcggtgtggcaaaaagtcgtttatgtggtgatgataaaaaattagacgacgatgtaggaagtacggaaaaattaatggataaggatgagcagttaggttggatttatcgtagtaaaaaaagatgtaaacctttatatatttctccaggctataaagtgagtatggagagtgcattagcgtgggtaaaacgttgtataaatggatatcgattacctgaaccgactcgttgggccgatggtattgcctcaaataggcgattatttgagcaattgaataagaataagctctaa

SEQ ID NO: 3173 - DNA, 1092 bp, Proteus mirabilis
ttaagtttatatttttcagatatttatgataattttttactaagtaaaaggtcatttttttctgtaagctggcgatccacatttagcacggagtcagcgatgaataaacctattttaatttcttctcatgatgctgcattcaaacgcttcatgatgaatatcagtaatgctaaggatttcttttttatccatttatcagatgaattaaaaagctattgtgatttttcaactttaaagctacaaaattcctcttttatcgatattaaattacgttctcgtatgtcagatattctctactcagtgaaaaccaaaacggggaatatctcaatttatttcttaattgagcaccaatctcgaccagataaaatgatcgcttggcgtatgatgcactatgcgttttgcacgatgaatcagcatctacagcaaggttacacatctttgccattggttgttcctatcttgttttatcatggcaaacgcaagccttatcctttttctgtcaattggttagattgttttccgctttctacattggcaaatcaactctatcttaataattttgcattaattgatttgaattcaattgatgatgaaattttattaacacatagaaaagccgctgtaatggaaattgcaatgaaacatgtgaacagttgcgatgatcttgataagttagcgatgcttctctcaaaagcgataaatcagaaaaactgcagtgatgaagacactatcgctgttgtacaatatttattctcaattatggacgcggcggattttgaatccatcataaataagatagctgaacaagtagataaccatagagagacgattatgaatattgcatggcggttagaaaataaaggatttaaattaggaaaaatggaggggatagagataggtaaaaatgaaggtatagagataggtaaaaacgaaggtatagagataggtaaaaacgaaggtatagaaataggtaaaaagatagtacaaatacaattagcaaaaaacttattaaaagaaaatgttgagttggaatttattgaacgaataactggtttaagtatacaagaacttaaaatattgcttttaacttaa

SEQ ID NO: 3174 - DNA, 348 bp, Proteus mirabilis
agagcagtgcaactgtcgctgccgtttccggttttttgcgttgttgcgaggaggtgcattctacattttcctcattcagtgtcaagcgctaatttattaggcttttcactttttattttgttctctcagccagttcgcttagcgccctgtgccgtgacaacgaggacgcattatagggagttttctgaggctggcaatagtttttttaagaaaaaaattcgtttgcttaattccacagcaaaacccttagttatacgcagttatcaacaattttatccacaagccatcttttcccacaaatttagcatgtcaaacgcaaacgtttgcgttattataatacccaaatga

SEQ ID NO: 3175 - DNA, 717 bp, Proteus mirabilis
tggaggactaatctgatggctaaactaaccaagcgcatgcgcaatatccgtgaaaaagtagatgtagtgaaacagtacgaaatcaatgaagcagttgctttattgaaagagttagctacagctaaatttgttgaaagtgttgatgttgctgttaacctcggcatcgatgctcgtaaatcagaccaaaacgttcgtggtgctactgttctgccacacggtactggtcgttcagttcgcgttgctgtattcgcacaaggtgcaaatgcagaagctgctaaagaagctggtgcagaattagtcggtatggatgacttagctgctaaagttaaagctggcgaaatggactttgacgttgtaattgcatctccagatgcaatgcgcgttgttggtcaattaggccaaatccttggtccacgcggtttaatgccaaacccgaaagtgggtactgtaacacctaacgttgctgaagctgttaaaaatgctaaagctggtcaggttcgttaccgtaacgacaaaaatggtattatccataccactatcggtaaagttgatttcaacgaagctcagttgaaagaaaacttagaagctctgctggttgcgctgaaaaaagcaaaaccatcttcagctaaaggcgtttatatcaagaaagtaagcctgtctaccactatgggtgcaggtgttgctattgatcaagcaagcttaagcgcgacagtttaa

SEQ ID NO: 3176 - DNA, 432 bp, Proteus mirabilis
ttaatggctaagaaagtccaagcctatatcaaactgcaagttgcagcaggtatggctaatccaagtccaccagttggtccagctctgggtcaacaaggtgttaacatcatggaattctgtaaagcattcaacgctaaaactgaaagcgtagaaaaaggtttaccaatccctgttgttattacagtttacgcagaccgttctttcactttcgttactaaaactcctccagcagcgattctgctgaagaaagcggcgggcgtgaaatcaggttctggcaaaccgaacaaagagaaagtaggtaaagtaactactgctcaagttcgtgaaattgcagaaactaaagctgcggatctgactggtgctgatgttgaagctatgatgcgttcaattgaaggtactgctcgttccatgggcctggtagtggaggactaa

SEQ ID NO: 3177 - DNA, 4167 bp, Proteus mirabilis
tttaagagtaatagcaataagtattatggaaaattctattttcctacctacaaaaaaacagtgttagatgaatgtcgtgtcacccttaataacaagggcaggcagagtgggtcacttttcagcgagctgaggaaccctatggtttactcctataccgagaaaaaacgtattcgtaaggattttggtaaacgtccacaagttctggatgttccctatctcctttctatccaacttgactcgttccagaagtttatcgagcaagatcctgatggtcaaaatgggctggaagcggctttccgttccgtatttccaatccaaagctacagcggcaatgctgaactgcaatatgtcagctaccgccttggcgagcctgtttttgatgttaaagaatgtcagatccgtggtgtaacttattctgcaccattacgtgtaaaactgcgtctggtcatttatgaacgtgaagccccagaaggcaccgttaaagacatcaaagaacaagaagtctatatgggtgaaatcccattaatgaccgataatggtacttttgttatcaatggtactgagcgtgttattgtgtcccagttacatcgtagccctggtgtgttctttgatagcgataaaggtaaaacgcactcttcaggtaaagtactgtataacgcacgtattattccttatcgtggttcatggttagacttcgaattcgaccctaaagataatctttttgtccgtattgaccgtcgtcgtaaattaccagcgactatcattttacgcgcaatgaactacagcaccgaagacatcttaaatctgttcttcgagaaaacaacgtttgaaatcagtaataataaactgatgatgacgttagttcctgagcgtctgcgtggtgaaacagcttcatttgatattgaagcaaacggcaaagtttatgtcgaaaaaggtcgccgtattactgctcgtcatattcgtcagttagaaaaagaacaaattgagcgcatcgaagtacctgttgaatacatcgcaggtaaagtagtggctcgtgactatattgatgaagcgacaggtgaattgatttgtgctgctaacatggaaatctctttagatgtgttagctcgcttaagtcaagctggtcataaaaccatcgaaacactgtttaccaacgatttagatcatggtgcttatatttcagaaactatccgcgtcgatcctaccaacgatcgtttaagcgcattagttgaaatctatcgcatgatgcgtcctggtgaaccaccaactcgcgaagcggcagaaaacttatttgagaacttattcttctcagaagatcgttatgatctctctgcggttggtcgcatgaaattcaaccgctctttaggtcgcgaagaagttgaaggttctggcatcttaagccaagaagatatcattgaagtgatgaaaaaactgattgatatccgtaatggtaaaggtgaagtggacgatatcgaccacttaggtaaccgtcgtattcgttctgttggcgaaatggctgaaaaccaattccgtgttggtctggtgcgtgttgaacgtgcagttaaagagcgtctatctttaggtgatcttgatgcattaatgccacaagatatgatcaatgcaaaaccgatttctgctgcagttaaagagttctttggctctagccagttatcgcagtttatggatcagaataacccgctgtcagaaattacccataaacgtcgtatttctgcattaggccctggtggtctgactcgtgaacgtgcaggcttcgaagttcgagacgtacacccaactcactatggtcgtgtgtgtccaatcgaaacacctgaaggtccaaatatcggtctgattaactcattatctgtttatgcacagactaacgagtacggattcttagaaacgccttaccgtgttgtagaaaacaacgctgtaacagatgaaatccactatctgtctgcaattgaagaaggtaacttcatcattgctcaggctaactccgtattagatgatgatggccacttcgtagaagaattagtaacttgccgtcataaaggtgagtcaagtttatttagtcgtgatcaagttcagtacatggacgtttcaactcaacaggttgtttctgtcggtgcttcactgatcccattccttgaacacgatgacgccaaccgtgcattgatgggtgcgaacatgcaacgtcaggctgttcctacacttcgtggtgataaaccactggtaggtacaggtatggaacgtgctgtagcggttgactccggtgttactgcggtagcaaaacgtggtggtactgttcagtatgttgatgcttctcgtatcgttatcaaagtaaacgaagatgagacttatgctggtgaagcaggcattgatatttacagcttaactaaatatacccgctctaaccaaaacacatgtattaaccaaacaccttgtgtttctttaggtgaacctgttgaacgtggtgatgtacttgccgatggtccatcaacagaccttggtgaacttgcattaggtcaaaacatgcgcgtggcatttatgccatggaatggttataactacgaggactccatccttgtatctgagcgtgttgttcaagaagaccgtttcacaactatccatattcaagaacttgcttgtgtgtctcgtgatactaagttagggcctgaagagatcactgcagatattcctaatgttggtgaagctgcgttatctaaactggatgaatcaggtatcgtttatatcggtgctgaagtgaaaggcggtgatattctggtaggtaaagtaacaccgaaaggtgaaactcaactgactccagaagagaaactgctacgtgctatcttcggtgaaaaagcatctgatgttaaagattcttctctgcgtgttcctaacggtgtatctggtacagttattgatgtacaagtcttcacccgtgatggcgtagaaaaagacaaacgtgcattagaaattgaagaatcgcaattacgtgaagttaaaaaagacttaacagaagagttacgtatctttgaagcgggtctttttgcacgtattcgtggcgttctgattgccggcggtattgaagctgacaaattagataaactacctcgtgaacgttggttagaactgggtcttgctgatgaagagaagcaaaaccagttagaacaattagctgaacagtatgatgaactgaaagctgaattcgcgaagaaactggaagctaagcgtcgtaagatcactcaaggtgatgatttagcaccgggtgtattgaagattgttaaggtttatctggctgttaaacgtcagatccaacctggtgataagatggcgggtcgtcatggtaacaagggtgttatctctaagattaacccaattgaagacatgccatacgatgaaaacggtaatcctgttgacctcgtactgaacccactgggtgtaccatcacgtatgaacattggtcagatccttgaaactcacttgggtatggctgctaaaggtatcggtgataaaatcaatgcgatgctgaaacagcaacaagaagtggctaagttacgtgaatttatccagaaagcttatgatctgggtatggcacctcgtcagaaagttgatttggacaccttcagtgatgaagaagtgttacgtttggctgaaaacctgaaaaaaggtatgccaactgcaacacctgtgttcgatggtgcagaagagatggaaattaaagagatgctgaaattagcagatcttccaacttctggtcagattacacttttcgatggtcgtacaggtgaacaattcgaacgtccagtaactgtaggttacatgtacatgctgaaactgaaccacttagttgatgacaagatgcacgcccgttctaccggttcgtacagcttagttactcagcaacctcttggtggtaaagcacagtttggtggacagcgtttcggggagatggaagtatgggcactggaagcatacggtgcggcttacacgctacaagaaatgcttactgttaagtcggatgacgttaacggtcgtaccaaaatgtacaaaaacattgttgatggtaaccatcagatggaaccaggtatgcctgagtcgttcaacgtattgttgaaagagatccgttcactgggtatcaacatcgaattggaagacgaataa

SEQ ID NO: 3178 - DNA, 516 bp, Proteus mirabilis
tccaggagcaagaagctaatggcactaaatcttcaagacaaacaagcgattgttgctgaagtcagcgaagttgccaaaggcgcgctgtctgcagttgttgcggattcccgtggtgtaactgtagataaaatgactgaactgcgtaaagcatgtcgtgaagctggtgttactgtacgtgtagtacgtaacacattgctacgtcgcgctgttgaaggtacttcttatgaagtgctgaaagacgcatttgttggtcctaccttgattgctttctcttctgaacacccgggcgctgcagctcgtctgttcaaagatttcgcgaaagcgaacccagcattcgagattaaagcggctgcctttgaaggtgagtttatcccaggttcaaacattgatcgcctggctacactaccaacttacgaagaagcaatcgcacgcctgatgtcaaccatgaaagaagccgctgccggcaaactggttcgtactctggctgcactgcgcgatcagaaagaagctgcttaa

SEQ ID NO: 3179 - DNA, 348 bp, Proteus mirabilis
ctctctaaaaaagatgaattaagttttttcaccagatgtttttcaaacgataaaacatactttaaggactattttatgaacaaagctgaattaaccgaatcagttgctgaaaaagcggatctgacaaaaactcaggcaaaagctgctattgaagcgtttatcgactcagtaacaggtgctctgaaagaaggtgattctgtccagttagttggtttcggtacattcaaagtgaatcaccgtgcagagcgtactggtcgtaaccctcaaactggcaaagaaattaaaattgcagcagctaacgttcctgcatttactgccggtaaagcactgaaagacgcagtaaaataa

SEQ ID NO: 3180 - DNA, 654 bp, Proteus mirabilis
ctgataatgaacagatcctctaattcggcttttgccccaaccgaaaaaaagttggggctttaccctgttgtcgattctattgaatgggttgagcgcctgttgaaaataggtgtaacaacgatccaattacgcatcaaagataaacagcccaaagatgttgaacaagatataatcactgcaatcaaattaggtcgtaagtataacgcaagattatttatcaatgattattgggaactcgccattaaacatcacgcttatggtgttcatcttggacaagaagatctcgacattgccgatcttgatgctattaaacagtcaggtttatgccttggtatttccacccataatgacactgaactacaaagagcaaaaaggctacttccctcttatattgctttagggcatatatttccaacgacgacgaaagatatgccatcaaagccacaaggtttaagagcactcaaacatcaagtagaacaaactcatgattttccaaccgttgctattggcgggatctctctagaaaaagtctctgatgtcgtagcaactggcgttggtggagttgctttagtgagtgcaataacaaaggcatcagactggcaacaggtaacacttaaattattagaattagtagagggaaaaccatcatgctaa

SEQ ID NO: 3181 - DNA, 1158 bp, Proteus mirabilis
aggtgttgcctgccaactgttatttttccaacatgttacactacacgctattttgcggccctattactattaatggagttagacatgagtgagttgaaaaacgaccgctatttacgtgcgctgttgcgccaacctgttgatgtcacccctgtttggatgatgcgtcaggcaggcagataccttcctgaatacaaggaaacacgagcacaggcgggagacttcatctcattgtgcaaaaataccgaattggcatgcgaagttaccttacagcctttaagacgttttcctttagatgccgctatcctattttctgatattttaactatccctgatgcgatgggattaggtctgtattttgaaacaggggaaggtcctcgttttaaaacaccgataaatagccttgatgatataaaaaaattacctattcctgatccggaagatgaactaggttatgtcatgaatgcggtacgtgctattcgtcatgcattgcaaggtaatgtgccattaattggtttttcaggtagtccatggacactagctacttatatgattgaaggtggaagtagtaaggcgttcacaaaaattaaaaaaatgatgtatagcgagccacaagctctgcatctattactggataaactggcggatagcgttatcctttatttgaatgctcagattaaagcaggggcacaatccatcatgatcttcgatacatggggaggtgtgctaacaggacgcgattatcaattgttctcattacaatacatgcataagattgttgatggtcttattcgtgagaatgagggcagaaaagttccggtcaccttatttactaaaggtggtgggcgttggttagaagcgatggcagccacaggttgtgatgcattaggacttgattggacgattgatatcgaagatgctcgccgtcgagtcggtgataaggttgccttacaaggtaatatggatccttctatgttgtatgcgccaccagcaagaatagaacaagaagtcgctacgattttagctggctttggcaaaggtactggtcatgtctttaatcttgggcacggtattcatcaagatgttccaccagcgcatgctggagcatttattgatgcggttcaccgtctatcgaagccttatcatcaggataatgattaa

SEQ ID NO: 3182 - DNA, 204 bp, Proteus mirabilis; identical to SEQ ID NO: 1188

SEQ ID NO: 3183 - DNA, 426 bp, Proteus mirabilis
ccaacaacgcgcattgcatctggagatgcaattacaacgtcaaagtccatttcgccagctttaactttagcagctaagtcatccataccgactaattctgcaccagcttctttagcagcttctgcatttgcaccttgtgcgaatacagcaacgcgaactgaacgaccagtaccgtgtggcagaacagtagcaccacgaacgttttggtctgatttacgagcatcgatgccgaggttaacagcaacatcaacactttcaacaaatttagctgtagctaactctttcaataaagcaactgcttcattgatttcgtactgtttcactacatctactttttcacggatattgcgcatgcgcttggttagtttagccatcagattagtcctccactaccaggcccatggaacgagcagtaccttcaattga

SEQ ID NO: 3184 - DNA, 732 bp, Proteus mirabilis
agcactgaaagacgcagtaaaataattcctttgaacggaatgaacaatagagggggagttgctccccttttgttgagacgacaggggctgttagcaatagggttctcttttttgctcagcgcctgctcttcttctccacaactacccgaattttctgcaacgggctatattgcagatgaaggggttgtgcggctttggcgtttaaataacaaaacatcagagcctcaagtgattatgagtgtctatagcttttatcaaaagcctgaaactgttgtcactttttatgagtaccgccaaaatagattatggcaaattcgcagtgaaatcgttaatccctcccatccttcctcttggcatttacgtttaaataaacgtggcgaagttatctttatgcaacaagagtatcaaggacaaaagcgcccattaacagaagatgaacgtttaaaaatggtatttgcagccagtcgagaacgagagatcagtaaggcattggcaataggtcaggtaaagttagttcaaggaacctggtatcaagatacattgacaacatgtgcgggtgaaaaagtgaatgtatcatttgaagcaccagaacaacgttggctaaaacgtagaacacagcatctaactcgtcccgcttatgttgcttggttggattcccccgaaggtaaccagttgttaatggttgcagaacacgatttttgtaaatgggaaccaacaaaagagagtttgtga

SEQ ID NO: 3185 - DNA, 393 bp, Proteus mirabilis
aaccgtaacggacagcgccgtaaaagtgagcgtaaatttttcccaggctatgttcttgtccaaatggtcatgaatgatgcaacttggcatcttgtgcgtaatgtgccaagagtcatgggttttattggcggtacttcagacagacctgcaccaattagtgataaagaagttgatgcgatcatgaatcgtctacaacaagttggtgacaaaccacgtcctaaaacactgtttgaaccaggtgaaatggttcgtgttagtgatggtccatttgctgactttaacggtgttgttgaagaagttgattacgagaaaagtcgcctgaaagtgtctgtttctatctttggtcgtgcgaccccagtggaattagactttagtcaggttgaaaaaggttaa

SEQ ID NO: 3186 - DNA, 1971 bp, Proteus mirabilis
tatttattaggaaatgctatgtccaaaaatcaaactatctctattaaagatgtttcgcccactgcgaataaacagcgcccacgtaaagaacaacgcgatgcagcgcaatcctttattagcactattcaaggtattaattttcccaattcaaaacgtatttatatcactggtactcgttcagatattcaagtgccaatgcgtgagatccaacttgataagaccctgatcggtggctcaaaagaagatcctatttttgaagagaatgaacctattccagtctatgacacttcagggccttatggtgatccaacttctcaacttgacgttaatcttggcttaaaaaaaattcgccaaccatggattgatgcgcgtaatgataccgaacctctttcacacttaagttctgatttcactcaacaacgccttactgatgcaggattagaacatctacgctttccgttaaaacccagccctagaaaagcgctaaataataagagagtgacgcaattacattacgctcgcaaaggtattattacgccagaaatggaatttattgccattcgagaaaatatggggcgagaacgtattcgtagcgaagtattacgccaacaacatgccggatttagctttggtgcacatttacctgacaatattacgcctgagtttgtacgccaagaagttgctgctggtcgtgccattattcctgccaatatcaatcacccagaatctgaaccgatgattattggccgtaatttcttagttaaggtgaatgctaatatcggcaactcttcggttacctcatctatcgaagaagaagtagaaaaactgatttggtcaacacgttggggggccgatacggtgatggatctgtcaactggacgttatatccacgaaacacgtgaatggatcatccgtaatagcccagtccctattggtactgtccctatttatcaagctctcgaaaaagttaacggtattgcagaagatctcacttgggaaatgttccgtgatactttattagaacaagcggaacaaggggtggattatttcactatccatgcaggtgtcctattacgctatgttcctatgaccgcaaaacgtttaacgggtattgtctctcgtggtggatcaattatggcgaagtggtgtttatcacaccataaagagaatttcctctatacccacttccgggagatttgcgaaatctgcaccgcttatgatgtttcattatcattaggtgatggtctaagacctggctctatccaagatgctaacgatgaagcacagttcgctgaattacataccttgggtgaattaacaaagattgcttgggaatatgatgtacaagtcatgattgaaggcccaggtcatgtaccaatgcagatgatacgtcgcaatatgacggaagaactagagcattgtcatgaagcccccttctatacattaggccctctaacaactgatatagcaccgggctacgatcattttacttccggtattggcgctgcaatgattggctggtttggctgtgccatgctctgttatgtcactccgaaagagcatctcggactccccaataaagaagatgtgaaacaaggtcttattacttataaaatcgccgcccatgcagctgatcttgccaaaggacatcccggcgcgcaaattcgtgataacgccatgtctaaagcccgttttgagtttcgatgggaagatcaatttaatctagcacttgatcctgaaactgcccgtcaatatcacgatgaaaccttacctcaagcatcggggaaagtcgctcacttctgctctatgtgtggacctaaattctgctcaatgaagataacacaagaagtgcgtgattatgcagcaggtatggagcagatgtcgcaagcctttaaagcccatggtagtgagctataccacagtgcagaaatagccagttccgaggtagctgataatgaacagatcctctaa

SEQ ID NO: 3187 - DNA, 246 bp, Proteus mirabilis
cgttggacaggaacccttggtcttccggcgtgcgggtttttcacccgcattatcgttacttatgtcagcattcgcacttctgatacctccagcatacctcacagtacaccttcgcaggcttacagaacgctcccctacccaacaacactatgtgtcgctgccgcagcttcggtgcatggtttagccccgttacatcttccgcgcgggccgactcgaccagtgagctattacgctttctttaaatga

SEQ ID NO: 3188 - DNA, 801 bp, Proteus mirabilis
gatagaattattactatgcatttatatacgctaacaggtggtgaaaaaggctggtggacagtcagcctaggcggccgagtttggttacccaaaggtgaacttccatttggtttagcaacagattggggacttgtgggtaaacaagccaaaattgttggggaatggcaaggagaaaatgtctggctgatttatgacaaaatggaaagcgatatgtgttcaccaaggcttatcgcatctcaagatgaaaagttatttaaattagtcggtcgtggtgttcaacttgctgaattttatcgttctcatcggttttgtggctattgtggggctaaaatgcgccatagtgagagtgaatgggcatgtttatgtgataactgtcatgagcgttattacccacaaatagcaccttgtattattgttggtattcgtaataaagataaaattctattagcacaccatgttaggcataaacattcaccactctacaccgttttagctggttttgttgaagtaggggaaagcttagaagatgcggtagctcgcgaagtttttgaagaaagtcatattcatattcgcaatattcgttatgtttcttcacaaccatggcctttccctcattctcttatgatgggttttcttgccgattatgcagggggagagttacgacatgatccttcggaattaatcagtgcagcatggtatcgctatgatgagttaccacaaataccaccttctgatactattgcgcgacgtttaatagaagatacgatagcgaatattagacaagatgaagaaaatagctaa

SEQ ID NO: 3189 - DNA, 1299 bp, Proteus mirabilis
gggattgctatgaaaattttaatcattggtaatggtggtcgtgaacatgcactagcttggaaagcagcgcaatcgcctttagcaacccaagtgtttgttgcccccggtaatgcaggaacagcattagaacatggcgtacaaaacgttgatattagtgccactgatattgccgcattagttgcatttgcccagcaaaatcacattgatttaaccattgtggggcctgaggcaccattggtaattggtgtagtagatgcgttcaaacaagcgggactgatgatttttggccccaccaaaggtgcggcacaactagaaggttcgaaagcatttacaaaagattttttagcccgccatcatatcccaacggcagcttatcaaaactttactgaaatagcgcctgcacttgaatatctccataaagttggcacacctattgtgattaaagcggatggcctagctgcgggtaaaggtgtcattgttgccatgacacataccgaagcagaaaatgcgataaaagatatgttagcaggtaatgcttttggtgatgcaggacaccgtattgttattgaagaatttcttgatggagaagaagccagttttattgtcatggtggatggtgaaaatgtacttccgatggcaacaagtcaagatcataagcgcgtcggtgatggtgactcaggcccaaacaccggcggaatgggggcttattctcctgcaccggttgttactcctgaaatccaccagcaagtcatggataacatcatttatccaactgtcaaaggcatggctgccgaaggacatcgctatcaaggttttctttatgcaggcttaatgattgataagcaaggtattgccaaagtcattgagtttaactgccgttttggcgatccggaaacgcaacctattatgatgcgcatgcaatcagacttagttgatctctgtttagcgggtgcaaaaggcgaactagcaggtaaagactccatttgggatccccgccccgctttaggtgttgtaatggccgccggtggctatcctgataactaccgccaaaatgatattattgagggactaacagcaacatcttcttcaacagctaaggtatttcaagcaggaacaaaattaacggctcaaggtgaagttgttacagcaggaggccgagtattatgtgcaactgctttaggggaagatatcgaacaagctcaaaagaatgcctatgctttagccaaaagtattcactggtatggctgtttctatcgccatgatatcggctatcgtgccattgcgcgtttaaaaaagtaa

SEQ ID NO: 3190 - DNA, 780 bp, Proteus mirabilis
attattagaattagtagagggaaaaccatcatgctaaatgataatgattttatgcgttatagccgacaagtgatgttagaagatataggcttagaagggcaaaccaaaatacagcaagccagagtattaattattggcttaggtgggttaggctctccagcatcactttatctagcaggggctggagtgggtgaacttattttagtcgatgatgataatttgcatgtctcgaatttacagcgtcaaattctctatcgcactcaagatatcccagatgcaaaatcagacatcgccaaacaggctctacttgccttaaatcctgacattaaaatcaccacctataaacaacgtgttaatgatgattttctctctacgttgcttcaaaacatcgatttagttttagattgcactgataacatgagtactcgccaagcaatcaatcgtatctgtgttaaacaacaaataccgcttattagtggcagtgccgttggatttagtggtcagctgatcgtgtttgagcccccttttattcatggttgttaccactgtctctatcctgataacaaagagccacaacgcaattgccaaacagctggaattctaggccccgttgtaggggtcattggtactctgcaggcacttgaagcaattaagttacttgcaggtttaccaagtacgttaagtggaaaactacgtctgttcgatggtagaaaacaaaattggagcaccttgcgcttaacaccatcaaaaaactgtcctgtttgtcgagggttagcatga

SEQ ID NO: 3191 - DNA, 1710 bp, Proteus mirabilis
gtgagattgattttgtcttcatcttctgaaatgttagtggtgcaaacacaatttcactgtatcaacgtgacttttcatcacaatgactactgttatacaaaaacccaagggataaaactcatgcaacaccttcgtcctatccgccgtgctcttttaagtgtgtctgataaagcaggtattttagaatttgcgaaagcgcttgtagaaagaaatgtagaacttttatcaacaggagggacagcgcgtctattagcagaagctggcttacccgtcatagaagtctctgactacaccggttttccagaaatgatggatggtcgtgtaaaaacacttcaccctaaagtacatggtggtattttaggacgtcgtggacaagatgataccattatggaggagcatgatattcgtcctatcgacatggttgttgtcaatctttatccctttgctaaaacagtagctcgtcccgattgctcattagcagatgctgttgagaatattgatattggtggtcctaccatggttcgttccgcagcaaagaatcataaagacgtcaccattgtggttaatagcaatgactatgaaaaagtgattgaagaaatggacaatcaccaaaacagtctgactttagatacacgttttgatttagccattaaagcctttgagcataccgcagcttatgacagtatgattgcgaactactttggccaaaaagttgcaccttattatggtgatacttcacaaccatcaggaaccttccctcgtaccttaaatcttaactatataaagaaacaagatatgcgttatggtgagaatgctcatcagcaagcggctttctatatagaagagaatattgaagaagcctctatcgcaacagcaaatcaattacaaggtaaagcactctcttataacaatattgccgatactgatgctgcattggaatgcgtgaaatcattttccgaaccagcttgtgttatcgtgaaacatgcaaacccttgtggcgttgctattgcggacaccctcacacaagcatatgacaatgcatttaaaactgatccaacttctgcatttggcggtattatcgctttcaatagaagcttagatgcaaaaacagcaagtgccgttatagagcgtcaatttgtcgaagtcattatcgcgccttctattaatgaagatgctctacctattttagcaaccaaacctaatgttcgtgtattagcctgtggtgaatggcaagaagctaaacctgcacttgatttcaaacgggttaacgggggcttattagtacaagatcgtgatttaggtatggttaaagaagaaaacctaagggttgtcacgcaacgccagcctagtgaacgagaatggaaagatgcgctattttgctggaaagttgcaaaatttgtgaaatccaacgcaattgtgtatgccaaaaatgacatgacgattggcattggtgcgggccaaatgagccgtgtctattctgctaaaatagcagggattaaagcggctgatgaaggtttagaagtagcaggttgcgccatggcatctgatgcattctttccctttagagatggtattgatgcggcagctatggccggtgtaacttgtgttattcagccaggtggttctattcgtgatgatgaagtaattgcagcagctaatgaacacaatatcgcgatgatttttactaacatgcgtcatttccgccattaa

SEQ ID NO: 3192 - DNA, 270 bp, Proteus mirabilis; identical to SEQ ID NO: 1383

SEQ ID NO: 3193 - DNA, 456 bp, Proteus mirabilis
ccgcatgatgtccgaccatgcttagccaaccttcgtgctcctccgttactctttaggaggagaccgccccagtcaaactacccaccagacacggtccccgacccagtttatgggcctaggttagaacatcaaacgttaaagggtggtatttcaaggttggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttactggggcttcgatcaggagcttcgcttgcgctaa

SEQ ID NO: 3194 - DNA, 831 bp, Proteus mirabilis
tcaatgagggtgacacaattcttctctttcaagcaattgcgggaggctgatatgttgaaaattgctgatactacattcacatcaaggttatttactggtacaggtaaatttgcgacaccaacactcatggctgaagccattaaagcctctggtagccaattagtgacaatggcaatgaagcgtgttgatttaaaaaatggcaatgatgatctaatcgcccctcttaaatcattaggggtaaaattattacctaatacttctggtgcaaaaacagcacaagaagccgtttttgctgcacgattagcaaaagaggcctttgatacccattggatcaaattagaaattcatcctgataccaaatacctacttcctgatccaatagaaacacttaaagcggctgaacttctcgttaaagaaggttttgtggttttaccctattgcagtgctgatccggtattatgccgtcgtttagaagaggtaggatgcgcagctgtaatgccgttaggttcacctattggttccaatcaaggtttacaaactcgcgattttttgcggattattattgaacaaacctcaatacccgttgttgttgacgctggtattggcgcaccaagccatgctcttgaagctttagaattgggtgcagatgctgtactcgtcaacaccgccatagccgtagctaaaaatccagttttaatggctcaagcttttaaagctgcaattgatgctggagagcttgctcgacaatctggactggctgtaccgactgcaataacacatatgcaagcacaagcctctagcccattaacccaatatttagaggctttctaa

SEQ ID NO: 3195 - DNA, 267 bp, Proteus mirabilis
aaaacaaaattggagcaccttgcgcttaacaccatcaaaaaactgtcctgtttgtcgagggttagcatgaatattaccgtaaatgacgaacgttattctctggatatgcctgtcacgataagccagctccttattgagttaaaacaaccttctatgggggtggcactcgctatcaacgacatcattattccccgtgaaaactggaatacacaaatgatcaatgagggtgacacaattcttctctttcaagcaattgcgggaggctga

SEQ ID NO: 3196 - DNA, 348 bp, Proteus mirabilis
gactcggtttccctacggctcccctatgcggttaaccttgctacagaatataagtcgctgacccattatacaaaaggtacgcagtcaccccataaagaggctcctactgcttgtacgtacacggtttcaggttctttttcactcccctcgccggggttcttttcgcctttccctcacggtactggttcactatcggtcaatcaggagtatttagccttggaggatggtccccccatattcagacaggataacacgtgtcccgccctactcgtcgagttcacaataacagcatcttcagatacggggctatcaccctttactgccggactttccagaccgttctcctga

SEQ ID NO: 3197 - DNA, 255 bp, Proteus mirabilis
aaagtaggttcaggagaaaaacctgtaacgccacgtccagggctagttctagaatctaaaataaaagagaaaaaattactattaataaagaattgtatagtaccaccaataaaccatataactataaaagctagtattaattttgatgttagtatttttttctttaaacaatatatgaacgaaaaagagactgtaaataatgaaatatatgtggcagtatttctgattaaatcagataataaaaaatatttttga

SEQ ID NO: 3198 - DNA, 1155 bp, Proteus mirabilis
tgtgaagtctctcactatattcctacagacaaagacagggtaattacaatgaaaaatgttggttttgtgggctggcgtggtatggtcggctccgttttaatgcaaagaatggttgaagaacgtgattttgatgggataaaccctgttttcttcaccacttctcaattaggtgaagcagcacctgcttatggcaatcatcgtagtacactgcaagatgcttatgatattgatacgctcgcctcactcgatatcattatcagttgccaagggggtgattacacccatgatatttatcccaaattacgtcaagcgggttggcaaggttattggattgatgcagcatctgcactacgcatgaatgatgatgcggtgattattcttgatcccgttaatggtcaacatatccaagatagcctcaataaaggtattaaaacctttgtgggggggaattgcaccgtaagcttaatgttgatgtctttgggcggactttttgctaacgatttagttgaatgggctagtgtctccacttaccaagccgcatccggtgcaggtgcgcgtcatatgcgtgaattattgtcacaaatgggtgcattacataaccaagtggttaaagagctagaaaatccagcctcggcaattttagatattgagcgcaaagtcactaactttactcgcagtggtactatgccgacagagcaatttggtgttccactggctggtagcttaattccttggattgataaacaattggaaaatggccagagccgtgaagagtggaaaggccaagctgaaaccaacaagatcttaaacaccggttcaaatatcattcctgtggatggtctttgtgttcgtataggtgcattacgttgtcatagccaagcattcaccttaaaactgaaaaaagatttgccggttaacgaaattgagcaattacttgcccaacataatgattgggtaaaagtagtgccgaacgatcgtgaattaacaatgcgcgaattaaccccagcagccgtaacgggcacattaagtacccctgtaggacgtattcgtaaactgaatatgggacctgaatttatttctgcctttacagtgggtgatcagttgttatggggtgccgcagagccactccgtcgtatgctgaagatcttagcttaa

SEQ ID NO: 3199 - DNA, 276 bp, Proteus mirabilis
ccttccctatcccccaacgccatctttctcaatgggagaaatttagttttgataaaaatagaaccagtaaaattgatattatcttctattgcaattctatttatagccattttttcaatttatatatcaacaagttactacataacctattttctaatggaagataggatcttattctcatttcaaacagggctcttagtttttgcaacgcctctaatactttatttctcatattatagttttattttaggataccaaaaaagttacaaagaatga

SEQ ID NO: 3200 - DNA, 447 bp, Proteus mirabilis
aaatggtcgtcaggttctggctcgccgtcgtgcgaaaggccgcgctcgtctgaccgtttcttcgaaataataaaagctaaccattccgtggttaagctcgcttttccaagggagttacgtttgttaactcccaagcatttcaattttgttttccagcagccacagcgtgcgagttcaccagaagttacaattttgggtcgccagaatgagctggggcatccccgcatcggtctaactatcgcaaagaaaaacgttaaacgtgctcatgagcgtaatcggattaaacgattagcccgtgaatactttcgtttacatcagcatcaattacctgctatggattttgtggtattagtaaggaagggggtagctgaacttgataaccaccaattgacggaagtgttgggtaaattatggcgtcgtcattgtcgcttggctcaaaaatcctga

SEQ ID NO: 3201 - DNA, 264 bp, Proteus mirabilis
attatggcgtcgtcattgtcgcttggctcaaaaatcctgatcttgctgattaggggctatcaactggggattagtcctctgttggggcctcgttgtcgtttcaatcctacgtgctctcattatggtattgaggcattgcgcaggtttggaatgataaaaggtagttggttaacagtgaaacgcatattaaaatgccaccctttacacgaaggtggtgatgatcctgtcccacctagaaaaaacgacgataacagagaaaattaa

SEQ ID NO: 3202 - DNA, 513 bp, Proteus mirabilis
attgaccttcctgtagggggaaagattattgttctctgtattcgtatctataaggaatacatgatgaaaaaattactttttccctctctcttagtattgtcaacggttagtggtactgtacaagcggcaaatcatgctgtagttgaagtttataaaaccgaaaattgtggttgctgtaatttgtgggctgatggtgtaaaagaagcgggctttgatgttaatgtcaatattgtctctgaaacagaattaatgcaaaaatatcagcaagcagcagtccctgataatttattaagctgtcactatgcaacataccaaggcaaagacttagtcggacatattcctatcgatagcttaaaaaatatagacttaatggataaaaagcaaataggcattgctgttgcaggtatgccagcgggtagcttaggtatgtatgcaggggactataaagaaccttatcaagtcattgcttttgataaagcaggtaatcaatcactatttaaatcatacaattaa

SEQ ID NO: 3203 - DNA, 186 bp, Proteus mirabilis
ataatgactttattagcctttgataataacgcatggtttatccttataataacaatagatctattccttacaatccgttttttaaggcaaaaaaaaacagataaccgtatatttgattatctgttgctaaaaactagcttaatgaccactaataccacgtatgtaaaaggactaaattgtttttaa

SEQ ID NO: 3204 - DNA, 432 bp, Proteus mirabilis
atgtttaaaccaataagcgagcctattatgaaaaaaatactagttttattaattggtagtacattggcttttgcatctcaagccaattcaaaccaacaaaatagtggtggttttgttgccccacaaagcgctatcaccaccacagagcaaggtggatttaaaggtccttcaattagcgaaaccaccgttgctaaagcaaaaacactttcagatgatacttgggttattttaacaggcaaaatcaccaaaaaaattggtgatgagctttatgtttttgaagacacaacaggtgctattaatgttgaaatagaccaaaaaagatggcgtggtcaaaccgttacgcctgagaataccgtaaaaattgaaggtaagatcgataaagagtggacaagtactgaaatcgatgtaaaacaactgagcattgttaaataa

SEQ ID NO: 3205 - DNA, 333 bp, Proteus mirabilis
cagggtgtgccggctaaaaaattgcattacttcttgcagcataggatgcaatcactctcgttagttaaaaatagtattaaagagccaaagtatacctttgtcatggcgcaattacagcctattccttcgtttctctttcagtttttgcggaaagtttctcaacaatcattttttttattgacggatttatgtaccattagcgccgaaaaatcctgtaaaacagcgtttaaaagagtctctcttttcactttaccggatctctcttcaggtaagctattaagaaatcagcattcatcatcaaagcctgtgacaaaaatagtcactcgtacgtag

SEQ ID NO: 3206 - DNA, 1257 bp, Proteus mirabilis
aaatgcacgccaacgcattgcttctcactatacttggcaacattcagcacaacgattactacaggcattaaaaacagaatgatgaaaatcgcctatcttgatccttatcccgttcccgatttgcgtgtggcttcattgcaaatattgcaaaacgttgatgcgtttgcccgtgccggtgcacaagtgacgctagtcacccccaaaggacagtatcgagatagcgatattctcgggcgtgatattcatagcaatgcgcggttaattgcgctaagagatatcagacgtaaatggtattttccctttaattcgcaaaagctattttcattacaaattgcacgttggttaaaacaacaccctgttgatgcactatttacgcgtaatttaaaactggcctgctatctggctgagaaccatgcagatattccgctttttttcgaaagccatgagatttttgcgcaatcttttgcagagtcgcactcttttgaaacgaaaaaaaatcgcctgaaataccataaactgctaaaaatggagaagttggtatacagtcgcgcaacggcagtatttgtgctgacctcgctgttaagggacgatattatttcgcaatatcaagtaaccacgcctattactattgtacccgatggggtggatttatatgccgcagatagcaacaaagatagccatagagatataaccgctacgaccaataatgtaacagaggtactttatctaggtagtttgcataaatggaaagggatccccaccatgatgcgagcgatgaaatatctggataacgctagactgaatattgctggtggaacggctgagcaaattaaagggctgcaattgcttgctaaggagatggatgtaaaagagaaagttaactttcttggttttatcgatcctaaacaacgctttcaggcgattgctcaacatgatatttgtgtgctgcctttaaccttaaccagtatcggtagtcgctacacctctccgttaaaactgtttgaatatatggcgatgagaaaaccggtggttatttcagattttccatcaattcgtgatgtggtggatgaaaaagcggtgagttttgctgatagtggtgatgcgcagagttttgcccaacaaattaaattactaagagaagagccacaacgtaccagtgagaaaatcaatcacgcccgttcattagttgaaaattattacaactgggataaacgggcagagacgattttacataccatcaataaactgattagctaa

SEQ ID NO: 3207 - DNA, 891 bp, Proteus mirabilis
aataaacagttgcatatgaaaattttagaatattatttcaaacaattacgcacgctcgcacagccagatcgtgtttatctaaaaaataaatttattcgtaacttaggttatcaacctaattttcgccaccccatgtcattgaatgaaaaaatcaatgcacgtatgttatttgatagagatcctatctatacacgcttagcagataaaatcagtgtcagggagtatgtaaaagaaaagataggcgaaaaatatctggtcaaaatccttaatacttatcgccatccaaatgaaatcgaacttaatacactacctaaccgtttcgtattaaaatgtaatcatgacagtggcagtactattatttgccttgataaatctcaatttgatttggagatggcaaaaaagaaacttaattttcatttaaagagaaatctctaccacgttactcgtgaatggcattataaaaatattagtgcgcaaattatctgtgaagagtatatcgacctttttgatactcaatgtccgatgatcccaaccacatgccgtatccactgttttcatggtcagcctcattatgcggaaattgatatttcggatacaaagggatgcgagtatatcaatgtttatgatacacaatggcaattacagccttttactttagaagatcccaataccccagaatatattgaaaaaccgctacaatttgacaatatgctcacattagccaacaaattagctaacggttttgcctattgtcgggtcgattttttaatgtcagaaaccacactactgtttagtgaaatgacctttacccccaatgcggggcgcattcccattaaaccaaaagagtgggactataaattaggtgaactatggacacctattgcttcttaa

SEQ ID NO: 3208 - DNA, 1380 bp, Proteus mirabilis
ttaagcgagttcaccatgcatagcactgatactatcgtcgctcaggccacacctcctggaagaggcggtgttggtatcctacgcgtttctggccctaaagcggctgttgtagcacaaactattttaggcaaagtacctaagccacgttatgccgactatcttccttttcgcaatgaagataactcagtgcttgatcagggtatcgcccttttcttccctaatcctaactcttttacgggtgaagatgttttagaactacaaggccatggtgggccaattattctcgacttactcttaaagcgtattctacaaattcccggtatccgtattgctaagcccggtgagttctcagagcgagccttcttaaacgataaactcgatttagcgcaagctgaagcgattgccgatttaattgatgccagttcagagcaagcggcacgctctgcgattaactctttacaaggtgctttctcctctcatattaatgagatggtcgagtccttaaccaatttacgtatctatgttgaagcggctattgatttccctgatgaagagatagactttctttctgacggggtgatcgagggcaaactcaatacggttatcagtcaattagacgatgttcgtgcgcaagcgcgccaaggcagcctattgcgtgaagggatgaaagtcgtcattgctgggcgccctaatgccggtaaatcaagcctattaaatgcattagcgggaagagaagcggccattgtcaccgatatagcgggtacgacacgagatgtattacgcgaacatatccatattgatggtatgccattacatattatcgatacagcaggtttacgtgaagccagtgacgaagtagaacgtattggtatcgagcgtgcatggcaagagattgagcaagcagatagagtcctctttatggttgatagtaccaccaccgaggcgacgacaccggaagagatctggcctgagtttatggctcgtttacctagcacactgccggtcaccattattcgcaacaaatcagatttaacgggtgaacctgccgagatcacctcgcaaggtgactatccgatgatccgtttatctgcccgtgatggaatgggcattgaattactacgctcacaccttaaagaagccatgggctttaacagcaatactgaagggggcttcttagcgcgccgtcgtcatttacaagcattaaacacagccgctgaacacctacaacaaggctatcagcaattggtttatgccaagtcaggtgagctattagcagaagagttaagacttgctcaacaagcattaagcgaaattactggtgaatttacatcagatgatttattagggcgaattttctctagtttctgtattgggaagtaa

SEQ ID NO: 3209 - DNA, 891 bp, Proteus mirabilis
ataatggatacacgtttattaaatgcttttgtggtgttagctgatacagggcactttggtgaagcctccaaacagctttgtattagccagcccgcattaactaaacaaattaaaacgttggaatcacaactggatatcgtgttgtttgagcgtggtcgccatggtgcaaagctcacgcaagaaggacaatatttactcaatcaagctcaagtggtattacgggaatcccatattttagaaaaacaagctcgtcaattagttgagccacaaaaagtctcactttatgcgggattcggtctgtcatcattaagttttattacttcactattggcgagatttaatcaaattgagccaaatattagcgtcaatattgatgatatgtcttctcataaaatggaagaaaaattattaatgggtgaacttgatgtggctttttctcgtttacccgttatgccccctttacaagggatagcgttgacacaagagcaactgatgttagctattgcaacacaacatattacggtgttggaggcagattataacccattacattatttcgactcattagagcttattttacttgctccagaaaaagggaaaaaactgtatcagcagatacatgcttttttacaacagcataaactagcaccgcgtttattacagcaatctcaagatattcagacccaattagcgctagtcgcagctggattagggatagcattagtgcctaaaagcgcgcaattaatttgtgataaacaaagagtcacattgttacctctatctgggttatacacacaatggaaaattggtgtaatttggaatagtaatattaaaaataaagaacgtgatctttttattaaaataattactgaaaaaattgatattaaataa

SEQ ID NO: 3210 - DNA, 306 bp, Proteus mirabilis
aaagatatcactcggcctgttattgctgtcatagtacgtttaattctggctcttaataaggtacactttttgtgtttttataggatccactttatgaaacagaaaccaacagcttatttccctaaccttgtattagaagaagggtctattagctcacaagtctattacgccgttagaaaggctatttatttactcgtcgcgggtcgggcacttttgttacgaataccattcctgatagcattaattccaatcagtgggttaaaacaaccctgccgacgtcttcattgcatatcgataatgaattag

SEQ ID NO: 3211 - DNA, 3066 bp, Proteus mirabilis
gtaggtaacacaatgcatgtagtgctttttcacaaacgtacgttagtctccatgatggtttcactctccttattttctctcaatagttattccaagactaaggataatacaaccgatcttggacaaattcaggttgcagataatttagaaaaagatcaacaaggttatgctcaagtctatgaaaagtatgtggctaatatttatttaggtaaagcccttattgagcgttatcaaggggtatcgcgtgcagatttatttaaaagcgcgataggtgttcatagtggtgaagcccgtaatgtaggagcattggatccgaatattagtggtattcaaggcctagggcgtatcaccgttactgtggatggttctgagcaggcgattacggtatatcgtggttatagcggcgcatctaatcgtacatatactgattccaatttgataagcagtatctatatagaaaaaggtccttcacttaatcctaatataaaaacagggattggcggaggggttgccattaaaacattagatatacgtgatattgtgcccattggtgagtcttttggtattaattttaaaggtgatattagtaataatgccacaggctataaagatatttatactaatatgattgaagagtaccgttattatccaaaattctatcaacaaaatgcttatattatcgatcctgcattagaaataacacctaaaaaaagtaaaatagaaaactttcaagattattcatttcgcttaggtgtaggatttgagaaagaaaaatttaatttactttttgcatatgcaatacgtgaaaaaggtaattattttgcaggaaagagaaatgtagaagagtatagtaaagtagatgagcaattgcttaattctgtttatataatggacgggaaaagacattttgagccttatttaccttttattgctcatatttatcgacctggtaatgaagtaccaaatacatctaatcgtaaccgctcttttttagtaaaaggaactctatttccacaacaaacgcatcgtttctccattaattatcgatacaccgatttattatttggcgatattatgccatcacgattaagttgggttcgttatcaagaaaatttagttaatcaatggcctttggcaaatattacacaacaagcaggcatattaacctatcaatataaaccagaagataaaaaaacagatttattactgcgtttatggggtaatttaacgttaggacatactaatactcggggaggaaaaccaagagagcctaaaatggttgattttagagctagcagaaatacaaggtgggatccctctattgatacaggctttttagatacagcttctctatatcaagataataatcgttatggtgttgatttttcatcgttatttaaattatcacctcagttttctatttctttttccggtcaatatcaattggaaaaattagatagtcatgagcttgaacttcccatgggttttgatttcgtgaccgaggggcgagcagggcaacgtcatgaagtcaatttagcgttagccacagattggaaaccattaccctggtttgcgatgaatattggcggtaaatatcattactatcatctgacggatacctttttaaataataaacggaagaatagggttaaaaattacgagaaaacagcccctatccgcggttatctgatctcttatcgacgagtattaacgccagaagagtatttactctatcgcgcggttaacaaaattgatgtcgatactttacctgacgagttaaaaaattaccgaagttctgctgagctgagtaaaaaaattagagactttcaacaagcggttttagtttaccctgaaggtggcgctttgctagaggaaatcaaggagcaggttgctaggccatatcttcagagaatacagcatgatatggagcatgaagattttcttcgtaataaccatggaaagatgcaaataaaaaacgctaaagccatcccgatgaaaagagagtttagcctttggttatttgatgaaaatggcgtactacttaagagtaagaatattttacttaatggttttcttgatatggaggaaaaagtccctcatccagtgacgggggagttagtctatcgctttgaaaaagatgttattaatcctcaggcattttctctatcagaagatattcaagatccctacgcactggagcctagctatcagcatggcgcattttcccctttaatctctgccaccctttatgccaacgatatggtgcgtttttatggccgttatactgagcaattgcgtttacctaacttatttgaagataccagtggtttttcaggctctaaagctcgctattatggctttaagttaaagccagagcgtgccaaaagcagtgagtttggtgtggttgttgattttacgcattggttgaatatagagcgccacgctgatattaaaattaattactttaaaacgaacattgaaaatgtatttgatagagatgctaattggcaaattagacagttagaaaaacaaatattagaaggtgtagagttacaagcccggtttgataatggatttattttctttgataccgcattagtgtatagccataaaaataaagtctgtgatgaaaatgctttttatgagcttgatgcatcaggattatcgggtattaaaaactgtatgacagggggataccctggcggatttttgcgcacctcaatgcagcctaaatactcagttaacctacatttaggcacgcgctggctaaatgataaattagaattaggtagtcgctggctctattcatcagaagttgaaaataaagatgagaaatggcttaaagaaaatttacctaatagctattttggcataaataataatccgatgcgttgggcaaaagtatttactattgatgcttatgcaacctatcaatatagccccaatttatcttttgaaataacaggaagtaatttattaaatgaatattacattgatccgctgacccgttctggtatgccggcaccaggaagaagtttgcgattaggtgtaacagcccaattttaa

SEQ ID NO: 3212 - DNA, 567 bp, Proteus mirabilis
tggtatttaactatgcatgctcaagctaaggttacccttgctgaactaaaagagtgcttacaggctgaatatattggtgataaaaaaccctttagttggttaagactatttcatcgagtatttttctgtcagcgttcccgttacctattttggtggcgggtagcacagtatttttatttctctccccatcgctttttacataaattaggtattcggatcggtgctagcaataaccgcaaatactgtaatgatatctcgttaaaaactcgtattggtaaaggcctttctttaccacacccgattggcattgtactgactaattattgtcaactgggggaatatgtcactattatgcaaggggtgactattggcgtaaaagagaaagggggaaaagccaatatccaagtaggaaaccatgtttatattggctgtaattcgtccattattggtggagagattaatattggtgataatgcgattattggcgcccatgcattagtattaaaggatgtgggagaagggtgtcggtatatcacgaaagtgattgcggatatcaggcaggtataa

SEQ ID NO: 3213 - DNA, 2460 bp, Proteus mirabilis
cacggaccaacggtagcaagtcttgctccaacatttggtcgcggtgcgatgaccaaccactgggttgatatgaaaaatgccaaccttatcgtcgttatgggcggtaatgcggctgaagcacaccctgtcggtttccgctgggcaatggaagctaaaatccataataaagccaagttaattgtgattgatcctcgcttcacacgtactgcgtctgttgcggatttctatacgcctattcgttcaggtacagatatcaccttcttatcgggggttatcttatatctgctcgaaaataaaaaatatcaaaaagagtacgttgaggcttataccaatgccagcttgattgtgcgcgaagattaccattttgatgatggtctctttagtggttacgatcctgaaaaacgtcaatatgataaaaccacttggaattacgagatggatgaaaatggtttcgctaaacgcgacaccacgcttcaacatcctcgttgtgtctggaatctattaaaagaacacgttagtcgctacacacctgatgtggtcactcagatttgcggtacaccaaaagaagatttcttaaaagtctgtgaatatattgctgaaacagcagcgaaagataaaacagcctctttcctgtatgcattaggctggactcaacacactgttggtgcacaaaacattcgtactatggcgatgatccaattactgttaggtaatatgggtatggcaggtggcggtgttaatgctctacgtggtcactctaatattcaaggcttaacagatcttggtctgttatcacaaagcttaccaggttacctaaccttgccttctgaaaagcaaacatcgttagaaacctatttagcagccaatacgccaaaaccgaccgtccaagggcaggttaactactggggtaactatcctaaattcttcgtcagtatgatgaagacattttatggtgatcatgctcaacgtgataacgattggggattctcactattacctaaatgggataaaccttacgacgttctgcaatatttcgaaatgatggataaaggtgaagtcaatggctatatctgccaaggctttaaccctgtagcttcattcccgaataagaacaaagtgatccgttcattatcaaaactgaaattccttatcaccatggatccgttaaatacagaaacatcttgtttctggcaaaaccacggtgaagagaatgatgtgaaaacagcagatatccaaactgaagttttccgtctacctacgacctgttttgctgaagagaacggctctattgttaactcaggacgctggttacaatggcactggaaaggtgctgatgccccaggaattgcactgcctgatggtgaaattctctcaggtattttccatcgtttacgccaactttataaagaagaaggtggcgcaatgcctgagcaggtgttgaatatgacttgggattactttgatcctaataatccaacatctgaagaagtggctcaagagagcaatggtaaagcccttgtcgacttaaaagacgctgatggcaatatcattttgaagaaaggtcagcaactaagctcatttgctcagttacgtgatgatggtacaacggcaagtggctgttggatcttcgcgggtagctggacagaaaaaggcaaccaaatggctaaccgtgataactcagacccatcaggtttgggtaacacattaggttgggcgtgggcatggcctttaaaccgtcgcattatttacaaccgtgcatcagcagatccacaaggtcaaccatgggatccaaaacgcaagttaatcgaatgggatggcagcaaatggacaggtattgatgtacctgactatagcaatgccgcaccaggctctgatgttggtccatttattatgcaacctgaaggtatggggcgtttattcgctatcgacaagatggcagaaggtccattccctgaacactatgagccaattgaaaccccattaggtaccaacccactgcatccaaatgttgtttcaaacccagcagcacgtgtgtttaaagatgactgggaagagatgggtaaagcagaagagttcccatatgtaggtacgacttaccgtctgactgagcatttccacttctggacaaaacatgcgctgttaaatgccattattcagcctcaacaatttatcgaaatcggtgaacggttagcggcagaaaaaggtatttctcaaggtgacaccgttaaagtcagttccaaacgtggttacattaaagcaaaagctgtagtgaccaaacgtattagaacacttgatgttgatggtcgcaaagtggataccattggtattccgatccactggggttttgaaggggttgcggttaaaggctttattgctaataccctaacgccattcgtcggtgatgcaaatacacaaacgccagaatttaaagcgttccttgttaatgtggaaaaggtgtaa

SEQ ID NO: 3214 - DNA, 339 bp, Proteus mirabilis
aatttaaaaacgcgacgttttactatggggttcattatgcattttcgatatcgtaaaatgatatttttattattagcttatctaattaacaataatttagcattagctgataataaaaatatcgagtttgatattgactcacttaaatctcttggttatggcagtgaaatcgctgattattttaaagaaggaagtcattttcttcctggttatcatgatgtaacaattatagtaaatagtagccttaactattctgataatatccttattaatgaatcaggtaatctttgcttaaataatcaattaatagataagctgaaattaaaaaaaaagagataa

SEQ ID NO: 3215 - DNA, 399 bp, Proteus mirabilis
gaatatcgaacagtcactttactcaaagccaaaagtgaagctatactttcactaactgaagatttaagaaaatatagtttcactatgaataccatcgaatcaacaacaaagcgcactgctgtcgtttttccaaaacataaaaaggtgttaagcattttgggcgagaacttaactctagcaatgaagcgacgtggtattacccaagaaatgatgcataatcgaacaggattgtctaaaccaacgctacgaaaaatcctaaaaggcgatccttccgtttcgcttggtcactatgtcaacgtattagcctccttaggcctcttagaagacttaaccaaagtcgcctttgatgacgaattgggaagaaagctgcaagacatccaattgctgaaaaaaaaataa

SEQ ID NO: 3216 - DNA, 1470 bp, Proteus mirabilis
agtgaccatgccatgctaacactttctaccatcgatatgcttttagcgataaacgaagggcagcttatagaagaagtgattatcactttattagcttctcctcaattagctgttttttttgaaaaacacccaagattaaaaaaagcattactaaaagacatttatcaatggaaaaaaagcttacaagaaaaagtgaaagaaacactggtgccgaccatcatcgcagatgaatttgcactttatcagcaaacgcaatcattatgtaatgctgtttttaatcagcaagtggacaatattcttacagaactaaatcagcttgattcttcatttgttatagaagcaacacaactaataaaaacaaataaacctttttctccagctcaacaagctctatttattcaacgctggcgcattagtttaatatttcaagtcacgacattacataaagcactgtttgaacaagagcaagagcagttacttgcagaactacaagaacgcttagcattaagtggcagtttaagtaatacattttctgaaaatgaacgggctgcaggccgtttatgggatatgagcaaaggcgttattaccaaaaccccctatgatgagaaaattattcaacgttatagtgattttctaaatcaacaacctgaattacataaattggccagcttactggggcgaagtaaaacggcgaaatcgcttcctgaagagagtgtgatttttgaatcaataacaatcgttgaaaaagcaccggataccacgccagagcaagtaaatggtataggcttaagtgatgatattttacgtttattacctgctgaactagctttattaggcataaatgaagttgagtatgagttttatcgtaaactcattgaaaaacagctcaatacttatcgtttacagggtgatagttggcaggaacgcacagtattacgcccagtcactcatcaccttgatgaagaacgaccaagaggcccttttatcatttgtatcgacacttctggctctatggggggatttaatgagcaatgtgctaaagcctttggtttagcgctaatgaaaatagcactagcggataaccgtgcctgtcatgtcatgcttttttcaacagaaatgatccattaccaattatcttcttctgatggattacaagaacttgttaaatttttgaatcaaacatttagaggtggaactgatttagcatcttgtttaaatgaggtagcagataagcttaatacccccacatggaaagacgctgatgctgttgttatttctgactttgttgcccaaaggttacccgaaaacctaatcaataaaatcaaaaaagtccaacagcaacagcataatcgcttccatgcggttaccctatccaattatggtaaacccagtattatgaaaattttcgaccacatatggcgttttgacactgggttaaaaagtcgattactacgacgttggcgtcaataa

SEQ ID NO: 3217 - DNA, 708 bp, Proteus mirabilis
tgtttaaatgcttggcgaaaagggagagcacaaagaatggaaaacgcaaccatagagacactcttaccgagagaaaaactgctgttgcatggtgtagaatcgttaacggatgcagagttattggccatttttttacgtacaggcacctatgaaaaatcggtattagaattagcagactttttacttagaaagtgtggttctctctatcatgtgattaatgcggattatgaaacattaggctgttttaaggggataggcgtgggtaaatttacccaattacaagccattaatgagatggctcaacgctttattaaaacaaagtttatgcataaaaatatcctctcctcatccgcagaaaccaaaagttatttgcaaaaacgacttaattggcgtgatagagaagtatttgtcgtgctatttttagataaccaaaaccaaatgatcgattgtgaggaaatgtttaaaggaacggtggatcgtgttgaagttcaccccagagaaattattcgccagtcgattaaaaagaacgctgcatcgattattttagcccataaccatccttcaggtctgtctgagccaagtcttgccgataagcagataacagaaaaaatttttacagcctgtcaattagtcggtataaaagtgcttgatcaccttgtggtagggcatgataactgtgtttcttttgctgaacgaggttggttatag

SEQ ID NO: 3218 - DNA, 432 bp, Proteus mirabilis
tatgatgatgcaacgtcatggacataccgtagaggcactgacaaatcgatgatatgggttagcgcacaggaagttatcgctttccatgatcgtatattacaacgtttcccaggtgtggccggtatgcccgatcctggcagagcggaagctcttatttaccgggtgcaaaaccgtaaacattatgaaggcattacagatgtgtttgaactggcagcaacttattgggtcgctatcgctcgagggcacatatttaatgacggtaataaacgtaccgcattttttgtgaccatgacatttctctatcgtaatggcatcaggatccgcgatactggcaatatgctggaaaacttaacagtagaagcagctacaggtgagaaaaccgtcgaccagttagcaaaacatctacaaaacttggtagagaaaactaactaa

SEQ ID NO: 3219 - DNA, 687 bp, Proteus mirabilis
ttttatatcgctcatggaggatatatgttcaaaaaaagcttattagctatttctttacttactttatcaagtagtatcgctttcgctgcgacaccaaccgctaaattaaaagtaagtggggatatccaaccaccaacttgtaccattaatggcgaaacaagtgaaactactgttgaatatacttttgctgtaactcctggccttttccctgcaaaaggtgatttaacattagagcctcaatcaaaaaatattgtcgtaacttgtgatgcaaaaacctatctagcttttactcctactgataatagagctgggacagaaaaaaaagaaggtgattcttattttggtttaggcagttataagatggcagtcgatggaaaagaggctgttgatactaaagtaggttactacacagtttcaatgaaaaatgccacagtaaaagaagatttgactagtgaagaaaagaaagtctatgtaatggattctagatatggcagatctacttctaagacactagtaaaaaatgattcattaggttgggctcgtagtaatgctaatgattatgctgacggtcaagtatttgcggcagattttgaagtcacaccaaccatcaatagcgcactaaaaaatagtgatggtgatgctaagttagatggtttagccacattaacattccaattcggaatttaa

SEQ ID NO: 3220 - DNA, 234 bp, Proteus mirabilis
agcttcatcgcttcctttgaggcggaaaaatcagccaatttttgcgcggcatctcgcttattagttcctttgattatcgccgttgcttcaatatcccaacccaatccttcttgcggtaatatgatgtctagtggcgccccttgtcgtttcaattggagcgccggatattcaaaggatatgcctatcgggtattcccccgatgcagccattttgcagggtttggagccagaatga

SEQ ID NO: 3221 - DNA, 1413 bp, Proteus mirabilis
gaggagtccgccgtgtcactttcgctttggcagcattgtcttgcccgattgcaggatgagttacctgccactgaatttagtatgtggatacgtcccttgcaggcagaactaagcgataacacgctggcactgtatgcacctaatcgttttgtgttagattgggtaagagaaaagtacattaataatattaatgcgttattagtcgacttttgtggttctgatgtcccttcgttgcgttttgaagtggggaataaacctgtatcagcacgtaccaccgagagtgttcccaaaaccgtgacacatcccgcggttaattccacaccgactaacagccagcctgtgcgtccaagctgggataatcaaccgcaatcccagttacctgaacttaattatcgttataatgtgaatcctaaacataaatttgataatttcgttgaaggtaaatcgaaccaacttgctagagctgccgcaagacaagttgctgataatcctggaggagcttataacccactgtttttatatgggggaacgggtctgggtaaaacgcatctattgcatgcggtgggcaacagtattatggaacgtaaagccaatgctaaagttgtttatatgcattcggaacgtttcgtgcaagatatggtaaaagcgttacaaaataatgctattgaagattttaaacgctactatcgctctgtagatgcgctattaattgatgatattcaattttttgccaataaagagcgttcacaagaagagttttttcatacctttaacgctttgttagagggaaatcagcaaattattttaacctcagaccgttatcctaaagagattaacggggtagaggatcgattaaaatcgcgctttggttggggattgaccgtagccattgaaccaccagaattagaaacgcgtgtggcgattttgatgaaaaaagcggacgaaaatcaaatccagttacctgatgaagtggcgttttttattgctaaacgactccgctctaacgtccgtgaactagaaggtgcattaaaccgagtaatagctaacgcaaattttaccggtcgagccattaccatcgactttgtgcgtgaagcattacgtgatttactcgcattacaagagaaactcgttactatcgataatattcagaaaactgtagcagaatattataaaattaaggtagcggatttgttgtcgaagcgacgatcccgatcggttgcccgtccgaggcaaatggcaatggcgctggcaaaggaattaacaaaccacagcttgcctgaaatcggggatgcctttggtggtcgtgaccatactacggtactgcatgcttgccgaaaaatagagcaactgcgtgaagaaagtcacgatatcaaagaagatttttctaacttaatcagaacattatcatcctag

SEQ ID NO: 3222 - DNA, 1284 bp, Proteus mirabilis
aaaggctatttatttactcgtcgcgggtcgggcacttttgttacgaataccattcctgatagcattaattccaatcagtgggttaaaacaaccctgccgacgtcttcattgcatatcgataatgaattaggaacacttaatcctaatttgcaaaagatgcatgctttttggcaacaatcacaactaaataccaatagtcgctttatgtttcatgtgggtgttgggtgtattgatcttttcccccatgagctttggggaagattattaggacgagtttggcgacactccaaaaaagaactcgcaacctttaactcgccaacaggctatacaccattaaaaaagatgatatgccaatatgcccaatcaacacgtgggcttaactgtcaacctgagcaagtcatcattgtcaatggcacacagcaagcgattaatcttgctactcgagtgctattacaagaggaagatactgcttggttagatgatcctggttatgacagcgctcgagctatcttcacatcgtatggtataaaaatacaccccgttcgttcagatagtgacggtatggatatttctcaagctatagaccaatgcccgcaagcaaaactagttttcaccacaccttcacatcaattccctttaggtaatactctttcactttcacgtcgtattgccttattagagtgggcatcgtccaataacatgtggatctttgaagatgattacaatagcgaatttcgctatcacactaaacccattcaagctctacaaggattagacaaacatcagcgggttatttatgccggaaccttttcaaaaatgatgtacccgggatttcgtttaggctttttagtggtacctccatctttaattgacagctttaaagtcgctaaatactacaccgactctcattctggttttttagaacaagcaacattagcgctatttatatctcaaggacattatgctcgccatgttagacggatcagaaaagcctgttatgaacgttatctaacgttaaccaatacgataaaaaagtatctctctcacatttttcgtattgaaccgactgattctggcatccatattgtctgctggttacagtctggttatacagaagaatatattgtgaaagagggacggaaaattgggttagccatacagcctttatcgcgttattgtattcaatcttatcctaaacagggtatattattagggtatgccgcacaccatccctctgaaattgaaaaaaatattattttgcttgctcaagctttatctaaataa

SEQ ID NO: 3223 - DNA, 996 bp, Proteus mirabilis
cgaactcgagcaattactcgctacggagccatcgctatgaagcgggtactgattgttaaaacctcttccatgggggatgtactgcataccctaccggcattaactgatgcaagagcagcatatcctgagatctgttttgattgggccgttgaagaaggttttgcgcaaattccaagctggcacccagctgttgataccgttattcctgtcgcaatacgccgttggcgtaaaaactggtttagtgcgcctattcgcgctgaacgtgcacaatttcgtcacgcgatacaagcacatcattatgatgcggtgattgatgcccaaggtttactaaaaagcgcttttttagttacacgctatgcgaaaggctccaaacacggctattctcgtcaaagtgctagagagcctttagcgagttttttctatgatattcgccacaatgtcagtaaaaaaatgcatgcggtagagcgtatccgccagctatttgcccttagccttaattacccactccccaccactcaaggggactatggtatagcacagcattttctctcgttacccgctattgataaacgcccttatttagtcttcttacacgccactacccgtgatgagaaacattggcccgaggcccattggcgagagttaattgcattactggcggattcagatttgcgtatcaaactaccttggggtgcagagcatgaacatcagcgtgcaatacgccttgcacaaggttttgactatgttgatgtattacccaaaatgtcactcgcagaagtagctcaagtgattgctggagcgcaaagtgtcgtttctgtcgataccggattaagccatttaaccgcagccttagataagccgaatattaccctctttggccctaccgatccgggattaatcggcggttatggtaaggcacaaaggtcgttaaaagcagcaggtggggatattggggagatcacgcctcaaaaggtttttaatatacttaagatttaa

SEQ ID NO: 3224 - DNA, 564 bp, Proteus mirabilis
tattggcatttgttaatgcacagtatacctttaataaatacgcctcattatgggaacttagccggaaaaaccgtgaatatgaaaaataaagctatctaccctggaacctttgatcccatcacctatgggcatattgatattctcactcgtgctgcgggtatgtttgacacggtgttattagctattgctgccagcgcccgtaaaaaccctatgtttagtttagaagagcgtgtcgctttagcaaaagaagtcacccaacacttgccgaatgtggaagttgtcggcttttgtgagttaatggcgaattttgctaaaaaacagcaagcgaccattttgatccgtggcgtacgctcggtttctgattttgaatatgagtggcaactggcgaatatgaaccgtcattttgccccagatctcgatagtgtctttttgttaccttcacaaaatctctcttttgtttcttcttcacttatcaaagatgtggcacgtcatgacggcgatgtatcgacttttttacctgaagtggttgctacagcaatgctacaaaaactcggtaagcgttaa

SEQ ID NO: 3225 - DNA, 270 bp, Proteus mirabilis
agtaaaaattttactaaaacttgtcgctattttgggcacaatagagaaaccttttactcttggaaaagggcttatgaacgggatggcgaaaaaaggattaatcaacataaaccttgtcctgaatatctaacaataatagttgtaaagcacatcgaagaactggtgatttatttgcgcacaacctatcattttggcccacaacgtatcgtatatcttctactagttcataatatcgaaatattggttcgaaccgctacggtatattggtaa

SEQ ID NO: 3226 - DNA, 603 bp, Proteus mirabilis
tttttattttatctagataaaagctttagggggcgcaagatggatttatcaacctactttccattatcaacctattattcatatttaaagcggtttgtactgtctcctaccacaatgggaactattgcgccttcatcacgttggttatgttatgaaatgctcaataaattaaattggcaacaagatatccaaatcgccgaattaggtgcgggtactggggtgattacgcaacagatcttaaaacgtatgtcatcaaactcggtattagatgtttttgagatagagccggcattcgctaatgagctgaataagattaatgatccccgtttaaccatctatacagcgtctgctgaaaagttagatagtcattataatatgattatttctgggttgcctttcttgtctattaacagaaggttagggttaaaaatcttaaagcgggtacatagcgaattattaaaaacccaaggttgttttgtgttgtttcaatataccactcgatatgaaaaaacattatctcgttattttcatttagagaaaaaacgagtgatgttaaatgtaccgccagcttgggtttattattgcaccccaaaaataaaatag

SEQ ID NO: 3227 - DNA, 246 bp, Proteus mirabilis
gatgtacattataggagaaatattatgcgtacatatacctcgacacaagcccgagccaatatttcagaagtattagatattgcgacccacggtgaacctgttgaaatcacccgcagagacggttgttcagcggttgttatcagtaaaactgaatttgagtcataccagaatgctaagctagatgcagagtttgatatgatgatgcaacgtcatggacataccgtagaggcactgacaaatcgatga

SEQ ID NO: 3228 - DNA, 1128 bp, Proteus mirabilis
tcagaacattatcatcctagcgctatgaaatttatcattgaacgagaacagctgctaaagccgctgcaacaagtcagcggccctttaggcggtcgcccaactttacctattttaggcaacctgttgcttaaggtgacggagaataccttatcgctaacaggtacagaccttgagatggagatgatggcaagagtgagtcttagccaatctcatgaaatcggtgcaacgactgttcctgcgcgtaagttttttgatatttggcgcggattacctgagggagcagaaatcagcgtagaattagacggtgatcgcttactcgttcgttcaggaagaagtcgtttttctttatcgacactccctgcgtctgatttcccgaatttagacgattggcaaagtgaggttgaatttactttgccacaagccactctaaaacgtttgattgaatccacacagttttcaatggcgcatcaagatgtgcgttactacctcaacggtatgttatttgaaacggaaaacacggaattgcgcacggttgctactgatggtcaccgtttagcggtctgtgccatggatattggacaatctttacccggacattctgttattgtgccacgtaaaggtgttattgaactgatgcgtttacttgatggcagtggtgagagtttattacagttacaaattggcagtaataatttacgcgctcatgtaggcgactttatttttacctcgaaactggttgatggtcgtttccctgactatcgccgcgtattaccgaaaaatccgactaaaacagttatcgcaggttgtgatatcctcaaacaagcgttctctcgtgcggcgattttatcgaatgaaaaattccgtggggtgcgtattaacctcactaatggacaattaaaaattaccgctaacaaccctgaacaagaagaagcagaagaaattgtcgatgttcagtatcagggggaagagatggagatcggttttaatgtgagctaccttcttgatgtgttaaacacactcaagtgtgaagaggtaaaattattactgactgatgctgtttcaagtgtacaggttgagaatgtggcaagtgcagccgcagcttatgttgttatgccgatgcgcttgtaa

SEQ ID NO: 3229 - DNA, 1356 bp, Proteus mirabilis
accatgcgttattatcaaaggctaataaagtcattatttattattaatatcttatttcattcgtcacagggggcggcaacacaacctaatcaagagcagcttaataaagagaaggtcgctcaattaggtcaacaactgtatcatcatttacagcaacagcagtggtatcaagcggaaaaactattagttaattatcagcaattaccattacacgaaactttattagtctattatgctcaagcactattagcacagaagaatggtaatttcttacaagctgaattttattatcagcagcaacttaagcagcaagcagattttattccggcacaaactggcctaattcagctctacttttctcaaggagaatataaaaaagcacaataccagctaaatcaattaagtcgtttatcgggattatcacctaccattaatcaagcaattatctattatcagaaacagcttaacgattattttaaagctaggcgtttttatcaaatcagttttttttatgatgataatattaatcatgcaccttatcttgatgagcaaattgtttcgcaatcaacgcaagtcatcatgaccagaaaaggcgctcaacctatagcatcgatgggggttagtcatcttttttctttctatcagcccacttttatttacgctaataataccctatcaggctatttttcagcacgctatcgtgattattttgcatataaacaagctaattttacacatttatatactcaattaagttatcagtaccaaaaaaaggattatcggtggactttatccccctattatgaaataaaatcacctaaaaaggcgtttgagtatcaatctattggggtatataccgggctatttttctccattaataaatatcattctattaatttatctataaattattatataaagaaatataataaagaattaataaacttaaataatcataagcagctatatgctattagctattactatatattagcagagaatgttcaattagttaatcaattaaactattatagtagtcgtaaaaaaaatactttattaaattatcagcaatatgatataaaaacgggtgtttattatttattaccaaaaaattggcaagtttctctttctttacaatatcaaattaaaagttttaataattataatccattattaaataagaaaagagaagataatggctttgtttttacaacaactattaaaaataaagcacctattatctgggggttttatccagcaatagaattaagttatacccgtagattaagcaatgtggattggttatatcaatatcagcagcatgaagtcttatttaaattagaaaaacaattttaa

SEQ ID NO: 3230 - DNA, 720 bp, Proteus mirabilis
gaaataagttataacatgggtaaaaaagtttttatttcatataaatatagtgatacagatgttgcttcttttaaagagctctctatggaatcatcagagccaactaaagtcagagattatgtgactaaattacaagaagtgattggtgaggaacatgtaaataaaggtgagaaggatgatgaaagtttagaagaatttaaagatgacaccatccaagggaagctagcagataaaatttttgatagcacagtaacaattgttttaatttcaccaaatatgaaggatactcttaaggcagaaaccgaacaatggattccatgggagatatcttattcattaaaggataaaagtagaaaagataaaagtggaaagattcaaaggagtccgatgaatgctgtattagcggtaattctaccagataaaaaaggaaattatgaatattatattaaagaaaatatttgttctaaatgtggctgtatcaatttaaaaactaatatgttatttgaaattctttctaaaaatatgtttaacattaaagagccaagttattcaaattgttcaaatcatgatgaaaactctgtttatataggtgatccttcttatattatttctgttaagtggtgtgatttcattaaaaatgttaattactatattgaacgaagccttgctattaaagacaaaaatgaaaattataatattgttaaaaaaccaattatataa

SEQ ID NO: 3231 - DNA, 750 bp, Proteus mirabilis
acggtactctacatgacatttattaaatctatttcgacctttatcagtctaataacacttttttgctcattttctttacacgctaatttcgaagagcaagataaaaaattatttgaagatacccgcaaagaagcactaaaccataatgcactcgctcaatatcagttagccgaaatgtatttattgggggatggcgtagaaaaaaacctgctaaatgcacagctgtgggcaaatgaagcaataaaaagtggctatgccgatgcctatgcgctccttgctgacatttacctctttaatgccgacccttattttaaaagctattatgtcgaagcaaaagagttagccaccactgccgttaataaaggaagcatgagaggaaaaatcagcttagcaaccgcgcttattgctcctttatctggtgaagtagattatcagcaagcgatggtattacttgaagaagccacacaagcgcatcaacaagaacttgtttatgcgcccatttggttaggtattttatatagtggtataggtaatattcctgtcgatatggaaaaaaccaataaattatttgcacaagccaatgaaatgacatttgaaggatttgctcaagcaatggcctcttttatgttctcaggtcaatatcatattatcgagcccaacaaacaaaaagcagatgcatttatgaaacaagcctgtgaagaagcgagaaaagttggcaatgaattttattgccaaccagaattaaattaa

SEQ ID NO: 3232 - DNA, 1236 bp, Proteus mirabilis
ctcttatctcttttcgtctctgccttaggagaaagcatgtctactcactctttctatcaacaaattaatcaacaactcgaacaaacacgtcaagatggcttatttaaaaatgagcggatcatcacttcttcgcaaagtgccgatattgcggttgctgatggtagtcatgttattaacttttgtgccaataactacttaggtttagctaaccacccacaacttattgcagcggcgaaagcgggaatggatagccacggttttggtatggcatcggtacgttttatctgcggaacgcaagatctacataaaacattagaaaagaacatcgctgaatttttgggtatggaagatgccattttgtactcctcttgttttgatgccaatggtgggttatttgaaacactgatgggatctgaagatgcaattatttctgatgcgctaaatcacgcatcgattattgatggtgttcgtttatgtaaagccaagcgttatcgctatgccaataacgatatggtggcgttacgtgctcaacttgaacaggccaaagcagataatgcccgccatattatgattgccaccgatggggtgttctctatggatggggtgattgctgatctaaaaagtatctgtgatttggctgacgaatatggcgcattagtgatggtggatgactcgcatgcggtgggttttgtcggcgcacaagggcgcggtactcatgagtattgtgatgtattagatcgcgtcgatatcatcacaggaacattaggtaaagctttaggtggcgcatcgggtggttataccgcagctcgtaaagaagtggtggagtggttacgtcaacgctctcgtccttatctattctcaaattctttagcccctgcgattgtgagcgcctctattgcggttttagatatgctgaaatcaggggatgaactgcgcgctcgtttatggcgtaacgcagcactttttcgtgaaaaaatgacggcagcaggttttactttggcgggggctgatcacgcgattattcctgtgatgttaggagatgccaaactagcgcaacaatttgcagcacgtttacttgatgaaggtatttatgtcactggctttttctacccagtagtaccacaagggcaagcacgtattcgtacacaaatgtcagcggcacacaccccagaacaaattgaacgtgctattgctgcatttattaaaatcggtaagcaacttaatgtgattgcataa

SEQ ID NO: 3233 - DNA, 195 bp, Proteus mirabilis
atcagtcgatattccgatacttatatatacctaatcaatgttagaatacccagcaataacttgacctgctggtttgaagagtctaatctcatagcggtttggcatactgttaaagtatgcttatataacaaaactcttatattacagatagataagggttttaaaagagaaattttggcgctctgggagccgtaa

SEQ ID NO: 3234 - DNA, 201 bp, Proteus mirabilis
cgttttaagtaccgatttttgtcgtcttttttagcaaacccgattatcaatccttacttatgcgcaacgctcgctcttatcgacaccctaaaaagggaagataaagggcgaattgttggtacaagcacgcagggtgcaagattatacggactcagggtgaaagcgcaaggatctttggtggatcatcatgcagataattga

SEQ ID NO: 3235 - DNA, 183 bp, Proteus mirabilis
ttacaggattttatttttataaaatttatacaatttgttattagttttattacgttattagatggggaattaacctgcttttttacgttaaaaagagactttttttttgtgtttttcattaacattgtattaagtaaaaatacacagttagataaaataaaatacaagctgagcgaaaaatag

SEQ ID NO: 3236 - DNA, 915 bp, Proteus mirabilis
gatcaggttcattgcctgataggtagtgtaaaatcgttttacccgtattgttattatgtattaataaaattaggaattcatcttatggatgaaacaaaatcgacaaagttgttaactaaacgtgtaattgttggcatagatcaaacaactgtgcaacacaaaggctcccttaaccaagcagagcaggactatattgcactcgaagttccagttgcattagtgtacaacggaatatctcacgttgttatgatggcaagccctaaaaatttagagttatttgctgtcggattttccttatctgaaggcattataggatcttctaacgaaattcgcagtattgaaatcgttgaaagttgccatggtggcacagaagtacaaatagaattatcaagtcggcgctttatgcaattaaaagagcgacgtcgtagtatggcggggcgcaccggatgcggtatttgtggtacagaacaattagcagaaatttttcgccctatagcgccattaccttttacacaaacattttcactctctttgcttgataacgcacttgagcaactaaaaaccgtacaggaaattggcgagctaacaggatgtactcatgccgcagcttggctatctcctgaggggcaattacaaggcggttgcgaagatgtcgggcgccatgtagcacttgataagttgattggcttaaaaacacaacaaaagtggacagagggtgcaatattagtatcaagtcgtgcaagttatgaaatggtgcaaaaatcagcaatgtgtggtgccgaaattttatttgcggtttccgctgctacctcactcgccgttgaagtggcgaatcaatataatttgacgctggtgggtttttgtcgccgtggaagagcaactgtttttactcatccacaacgactcactgattaa

SEQ ID NO: 3237 - DNA, 3729 bp, Proteus mirabilis
gtgaaatatcaaagcgtcatgttgataaatagggggaataaaatgaaaaaacagacacttaatatgattgttaaagtgatttatgccagttgcttattaggcgttacccattccacgcttgctaatgcaacagatgcgaatattgtcagctcgttaatagagcaagcaaattactggcatggaaaagcgcatgatgaacgtgctattgaagcgctacaaaaagtgctgatcatggaaaataataatcaagatgcgctgtatttaatggctttttttactgcgcaacaaggaaatgaaaaacaagccagctattggcgtgaaaaactggcacggattgcacctcaagatccgcgtattgcgggattaaaaaatattcgctcatctcaatttagtgaacagcaattgggttacgcgagagaattagcccaaaaagggcaacatgaagaggcaataaaagcctatcagcgcttatttgtcacacatgaaccacctgattcgctatcacttgaatattatcaaactatggctggaataccggcaatgttgccacaagcgattgctgggttaaaacaacgtgctcagcggatgccagataataaagaaacacaaaaagcattaggattaacattaacttataacgaagaaactcgtcgtgaagggattgctattttaagtaagatttctggtgatgaaacggcgaaaaatggattaagacaagccttactatggcttaatgtacgtcctgatgatgaagggctgtatcaatcttatctacaaactaatcctaacgataaagccattgcacagcattaccaaggagcaatacaaggtaatgcccgacaagcggggtatgaagcgttaaacgcaggtaacctaaagcaagcaacaacttactttaaacaagcattaacggtcgatagtcaagatgctcaagcgttagcaggattaggttatgtggctctacgttcaggtgatttggcaaccggacaaaagttattaaaccaagcctctcagtcagggggggaacaagggcaaaaatggaaacaacaagcagaggatgcgggtttttattctcaattacgagaagtgcaacgacaagctaagcaaggtaatactcagcaagcactggataaattatcacctttaacttactcatcgggtgaaaaaggattatcagcacatttattacaagcggatttattgcgcaaacaaggtaatttacctgcggcttatcagctattatctgaactatatcaacagcatagtcaaaatgaaaaagttatttccgcatattactacttgcttattcaacaaggaaaaaacagccaagctgagcagttagtagcaaaacaacccgcatctttacgacaaaaattaacggcaaatactgatccatcagaaagattacgtcgtgatgcgcaaaaggcgttagaaaatggtcatcgcactcaggcaagacaattattaactcaggcacaacgtaaaaacccgcaaaataattgggtataccttgatttagcccgtttaatgatagccgaaggtgataaaacgcaagcggaacagctcattttacaacttgaacgtcgtcaaacacgtgatgccaattatattgcggcgctcttttatgttgaacaaaaacagtgggataaagtttttaccctactgaacagtcaacctcaacaaaatgaggcggaaaaagcgttattagagagagcgcgtttttatcgtcaactgacacaagctgagcgttactataaaacgggcaatcttgttgcgatgcgcaatacgctgcgtcctttaatcaaccaagtggctgattatccaaatgatgtaggggaattagctgaaaaactggtaaatagtggtgcacaagatgaagcgctgcaattgattgaaaatgatctggctaaagggactaaaggctccgtgggaaattatgctgggcatatcaatgtgtttaatgcgttaggacgttatgcacaagcctcgagcttgattaatgatccagcattacagcaacaaacgccagcagccgagaaacaacgtttagctatactgacaaatgttgcgcaagcggatagtttacgggaaaaaggtgaaatcaaagccgcttatcaaactctcgtcacctcattaaaggtaagtcctgatgatccagacttattaatggctttaagtcgtgtgtatttagcgcaatctatgccagagcagtcaaataaaattctctcttaccttgaaaaacagcaaggaagcgatagcaaattacttcaagcacaaattgaagttgctctggcgcaaaaagacggtcgtaaagccaaaacactgttacaacaaataccgacatcttcacaacctgcttatctattacaagcagcacaagtagcgcaattaaacggtgaaaatcgtcaggcattggcgttattgcgtagcgcacaatggcaaacgacaaataacacaacaggtacggtgaataccgcagcagggcagttaatggcactagagagtgaaaatagtgtgatgactggctctataaatgaagataaacagatggttgctgttcaacgctccattcgtcaattagagcagcagatatctccttgggtacaaggtggtattgctattcgtcatcgtaatggtgataagggattatcaaatttgactgaaatatcggcaccgattgctatctcaagtgttcctggtgaagattggcgctggcaatttaatattaatcccgtttcaatcaccagcggtacggcttctggagagcgcgctaatcgctttggctcggggcaattgcagcatgctgaacgttttgcgaaaaacagtgataatcatgatgaaaagaacaaaataaacgcagatgatgcgggaagccagcgggcttcaggtgttgaattaggattgattttatctgatcacaatacacgttttgatgttggaacaacacctttgaataaagatagttccactattgttggtggactgacttactcaccaaaaattggccaaaatggacagttaacattaaccgcagagcgtagagcgattaaagatagcttactttcctatatgggacgtaccgatcctataacgggagaaacctggggacaggtcacgcgtaatggtgctaaagcgcaatatgcatgggatgatggcaaagtcggtgcttatattggtgggggatactataactaccaagggaaaagtgttgaaagtaatgaagaggtaaaagtttggcttggctcttatgcaaacttctacaaagatgagcaacaagaagtcaaagcaggtgttcatgtggactatatgaactttaaaaacaaccaaaattacttttcattagggcatggggggtacttcagcccacaagattatgtcgctgtctctttgcctgttgcttatacccgtcgttttgaaaaaggagaggtatcgctaaatggtgcgataggggtacagagttacaagcaaaaggggagtgattattttccaacccatgcttatatgcaaaatgcgttaaacaaacgtcatacgagtgactcacgtattaaatctcgttatgaagagcaagatgaaaccaatattacctatcgtttagggctcgatgctaaatattatttaaataaagagtcagaattagggctcagcttatctcatgatacatcgggtgattatgctgaagataatatgtggttatatctaaaatacaccccagactttttatctaaataa

SEQ ID NO: 3238 - DNA, 945 bp, Proteus mirabilis
tttctttgtcttaatcaaataattaataatatttggagagtaataatggctattgaccttagcaatcttgtcacggaaagtcgcaatcatcacagtgaacatattgatacactttcaacacttgaaatgctaaaagtcattaataatgaagataaaaaagtgccttttgcggttgaagccacattaccccatattgcacggctggtggataaggtcgtaacagcattttctcaaggtggtcgattaatttattgcggtgcaggtacttctggtcgtttgggaattttagatgccagtgaatgtcctccaacctatggaaccccccatgatatggtgattggcttaattgccgggggacacaaagccattttacaagcggttgaaaatgcagaagataatgtccaattgggggcggaagatttacgccagcttaattttaatgccaaggatgtgctagttgggattgcagccagtggtcgaacgccttatgtgattggcgcattagaatatgcacgctcactaggtgcggtgaccggggcaattagttgtaatcctgatagtcccatagcgcaacgtgccgatattgccattacgccgattgtggggcctgaagtggtaactggctcatcacgtatgaaagcaggcacggcacaaaaactggtattaaatatgataaccacaggtgccatgataaagatgggtaaagtatttggtaatttaatggtggatgttgaagccactaatgccaaattaattgagcgccaaattcgtattgtgatgcaagcgacagagtgtgaacgagctactgctgaacaagcactagcacaatgccaacgtcattgtaaaacagcgattttgatgattttagccggcgtaaatgcacaacaagcaacacagttgttggcgcaaaataaagggtttattagacaagctctagcaaaatga

SEQ ID NO: 3239 - DNA, 1308 bp, Proteus mirabilis
gctttcgtccagataagtgaatttgatagcatgttgttgcgtttatatcaggtacttctttaccttattcaacctctgatttggctacgtcttttattacgcagccgcaaagcacccgcctatcgcaaacggtggggtgagcgctatggcttttgtcgaggcaaagtcgcgcctcatggcattttattgcactccgtttcagtgggtgaaacacttgccgctgtacctcttgttcgtgcattacgccaccattatcccgatttacctattaccgtcaccaccatgacaccaacaggctcagagcgtgtacgctctgcatttggtgacgatgtgtaccatgtctaccttccttatgatttacccggctcggttaaccgttttcttacaacggttgatcctaaattggtgatcatcatggaaacagagctgtggccaaatcttatctcacagctttatcgtcgcaaaatcccattgattattgctaatgctcgcttatcagagcgctcagcagcgggttatcaaaaactaggtagttttgtcaaaacgatgctgagaaaaattaccttaattgctgcccaaaatcaggaagatggcgaacgttttattgctttagggctaaaacgctcacatctgcatattaccggtagcttaaagtttgatatctcggtcacccctgaactcgctgctaaagccgtggcattacgccgccagtgggcagcacatcgccctgtctggatagccaccagtacccatgaaggggaagaggcgattgtcttagatacccataaaaaattactggcacaatttcctcaactgttgctgattttagttccccgccatccagaacgttttgcaaaagcagagcaacttacccaagaggccggctttaaatataccctacgcagtagcgatgctattcccgatgcacaaacccaagtggtgataggcgatactatgggggagttaatgttgctatatggtattgctgatctggcctttgttggaggcagtttagtcgagcgtggtggacataacccattagaagccgcagcccatgctattccggtattaatgggcccttatacttttaattttaaaaatatctgtgccaagttagaccaagctgaagggctaattaccgtcactgatagtgactctatggcgacggctatcgcctcattactcaatgatgaagattatcgccgctattatggacaccatgccgttgaggtacttcatgagaatcaaggggcattattgcgcttattaaccttactctctccctatctgccaccacggagtcactga

SEQ ID NO: 3240 - DNA, 474 bp, Proteus mirabilis
gtaatgaaccaacatgatagcgatatattacagttaccttttgaaagcggttggcaagatctgacacaactattattttttcaaatagttagtgataacgatattacgcaggccgaaaataaattaagggatatcgggaaagatatcgctcaacgttacccattacctgatagcgaaaatatccagtcattagaatcacatatcaatcaagttttaacactgtttaagtggggctttgtgactatctctccagcaatgagtgagttgctattagtgcactgtgcatggccacatttttcagcaaatgaagaggaagctaattggcgtgcagcgagtgccagtgtattagaagggctatatgaaggctggcttactcatcaagggggaaatgataaaatgcatgtgcaccgtcaagctacagatgcaaaagatgcctttatttttcgttatgcgaatagttcatcaaataaataa

SEQ ID NO: 3241 - DNA, 762 bp, Proteus mirabilis
agtcattgccaaactaaacgatcacaaaccaacttcaataggtcaggcatcgcggatctccggtgtgacacctgcagctatctcaattttacttgtttggttaaaaaaacaaggtttattacgccggagtgcatcatgagtgacttacttaatcggttaaaaaagctggcaaagcaagccaatattgagttaactgatgttcaagctcaaaaattaaccgcttatgttgctatgctcgataaatggaataaagcatataatttgacctctgtcagagatcctcaacagatgcttattcgtcatatcttagacagcatagttgtgagtcaataccttgaaggaaacaactttatagatgtcggtacagggccaggattgcccggtattcctttagcaataatgcgtcccgatcaccactttgtgttacttgatagcttaggtaaacgcgttcgttttatgaagcaagttcagcatgaattagctctgcataatatcgagcctgtgcaatatcgagttgaagagtatcaagtagaaaaaccatttgatggagtgattagccgtgcttttgcgtcgatgaaagatatgctttcttggtgttcacatttagtcactgaagaacacgggcgtttttatgcattaaaagggcaaattcatcaagaagaacttgatgagctttctgaaaatggtttaaagatgcctgaaaaggtgattaatttagcgatccccgaattgaatgaacagcgtcatttggttgttttttaa

SEQ ID NO: 3242 - DNA, 951 bp, Proteus mirabilis
aggggtagccatatgattatcgtcactggcggtgcaggttttatcggcagcaatattgttaaagcattaaatgatgaaggttataccgatattttagtggttgataacctaaaagatggcacaaaatttgtgaatcttgtcgatcttaatatcgctgactatatggataaagaagactttattgccagtattgtagccggtgatgattttggtgatattgatgccgtattccatgaaggagcatgctcttctactaccgaatgggatggcaaatatatgatggataataactatcaatattctaaagagttactgcattattgcctcgatcgccaaattcctttcttatatgcttcttctgctgccacttatggtggccgtactgatcattttattgaagaaagaaaatatgaagccccacttaatgtgtatggctactctaaattcttgtttgatgaatatgtgcgccaaattttacctgaagcacaatctatggtgtgtggcttccgttattttaatgtgtatggcccccgtgaaggacataaaggcagtatggccagtgtcgccttccatttaaatacacaagtcaatgacgggcaaaatccaaaattatttgaaggtagtgaaaccttccaacgtgactttatttatgtgggtgatgtggctgcggttaatttatggttctggcgcaacaatgtctccggtatttataattgtggtaccggccgcgcagaatcgttccaagccgtggctgatgcagttatcgcttatcataacgataaagagctctctgtggagcatattgaattccctgagaaactcaaaggtcgctatcaagcctttacacaagctgatctgacaaatttacgcaaagcaggctacagcgccccttttaaaacggtcgcagaaggtgttgctctttatatgcaatggttaaatcaggataagtaa

SEQ ID NO: 3243 - DNA, 1722 bp, Proteus mirabilis
gcattcagccaattaaggtattcttcgcttgtctttatcaataaacttttaatcactatgctcggaagagatatgaaaaaattatcagggcgtatatatcttgcgcttgttcttattgcttcattatttattgtctttgagaaagcttctctaatttataccgcactactgtctgttagtgtttattttattatttttacgctgtgttttgttttatcgtcccgcgcgctattctcggcaatcacaacagggacactctttatcattatcaagtttatcaatcagcttaaagtccactattataaagagtcactgctattttcagattttaaccttgcttttgatagctcaaatttaggcaccttaacgcagtattgggaagccggtgtcgcgattattgccatggctatttggctaatcattaatatggttaccgcgtggcgtttctcccgtaaatcacctattgctacacgcctaagtagcttattactcattattattggccttacaactattcattttacagtgaataaatggcaatcggagtgggaaggtacgcttcccagtggtcgaggaactgtgactaatttaattatgtcgggttatcaaacggcttatcatcccccttactatgcacaaagtgcagactactttatcgagcaagccaaccgtgtggtcttaccggaaacacaaaccgaggtaaaacccgatattgttgtattactacaagaatctaccgtaaacccaagcatttaccaatttgataaaaacgtggatttgcccgatctttttatgtttaaaaaagatgaaggtgtcagtgcccaaagcccattacgagtacaaacctttggtggaggaacttggctttctgagttctcagtattaaccggtctaaataccgatgattttggtgcgcgtaaaaactctgtgttctattttgtggttgataaactcaatgaaagtttattccgccaactcaaatctcaagggtattacaccgtactgctcactccctttaatcgtaacgcctatcacgcgggatatgcttatgaaaaattaggggtagatgagattatccagccacaagaattgggttatccggggagtttagaagagaatttatggactatccctacccaagatatgattaattatctaaaagaaatcttaaaaacacatacagataagccattatttatcttttctttaactatgtatgagcatggcccttataaaggctcacatagtgatgattatcaattagctggtcagacagaaagccctgatgcaccgggtaaatttagccactatatggaaaaaattattgccagtgatccggctattgaagatttttctcactttgtcgcaaatagagagcgccccactctgtttctttattttggtgatcatcaacctaatattgacctaaaaaattatcaatcaccttttagtgatccagcacatattacccaattcaccttaagggataatttaacgcaaggtgcaaccctttctactggagaattaacggatattaattttttagggggaatgttgttagagcgcgctcgtttacctttatcaccttactataaagccaatattcaaatgcgccatttatgccaaggcaaattaaatgattgtgaggatgaaaaattagttaatagttataagaactatatttatgacaaattaaacgttgccggtggcaaagataattaa

SEQ ID NO: 3244 - DNA, 873 bp, Proteus mirabilis
gatgttctacattctccccattcgccgttaataatgatttcacatagtaggtctaaacatatgaataaatcggttgaagcagtaattttagattgggctggtacagtagtcgattttggctctttcgcccccacacaaatttttgtcgatgcctttgctcaagcctttaactttaaaataagtttatcagaagcacgagggccgatggggatgggtaaaatcgatcatattcgtgctttacttaacgagcctaatattcgtactcgctggacagcccaatttggtcacccaccaagtgaagaagaggcacagcatatttatcgcacctttatgccgttacaaattgcacaagtggtacattttgctaaaccgattgagggagcacttgaggctatctcgaccataagagcacaaggaattaaaatcggctcttgctcaggttatcctaaagccgtaatggatgtattagtaccgaaagccgctgaatatggttatcagcctgattgcgtggttgctagtgatgaaattgccgccggctctcgcccaggcccttggatggcgttaaagaatgtgattgaactgggtgtaatgagtgtagcacactgtgttaaagtcgatgatgcagtaacaggtattgccgaagggttaaatgccggtatgtggactgtcgggttatctgtttcaggcaatgagtttggtgccacctttgaacaatatcaaacaatggaacaggcagaaatagaaaaccgtaagcgcattgctgaaaataaactacgtaccgctggtgctcattatattattgatacccttgccaatttacctgcggtgatagaagatattaatcagaggatcgctaataatcaaaagccgtaa

SEQ ID NO: 3245 - DNA, 1314 bp, Proteus mirabilis
atggcgagtcttgatgtatatatgaatgaatactatgtgggcatctttactaaaaaaagctcaggtgcgcattcattccaatatactgaagattgggttaatcaaccaggaagtcgtcccatctctctttcgatgccattacagcttcaagaatatcaaggagactgtgtctataatttctttgataatctgttacctgataatactgaaattagaaatcgtattgtgagtcgctataatgcgaactcaaatcaaccctttgacctattagcggctattggtgcagatactgttggtgcattaaggttacttcctagtggcagtacgcctgcggatatcaaaaaaatagaatatcaaaaactcaatgatattgagcttgaaaaaattctactaggatataaatccaatactccactcggtatgcttaaagaatatactgatttcagaatttccatcgctggagcacaagaaaaaacagcattacttttaaaagataatcattggtgtgtgccacataataacacaccaactacccatattattaaactgccaattggtgttattgaaagtcattcttatacaatggatttatccaatagtgtagaaaatgagtatctttgtaccttaattgccaaagaatttgatcttcccgtcccccactgctctattattaaaacaaaaaatgttaaagcgcttgctgtagaacgttttgatagaaaatattcatctgataaatcgtggataatacgtttacctcaagaagatttttgccaaattttaaatataccttctgcgctaaaatatgaaaatgaaggagggcctggcattatcgatattatgaaatatttacttggctcatcaaatgccgatcaagatcgttttcattttatgaaggcacaagtgctattttggcttttggctgcaacggatggacacgcaaagaatttttctgtttttatcaaccaagaaggacgtttccatctcactcccctttatgacattatgtccatctatcccaatttcggaggacgaggacttaatccacgagatgcaaaacttgctatgggattaaaagcaagccgaggcaaaaaatacgcaatagaacaaatttttcctcgtcatttctaccaaacagctgaagctgtcggtttcgatccttcattaatgagcgatattcttcgttatttttatcaagaaatggacgatgtcatacaacgcgtaaaacagcaattacccgaggatttcccttctgagattagcaatacaatattagatggaatgaaagcacgcgctgttagattagctaacatttag

SEQ ID NO: 3246 - DNA, 483 bp, Proteus mirabilis
ccattgggtcttaactggaatttaaaggcttgtagacgtttcatattacctattatactttggtccatgaaaaatgaaactaatattcgccgtggcagacattgtgtattcctgatgcacgtccatttggtctttgtcacaaaataccggcgaaaaatatttgatcaggatgcaattgaaaaattgcgaggctactttgccagtgtttgtgctgattttgatgttgaactggttgaaatggatggggaacgggatcacgttcatttactgattaattacccgccaaaactggcgatatctaatctggttaacagccttaaaggggtatcgagtcgattacttcgacgtgatcgtcctgatattgcccaacgtgattactacaagggggttctttggtcgccaagttatttcgcggggagttgtggtggcgcaccaatatccattatccgccagtacattgagcaacaggaaacaccgagttag

SEQ ID NO: 3247 - DNA, 195 bp, Proteus mirabilis
gtatgtatgcaggggactataaagaaccttatcaagtcattgcttttgataaagcaggtaatcaatcactatttaaatcatacaattaatttttacactcatcatattgatgtaacaagaatatttctctcctattatattattcttattttattttctgcctgtactaaaacaggcagttttttattttactag

SEQ ID NO: 3248 - DNA, 723 bp, Proteus mirabilis
tatagaaagcaaattatggtaaaggtaactattattatgcaactaagcgaacaacgctcagcatcccaaaaaaatctttcttatattgttgctgaaaagctaggtaaacaaatactttctggatactacgaacctgaatctttattacctggtgagatagaactcgctgaactactttcagtcagtcgaactgttattcgtgaagcaataaaaatgcttgctggaaaaggtatgttactacctcggccaagaataggtactcgagttacgccaatgcaaaattggaatctattagataatgatttacttaattggtggatagatagcggtgaatttaataaggtgagtcattatttccatcatgttcgtttagcaatagaacctcaagcctgttatttagctgcattacatgcttcagagacacaaaaagagtcgctattatttctagctacagaaatgcagctactcaaagataactttaaccgtcagcattggttagatattgatacacaatttcactatctaatctatcaagccagtggcaatccattttttgcttcttttggttctctttttctatctgcctacaaaaaatattttgatttaattgttggcaatgaaacagtacagcctgaaactcataatcaaattgtacaagcgattatagaaggagatggaaatagagcgcgtgatctttgtttaatactattaataaatgactga

SEQ ID NO: 3249 - DNA, 1113 bp, Proteus mirabilis
ggctattttaatatgaaaatcctagttactggtgctgatggttttattggcaaaaatttatgtgttcggctagaagaaaataatttcgaactaataaaaatagatcgtgatagttctaaacatgatttagagctaggtctaataaatgcaaactttatctttcatttagctggagtgaatagacctaaaaatgaatatgagtttcatgaaggtaatgcatctttaactgaagaaattactcattttcttattaaaaataagaagaaaacaccaataatgctgagttcatcaattcaagcaaataatgataataaatatggtgagagtaagaaattagcagaaaaccatatagaagcatatggattaaaaactgatgcaagctattatatttataggttaccaaatgtttttggtaaatggtgtagaccaaattataactcatttattgcaaccttttgccataacatcgcaaataatattgatataataataaactccccgacagctaaagtttcactaatttatattgacgatctatgtaatgaattaatctctctattaaatggcaataataaggtaggctttcaaaatatttcacctgtttatgaaactactgtcggtgaagttgctgatttactttatacctttaaaaatagtcgcaatacattagttacagaaaaagtaggtgttggttttactcgagcactatattctacttggctaagttacctaaatcctcagcaatttgcttattctgttccgcattatggggatcaaagaggtattttctgtgaaatgcttaaaacacaaaatagtggccaattttctttctttactgctcatcctggtattactcgagggggacattatcaccatactaaaacagaaaaattcttagttattaaagggaaagctttatttaagtttgaaaatattattacaggtgaaaaatacgagctaactgtttcagacaacgagtataaaatcgtagaaacagtgccaggttggtctcatgatattacaaatattgctgatagtgaattagttgtgatgttatgggcaaatgaaatttttaataaagaacttccagatacaatagcgagacccttgtaa

SEQ ID NO: 3250 - DNA, 300 bp, Proteus mirabilis
gtattctttaatatgaaaataatacttcgcacttttatatttctatattttatttttttattaatattgattaatattctttccatatctgactatgaatggatgattggtgaaggtgatattgataatctttgtcaactgccactcaatggtagatatgttattgagcctatattgatattaataccttgtattttattactttttttagaaaaaaataaaaagctaagatggggttatgttacaatcactgttatgtatatcatatggtcattttatttacgttttaatttcttctga

SEQ ID NO: 3251 - DNA, 204 bp, Proteus mirabilis
ataaactttaaatgcataaaaaagataagaattaaatattttaatcttaataagatagtcattaaatgttatttaaatcaaaataagataattaataaattactttctttgtttgagtatttaaatacgagtcttattataatgaatgaaaaaacatataataaaaagtgtaagataattgttaaataccttacactttattaa

SEQ ID NO: 3252 - DNA, 1038 bp, Proteus mirabilis
aggaaacttttagtgattaattttaacggtaaaactttactaataactggtggtacaggctcttttggtaatgctgttttaaatcgttttttagaaacagatataaaagaagttcgcatattttcccgtgatgaaaaaaaacaagatgatatgcgtaaaaaatataataatcacaaattgaaattttatattggtgatgttcgtgattattcaagtattttaaatgcaacccgtggtgttgattttatttttcatgctgcagcacttaaacaagtaccttcatgtgaatttcatccaatacaagccgttaaaacaaacattttaggtacagaaaatgttttagaagctgctattgctaatagtgtaaaaagagtcgtttgtttaagtacagataaagcagtgtatccgatcaacgcaatgggcatatccaaagcaatgatggaaaaagtcatggttgctaaatctcgtaatttagatagcaataaaaccgttatatgtggaacacgttatggtaatgtaatggcttcgcgaggctctgttattcctttatttgttgacttaatgagagaaggaaaagcaattacaattacagaccctaatatgactcgctttatgatgacattagaggatgctgttgaccttgtattatatgctttccaaaacggaaataatggtgatatttttgttcaaaaagcccctgcagcaacaattgaaacattagctatcgcattaaaagaactattaaatgcaccagaacatccaataaatattattggcacacgccacggtgaaaaactttatgaagctcttttaagtagagaagaaatgttagcagctattgatatgggtgattattaccgtgtcccaccagatttacgagatcttaattatgataaatatgttgaacaaggtgattctcgtatttctgaaattgaggattataactcacataatacgactagattagatgtagatgaaatgaaaaagctattattaaaattacctttaatacaaaaattacataccaataaaatttaa

SEQ ID NO: 3253 - DNA, 1188 bp, Proteus mirabilis
gttaatattaaaggtttatgtatgaaaatcaccatctcaggaaccggctatgtcggtctatctaacggaatactcctttcccagcacaacaaagttgttgcattagatatcaataaagaaaaagtcgaattattaaacaaaaaaatctctcctatctctgataaagaaatcgaagagtttttagccactaaagagctcgactttacagcaactttagataaagaattcgcttataaagatgctgaattcgttatcattgccactcctaccgattatgatcctaaaactaactactttaacacctcttctgtagagtcggttattcgtgatgttttagaatataatccaaacactactatgattataaaatcaaccattccggttggttttactaaacagatgagagaaaaatatcataccgataatattatcttctctcctgagttcttacgtgaaggtcgcgccctttacgataacctctatccatctcgtattgtgattggtgagcaatctgcaagagcagagaaatttgctgaccttttacaacaaggggcattaaaaaaagatattgatgttctttttactgattccacagaagcagaagcaatcaaactatttgccaatacttatctcgcactgcgtgtggcttattttaatgaactcgatagctacgcccaagcttacggtctaaacgcaagacaaattattgaaggtgtttgtttagatccgcgtattggtaatcactataataacccctcatttggttatggcggttactgcttaccaaaagatacgaaacaactgttagccaactacgaatcagtacctaataatattattggtgccattgtggaagctaaccgcacccgtaaagactttattgctgattctattatcgctaaatcaccaaagattgttggtgtttatcgtttaattatgaaatcaggctctgataatttccgctcatcttcaatccaaggcattatgaagcgtataaaagcaaaagggattgaagtagtgatttatgagccagaaatgaaagaagagactttctttaactcgaaattaattcatgatttagataagtttaaagccatgtctgatgtcattattaccaatagaatggcttcagcactaaacgatgttgaagaaaaagtttatactcgagacctctttggtaacgattaa

SEQ ID NO: 3254 - DNA, 1119 bp, Proteus mirabilis
acggatattaactttgtgaatcaacgacatatactttttattattgatggattaccaggtggtggcgctgaaaatgtcacgctcaggctggctaatggttttcatcagcaaggatatcaggtcactcttttatccttacataataaattggcgtatgaattacctgattttattgactatattgttgatcatgatgaataccgaggtatctttagaaaactaacagagatatctcgcagagcaaaatctcttgataaggtattaacgcgactttttgcacaaaaaggtcgtcctgcattggtactttctaatttacataagacagaccgtattgtttgtcgagcgaaacaactaagacattgtaatgtttggtactgtattcatgggatctattcacaatcttatcttggtaataaatcgggtttctcttattggttaaaaaagaagaaaattcagcgagtttataaagataaaaaccttgtttgtgtttctaatgcggtaaaagacgatttaatacatgctattggcgtcgatgcacagcaattaaaaacaatttataacccatttaatattatggagatccaacataaagcctcacaacctaacccgtttgcagggaaagcgtatattttgcatgttgggcgattccatgaagttaaacgacaagatagattgataaatgctttcgctaaagccaatataccttgtcaacttattctattaggggaaggtactcccgttattaagcaacaattacagcagcaaattgcccaactcaatttaaatgaaaaagtcatattagcgggttttatcgctaatccactccctatcattcaaggtgctaaagttgttgcactcagctctgacagtgaaggattaccaaccgtactaatcgaagctcttatctgtggaacgcccattgtaagcactcgttgccctggtggcgtaagtgaaattatgacagacgaactgactaactatctttcagatatggatgcagactcactcgcagataaactacgtctcgcttattacgcaccacctcaaatattgccatcatcttatgcaaaatttgaaataaaccatattttaaagcagtatatcgctttaattccgtaa

SEQ ID NO: 3255 - DNA, 1404 bp, Proteus mirabilis
ttaggtattaacatgacacatgatacgcgttcactttacagtcaactgtcatcgatagacagtttgctccatcaggttgacattcaaactttagttgatggttatgggcagacctttatcgttgaacatttacgcaaactacaagaagaagcgcgtatcattattcgacaaaataatcagttaccgcaatggcatgataattgggcggaagaattaaaaaatcgtattgcattacaacgaaaagccgccataaaaccggtttttaatttaacagggacggtattacacaccaatttaggtcgtgcgttaatggcagagtcagcgattgaagcggtaagccaagtcatgcgctctccggcaacattagaatactcccttgatggtgcttctcgaggacatcgtgatcgagccattgccgatctgttatgtgaattaactggcgccgaagatgcttgtattgttaataataatgcagctgccgttttattaatgctggccaccgtcgcaccagataaagaagtggttgtttctcgtggcgaattagttgaaatcggcggtgcttttcgtattcctgatgtgatgtgccaagcgggatgtcgtttaaaagaggtgggaaccactaaccgtacccatctaaaagattaccgtaacgcgattaacgaaaatactgggttgctaatgaaagttcataccagcaactacagcattcaaggctttaccgctgaagttgaaggtgcacaacttgctgcgctgggtaaagagatgaatttacccaccgccatagacttaggcagtggctctatgaccaatttggctgcactgggtttacctagcgagccgatgccacaggactatttgcaacagggtatagatttagtcactttttcaggagataaactattaggtggcccacaagcaggaattattctaggtaaaaaagcgtggatagaagccatccaacatcaccctctaaaacgagcgttacgtgtcgataaaatgacattggcagcattagatgccaccttaagactttatcaacaacctgaaaaaatgatcaaggatatcccgacattacgtttactcactcgtacacaaaccgaaattcatgatatggcgcaacggttacttcctcattttcaggcatattatggcgataactaccatatcacaatatcctcatgtgcttcgcaaataggaagtggctcgttaccgattgaaagcttacccagtgcagcccttacctttgctgccaaagatgggaaaggaagtcaattagatgcccttgcggcacattggcgtaacctagaaaaacctattatcggccgtattacggatggtcgcttatggctcgacctacgttgtcttgaggatgaaaatgcattaatacaggctctatcactatga

SEQ ID NO: 3256 - DNA, 1890 bp, Proteus mirabilis
aaatgcattaatacaggctctatcactatgatttttgcgacagccggtcacgtagaccacggaaaaacaacattaatacaagcgatcaccggtgtagatacaactcacttacctgaagaaaaaaaacgcggtatgaccatcgatttaggttatgcctattggccacaaaccgatggatcagtcattggttttgtcgatgtccccggtcatgaaaagtttctttctaatatgttggccggtattgggggaatttctcacgccttattaattgtcgcttgtgatgacggtgtgatggcacaaactattgaacatacagctatcttacgtcttgccggttgtcctaacatcaccgtgatcctcaccaaagcagatcgtgtagagccaccacgtattgatgaagttaaacagcagataaccacacacttacttaatctaggttggtcagcaccacaaatctttgttacttctgcctcaacgggtgcgggtatcgcaccattacgagactatttagttaccctacatcagcaagagcaacaacaccctcaatggcataagcgttttcgcttagcgattgatcgtgtatttagtattaaaggtgcgggtttggtggtcacaggtactgcacttgccgggcaaattgcgctaggtgatactttttggctaaccggtgcagacaaaccggtaagaattagggcattacatgcgcaaaatcagccagtagaacaagctggtgcaggtatgcgcattgcgataaatattagtggtgatgtcagtaaagaaacggtttctcgtggtgattggttactatcacaagcaccactttatccttcacacaaaatattagtcagtctaatagctgatgaacctattaaacattggcaaccggttcatattcatcatggtacacgccatattacaggacgtattgcactattaaataataccgatgaaacaccgctattagcagagcttattcttgatgaacccttgtggctggtggataacgatagactgattttacgcgatatcagtgcacaacgaactttagcggcggccaaagtgctctgtttacactctcctcgtcggggtaagcgacaagctgaatttttatcttggctaagtgcacttgataaagccaacacggtgagtgataacctcgcactctatttacccaaaggtgaattgttattgacacaatttgcttgggcacagcaattgacggaaactgcacttgatacgctattaaccacctttgatgttatttctatttccggcgtcgtcatttcgaaagccaatgctgaacaggccaaagcaaaactattacgcacactagaagaatatcaccagcaacataacgatcaagtgggtgtggggcgttcccgtttaaaacgtatggctcttcccacttatcacgatgagctggtttatcacttaattgatcagttacgccaagaaggcgctattaagcaaactcgaggctggctacatctaccaacacatgggttagccttctcagcagagcaagaggcactatggcagattgccaaaaactattttcaacaatcagagccttggtgggttcgtgatctcgcccatgaaatgaaaaatgatgaaaaagtcatacgaagcttattacgcaaagccgctcaactaggtcttattatccccattattgccgatcgctattatactcatgattcgatagaaaaatttgccgctatcatcgtaaaatataacgaaactaacggcagtgtaaccgcagccgattttcgtgatgaactggccgtaggtcgcaaacttgccgtacaaattcttgagtattttgaccgaacagggttcactcgacgtaaaaaagatcttcatatcttacgagataaagggttattctaa

SEQ ID NO: 3257 - DNA, 2112 bp, Proteus mirabilis
gctgaaattaaaaaaaaagagataaattcagattgtgctgattttttagagatatatcctaaatcagatattacctatcacccaaataacaactctattgatatcactattaatgatgattacttcgatcaaagtgcctatggtaatgaattaacctatggtggcttaggggtattcaacaactatagaatctatggtatgaagttaaatggctctaataataggaatttttatcaaggtgattttaaaacaggtataaatttttataattggattttacgtaataacagtagcttttcttcaggtgatgggaaaacttactatagatttaatgaaacaacgctttcacgtacaatagaacgcatcaaagccattttacaattaggccaaattacatctaatagtgagttattagatagtgctgatgtgaatggttttcaattatattcagatagtagctatcaaaacagtaagttgacagttcctattactgggatgtctgaaaaaccggctaccgttgaagtcacacaaaataatcgattgttatatagaacgataatacctgcaggccctttccaattaaataacattagtggtgtatcatcaagtcaaccattacatgtcaaagttattcaagatgatggtactattcaagaatttgatgttattacatcaaataaagacttaaaaaatccacagagtagtaccagctttaacttttttatggggaaatatagaaaaaactcaagtgatgaacgcatacatactccttttattaccggttttgaaggtggcattaattatttaaatcataattttctagggggtatggaaatatcatcaaaatataagtccattgtaggtagcgtaaatagcgtttttggtgaacatcgtcctttatctactggctttggtattaaatatgcatcttcttctaataaaggtgatggcttccaagcaaatgctaatttaagtttacctgtatcagtattctcactaggcttatcaacaatatatcgttcacgtaactattcgacactctatgaatctctacaaatagataatatagaagacccattagatgataatcttgctaataatcagacaaaaacatcaagctcattatctctaagcttaggaaatcaacgttatggatcactgagttatagccttagctatagccaatattatggtgataaaaaagacaattattcaaataccatttcttatggaaaaagatttccatttatgtcttttaatattagctatcaaaaaagtagtaattttgaagatcgtacatttgtaaacatcaacgtacctattaataattcatcatcatttagtactcaataccaacattataaaacatcatctttaacaacaaattatagtaattatcataatgatttatttagatattctatcggggcaactgctgataaagacagtaaagataagaatattagcggtaatatcaatgcaacaaccgcttacagccaaattagtgcgacaggctcctttagtaatagtaatcaaaaatcggcgatgctgacagcatctggtgctattgcttatagtgatggattatttgctacttctcctgtggagttaggagatactttcggtattttacgtgttccaggacaatctggtattttagttaactctatgggtggtggtacgacaataactaatcactttggtaccgccgttattcctaacttacctgtaaataaaaaaacaactgttctattaaatactaaaaatttaccactcaatgttatgttaggcacaacatcctttgatattgcattggcaaaaggtactgttttttctcgtgagatccctgtcaatacaatgaagcaagttttattagaaataaaaaaaccagatggtaaacctgttaatacagcaaatagtgttattgatgataagggaaatctaataggtgttattatgggggacggtaatgttataataagtaatgagcaaatcggtaagccactaaaagtaaaatcagataatggtgacatctgttctgttgattattcagttccagaagaatttaatccagactttttatatgaaaaagttgatgcaatttgtaagtaa

SEQ ID NO: 3258 - DNA, 831 bp, Proteus mirabilis
tacaaggataaaataggagttttatttatgttggcactttctgtcagacagccacttaatatttattattggctcattgcgatatcattagtttatatcagtttattgagttgggtacttaattcatggtctatgacagaaagtgcgcatcatattgatcagcaacagcaaaatacattatcggtctatcaggtgatgttttcgccacctaaacaatctactaccatgattgaaccgagaataaagatcgagtcacaacaaccacctattgcactaccaagaagtgagaacggtgaatttattgaagcgcccaaacaacccgcaaaaaagcgtcaacaacaaccggccccaataacacctaaagcgataaaacaggtaaaaaaacagccagtagtagacaaaacagtacctataaaactacctgatttaacaaatcacaacatagttcaaagtacatcacaaccatcagcagaaaacttaacacagcataccgcgagttcattggcagggagcagtcgtgcattaagtgaaaatggtattgggcagggagagtctgaaaatcactatatcagtttattgcgccgagaaattgagcgtcataagcgctatcctgcgcaagctcgtcgtatgcaagatgaagggctggttgttgtgcgtttttcattaaccgatgaaggctatatttcatccgttgtacttgagcagacctcaggggtggcatctcttgataatgctgcacttgccgcggtaaaacgggtaaaaccaattggcccgaaacctaataacttatctgatcctttaactatctcgttaaaatttcaattaaattga

SEQ ID NO: 3259 - DNA, 1095 bp, Proteus mirabilis
aaaagcggtaactctataggttttatttctagagcgccgctttctctttttcactactttctccaatgtttctcacagtccactaataaactttgcaattgtagtttatggctatttaggtcaaaaaggaggctaacccataaaaatgtaacgaggagtatcgcgatgacaacaacacaatctactgattacaatattattgtcatgtcagatccacaaccttggcgtctagatctagataataatgaccccaataatgatcaatcccgttgggaaaccaccgtaaaaagcgttagagacagtattcaagcattacaccgtgaaaaatcttttgcttttggcattataaatggtgacttaacagaatttggccgtcgctcccaacgtgagagttttcgtgcactgtttgccccttcacctttaggatttaatacctatgttggacttggtaatcacgattatcaaaacaatgtgggtgactgtgcagagccgagtaatgccgattacagtatgaatgcctgtgcaagaggcatggtttttgatatgcactaccgtattgaagagtatcgtaattatgcaacttcaggtaattttagatacgatagtagcgaatattcaggtagtaaggcttactcttgggaatatggtgatattcattttgtgcaattacaaaactatcccacttatcatgtggtgctcgatcactggtcagcttcaactattaatgtcacagattctattgattggttagaaaaagatttaattcaggcgcgaaatagcaataaaaccatcatattaaacttccatgatggaaaccaacacttcccagaaaaatcatctcaagaagagctgaccttctttaaatatatgctagaacattacggggtaaaggcggtatttgttgggcatacccattatgttggtcaagataaccgttatggtggcagtgagatcttcggcgatgtcccagtttataatagtggtgcgctatttaaaggagattatttagccgtagaaatccgtggtactgaactatctatcactgtttataacggcttatcaggtacacctcaattaatagaaaaatggaattaa

SEQ ID NO: 3260 - DNA, 1152 bp, Proteus mirabilis
gaatgtggcaagtgcagccgcagcttatgttgttatgccgatgcgcttgtaatcacgattaatatgattttatcccgtttattgatccgccattttagaaatattgaacaggctgatttgccattagcggatggttttaattttcttgtaggaccaaacgggagtgggaaaaccagtatacttgaagcgatttacacattaggccatggacgggcatttcgtagtgcccaagcgaatcgagtgatccagcatgatgaaaatgcgtttattttacatgggcgtttaagtggccttgatgaagaaagtcgcggttactcgattggtttaagtaaagatcgcgagggtaacagtacggtacgtattgatggtagcgatgggcataaaattgcagagttagcgaagttattaccgatgcaattaatcacccctgaggggttcacattacttaatggtgggcctaaatatcgtcgtgcttttatcgattggggttgttttcataatgagcctcgattttttgttgcatggtcagatttaaaacgcgtcttaaaacagcgtaatgcagcactcaggcaagcgtcgtcttatcgacaactcttaccttgggataaagagcttatcttactgacagaacagataagccaatggcgagctgaatatacagaagatatcgccaaagatattgaagaaacgtgccaattatttctccctgaatttaccttgaaagtcagttttcaacgaggatgggataaagaaaccgattatgcacagttgctagaacgtcaatttgaacgtgacaaagtgttatcatatacctcgttaggtgctcataaagcggatttacgtattcgtgctaacggcactccggtagaagatatgttgtcacggggtcagcttaagttgttaatgtgtgcattaaggctggcacaaggtgaatatttcactcgtaagaatgggcaaagatgcctgtatctgctcgatgattttgcttctgaattagacgcaaatcggcgccagttgttagccgagcgtttaaagtctacgcaagctcaagtgtttgtcagtgcaatcacttctgggcaagttaaagatatgctagatgtaaatagcaggctatttagcgtagaacatggcaaaatagaggttaaaccatag

SEQ ID NO: 3261 - DNA, 720 bp, Proteus mirabilis
agtgcattaaaaaggtatatatgtatcgaattaagatatatatatacttccactggaggatgtatgtttaaaaaaagtttattagctgtttctttacttgctctaacaagtagtgttgcctttgctgctacacctactgctaaactaaaagttatcggtactattcaagcccctacttgtacagttaatggggaaacaagtgagactactgttgaatataaattcgatgttagcccaggccttttcccagcaaaaggtaatctaacattagaaccaatttcacacaacattactgttacttgtgatgctagaacctatttagcttttgttcctacagatgatagagcaggttcagaattagaagcaaatgcggctaactttggtttaggtacacaccacgaaacaaacaaagagggtgaagctgtagatactaaagtaggtttctatggtattaccatgaaaaatgcgacagtaaaaccaactgctgatgcagaagaagctaaagtttctgtattctacaatggtgctgtaaacagttctcaaagtcttcaaaaagaaaaagtgtttgcgtgggctaaaagctctagcgatttctctgccggtgaagtatttgcagctgatttcgaaatcaaaccaactatcaatagtgaactaaaaaatagcggaggtgaacctaaattagatggtttagcaactcttgctttccaatttggtatctaa

SEQ ID NO: 3262 - DNA, 471 bp, Proteus mirabilis
ataatgttaaacaaagaagaaaatttagaaaaagaatctaaaacaacacctctaaatgttgaatctaaagctgtacaaacacatttaggatttttacaagatattatttcaagattatctgataaaagctcaacatgtaaaaattggtgtattacattaacttcagcttttattttgttatcactaagattagaaaatggtagcaaatacatactgctatcatatataccgacactcctatttgcattattaaatacgtactatgtctacttagaaaaatcaataagaaaccaatataatacgtttgtcagtaaattacataacaaccaattgactacctctgatatttatacaatcaaagttaattttgaagaaaaatgcaattgcaaacaatggaaattatcaattaaatcgttctcgattcttattttttatttgccgttatggatcattaatgtagttataacatag

SEQ ID NO: 3263 - DNA, 1257 bp, Proteus mirabilis
cttgtggtaaaattatggacatttatttatgcaattaggcatttcatcatgactacacttcacgacaaaaatattattctgggtatcagtggtggtattgcggcctataaagcgcctgagctagtccgtcgtttacgtgataaaggcgctattgtgcgcgtcgttatgacgcctgcagcacatgcctttgtcaccccgttatcgctacaagcggtatcaggcttccctgttgcggatgatttacttgatcctgccgcagaagccgcaatgggacatatcgaactaggaaaatgggctgatctgattttattagcccctgctaccgcggatttgattgctcgtttacgcatggggatggcaaacgatctgttaaccacactctgtttagccagtgcagcacctattgcgattgccccagcgatgaatcaacaaatgtatcgtgcgacgattacacaagaaaatttaacggctttggcacaacgaggttgtcttatctgggggcctgactctggtagccaagcctgtggtgatgttggacccggtagaatgttagatcctcttgaattggtggcattagcagagcaacaatttgcaattcaacacgattttaaaggtaaaaaaattaccattaccgcaggcccaacacgtgaagccttagatccagtacgctttatcagcaaccatagctcaggaaaaatgggctttgctattgcgcaagcggccgctcaacggggagcagaagtgacactcattgccggccctgtcacattgccgacacctgcttgtgttaaacgtatcgacgtcgaaagtgcccaagagatgtatcaacaagtgatggatattgcgcaatcccaagatatttttattggttgtgctgccgttgccgattatcgagccaaacaggttgcccctgaaaaaattaaaaaacaaggtgatgaagtaacgataactatgataaaaaaccccgatattgttgccagtgtcggaaaaatggttgagcatcgcccatttgttgtcggatttgcagccgaaacccagaatgtggaagaatatgcccgccgtaaacgagaacaaaaacaactcgatttaatctgtgctaatgatgtatcactaaaagatgctggttttaatagtgataacaacgcattacaccttatctgggcaaatggagaaacgcgtttaccacatagtagtaaaacgcaactgagtcatcgcctacttgacgagatagccaaacattatgatgaaaaaaattga

SEQ ID NO: 3264 - DNA, 669 bp, Proteus mirabilis
ggaggagcaaaaatgatgaagaagaaaggtgataaaattcttcgccataccgcatcagagcgaattaatcactgggttgttgtgattgtatttctattcacagccatcagtggtttgggtttcttcttcccatctctgaactggtttatgaacattttaggtacgcctcaactgtcacgtttacttcacccatttgtggggagtgcgatggcgattttgtttatctttatgttcttcagatacctgaagtacaactttattgataaagatgacttagtttgggctaaaaatattcataaagtgctaaaaaatgaagaagcaggtgatattggtcactataacttaggtcagaaaggcatttactgggcattatctatcagtttgatcctgctgacggtcagtggcatcatcatttggcgtccttattttgctgaatatttctccattccggtgattcgtattgcattgctggtgcactcatttgccgcaatcttactgattattaccgttatcgttcacgcttatgcagcgttttgggtgaaaggctcaattcgtagcatggttgaaggttgggtgactcgcggttgggcgaaaaaacaccatcctcgctggtatcgtgaagtactggaagaagagaaaaaagaagccgaaaagcagtcacagaaataa

SEQ ID NO: 3265 - DNA, 1245 bp, Proteus mirabilis
ctacgtaaaaagagttgtttggaaagaatactaatgagattagctctcatcattgatgattatttgcctcatagtactcgcgttggggcaaaaatgtttcatgaattagcattagagttacaatcactcgggcataatataaccgttattacaccagcagaaaatcaacaatatagtttatatgttgataatttagatggtattactgtttggcgttttaaaaatggtcctattaaaaatgtcaaaagaatatctagagcaataaatgaaaccttactttcttataatgcttggaaggcaatcaaacatttagttaataaagattcttttgatggaatcatttactactccccttctatattttggggaaaattagttaataatctaaagaaaaaatgtcaatgtccttcctatttaatattaagagacttatttccccaatgggttgttgatgcaggaatgttaaaatcaggctcattaattgaaaaatatttccgtttttttgaacaatactcatataaacaagcatcgataattggtttaatgtcgaaaaaaaacttagatttcttttatacacataaaaataataagtactataaatgtgaaatattaaggaattgggcaaatacttcagaaatatcgataaaaaaagaaggatatacttcaatacgtacttccttaaatttacaaaataaaactattttcttttatggtggaaatataggccatgcacaagatatggaaaacttgatgcgcttagtgaagaaaatgagcatttatcctgatgctcattttctttttatcggtcaaggcgatgaagttgatttaattaattcattagctaacaaatggaatttgagcaactttagttacttaccttctgtgaatcaaaacgaatttaaactcattttaaaagaaatcgatattggtttattttcacttgccgcacaccattcagctcacaattttccaggaaaattactgggatatatggctaaccatattcctattttaggtagtgttaatgtaggaaatgatttattagacctaataaatcatgaaaatgcaggttttgttcatataaatggtgaagacgatgatttatttgaatctgctaaaaagctctatcttgatataacattacgcaaaaaatgtggccatgatgcttataaactattgtgtaaagagtttgcagtgacctctatagcatcaacactcatagatagattaaggttattaaaatga

SEQ ID NO: 3266 - DNA, 1158 bp, Proteus mirabilis
tgcagcaaaaaggtacttaagctaatgaatgcccctttacgattagccattgttagacaaaaataccgtccagatggcggtgctgagcgctttatcgcacgtgcacttgatgccttatctagtgatgcactagaacttaacgtcattactcgacaatggcagggtgatacccatcctgattggcatatacatctatgcaaccccaaaaaatatggtcgtattagtcgggagtctggttttgctaaagcggctagagcatgctggcaagaaaaccactttgatattgtacaaagccatgagcgtatcgcgggatgtgatatttttcgtgcaggtgatggcgtacatcgtcgttggttattacaacgacagaaaatattacctcgttggaaaggacgttggttattttatgataggtaccaccgttatgtgatgaatgcagaacaacagatgtatgctgatccagcgttaaagcaagtcatttgtaactcacagatggtgaaaaaggaaattattgcggattttggcctctctgccgataaaatatctgttatttataatgcaattgaccataatgtttttgtaccagcaacaaattctcaaaaacagcgcttaaaaacacagtataatatccctcaagataagccttgttttatttatgtaggatcgggatttgaacgaaaagggttagctgcagctatttcagccattgccaatacatcgtcaatcttacttgtcgtaggtagtgataaaaatcagcgaaaatatgaacaacttgcaacacaattaggctgtagacagcgtatcttctttttgggtatgcaaaaaaagacgctcgacttttatcaaatagccgatgccttattactaccaacgctttacgatccgtttcccaatgttattcttgaggcgttatcatgtggtttgcctgtgatcacttcaaccagttgtggtggtgcagaatttattcaaaatggtaaaaatgggtttgtttgtgatgcgttagatattcctgcattaacagaggcaattgtgcaaattccaacaaactcagcatggtctgaaatgtcgcaagtggcgcgagaaactatcctcccctatacaccgaagcgattatcagacgagcttatttcactttataaacggatattaactttgtga

SEQ ID NO: 3267 - DNA, 996 bp, Proteus mirabilis
aaaatggaaaaatcattcattcagactcaacaacaaattagctttgttaaatcatatttttcacgtttattagaaaaagaattaggcctgattgaagttcaaggaccgatcttaagtcgccttggtgatggaactcaagataacttatctggtcatgagaaggccgtacaggttaaagtgaaatctttacctgattctacctttgaagttgtccattcattagcaaaatggaaacgtaaaacattaggtcgttttggatttagttctggtcaaggtctttatacacatatgaaagccttgagaccagatgaagatcgcttaacgccaatccattctgtctatgttgatcagtgggattgggaaaaagtgatggaaggtgaggagcgtacactaccttaccttaagcagacagtgggtaaaatctatcaggctataaaagaaactgaaaaagccgtcagcgatgaatttggtctgacaccgttcctgccagatcaaattcaatttattcacactgaagaactgttacgccgctaccctgatcttgatgctaaaggtcgtgaaaaagcgatagctaaagaatatggtgctgttttcttaatcggtattggtggaaaactatcaagtggcgaagctcatgatgtaagagcgccagattatgatgactggacaacacctaacgaagatggctttgcagggttgaacggcgatattttagtttggaacccagtattgcaagatgcttttgaagtgtcgtcaatgagtatccgcgttgatccagagacattaatgcgtcagctaactttaactgatgatactcaacgtcttgagttagattggcacaaagcattaatgcatggcgatatgccacaaacaattggtggcggtataggtcaatcacgtttagtcatgctacttttgcaaaaagagcatattggacaagtacaatgtggcgtttggcaacaagacacccgtttagcttttgcggatatgctgtaa

SEQ ID NO: 3268 - DNA, 978 bp, Proteus mirabilis
ccgtttatgaacccattaacgacattacgtgttgcaagcgtacaactacaacataaggctaatgataaagattataatttagccaaaatacatcagtttattgagatggctgccagtgaaaaagtgaatcttctagtatttcctgaaatgtgtatcacgggatactggcatgtccctaaattaccggcgcaacaggtttatgcattaagtgaaaaactggctgatagcgcatcattaaaatccattaaacaaaaagcacaacagtatgcaatggctattggtgttggattaattgaacgggataacaataataatttgtataatacttgggttgtttgtatgcctgatggttcattacaaaaacatcgtaaattgcatgcatttgaacatccggttatttgtagcggagatcaatacaccgtatttgataccccatgggggattaaaatgggtattttaatttgctgggataataatttagttgagaacgcacgggcgacggcgttattaggggcagatattttattggctcctcatcaaactggcggaacccactctcgtagtccacacagcatgaaacctattccaatggcgttgtgggaaaatcgtcagcaagatccacaagcgttacaagctgcttttcaaggtgaacatggcaaaggatggctaatgcgctggttacctgctagagctcacgataatggtatgtttatcatcttcagtaatggggttgggcgtgatgaagaagaggtgagaacgggtaatgcgatggttatcgatccttatggacgtattgtaaaagaaagctgtgcgatagaagacgatatggtcgtcacggatattgatttaacgcttttgcctgaatcaacagggagacgctggttaacgggcagaagaccagagctatatcagatcctcaccactcgacaaggtaatgaacaagatccgatttccgttcgttttggtaacaaggactaa

SEQ ID NO: 3269 - DNA, 645 bp, Proteus mirabilis
gttattatgaatattataaaatctttttattttaccttaccatttttaagtatttcattagtatcaacatctgcttttgcagatatttataacgatttagcaccatcatttaatgatgattgttttgtgtcacaaaaagatataaccatagagtatcataatcttaaagcttatatgtttaaatctaatgaaaataataagttagatgatcgttatacattaataaatataagctgtccttcacctgtttcacctgtactattttcaataaaagcagatgaaaaaatgggaacaaccacagataatgctcaaactcattttggccttggcactataaatacaacaggtaagattggtttttttcaggtatctattgaaaaagcaacagtagatggcattgatgttaatatttatgaaacagataacgaaaataatattggaataataaaaacaagcccacaattaaaaataggcactctaaacggatttagtcaagatggtgtaacaccttcgaaagggaataactatcaattaaagttaaaaatttcaccaacaatttatagtttaaaagaaacaaatggccctcttgtcgatggtggagaactttcaggctctctattattcgatttttcatttggatcttaa

SEQ ID NO: 3270 - DNA, 2355 bp, Proteus mirabilis
ctaggtatgaaaaagaaactgacatcaatactaagtctgacggttattgccatggcgagtattcatttttgctatgcgacaacaggaatgctagagctagatggtgaagtattaccagagccaacatcttatactcatccgccactacaacccacagtaagtacgcaactatttgatgatgttgcactctccgaggcgcgtaatattgaagagcagttaacattagctcagatggggagtccatcaccaatagtattatccggtcgacgtttattatccggcgtgacatttcgtatggcaaatgatctgtttatcgatagtgcgacactcaccatgaaagtgaaagcttcatcgggattagtgcaagccgatcaaacgttacatttgatgctaaatggtcaacctatgggatttttgcctttagaagaaggtgagcaagaacatgagtatatgttagaaatccctgaaatgatgttgaccaatgtaaacaacttgagttttcgccttgccagtcgcgatgctttagatgaaaagcagtgtattcctcctttagctgatgagttaagtttggtgatttcgcccgattcatcattaaattatcgaggtcgttggattaatggcgggtatagcttggaacgactgcccctaccgttctttgatcctgacagaatgacagcgacctcattacctattgttttagccgataaaccagataatgggcaggtaacagctgccgctattgctgcttcttggtttggtagttttagtcatgatattaaacaaatagatttacctgtattaatgaatcaactacctgatagcgatggtgttttaattggttatgccggacagactattgcaggtattaccttaccatcaggaaaaaatgggcagctcacgatagtcgataaccctgttgatcccgtatttaaattattactgattagcggtgatgatgaaaaaacattacgtcaagctgcatgggcattaaatagtggcaaattgccaccaaatgaccaattaacggttgctgctcaacatattccggtacgtcaggattatgatgccccacgttggttaaataccaatcattccgtaacattgggggagatagctcatggtcgtgatgattttactcgccaaggaataaatcatgctcctaatcaattttcgtttcgtgtctcacccgatctcttttggtgggatggagatgcgctacctttagatctgcaatatgtttttcctcattcagataaaataaatagccgtcgctcttcgctaattgcatctttaaaccatcaatttattggtgcgttatatccttctcgttcagagccattaggaatattaaggcagtggttagggatggagaatgcacagcaaagtagtacgctttatttagatccacgacaaatctacagtcaaaatcaattagagttctattttgatttacatgagtatgatgatgcaccctgtattttaacggatggccaaggattgattagtcgtattgatccgcaatcaaccttacaatttaaaaatacgtggcactattccagaatgcctaatttagcctatttttcaggtgcatcgttcccatttagtcgccgggcagatttttctcaaaccacattattattgccagaaaaccccacaactgaagagctatatactttagttaatttaatggcgagatcgggctattcaaccggtacacctgtttcttatatttctgtttttcttggtgcgcaagccttagaaaaaaatcagttagcacaaaaagatatcttggcgattggagagttaggtagtaacggctttttgccaagtgctttttcacaaaaaaccttctcttttataaataaccaacttgagatccaatctccctcattgatagataaagctaaaagttggttagccggtgatccattatcaccaagtagtgatgcggcaaattatcttgctccgttaaatgattggcggggaatgatgagttttatctctccttgggctaaagatcgtgtggttgttttagtgactgcaaaaggtaatgactcaattaaaaacatcattggtgatttgaaccatgcaaatgtcaatgccgctattaaaggggatctgactttaattagtggtcaagatacggtgatgagcttccatttaggagaacatttttcacagggagacctgcctctattacagcaatttctttggtattgcaccagacatgtctatttgcttggcatgttggcagtcggtttttgtgcgctaacagggagcgtggtttattgctggttacaacgccgctcaacgcgtcgcctgagtgaaatatcaaagcgtcatgttgataaatag

SEQ ID NO: 3271 - DNA, 1458 bp, Proteus mirabilis
gctattaagaaatcagcattcatcatcaaagcctgtgacaaaaatagtcactcgtacgtagaatttcacacctgtctgagatacaaccactatttgttatttattaaaagtattgagaacacgagcatgtcgcaaacaaatcaagtgcctaaaattggattcgtttctttaggttgtcctaaaaatttggtggactctgaacgtatcctcaccgaactgcgtacagaaggttatcaagttgttcctacctatgatgatgctgatttagtcatcgtcaatacctgtggctttattgatagcgcagtacaagaatctcttgaagccattggcgaagcactcgatgaaaacggtaaagttatcgtcaccggttgtttaggtgccaaagaaaatcaaatccgtgaagttcacccaaaagtgctggaaatcaccggccctcatagttatgaacaagtgttatcacatattcatcactatgttcccaaaccttcccataacccatttaccagcttggttcccgagcagggcgttaaattaaccccttgtcattacgcttatctaaaaatttctgaaggttgtaatcaccgttgtactttttgcattattccttcaatgcgaggtgatttagacagtcgcccaattggtgaagtgttaaatgaagcgaaaagattagtcaatgctggagtgaaagagttactggttatctcacaagatacttccgcttatggagttgataccaaacatcaaaccggtttttgggatggtatgcccgttaaaaccagtatggtgagtttatgtgaacaactagcaaaattggggatttgggtacgtttacattatgtttacccttatccacatgtggatgaggttattccattaatggcagaaggcaaaattttgccttatttagatattccgctacaacacgctagcccgaaagtgctgaaattaatgaagcgcccaggctctgttgagcggactttagagcgtgtaaaacgttggcgagaaatttgtcctgaattaacgttacgttcaacctttattgtcggtttcccgggggaaacagaagaagatttccaaatgctattggatttcttgaccgaagctcgtttagatcgcgtgggttgttttaaatatagccccgttgaaggtgcgaaagcgaatgaattacccgatccagttcctgaagaggtaaaagaagagcgttaccatcgttttatgcaactacagcaacaaatttccaccgaacgtctgcaagaaaaaataggtaaagttttaccggttatcattgatgaagtggatgaagaaggtgctattggccgtagtatggcggatgcaccggaaattgatggtgctgtgtaccttaatgagcagtttgatgtcgagccaggacagattgtacgtgtgctgattgagcatgccgatgaatatgatctgtggggtaccatcgtcgaacaataa

SEQ ID NO: 3272 - DNA, 1014 bp, Proteus mirabilis
acgccaaggaaaagcagtcaacccagttccttggcttgggaggtagttttgcatttacttggcacattacaacgaaatatcgcgctaacacttagtttaatgttgctaagttttctattcagtgcacctgctttttcggcaaagttggccattgttattgatgattttggttatcgaaaaaaagaagataaccaaatcttacaactgccaacagccgtttctattgccatcttacccaactcgccccatggtaaagagatggcaacgaaagcccatgcccaaggacgagaaattcttattcatatgccaatggcacccattagcaaacagccattagaaaaagataccttaaagccctccatggatcaggctgaaattaatcgcattattcaaaatgcaattaatcgtgtgccttatgctgtgggtatgaataatcatatggggagtgcgatgacatcggataggcaagcgatggatagagtgatcaaagcccttaatcattctgatctctattttcttgatagtgtcactataggcaatacgcaagcggccacggcagccaaagcggctggcgttccttctttacgccggcatgtatttttagataatgtgcaaacagaagcagaaacccgacaacagcttaatcgtgctattaatttagcgcgtaaaaatggctttgccattgccattggtcacccccacccttcaaccgtaagggcattacaacagcagttgccactactacctgccgatattcagttagtcgcacctagtggtttgttaaccccttcaccagacagcccagtggtacaagagccacccgctgttataccgccaacagagcaatctaaagagccaaaacctgcaacatggttaaagccagcacaacaagccattatttcaatgaaaaaaagtactcttatgaaagtacttactaaaaaattaatgaccttcgaacaagataagcaattcccttcccagcatttagaaagcaacaaagataaagtcgaataa

SEQ ID NO: 3273 - DNA, 477 bp, Proteus mirabilis
tttgctcgtttttgtcacttgacactttatagcaaagacagtttgatacattattcagtaataccttttacgatagcgagtctggagaatacaaacgtcatgtctgtctccctctacagcgggaaagttgcactgaaactgttatttttgcagtttatgacttttgttattctcagtgcgggtttctactttaagagtacagactggagcttttctgcttttttaggtggaattgcatgttggttacccaatattgcatttttattattactacgcttacaaaaagtagatgaaaatgaagcttcagttcgcataaactggctttttgctttcagtgaagggttgaaggttatattatcaatagccttgctgatagttgctttaggagtgtttaaagcggcatttgcaccactggtcatgacctacttagcggtgcttgttatgcaggtcgttgcaccagccgtcataaacggttag

SEQ ID NO: 3274 - DNA, 429 bp, Proteus mirabilis
cgggaggttgatatggccgatacatcgttccacctgaaagttgtcagcgctgaaaagcatttatatgacggcgaagtcaaacatattcaggtaactggtagcgaaggtgagctcggtatttatccgcagcataccccgttattaactgccataaaaccgggcatggtacgtgtcgtaaaaacatcgggtgaagaagagtttatctacctttcaggtggtattctcgaagttcagcctacaggcgtcattgtactggcagatacagctatccgtggtcgtgatttggatgaagcgaaagcgttggaatctaagcgtaaagctgaagaacacattcaatcctctcatggtgatgttgattatgctcaagcatcagcagaattagccaaagcgattgcaaaactacgtgtaatcgaattgactagacgctaa

SEQ ID NO: 3275 - DNA, 219 bp, Proteus mirabilis
agacagatagagactattatagaagtattctctccacatgaaaaaaaatctaacattatttacatgccacataaaccatatggtggaggttttctaatggatatttcaaatgctaaaagcgaattagggtatgaacctaaatatgattgtaaaaaactttttgaagcatataaggttgaaatgaacattaaacgattcgatcagcttcgtgttaagtaa

SEQ ID NO: 3276 - DNA, 828 bp, Proteus mirabilis
cttgtgccagaattaccagaagttgaaaccagtcgccgaggtattgagcctcatttagtgggcaatatcttgcactacgcgatagtgcgtaacagtaaattacgttggcctgtttctgaaaaaatcaaaaccttgctggatgaaccgattttaaatgttaaacggcgcgctaaatatctgttaattgaattaaatcaagggtggatcattgttcatttaggcatgtccggcagtgtacgtatcttgccagaagagcagcctgaagagaaacacgatcatattgatttagtgtttcgtgatggcaaagtactacgctataccgatccgcgtcgtttcggtgcatggctatggtgtgaagatttagccaccagctccgtattagcccatttagggccagagccgctttcggcgcaatttaacgcgcaatatttatatcaacagagcaaaaataaaaaaatcgccatcaaaccatggctaatggataacaaactggtggtgggtgtcggcaatatttatgcgaatgaagcactcttctcatcagggatcatgccagatagaaaagccaatagcttaaccgagcaagagtgtgacgtattggttaatgccattaaagcggtattaactcgctcgatagagcaagggggaaccaccttaaaagattttctacaatctgatggtaaaccaggttattttgcccaagagctatttgtctacgggcgcaaagataaagcgtgcttaatttgtggtcatactattgaaagtattaagcaggggcaacgtagcactttcttttgccgacattgccaacatggtgagataaccgattaa

SEQ ID NO: 3277 - DNA, 876 bp, Proteus mirabilis
ggagaagcagaaatggccggcgcaaaagagatacgttcgaagatcgccagtgtgcaaaacacacagaagatcactaaagcgatggagatggtcgccgcgtcgaaaatgcgtaaaacgcaggaacgcatggcagccagccgtccttatgcagaaaccatgcgcagtgtgattggtcaccttgcgttagggaatctggaatataaacatccatacctcgaagagcgtgaagttaaacgtgtcgggtacctggttgtttcgaccgaccgtggtttgtgtggtggtttgaacattaacttgttcaaaaaactgctggcagacatgaaagagtggtctgataaaggtgtagaagtagatttagcccttgttggttctaaagccgtttcattctttgcctctgtaggtgggaatgttgtcggtcaagtaacaggtatgggtgatgatccgcaactatctgaccttatcggcccagtcaatatcatgttgcaggcttatgacgaaggtcgtttagataaactgtatgtggtggcaaataagttcatcaataccatggcccaagagcctaaaattctgcaagttttaccattaccaccaggtgatgatgaagaactgaaagaaaaatcttgggattatctgtacgaacctgatcctaagacgttactggatactttactgcgtcgttatattgaatcgcaggtttatcagagcgtcgtagagaacttagcgagtgagcaggcagcacgaatggtcgcgatgaaagccgctacagataacggtggtaatctgattaaagaactgcaattggtgtacaacaaagcacgccaagcaagcattactcaggaactgacagaaattgtatctggtgcagccgcggtataa

SEQ ID NO: 3278 - DNA, 258 bp, Proteus mirabilis
aacaaactggagactgtcatggaaaacctgagtatggatctgctgtacatggctgccgctattatgatgggtttagctgcaatcggtgctgcaatcggtatcggaatcctcggaggcaaatttttagaaggtgctgctcgtcagcctgatctgatccctcttctgcgtacacagttctttatcgttatgggtctggttgacgccatcccaatgattgctgtgggtctgggcctttacgtgatgtttgctgtcgcctaa

SEQ ID NO: 3279 - DNA, 981 bp, Proteus mirabilis
ttatttgaggagtatattatgatgaaagctgttattcctgtcgctggattaggcacacgtatgttacctgcaactaaatccattccaaaagaaatgttaccgatagttgatcgtcctttaattcaatatattgttgaagagtgtgcacaagcgggcgttgaagaaattattttagtgacacattcatctaaaaattcaattgctgatcattttgataccagctttgaattagagaatatgttagagcaacgaataaaaaataaattattaaaagaagttcgctctatttgtcctgaaaatgtaaaaattatccaaattcgccaagggcaagcattaggattagggcatgccatttgttgtgctcaccctgtcattggtgataatccttttattgtgttactccccgatgtgctattaaattctcactactgtgatccttgccatgataacttatctgccatgatcaaacgcttccaaaaaacagagcgtagccaaattatggttgaacctgtcgctctcactcaagtacatcaatatggaattgttgattgccaaggtgttttttgcccacaaggtaactgggcgcctattcgtcgtattgtggaaaaacctaatccagaacaagcaccttctaatctttcagtggtggggcgctatgttttctctgcagaaatctggccgttactcgatgggttgcctgcgggggttggcggcgaaatccaattaacggatgctattgatctcttattgagaaaagaggttgccgaagcttacaccttagttggtaaatctcatgattgtggtaataaactcggttatatgaaagcctttgttgagtatggtttacataatagcgaactgaaagaagagttcgctctttggatacaagagttgtatgcaaaagatgtattatcccaaactatggccaataatcgcccaacactaaaagaagtcgataacagtgtgatgacaattttttga

SEQ ID NO: 3280 - DNA, 594 bp, Proteus mirabilis
tacaaagaggatagtctaattatgaaaatactaaaaggaatgatttttctcattctattaataagtcatttttctcatgctagttttcaattggaaaccatgactgttattttagattcagaagagccaagaaagatttttaatgttaaaaatacgggtagtgaacctattttattatcaacaaaagtcagcgatttagataaacaacacgaaatagcaaaaaatattattataactccacctattacaagaatagagccagatcaaagtcagaatattaattttattttaaaagacggtattgaatttgatgatgaacaaattttaaaagcctctttccaaggtattggtgttgcaaaggtcaattcaacaaaaatgcctatcagacaagatattgcgatgttaattattccaaaagggttaaccatagagcgtgaaccttggaaaaatctagaagtaaaacaagtcaataatcaattaatattaaagaataatggtaaacaagttattcgtatggctcccgcttttagctctttaccaagcaataacggttatagtattggtcaatttttatatttcgtcctcacgaaataa

SEQ ID NO: 3281 - DNA, 978 bp, Proteus mirabilis
gttgacggggaatgcatgaaaaaaccagcatttattatcacattagataccgaaggcgataatctttgggaaaatgagcataacattactacgcaaaatacgcattttttaccccgttttcagcaactttgcgaacgttttcaatttaaacccgtttggctaaccaactatgaaatggcaatagatgaagcctatattgagtttgcacaagatgtgatagcccgtaacactggggaaattggtatgcaccttcatgcatggaatagtcccccacttgttgcgttaacggacaatgatctccattatcagccttatttaattgaataccccaaatcgcagatgcgtgacaaaattgcctttatgactgacttactggaaaataaattacaaacaaaaatgttaagtcaccgtgctgggcgttgggcatttaatgaaacttatgcgcagctattgattgaatttggttatcaagtcgattgctcagtcacacccaaagtcgattggcgttttactaaaggtgatccggcacaatcaggcggtacaaattacagtaatttcccaagccatgcatactttatggatgttaatgatatcagcaaagcagggggttcaacgttacttgaagtgccaatgagtattcaatataaacattccccttttatgaataaaattaagcaagggtacgataagctaagaggtaaacaacgctcaccttcagtgaattggttacgccctaaagggggaaatgcacaacagatgattgaagtggcacaaaaatctttagcccaaggtcactctcatattgaatttatgttgcactcttcagagtttatgcctggtggaagccctacttttagaacagaacaagatattgatggcttatataatgatttagaaacactatttaatttcttacaagataaagtacagggaatgacattggctgagtattatcacaataaagtgcaggcaaaataa

SEQ ID NO: 3282 - DNA, 477 bp, Proteus mirabilis
aaacagggggattttatggacaatatttatcagatcgataatctcgatcgtgacatacttcacgctttaatggcgaatgctcgaacaccttatgctgaattagctaaaaaatttgcagtaagtccgggcacaattcatgttcgtgttgaaaaaatgaagcaagcaggaattattacggggacacgcgtagatataagtgaaaaacaactagggtttgatgtttgctgctttattggcatcattttaaaaagtgccaaagactaccataccgcattagataagctagataagttagatgaagtggttgaggtttattatacaacaggtcaatacagtatctttattaaggtaatgtgtaaaagcatcgaagcgcttcaagacgtacttatcaacaaaattcagactattgatgaaatccaatcgacagaaaccttgatctctttgcaaaacccgataacaaggacaatcaagccataa

SEQ ID NO: 3283 - DNA, 1314 bp, Proteus mirabilis
caacatctactatacattataaatatgaattacaaacatataccatttacaaatatattattatatatctttattctattatcaagttttagttatataaagcttctacctaataacatggatactcaaccttggtatatagtaatatcgatatttatctgcttaatctttattttgaaaaataaaattatttatcgtgagaatttaatatttgtttatttattattttcctattttattgtattaacaatcgatatattaaatcaaaaatattttttattatctgatttaatcagaaatactgccacatatatttcattatttacagtctctttttcgttcatatattgtttaaagaaaaaaatactaacatcaaaattaatactagcttttatagttatatggtttattggtggtactatacaattctttattaatagtaattttttctcttttattttagattctagaactagccctggacgtggcgttacaggtttttctcctgaacctactttttatgcaataataataacacttttatactttttattttacataaccaaaacaactctagaaggaaatatatcttttagttttatttttaataaggtattgtttcttgtattattacaggtattcattttttctaaatcatctatgatgatgctattttggctaattgtatttttgtttagttatattgtgtacacagccattgcctttaaagaaaaaaaaatagctcaactaattatattattcataggtatatttatcttactaatattaatatattcaattatattaatatctaatacagactacattaatagtatcaaaggatatagattttataaaatatttcaaatatccaacaatggattatcatccttaatttatcaagatgcttctataaatgatagagttgctcacttagtaataccctggtatggactaatgaaaaactatctttttccaggaggattttatagctttactcactatttagataataaaggtttaatatttgaaggcattttttggtatggctctttaacaaataaaataatgtcatatattggaagtgttatctatgagttaggttttttgtctttcccttatctcttttatatattaataaacctaattaaatttatatctcaatcaaagaataagaaaggtgatatcatattatcatgttcctttttcactcttatttttttaagtattccactatctaatcctattgttacggggtttattactaccatagcatacataaattatcacaattttcacatgagaaataattaa

SEQ ID NO: 3284 - DNA, 942 bp, Proteus mirabilis
attatgtcactgcaatcacaagacattattcgtcgctctgccaccaattcccttactcccgcaccacaagtgcgggattacaaggaagaagtggcaaaacttatcgacgttaccacctgtattggttgtaaagcctgtcaggttgcttgttctgaatggaacgatatccgcgataaaattggtactaacgtcggtgtttatgacaacccaacggacttaacggctaaatcatggacagtgatgcgtttctctgaagttgaagagaatggcaaattggaatggttgatccgtaaagatggttgtatgcattgtgctgatccgggctgtttaaaagcatgtcctgcggaaggcgctatcattcaatatgctaacggtattgtggacttccaatctgagcactgtatcggatgtggttactgtattgctggttgtccttttaacgtaccgcgtattaatgaagaagataaccgtgcttataaatgcaccttgtgtgtagaccgtgttgaagtgggtcaagagccggcttgtgttaaaacctgtccgactggtgctatccattttggctcaaaagagtcgatgattaatcttgccaatgaacgtgttacagagttacaaactcgtggctatgacaacgctggactctacgatccacaaggcgttggtggcacacacgttatgtacgtgcttcatcacgcggataaacccaacctgtaccatggtttaccagaaaacccagaaattagctcaacggttaaattctggaaaggtatttggaaaccattagcggcggttggttttgctgctacatttgcaggtgctatcttccactacttaggtgttggccctaaccgcaccaccgaagaagatgaagaagcggcacaaaaagagatggaagcatcttctaaaacacagacctctgtgaataaggaggagcaaaaatga

SEQ ID NO: 3285 - DNA, 258 bp, Proteus mirabilis
ttagatttttggagaatagacatgtcccgagtctgccaagttaccggcaagcgtcctgtgagtggaaacaaccgctctcacgcattaaacgcgactaaacgccgttttctgccaaacctgcactctcaccgtttctgggttgagtctgagaaacgtttcgtaactctgcgtgtatctgctaaaggtatgcgtgtgatcgataagaaaggcatcgaatctgtattagcagatttacgtgcccgtggtgagaagtactaa

SEQ ID NO: 3286 - DNA, 1050 bp, Proteus mirabilis
tgtatagtctggaaagtaaatgtatcatttaaactaaataaaaagtgtatggatccaaaaaacatattggttatagcaattgcgcgttttggtgatacgttactgatcacgccggtgatccacgcactaaaagagcgttggccgaatgcgcgtattcatgtattggcgcataaacgcagtgcctgcattttgcagcacaatcctgatatttttagtgttaagcctttctcgaaaaagcgcgcccgttggcgaggatggttaccccataaaccttatgatttagctttggtatatggaaatgatcattcattagtgcagtatgcccgccgtcaatcacaacatgtagtggcttttgctgaaaataaccaaaagcaatcagacataacatgggtggcttaccctaaagagttaatggtggcacaaaaagagcgtgctttattaattaatgcattaggaatttacccaaccaattggcaattacgctactctattagttcagaagaaaagcaatttgcccaacagtttatagagagtaatgcattaattaataagcacattattggcttacaattacaaagttttcctgccaaagcttaccgcgattggcctatagaacactttttgcagttagccaaacagataatgactcatgacgagcaggcctattttctgttattaggtgggaaagagagccaacaagtcgccattgaactggcgaaaaaaataggtactgagcattgtttggcattagcagggcaagtttctatgcgcgaaaatgctgccattatggcgcatttgtcgctctatatcggggttgatacagggccgacgcatttagctggcgcgttaggtattccgatggtagccatgtatcacagctatcatcccggatgttatttagcgccattacaacattcatgttgtcatattatccaacatcctattgcgttagccgatgcaagtcgtgaagatagtatgtctgatatttctgtcgccaatgtttggcatgccgttagcgatattttaaatggaataaaggtgaaacagtaa

SEQ ID NO: 3287 - DNA, 1086 bp, Proteus mirabilis
tcagtagtatgccgaccgagttcatttagcggtcggcaaaagaaggagaaagagacaatgtccataagacagttatctcgattgactcatcgacttggtattttgctaacactaagtgtgatgttaatgatatccccaatgacacaagcgacagaaacccaagcaggatggcaacaatttaaagcgcgttacattactcccgaggggcgtgtcattgacagtgctaatcaaaatatttcacactcagaaggtcaaggatatggcatgttaatggcggttatgagtgacgatcgccaaacctttgcacaattatggcactggacggcaatgtcgctgtatcgtggtgatcttggcttatttaaatggcgttatgaacccgaaaataatcaacatacacccgatcctaataatgcaacagatggtgatattttaattgcttgggcattattaaaggctggggaaaaatggcatgatgaaagctatctttcagcgtcagattctattcagcatgcgatccttgaacacactttagtgaagacagaaaactacagtgtactcttaccgggaattaatggttttaaaacccccgaagaaattatcattaacccctcctattttatctttccggcatggaaagatttctatcgagttagtcatgatagccgctggaaaaatttaattaacgatagccaatccttattaagaaaaatgcgttttggtaaatataaattaccaagtgattgggtaagtttataccctgatggtcatcttgccccgagtgaaaaatggccagcacgatttagttttgatgctattcgcattcctctttatttggcatgggcacaagataaactcgcattacaacctttcgtgaattattggcaacaatttgatcgtgataagacgcctgcgtggatcagtattgatggtaaagagcgcgctgattataacttaacgccaggtatgatggcggtaagagatctgacaatgaaaacagtaattgaaaatgtcgatttaactaaggatacggattattactcttcagccttacatttattagccgcctttgcacagaataataactga

SEQ ID NO: 3288 - DNA, 639 bp, Proteus mirabilis
tttgttttgcttttagcaggggccttatcagtcatggcagaagaaaaagaaaccaaaaagaaacgcagaaatagacgggatgaaatactacaatcgctcgctcaaatgttggagtctagtgatggtagtcaacgtattactacagccaaattagcggctaccgttggggtatctgaagcagcactttatcgacatttccccagtaaaacaaagatgtttgatagcctaattgagtttatcgaagatagcttagtttcgcgtatcaacctgattttaaaagatgagaaagaaactatcgcgcgcattcgccttattcttatcttgatccttggttttgcagagaaaaaccctgggctatctcgcattcttaccggacacgcattaatgtttgagcaagatagattacaagggcgcattaaccaattgtatgagcgaattgaagtacaacttcgccaagtgattaaagagcgtaaaattcgcgaaggaagtgcctttttacatgatgaagcactactcgcttcacaactgcttgcgttttgtgaaggtatgctagcacgttttgtacgtactgaatttcgttatcatcctacacaggaatttgaagcacgttggccattaattcaggcacaattacagtga

SEQ ID NO: 3289 - DNA, 219 bp, Proteus mirabilis
ttacgtgaacgatatattgttgataagcctagtgagaatactgatacaggtaaacttaaattagcatttgcttggaagccatcacctttattagaagaagatgcatatttaataccaaagccagtagataaaggacgatgttcaccaaaaacgctatttacgctacctacaatggacttatattttgatgatatttccataccccctagaaaattatga

SEQ ID NO: 3290 - DNA, 1278 bp, Proteus mirabilis
tcaaatatttttcgccggtattttgtgacaaagaccaaatggacgtgcatcaggaatacacaatgtctgccacggcgaatattagtttcatttttcatggaccaaagtataataggtaatatgaaacgtctacaagcctttaaattccagttaagacccaatggtcagcaagagcgtgagatgagacgctttgcaggggcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaaacgtaccgcttttcctcgattcaagaaacgcggtaaaaatgacgcttttcgctacccgcagggcgtgaagctcgatcaatccaatagtcgtatatcattgccaaagttgggatggatgcgctaccgcaacagtcgtgaagtcgtcggagaagtgagaaacgtcacggtcagtcagtcatgcggtaaatggtacgtcagcattcagactgagtatgaagcgacagaaccacaacatgaatcaacctcaatagtcgggcttgatgcaggcgttacaaagctggccacgctttcagacggtacggtatacccgcccgtcagcagttttaaagtaaaccagcgaaagctggcaaggcttcaacggaaattaagccgtaaaatcacattcagtgccaactggcaaaaacaaaagcgcaaaattcaacgtctgcatactcatattgccaatatcaggaaagactaccttcacaaagtcaccagcgaaatcagcaaaaaccacgcaatgattgtcattgaggacttaaaggtcagtaacatgtctaaatcggcaaaaggtacgacagaacggcctggacggaacgtaaaagctaaatctggtttaaaccgcgcaatactggagcagggctggtatgaaatgcgccgtcagcttgagtacaagcagctctggcgaggtggtcaggtactggcaataccaccagcctacaccagtcagaagtgcgcttgctgtggtcatacagcaaaggaaaaccgccagtcacaaagtcaattcgagtgccttgaatgtggatatacagcgaatgctgatatcaacggggcacgtaacattttagcggcaggacatgccgtgcttgcccgtggagggagggtgcagtga

SEQ ID NO: 3291 - DNA, 213 bp, Proteus mirabilis
ttttattttaggataccaaaaaagttacaaagaatgaataataaagtagctggtatatgcgcaggaatagcaataattggtatcgtttttagctttttcttttcaatttatgtcggtctcgatttaacctctaaaggctattatcgttgttataaatcatctgcttttgcaccaaatgaatatgttattgcaaaagagatgtgtaaaaaatag

SEQ ID NO: 3292 - DNA, 1122 bp, Proteus mirabilis
gcttcgcttaggagtagaaagatggaaaatattcaatcaaaaaaagaaaaaatcatgcagttagtgatggtttatacaccttggatcactgtgatatgtgttgttgcgtttattggtatagcgactgcagattgggatcgctggtggagtgatgctcgttatcaaacaacagataacgcttacataaaagcggactcaacgatattgaaatcacgaatgactgggtttatttctcagattaataaagaggattaccaagtagtaaaacgtggtgaggtcattgctgaaattaataagaaagaacaaatattaaatcggcaagcggcattagcagagtatcaaaaagcccaattagctttagataatctcactgaagaaattaaagaatatcaattaaatattgagaaattagctaatcgttatcaagcatcagttattgatgttacccaagctaagcgcagcccaatgttgcgtaaagatttaattaatagtggggcaatcacacaacaaaattatttagatgctcaatctgatttgcaacgtttaatgaaattacaaagtgctgcgaaaaatgagtgggatcaggctaaacaagcactggtattactaaaatctcaagaaaaaatacgtctggcacaaaaagatatcgctcaaacacagtatcagcaggctgaaacggagctttcatacgcgactattaaggctcctttcgatgcgcaattaaataaaataaaagtcaatatcggtagccttgtgactgcgggtagcgaaattgtgactttaacaccgattaacgatgtatacattattgccaatttaaaagagacacaaataaaaaaagtacagccagaacaatctgttgctatcaaagttgatgcttttcctaccgatgttttttcaggaaaagtgagatatatcggcgcacaaagtagtggtgaatcagcacttattcctgctgataatgccagtggtaattttactaaagtagtacaacgtattccggtttatatcacgctcaatagtgataaccgacacttagctaaattaagagcgggtatgtctgtgcaagtgaaaattgacacagatagccttcctatagaggagggggagcgcagtgattaa

SEQ ID NO: 3293 - DNA, 432 bp, Proteus mirabilis
caaggtattaggtgcgattatttaagggttcatattatgtatgatgatatagataatttaaaaaataagtttcaggaagaggggtttacttttcaagatttctcttctcaaacgacaggtaacatagcctgtaatattggtaatagtgttataaatcaacaggataataaaggctctctatcaggggataatgaagagttcttgaatatatctaaagttaaaaagagacaaaaacaaacagctaatatagcgacttctctttcttattcacaagatttagcctcggaattaaaagaaaaaaatagagttaataagcaaagtaaatgtttgctagataatcagttatttgaaaaaaaaaccacagataagtgccaagtaaatgaaaagctctcattgcaaaagatattttcatttattgcatcagctaattaa

SEQ ID NO: 3294 - DNA, 1173 bp, Proteus mirabilis
ttaatagatagggtgcgatgcactctatcttgtttagggtgtcatatgaaatttgatattgcggttattggtgcgggcattattggtttatctcatgcatatgcagcggctcagcgaggtttacgtgttgctatttttgagcgcagttacacgcctgtgggcgcttctgtacgtaattttggtcacggattaattttgggtcaagcgccgggaaaaatgctagatttagcaaaaaatagtcgtgaaatttgggcaactatggccaaacaggctaaatttttaacgcgtcaaaaagggacttatctgttagcacgtacacaatctgagcaagctgttcttgaagcctttgtcgatggtcgagctaaaacctatggttatgattgtgaattactttctaaaacacaattagctatggtttatggtggtcaattacaacaccataaagcggcgttgcatggcaaagaagatcaggtgctattttcgcgagaagcgatcccacagttagcggcttatctaggcagcttagctaatgtaacgagttatttttccacattagtacgggatattgatgtagatacggggacattgatcaccagtaatggaacatttagtgcagaaaagatcattgtctgctcagggcacgattatcaaacattattggctgacgaaataaaaaagcttgatcctatagtttgccgcctgcagatgttgcgagtgacagcagagcaaaatattggattggcgcatgcgctaatgacgggattaagttgtactcactatggtgcatttgctgatttacctgaggcacaggctttagcgaaagaaattaaaatgcaatcgccgttgattgagcagtatggtattcatttattaattaccccgactccttatggcgatcttattattggtgattctcatgaatatagcttagatgcacagccttttaacagcgaagaggttgataacctcctgatagagttagctgagcacacattaggttgttcggttcaagtaaaagagcgttggcaaggggtttatggggcaaaaggaaaggagccgatttcaattttaacgccgagtgaaaaagtcactgcagtattgatgcgaacgggtttaggaatgagtgttgggcctggtttaggtgaacaaaatattcgtcaactatttgattaa

SEQ ID NO: 3295 - DNA, 1989 bp, Proteus mirabilis
tactacgtcagagaaggagtctcttttatgcatttaaatccgttaaaaatatcaataagcccttcgtcactcccctgcactcaacctttaacctgcattgaatatgaggacttaaaggatgggatgttagatatgattaatcgcaacagtaatatattacccactgttgtggatgaatttaatcaacaagatccgcttaatgcgcctattatggtgggtgaagtggtcgtgggtcatatcattggtctaatacctgttgttgggggagtactttcaaaaattacttccgcgctttttggcctcatgaataaaaatatgaaagatagctcgttagctgagcaaattattgcccatgtctctcgtattattgatgctaaaatcactgataacaatataaaaatcattaaactcaccacagaaggtattagcgacgtttatcaattattttcagattctctcgctcgttaccttgaccccaatgtgcattattcagaaacacaactacgagatttacgggaacaagttcttaaccgttttgatgatgtgatttcgacaattattgctcaacaaccattagtattaaatttagcacaatcagcaggattgcccttttattgccactgttgcgcactttttgtcgccgcccattgcgatatattaaccaataaagaaaaacttgctctggaagaggattatttcaaaaataatctaaaaacattaagaaatagcattgataaatttaacgccaatattcataaagcgatttatcagcagacctcccaggtttttaaagatgattataataaatgtaatacttttttagtgggtatctatacttctggtttatctttctatcaaacttgggttaaacgtagttttgaaattgaatttacaaccccctttgctcgttggaatagcttagagctttatggaaatgactatagccatgatccaaaaatcagttattacaagacttacgttgagatgggaaaagatatattacatagaacatccatgctacaaagtattgaatcctactctcatattgatgcagtgatccgtttaaaacagaactacttaacacctgaaaaagaggtagatagttttcaatatgaaggctgtaatggcgtggcaggagatagccatgatgttataaaaaacgacacattttttaccccagacagtcagaaagcctatctgtcaccaacgcaaattttaccctccgttcgctatatttctgacacaccttggggagggttaaaatatatggtacttgatgatgttaacaataatagttttactatcggtcaaggtaatcgagataataaatcgtatcttaatattcctggctactgctttaatggcgtaaatctttatttaagtcgtcacaatggaaaaagctgtcaagctgactcaggagcttggttaaccgaatctgcacctatatttcgtttttatgatggttatgcatccttaccccttgacactaaaaatcatttacccacagcaaaaaagagctatgaactcgatttaaatcatggatttatgactcaactaagcaaagctcaatatggctatagtgatatgttagtggggaaaaattgtattttgttaaatcacgatgcctatttttgcttaccatcagaagagccgattggcaaagtgggtttatcacaaaaaatcaccttgttattacagtgtgcaattacgcaggaacaatcattagctatagtggcaagaacgggcgatgcgacccaaggcactattattggttctgctgaatttaagctcaccacagatcaagataatattatttataaaataaccccattacttaatcatcctatttccgataataaaagttatttttatacttatcaaattgatttatcttgtatttttagtcaagaagatcaaaaaaatctctattttcatctctatttttttgagcctaataccttgttggctgatatgactgttttattctaa

SEQ ID NO: 3296 - DNA, 1164 bp, Proteus mirabilis
agaacttccagatacaatagcgagacccttgtaatgaaaaaattaaaagttgtatccgttgttggtactcgtccagaaattattcgtttgtctagagttttaataaaattagatcaattttgtgagcatattattgttcatactgggcaaaattatgattacgaattaaatgaggtttttttcaatgatttaggtgttaggaaacccgattatttcttaaatgcggcaggtactaacgctgcagaaacaattggcaatgtcattataaaagttgatcaagtcttagaaaaagttatgccagaagccgtacttattttaggcgatacaaactcttgtatttcagctatacccgctaaaagacgtaaaatacctatttttcacatggaagcaggtaatcgttgttttgatcagcgagtacctgaggaaactaataggcgtattgttgatcacacggctgatatcaatttgacctatagtgacattgctcgccaatatcttctttccgaagggatacctgcagaccgagttataaaaacaggtagccctatgtttgaagtgctttctcattatatggaacaaattgataactctaaagtattatctcaattaaatttaaaatctggagagttttttgtagttagtgctcatcgtgaagaaaatgtcgattctccaaagaatattatgaaattaacaaatatattaaatactgttgctgagaaatataatcttcctgttatcgtctctacccacccaagaacaagaaaaagaatcgatgaccatggaattacttttcatagtaatattcaattattgaaacctttaggtttccatgactataatcatctacaaaaacatgcaaaagcagttctctctgatagtggaacgatcactgaagaatcttcaattatgaattttcctgccattaatattagagaagctcatgaaagacctgaaggttttgaagaagcatcagtgatgatggttggtttggaatgcgatcgggtgctacaagccttgaatatcctttcagctcaacctcgaggaaatgaacgtttattacgtcaagtatcagactatagtatgcctaatgtatcagataaagttgtaagaataattcattcatacactgactacgtaaaaagagttgtttggaaagaatactaa

SEQ ID NO: 3297 - DNA, 237 bp, Proteus mirabilis
gtcatgaccagtggtgcaaatgccgctttaaacactcctaaagcaactatcagcaaggctattgataatataaccttcaacccttcactgaaagcaaaaagccagtttatgcgaactgaagcttcattttcatctactttttgtaagcgtagtaataataaaaatgcaatattgggtaaccaacatgcaattccacctaaaaaagcagaaaagctccagtctgtactcttaaagtag

SEQ ID NO: 3298 - DNA, 432 bp, Proteus mirabilis
aaactgaaaagtagggaaactttagtcatggttaaaataaactctctaaaaatgtatttaattgcaatattccttttttctttagctttgttttgtttctatgactccataatctactacaaaaactattttatgatgaaagatagaattctattctcatttcaaacagggttgtttttttttgcagcccctttgattatctatttttcttatctaatttttatttgtggatacacaaaaaaaacacaaaaaatgaataataaagtagcgggtatatgcacaggaatagcaatagttggtatcgtttttagctttttcttttcaatttatgtcgctctcgatttaacctctaaaggctattttagttgttataaatcatctgcttttgcaccaaatgaatatgttattgcaaaagagatgtgtaaaaaatag

SEQ ID NO: 3299 - DNA, 1119 bp, Proteus mirabilis
cattggctgagtattatcacaataaagtgcaggcaaaataagatgaagttaaagaaattaaaatgggtgcactattttctaaatctctataacccactctttggtaagatgaaaaaaacggcaacattttcatctgatatcaaatttaacagtattgttattttttcaaccacagcgttgggggattttatgtttaataccccagccatcagagcaattcgtgcacattatcctgatgcacatatcacactggtttctagtgtaaaaaataagctattagtggaaaactatgagcaaatagatagtgtggtgtattgggataataagatcagaaacttgttaccggtggctttacaagctaaaaagtataaacctgagttagcgattattttacattcccacctcccttatgacgtattatttgccgtgatggcaggttgccaatatattttacgcaatacttttcatgttattcctgagtggttccgaaaatggattattgctgaacaccaaccctctcaatatcatgtgatccaaagcaaattaaatattattcgttatttaggaattgattgttctgatactagaatggagctcccttgtaaaatagaaccattagctcaaagtaacaatagcattgttggttttcagatgggagcatcaacacaagagcgtagatggcctgttggatcttttgtggaattagcgaaaaaattaattgatagtgcgccattattacaaataaagctaataggttcatcgagagagctggaattgccagaagagttttttgctttattacctgaaagatatcatcaaaatatagaaaatctggtaggtaaaacctcactacctgatctgttaagtcaaataaaaaccatggcggtattagttacgggagacacgggcccgctacatttggcaatagcattacaagtacctacagtaagtttatttgtaaccgcaaatccaaagtggacaggaccttatcaagatctcgatattcatactattatccataagatcccgcaacaagatgaaaatagagcactttcgatggatttgattactgttgatgaggttctaaccgcagtaaataacaccctaaaagataaataa

SEQ ID NO: 3300 - DNA, 927 bp, Proteus mirabilis
aacgttatgagtattcgcatcgttcctaaagagcaattaggtaaagagccatcagaaaaaagcatcagctttattccaccggtgttattccctaatttaaaaaacctctatcaacgtcgtgctgaacgttttcaagcattagccaaagacaatcctttcgctgattatcttgaatttgctgccgaaattgccttagcacaagaaaaagcattacatgataacccgcttgaattagatttaaccccgttactttctcaacaaacgggtatagcgccactagataaaaagacctttaagcgtagtaagcattggcatgcattactcgcctcaatcattgcggaattacaatccgttgtacctgaaagtgctaaaattgccttagaaaatctctctaaagcctctgaaaccgaattagaagagatggcaacagcactattaaacgatgaatactcaaaagtttccgctgataaatcagtatttatttgggcggcattatcactttactgggcgcaactggcggcaaacattcccggtaaagcgaaaacagaatatggcgaaaatcgccaattttgccccgtttgtaacagtatgcctgtatcgagtatggtacaaattggcaccactcaaggactgcgttatttacactgtaatttatgtgagaccgaatggcacgtggtacgtataaaatgtactaattgtgaattaacgggcaaattaaattactggtctcttgatagtgaaaatgcgccagtcaaagcagaaagctgtggcgattgtggtagttatttaaaaattttataccaagaaaaagatgctaacgtcgatgctgtggctgacgatttagcctcccttattcttgatgcaaaaatggaagaagaaggttttgcacgcagtagtattaacccccttctattccccaatgaataa

SEQ ID NO: 3301 - DNA, 1134 bp, Proteus mirabilis
ttgcagatgagtaaatcggtgttatctatcttacatacagagtcgtcttgtggttggggtggtcaagaaatccgcattttgacagaatctcaaggcatggtgcaaagagggcaccatgtgacactggtttgctgtccaaactcaaaaattgccaaagcagcccctgactatggtattgaggttgtcacattaccgattgaaaaaaaacgcggatctgcactgatggcattgcgtaattggttaaaagtccatcgtcagcaatttgatgtgattaatacccatagctcgacagatgcttggttagttgcgctatcttgtgcttcattacgccactctcccgccatagtacgtactcgccatgtatctaccgatgtatcacgttcactgcccacgcgttggctctacctgtcttcaagtgcccatattgtgactaccggtgaaaaattacgccaaaccttacatcaatataatcgttttccgctcagtcaaatgacctcagttcctacggggatcgatttagaaaagttctcgccacaaaataaacagcaagcacgagaaaaaataggtgtgcctaataaacctacattagggattgtggcaacaatgcgggtatggaaaggacataaatacctaatagaagcatggaaaacattgcatctgcaatttcctgactggcaactacttctcgtcggagatggcccacaacgtaaaaatttacaaccgatggttaaacttgcaggattagaagagagtgtctttttcttaggcaaccgcaatgatgtgccggattgcttaaatgcaatggatttatttgccttaccctcttttggtaacgaaggggtgccacaaggtattatgcaagcgatggcttgcggattaccggtggtatcaaccacagtaggtgcaattagtgaagcggtgattgatggtaaaaccggctttacattggcacctaaagtacaagaaaccctaattaattaccttgctaaattaatggcctctgatgagttacgtcaacaaatggggcaagcgtcattagcccatgccaaagctcagtttggtttagataacatgctagataaaatggaaaaaatatttattaacgccattagccttaaagataaatcacgataa

SEQ ID NO: 3302 - DNA, 615 bp, Proteus mirabilis
aaaatcaagagattaaaaatggataaaaatatttttctatctgctagtatcccattgcctgatagagaccctaagtttattgaaagtgcagatatttctgctattcgtgattctgttaatgcattatccaagttaatcattcccaaagcacatttaatttggggagggcatccatccattacaccactaattaaatttactttaaaacaattaggaaaaaatgcacaagaccatgtaacactttatcaatcaaagttatttgaagaattttttccagaagataatgcctcctttgcaaatataaaattagtagatagtgtgaataatgaccgtaaagaaagtctacttgcaatgagaaatgaaatgctaagcaaagataaaaattttattgcaggtatctttattggtggaatggaaggagttattgaagaaatgaaattatttcagaaatatcaccctgacacacctatatttccaatagcaacgactggtgcagctgctcttgaaatttataatatgaacccaattgtttatcctgaagagttcaaagatgagctgataaataactatgcttatctatcattatttattaaattactaggaaataagttataa

SEQ ID NO: 3303 - DNA, 492 bp, Proteus mirabilis
ccaagaaagaggtattgtgctgtgaatttaaatgcaacaatcctcggccaggccatcgcatttgtcctgtttgttttgttctgcatgaaatatgtatggccaccaattatggcggccattgaaaaacgtcaaaaagaaattgctgacggtttatcttctgcagaacgtgcgaaaaaggacttagatttagcgaaagccgatgcaggcgaacagttagcgaaagcaaaagctgaagcacaagcaatcattgagtctgcgaataaacaacgcactcaaatgattgaagaagctaaagctgaagcagagcaagaacgtagtaagatcgttgcacaagctcaatccgaattggaagcagagcgtaaacgtgctcgtgaagaacttcgtaaacaagtcgctatgctggctatcgctggtgccgagaaaattattgaacgttccgtggatgaagctgctaatagcgacatcgttgataaactggtcgctgaactgtaa

SEQ ID NO: 3304 - DNA, 1536 bp, Proteus mirabilis
aggagggggagcgcagtgattaaattattatcagcagcacaaaatcatcgtcctatttttgttgttatggctgtttttaccggggctattttatcaacactctttgtacgtatgttttctatctcgttagcggatttaagaggcgtgtttggtttagatgttgcccaaggatcttggttgaatgtggctcttaatatagctcaattgatcagtatgactcttgtaccttggtttatggtggtttatggcgcagaaaaaatattaatcagtgcgagttttatccttttttgttgtggattagcggttcccataataggacaacagattggttttggcggactttttattgctcattttatgattggattttgtatcggagtctatttgccgatgacgatttcattagccttaaaaagtttaaatcccagtgtttggctaatcgttatggcggcttatagcttacgtgtttctgtaggaatggatgcgggagtggggatctcaggagaatttgttgacatattgaattggcgttggatttattggttatccgctattttcaccttagtcatcctattttttacctggtggggaatgccactctcacctattaataaatcattgctcgctcaaagtgattggggaggaatggcgcttaaatgcttaggattaacgctattatatattggtgtcgttcaaggtgaattgttaggttggtgggattctgggctggtcgtgtcttgcttaatcggtagcgctatactgatggggacatttattattagagcttatatttataaacaaagctttggccacttaaattggatcaaagatagtaatttacggctctgctttattattgcctgtttatatggctttttgatgttacctaattcgttatttataccttcatttttgagtgttgttggtgggttgaaaccactacaaataggtcaagttaccaatcttgccttctttatctatctattatgtagtccaatagctatttttcttgcacggcgtttagagccacgattaatgatgttaataggtattatgattattggaggagcatgtttaatcggtcatcaaattgattatcagtggcgagctaatgatttctttattgtcatatctatgcaagcaatgggggaatgtttgctacttatcggattaattgcctcatttgttactaatatcaagccacaagaagcgttacatttaggggcatatatttcgatagcgagagtattaatgccagcccttgcaggagctattatcaatacttatttgaggatctcatatgatactcattatgatttgttaagaggatacatacaaactggtgagcaaaaattagcagggaatattgctgaacattatcaaacaacgatggcattagtaataagagaagcacatgttgcctcttttattgatggttttgatttgattatgctcttggttattttaggtgctctttgtatgtcatttttaaaatcgtcaccagaaaatccggtagtcccaaggctagtaaaataa

SEQ ID NO: 3305 - DNA, 1308 bp, Proteus mirabilis
aggtactttggtcagatggcagagaaaaaggatcttcagaacacaacacaccgtacttaccgtgtattttctttaccgttaatcacgctactgattagcacatctctgttttctgcaaccagcgcttttgccaatacattaacggataatcgtagtcagttaaaagatctgcaaaccaccattgctgaaaaagaaaagcgcgttcaagagcaacaaaaacagcgtactgctttacttgggcaactcaaatcacaagagacacaaatcgctaatgccagccgctctgtgcatgagacgcaaaaccgcttacaaaccttagctaaagagatcaaaaccatcaccgcaaatattgctcgattgcaaaagcaatataaccagcaacaagcactgttagcacgccaactcgatgcggcttaccgacaaggaaaacatcaaggtattgagttactgtttcgcggtgaagaaggtcagcgagaagagcggatcttagcctattacagttatataaatgaagcacgtaaacaatcaatggagcaattggcgcaaacttccaaagagctacaggcagaaaaagacgcccaacaagcgaaacagaacgagcaaaagcaggtactcaccaaacagcaacaagagaaacaaaaactagataatgcgctagctgcacgtcaaaaaacattaacgcaactagaatcaaccttaaaagaagatcaacgcaatttagccaccatgcgtgctaatgaaacacgcttaagaaataaaattgctcaagcagagcgtgaagccaaagcgcgagctgagcgtgaagcacgggaagctgctcgtattgccgccaagcaacgtgaagcgcaacagcgtggttcgacctataaacccaccgccgaagaacgctctttaatgtcccgtactggcggattgggtaaacctgcaggtcaggctatttggcctattagaggcagtttattacaccgctttggtgagtctatttctggctcgggtgaattacgttggaaaggaattgtgatccccgcggcacaaggcactgaagtaaaagcgattgcggatggtcgggtgctgttagccgactggctacaagggtatggtttagtggtcgtcgttgagcacggtaaaggggatatgagcctttatggctataaccaaagtgcgttagtcaatgttggtcaacaagtcaaagctggacaacctatcgccttggtaggaaacagtggtggacaagagcgctcagcgctctattttgaaattagacgccaaggaaaagcagtcaacccagttccttggcttgggaggtag

SEQ ID NO: 3306 - DNA, 810 bp, Proteus mirabilis
gtgaactatggacacctattgcttcttaacaaaaggtatatgtatatcatgaatatatttatcaccgatttttaccatcgcagcgatttgttagataaagcagaagccatgatagccaaccattggcctgcttttatgatgggaacttctgttgatgatagctattgggaacgcttatatgatgtgcctttttcccattaccaatttatggcggtattaaaaacgcaaacagaagaaaaggttatcggtgtaattaactccattgcgttaccttggcaaaccaactctctcaacgatttaccggatgaaggttgggatcgtgtttttcagctaggcatggaggctgaagaacaacaattaccttgccatcttatttctgctttgtcggttactatcgatcatcattatcgggggaaaggtattgctcaacgcttaattaataccttaaaggagcatgcaaaaaaacaaggttacctcggtgttgctgtacctgtacgccctacattaaaacattgttatccattgcactcttttgctgaatattgccaatggaaaaacgataatgatgagccctttgatccttggatacgtacacattggcgcttaggtgccaccacgatcaaaattgccccacagtctatgaaaattgaagcaccgacagaaaaatggcaacaatggacttcattacgatttcctgtcagtggtgactacaccattcctatggggctggcaccgttaaatatcgatattcaacgtcaatatggtgtctatctggaacccaacctttggatgtttcaccacatacgttaa

SEQ ID NO: 3307 - DNA, 1137 bp, Proteus mirabilis
acaaggtatggtagatgcattctacggatttgtttacaattaaagtatctcattgaagctaaagtaattatgaataatataaatcaatcatttaacagaatactggttattaaacttcaacatcatggagatatgttattaacgacacctgttattaattcgttaaaatcagcttatcctaatgcaaagattgatgttttattatacaaagaaacattaccgatgcttgaacataatccattaataaatcatattttttatcttgaccgaaattggaaatatcaaggtaagttcacacgattaaaaaaagagtggcaactagggaaaatcttacaaaaacagcaatatgacttagtggtgaatttagctgaccaatggaaagccgctattttcgccttagttaccaaagccccagtgcgcctagggtttgaatttgaaaaacggcaaaatagtaagttttggcaaaaatgtcataacattattgtccctactgctgagcatggacaattacacactgtagagcaaaatctttctattctagcccctcttaatgtaccaattatttctgatgttaccatggcatatagccaccaagataaacaatggttagaagagacaattaaaaagcatcatatccctaaaaactatattgttattcaaccaacctctcgttggttttttaaatgttgggatgaagataaaatggctacattaattactcagcttcagcaagataattactcaattgttttaacatcagggccagaagcgaaagagcttgagatgatagaaaatattttagctcagtgtcctgataaaacatcaattaatgtattagcaggaaaaacatcactctctcagcttgcgacattaattgatcatgcggctctttttattggtgttgattctgtagctatgcatatggcggctgcattaaaaacaccgctaatcgcactctttggctcatcaaaattagagcattggcatccttggcaagccattggagaaactatttgggcaggtaattacgctaaaatcccccacccagatcaaataaaaaccgatacacaacaacgttatctttctgctattcccgttgatgctgtatttaatgcagcaaaaaggtacttaagctaa

SEQ ID NO: 3308 - DNA, 1419 bp, Proteus mirabilis
aagaaagacggtatctgttacatgttaaaatccgccaaaaatatgtcagggttgccctggatcgctgcaatggctttttttatgcagtcattagatgcgactatattaaatacggcactccctgatatagctaaaagtcttaatcactcccctctcgccatgcaatcagccgtaattagctatactttaacggtagctttattaattcctgtaagtggatggttagctgatagatttgggactcgcaagattttcattatcgccgtttcactcttttctggcggttcattattatgcgcactttctcctaaccttgcttttttggtaatttcgcgggttatacaaggaataggtggtgcaatgatgatgccggttgctcgtcttgctttattaagagcttatcctcgtagcgaactccttcccattcttaactttgtcaccatgccgggacttgtggggccaattgcgggtccattattgggagggatccttgtcacctatgcttcttggcattggatatttattattaatattcctattggcttacttggtattttttacgccataaaacatatgcctaattttacgatgccaaaacgtaaatttgacttactcggttttattttctttggttttggtttagtcatgttatccgtcagcctcgatctttttggcgataaaaacatctctcgatatatccctcttgcggtgattttaggtggcttctttttactcggtctctatatcaatcacgctaaacgccaccagcaacccttaataccattaaatatattcaaaacacggactttctctgtcggtattgcgggtaatatcgcaacgcgcttaggaacaggatgcattcctttcttaatgccactgatgttacaagtaggttttggctatcctgctattatctcaggtatgatgatggcaccaatggctttgggctctatactcgccaaatcctttgtgacaaaagtcttagtgacatttagctatcgccggacactatttggaataaccattattataggtctgatgattgcacagttttccttacaatcacctgatatgtctatttattacctagtattaccactctttttattaggtgttgtcatgtcaattcaatttacttcgatgaatactatttcactcgctgacttaactgacaataatgccagttcaggcaatagtgttttagccgtcactcaacaactagcgattagttttggtattgcagtaagtgcttctatcttaaattattttgatgcagaaaatgccggctctacggtagataacttccattatacttttattactgtcggcgctattacactactctcttcatttgtcttcttattacttaataagcatgatggtgataatcttactaataagaagaaaaatgaaaactaa

SEQ ID NO: 3309 - DNA, 774 bp, Proteus mirabilis
gccgttttaggtcgtataatgcgcccccaatatgtcagagaaagcggagataacaccatgcgtccagcagacagacaagcagaccaagtacgtccgattaccattactcgccactatacaaaacatgctgaaggttctgtattagttgaatttggtgataccaaagtcttgtgtaatgccactgtagaagagggtgtacctcgttttcttaaaggacaagggcaaggctgggtgactgcagaatatggcatgcttcctcgcgccactaacagtcgtaatgctcgtgaagccgctcgcggtaaacaaactggccgcacaatggaaatccaacgtttaatcgctcgctcactacgcgccgctgtggatttaaaggccttgggtgaatttactatcacggttgattgtgatgttattcaagccgatgggggtactcgtaccgcctctatttctggtgcttgcgtcgcgttagtggatgctttaaataaaatggttacagaaggtaagctgaaaaagagccctcttaaatcaatggtagctgctgtttctgtgggtatcgttgatggtcaaccattatgcgatttggaatatgttgaagattccgcagccgaaacggatatgaatgtggtgatgatcgatgatggccgtatgattgaagtacagggtacggcagaaggtgcaccatttagtcatgaagagttacttgctttactcgcccttgcgaaagggggattagaaaagatatttgaagcgcaaaaagaggcgctgaagcaataa

SEQ ID NO: 3310 - DNA, 846 bp, Proteus mirabilis
gaatcaaggggcattattgcgcttattaaccttactctctccctatctgccaccacggagtcactgatgagtgaaagtaaacgtctttcggtcgtgatgatcagtaaaaacgttgcggatgttattgaagcatgtttagactcggtacaatgggctgatgaaattattgttttagactcagggagcgacgatgcaacttgccaattggcccgtgaaaaaggggctaaagtatttagcaacaccccatggccggggtttggtaaacagcggcaattagcacagcaatacgccacaggcgattatatttttatgattgatagtgatgagcgtattacccctgagttaaaagccagtattcaagccgtgttacaacaacctgaatcgggtgtggtttataattgtgctcgccgtaacctgtttatgggccgttttatgaaacatagtggctggtatcccgataaagtaacccgcctttatgctcgtgaacagtatcaatataacgataatttggttcatgagtcattagaaacccaaggcgcaaccattaaaactttaccaggggatctgctgcatcttacttgtcgtgatttaatcgagttccaacaaaaacagctaaaatacgctaaagcatgggcacaagagcgcaatcagcagggtaaaactacccgttatagcgctattattagccatacgctgggggcgttttttaaaacttggttactgagaatgggtattttagatggaaaacagggattaatattggcatttgttaatgcacagtatacctttaataaatacgcctcattatgggaacttagccggaaaaaccgtgaatatgaaaaataa

SEQ ID NO: 3311 - DNA, 546 bp, Proteus mirabilis
ggagggaggggcatgtctgaaatagcaacggtagctcgcccctacgccaaagcagcttttgactttgctgtggaaaaccaggctgtcgataaatggcaggttatgctggcattcaccgctgaagttgcacgcaatgagcaggtaaccgaattactttctggttctttagcatcagaaaaactggctgacatctttatcgacctttgtggcgatcaaattgatgaacatgctcagaacttaattcgtgttatggctgagaatgaccgtttatcaacattgccggaagtattgagccaatttattcaattgcgcgcagtactcgagtcaacggttgatgttgaagtcacttctgccattgagctaactaaacagcagctagctaacatttctgcagcgatggaaaaacgtctatcacgcaaagtgaagctgaattgcaaaattgataagtccgttatcgcaggcatgattatacgcgccggtgaccttgtcatcgacggtagtgttcgtggccgtttagagcgattaactgacgtcttgcagtcttaa

SEQ ID NO: 3312 - DNA, 747 bp, Proteus mirabilis
atattttttataaaaaaacaaaacacatcaaaaaatgacggctataatttgataaattactataccgccataggaggatgtatgtttaaaaaatatttattagcaatttctttattagcattatccagcggtactactttagcagctaaccctattgctaaattaaaagtcacaggaaggatcaagcctccgacttgtactatcaataatgaagagcaagaagccacaatcatctacaactttgatatcactccaggtcttttccctgaaaagggtgacttaaagttagcaggtcaatcaaaaaacattgttatttcttgtgattcaagtacttatttagcttttgttgcaacagataatagattaggaacacagagccaagaaagtgaagccttctttggtttaggtcactatcaatttaaaaataaagatgatggaaaaaatgcagaaacaaaagtaggctattacaccatcaatatcagcaatgccactgtcaaaaaagaagatggtagtaagtttgaaaaagcttatatcaaatctaacaacgccacgacatcagttcctaatacattaattcataaacaaagtgagtatggttgggctttgcctggtaagacatctgttgcaggaaaatcttttgctgctgactttgaagtcaaacccgtcattaatagccaaatgaaaaaaatcgaaggcgaagctgaattagatggcttagccactttgacatttcaatttggtatttaa

SEQ ID NO: 3313 - DNA, 648 bp, Proteus mirabilis
gaattatttatgaaaagccctaaaattgatcgattaaatgtgttggatacggcgctttctttgctggaaaaagaagggattgaaggcttaacaatgcgaaaactggcagatgcattacatataaaagccgcctctctctactggcattttgataataaacaaacgcttattgagggaatggcagatcgtatagtcagtgaagtcgctgttgattttcactatagccaagattggaaagcggatctaaaacgtctagcaacagagctaagagaagcttttttacaacatcgtgatggtgctagagtttttgccggaacctatgtgatttctgagaatgtgttacgtataaacaatacgcttattactttaattatgcagtctggtgcatctgctgagttagcgagcaatatgtcgatgaccttactctattttattttagggtgttgcattgaacagcaagctatcacgcttattgatagtgaaattttaatgcaaaaacgactcgcttttgaacaaattgtacgtgataaataccctcaaacttggcaagtaagagaaattctttttgctgatgattttgccatgcgttttaattttggcttagagcaattagtcacagggtttgaacaccaattgatgacaccatga

SEQ ID NO: 3314 - DNA, 1062 bp, Proteus mirabilis
tcgcggtttatgaaaatttttgtggtagggccttcttgggttggggatatgatgatgtcccaaagcctatatcgtacattaaaagcgttacatcctgcggcaactattgatgtgatggcacccgcttggtgtcgtccattattagagaaaatgcccgaggtcgataatgccattgctatgcctttaggtcacggtgccttagcaattggtgagcgtcgccgcttaggtaaacaactaaaagccaaaggttatactcatgcttatgttttacctaactcatttaaatccgctttagtgccgttctttgccgctattcctaaacgtactggctggcgaggagaaatgcgttatggattattaaatgatttacgcccgttggataaagctgcatttcccttaatggtagagcgttatgtcgcgctagcttacgataaacagcaggtacattcagccgctgatttaccaaagccgttattatggccaaaactggctgtctctgacaaagatatcactaccacacttaagcacttttcattatctacacagcgtcctgctatcggtttttgtccgggggcggaatttggtcctgctaaacgctggcctcattaccactacgcgacattagcccagaaacttattagcgaatatggctatcagattttcttattcggttcacaaaaagataagcctgcaggggaagagatcaaacacgccttaacccccgatgcccaagctgcttgtattaatctggccggtgagacttctcttgagcaagccgttaacctcattgccgcttgtaaagccgtggtgagtaacgattctggcttaatgcatgtcgccgcagcattagagcgtccattagttgccctttatggcccaagtagtcccgactttacccccccgttatccgataaagctcgtgttattcgtttaattactggctatcacaaagtgcgtaaaggcgatgctgaacaaggttatcaccaaagcttaatcgacattcaaccggaacaagtctttagcgaactcgagcaattactcgctacggagccatcgctatga

SEQ ID NO: 3315 - DNA, 546 bp, Proteus mirabilis
tttttacttatatttatatcaaagcgttatatcattttaggagattttatgactagaaaagtattttttagttttcattatcaacctgataattggagagtatctcaggtaagaaatattggtgtaattgaagggaaccaaccagcgaaagataatgattgggagacagtagtcggtggcggtgatacacaaataaaaaaatggatatctgctcaaatggaagggagaacttgtacagttattctcgcaggtcaggatacagctaatcgaaaatggattaattatgagattactcaatcttgggatgaaggaaaaggtgttgtagtaatttatattcataatttaaaaaatgcacaaggtgaacaatcaaataaaggagaaaaccctttagattttataaggcatagagatacagggaaaaaactatccgagattgcaaaagcgtatgatcctccatatttaactagcaaatttgtatatgagtatattgaaaaaaatattgacaaatggattgaagaagccataaaaattaggaaagaaaattaa

SEQ ID NO: 3316 - DNA, 873 bp, Proteus mirabilis
gaccctattatgatccgtagtatgaccgctttcgctcgtcgagatatcaaaaaagagtggggtagcgccgcatgggaactgcgttccgttaatcaacgttaccttgaaacatatatccgtttacctgagcaattacgtagtttagagcctgttattcgtgaacgtctacgtaatcgcttaacacgcggtaaaatagaatgtaacttgcgttttgaactcaatgctcactcacaaggtgaactgactttggatgaaaatttagcaaggcaactgattgtttctgctaactgggtaaaaagccaaagccatgaaggtactatcagcccatttgatattttacgttggcctggggttatctcagcccaagagcaagatttagatgccattggtagcgaactattagcagagcttgatgtagctatcgatgcctttattgcaagtcgagaagctgaaggccaagcactcaaaacgctgattgagcaacgtttagatgccgtaagtgctgaggtcgtaaaagtaagagcacagatgccagaaattctccaatggcaacgtgagcgcttaaccagcaaattagaagaagcacaagttcaagtcgataataatcgtttagagcaagaattagtgatgttagcgcaacgcttagatgtcgctgaagagcttgatagattagatgcccacgttaaagaaacacgcaaaattctcagtaaaaaagaggctgtcggtcgtcgccttgattttatgatgcaggagtttaatcgtgaatccaatacactagcatccaaatcaattaatacggatgtcaccaattccgctattgaattaaaagtattaattgaacagatgcgtgagcagatccagaatattgagtaa

SEQ ID NO: 3317 - DNA, 468 bp, Proteus mirabilis
ccaaacattatgatgaaaaaaattgacgttaaaatccttgatccacgaattggacaagagtatccactccctgcgtatgcaacaacaggctctgctggtttagatttacgtgcttgccttgatgctccactggtattagcaccaggacaaactgagctgttacctacaggtcttgctgtacatattgctgatgaagggttagcggcaatggtgcttcctcgctcaggcctaggtcataaacatggggtggtactcggtaacttagtgggattaattgattctgattatcaaggtcaactgatggtatcggtatggaatcgtggtcaacaagcgttcactattgaacccggcgaacgtattgcccagatggttatcgtacctgttgttcaagcagaatttaatattgtagaagattttacggcaacagagcgtggtacaggcggttttggacactctggtcgccaataa

SEQ ID NO: 3318 - DNA, 417 bp, Proteus mirabilis
attaaggttattaaaatgagatatattgataatttatcgttagcgaatttatataaagaagcagaaaaatcagaacgattacgtgcgcacttactattacatcaatctcataaagataaagtacaacgactccttattgctttagtgaaaggcagttatgttgaaccccattatcatgaactacctcatcaatgggaaatgtttgttattttagaaggaacaatagaagttgctttgtatgaccatatgggtgagataatagaaagcttcttagctggagaaaatactgatacttccattgttaatttagaaccaaacgaagtacatagtataaaatgtctctctgaaaaggcattaatgctggaagtaaaagaaggtccttttgacgcaaattatgctaaaaaattcttaaattaa

SEQ ID NO: 3319 - DNA, 447 bp, Proteus mirabilis
ttgcatcctatgctgcaagaagtaatgcaattttttagccggcacaccctgttaagttttatctggattgcgctgctggtggcggtcattgtattgacctttaaaggccttttttctaaaacgaaaaatatttcccgtacagaagcgatttctttgataaacaaagagaatgcggtttgtgttgatatccgtagccgtgatgagttccgtaaaggacacatcatcgattctatcaatttaacgccttctgagatcaaaagtaacaatattgctgagctggagaaatataaatcacagccggtgattgtggtatcaccatcaggtattgagggtgcaaaacctgctgaaagccttatcaaattaggttttgaaaaagtctttattttaaaagatggtctttcaggttggagtggtgagaatttgccactggcaaaaggtaaaaagtaa

SEQ ID NO: 3320 - DNA, 1269 bp, Proteus mirabilis
gcttttaatattttgaacaagcaaattttacacaatgctatttggatgatgtctgaaaaagcagtttctattataggactatttttagtaacctcttatgttgctagatatgttggtccagaaacctttggcattatagctttagctacagcaatatttcaagttgttcaaattattgcacaattaggcaatgataatatcatttttaaaagagtttcaaaaaacaaacaatcaggaattaaattaataaaatccactttttttatacgtagctttatttacataaccataacaataccattacttatctacttttactcttataaagataatttcacatttttattttctctcgccatttcaattgcatgttacttctcatcaatagatgtttattcaatctataataatgcaattcttaaatcaaagaaaaatacaatatctaatatagttggattgagtttaggtttaagtcttcagtttataattgctcataataaatacaacccgatctatttatctataccaattatcataactacttttattccatttttagtcagatttatttcttttcataaaatgaaaattgtaaaacaaacgactgtcaataaaaaaataaaatataatagatatatactgagttctgggctatcaattgtattttcttctttatctattgctatttacactagaataaatcagtttatgatttcttatctagatggtgaatatagtttaggaatttattcagttgcgataatattatcaagttcatgggctttcgttttaacttctttaataagttcaacgctaccatctatatttggtgaaaaagatgacaatagagctataaaaataggtataaaattaaatattattataattgtaatatcactatttgtgctttcttttattcttttgtttggtgagtttttcatcaatttgctttttggagaaaaatatattcctgcttattccttattaaaaattttatgtatttcaacaatgtttgcaaatctaggaaccttatcagctcgatttatcatacgttcctcaggatattcttttctttcaaaaaaaatgttcatcatggttttgttgagtatacctatttcttattatcttataaaaagctatggtttaataggcgcagcatatagcgtattaataatagagtttctatcgctaacattaatgaactattttttcaaaaataagattatatggaaactccatatagcaacattaaaaatgaatttcaaatga

SEQ ID NO: 3321 - DNA, 1035 bp, Proteus mirabilis
ggttctaatatgaaagcattgtcaaaattaaaagcacaacccggtatctggatgaccgatgtacccgtacctgagcttggtcataacgatgtgatgatcaagatccgtaaaactgccatttgtggtacagatgttcatatttataactgggatgagtggtcacaaaaaaccataccggttcccatggtggtcggccatgaatatattggtgagattgttgctattggccaagaggttaaaggttttaatattggtgatcgcgtctcgggggaagggcatattacttgcggtcattgtcgtaattgccgtggtgggcgtacacacttatgccgtaataccattggtgttggcgtaaatcgtcccggttgttttgcggaatatctggttattcccgcttttaatgcatttaaaattcctgacaatattccggatgaactggcggctatttttgatccctttggtaacgcagtacacacggcgttatcttttgatttagtgggggaagatgtactggtttcaggtgcgggacccattggtattatggcggctgcaatctgtaaacatgtgggggcacgccatgtggtgatcaccgatgttaatgaataccgccttgatctggctaaaaaaatgggtgtcacccgtgcagtcaatgttagtaaggaaaatctaacagatgtgatgaaagaattaggtatgaccgaaggctttgatgttggattagaaatgtccggtgcgccaccggcttttcgcaccatgcttagtacgatgaatcatggtggtcgtattgctttactgggtattcctccctcagatatggctattgattgggggaaagtcatttttaaaggattatttattaaaggtatttatggtcgtgagatgtttgaaacatggtataagatggcggcgttgatccagtcgggtcttgatctctcaccgattattactcatcaatttcctatcgatgaattccaaaaaggctttgatattatgcgttcaggtcaatcgggcaaagtaattttagattggcagtag

SEQ ID NO: 3322 - DNA, 921 bp, Proteus mirabilis
gagactgatatgtattatggttttgatatgggcggcacaaaaatcgagctcgccgtttttgataaagatcttactcaagtatggcaaaaacgtgtaccaacgccaaagaatgattatcaagctctattaaatgtttttaaaacactcactttagaagctgataatgatttaggctgtaaaggaaaaataggtatcggtgttcctggcatcgtcaacgcaaaagaaggaactgtatttaccaccaacgtgcctgctgccaaatataaaccgatgatccacgatctggctaatattcttgaacgccccgtcaaagttgagaatgatgctaactgttttgccttatcagaagcatgggatcctgaatttcgtcattatccttcagtactgggtttaatattaggtacgggtgttggcggtggttttgtcattgatggcaaagtactctctggtaaaaatggtattgccggtgaaataggtcacatgaatcttaatgtagatgctgataatgtgattggtgagaccatgccaaaaatattgtgtggttgtggtagaaaagcctgctttgagacttatttatctggtcgtggttttgaacgtatgtataaagcctttaatggctcaccacaaagagcggtagatatcgttgcacaatattatcaaggtgatgaacagacccaacagcatgttgaccgctatatgaaagtattagccatttaccttagcaatattctgactgtacttgacccacatttaattgtcattggtggcggtttatcgcaatttgacgcactgtataccctattacccgattatctctcacattgcgtatacggtaatacgcaaattccaacaatagaaaaagcacgttatggtgatgcgggtggagcaagaggtgctgcctgcttaaatttattagactga

SEQ ID NO: 3323 - DNA, 615 bp, Proteus mirabilis
aagcaatgtatgatgaggagagaccccatgcaggtcagcagaagacagttctttaagatctgtgctggcggtatggcaggtactacagcggctgccttaggttttgcacccgctgttgcgttagcaggctcacgtcagtataaattactgcgtgcccgtgaaactcgcaatacctgtacgtactgttctgtcggttgtggactattaatgtatagtctgggcgatggcgcgaaaaacgcaaaagaaaccatattccatattgaaggtgatcctgaccacccagtaaaccgtggtgcactttgtcctaaaggtgctggtctcgttgattttatccatagtaaaggccgtttacaatatcctgaatatcgtgctcccggctcagataaatgggtaaaactttcatgggaagagacctttgatcgtatcgcacgcttaatgaaaaaagatcgcgatgccaacttcgaaaaattcaataaagaaggtgttgaagtaaaccgttggttatcaacggggatgctttgtgcctccgcagcaagtaacgaaacaggctttttgacccagaaattctcaagagcacttgggatgctggctgtcgacaaccaagcgcgtgtctga

SEQ ID NO: 3324 - DNA, 1170 bp, Proteus mirabilis
gaaaaatgtatgaatcatgtatatcagcttgtattgttaggtgataaagaaaaatatgaaaaaccaattgttaattggttattaatacaaactaaaattcttggtatacaaaatgaatttattaaagttattaacagattaaactttaatgagtatctaccaaataatcccacctacggcctctattttggaagtgaaaatacttccctcgatcaaaatattcttaatactttaatagatgatgctactcttatcttacccattattcctgatttaagcttggcgaatcattatcttcccaaagaattacatcctattaatgccatagccatgaaatctataaatgatattcccaccataacaagtgcaattttagaaggttttgaactattgcgtcaatctagaaaactatttattagctataaacgttcagaatctagcactgtagcaatacaactctatgaagtactagaaaaatttggatttgatgtattcttagatactcatagtatcagaccaggagaaccctttcaggaagaactttggcacagaatgactgatagtgatattgttattttgcttaatactcctgactttcttggtagccaatggacacaagaagaactagctaaagcaagtgcaatgagcttaggtattattcagatcatatggcctgattgtactcctttacgtgagtcagagctttttagaactattaaactacaacgagaatctattaataaccaaggacatctttctgaatttattattaaacagttaatctctgagacagaaagtctgcgtgcaagaacattggctgcgaggcaagataatttaacaaccgaatttatagatatatcccataaattaggggttaaatctatattacatacagataaatttattacattttcaatcaatgatagaaattatgttgttattcccactgtaggcgttccacaatcatttacaagtaataatatttatactttaagacaaaaaatttgcaaagataaaattgaagaaatatatcttttatatgatcacacccatatcaggaaaaaatggttagctcatctaagttggttagatgagtatcttcctgtaaaaacgctacgattacttaatatacaacctttcatagaaaatcaagagattaaaaatggataa

SEQ ID NO: 3325 - DNA, 1416 bp, Proteus mirabilis
ggtgaatgtatggaaaagagtaaaaaaataaaatgggctatgcctgatgcctttattattatttttggcatcgttattttagcggccatcgccacctatttgatccccgcgggaagttatcagcgggaaaccgttaatggattaaaccgcgttgtccctaatagctttaattatgttgcacaaaatccagcttcattgatggatgtgttttatgcaatccctgtagggttaaaacaatctgccagtattattttcttgatctttatgattggtggcgcgattgccatttatgatcgcacccgtgctattgattcaggtattaatgcgcttattgttaaaaccaaaggtaattatcaagctcttattattacggttgcttttatttttggtatgttgtcatcccttgggcttgcggccaatgccgttattgcgtttatccctataggaatagccctttcgcgatcaatgaaacttgatgctattacgggggttgcagttgtttatttaggctattatgcaggtaatgcggttggtgtattagatccaactattttaggtactgcacaaacattagctgaagttcctcttttttctggtgttatttttcgagttgtattattcgctatcttaattgttgtcactattgcttatattgtctggtatgccagacgtattgcgaatgatccaacgaccagttatatgtatggaatagctaaagatgatcctgattatgaacagccacacactcaatcattagatagcaccttctcattgaggcaaaaattgagtttggtggtatttatagcgtttattggattgtttttatatggcgcttttgaatataaatgggggattgaacatctatcagccatttttattatgatgagcattgttgtggcggctatgtttaaaattgcccctaatgactatatcaaaacctttatgaaaggtgctcaatctttagtgtatggggcattggtggtggggatcgccagagcggttattgttattttagatgaaggacgagtgcttgattctattgtacaagccacattagtgccattacagcaaacctctcacttttggggcgctcaattactttatttctttaatttactatttaacttgctagtcacatcaggaacgggacaagcatcgattgttatgcctattatggtgcctattctcgatattcttgatcttacacgtcaaaccggtgtccttattttaaaactcggtgatggctttaccaatattattaccccaacatcaggtgtacttatggcggtactggcggtaggtaaagtgccgtggacgcgttgggttaaatttgtattccctattttaatgatttgggtcgtgataggtatggctgcaattggtattgctaccgcaataagttatggaccagtgtag

SEQ ID NO: 3326 - DNA, 936 bp, Proteus mirabilis
ggaaatatcatggaagcgaagaaattagtgattttaggtagtgttaatgtcgatcatattcttaatgttgctcactttccgcatcctggtgaaactatttccggtaatcagtatcagatggtttttgggggtaaaggtgcaaatcaagccgtcgctgcagggcgttgtggtgctaatattacctttttagcttgtcttggaaatgacgatattggtcaaagtgctaaagctcagctgatcacagataaaatagatacagattgtattgaattaattgatgatgaagccacgggtgttgcgttgatttttgttaatcagcaaggtgaaaacgttattggtatacacgctggagccaatggaaggttaaacagagaatatgttgaacgttataactcggtgattaaaaaagcagatgctttacttatgcaattagaatcacctctagattctgtattaaaagcggctcaagtcgctaaacaagaaagtgtgcaagtcatattaaacccagcaccagcacaggctttgccggatgaattattatctctcgttgatatcattacacctaatgaaacagaaactgaatacctcacgggggtaaaagttattgatgatgaaagtgctcaacgtgcatctaatatattacatgataaagggatagaaaccgttttaattactttgggtagccgtggtgtttgggttagtcaaaacaatcaaggaacgatggttccagcatttaaagtgaccgcaatagatactattgctgcaggagatacgtttaatggcgcttttataacggctttattagaaggtttaccaatgatgaaggcgattaaatttgcgcatgcagccgccgctatcgctgttactcgtgcaggagcacaaccgtcagtaccttggcgccatgaaattgaagcttttttgtcgcagcatgactag

SEQ ID NO: 3327 - DNA, 1908 bp, Proteus mirabilis
ggttcacacatgttttatccagaacattttgacgtcattgtcatcggtggtggtcacgccggtacagaagccgctatggctgcagctcgtatggggcgtcaaaccctattactgacccacaatattgatactttgggccaaatgtcttgtaacccagctattggtgggattggtaaagggcatctggtaaaagagatcgatgccatgggtggattaatggccacagccatcgaccatgctggtattcaatttagaacccttaatgcaagtaaagggccagcagtaagagcaacaagagcacaagccgatcgcgtactttatcgccaagctattcgcacaacccttgaaaatcagcctaatttaatgatcttccaacaacccgttgaagatctcattgttgaaaatgaccaagtaacgggtgcagtcactcgtatgggattaaaattccgtgctaaagcggtagttttaaccgtaggaactttccttgatggaaaaatccacattggtttagaaaattacagtggtggccgagcaggtgatccaccatcagtctctttatcacatcgattaagagaattacctttacgtgtaggtcgcttaaaaacaggtacaccacctcgtattgatgcaagaactatcgattttagtcaattagcgccacagttaggcgataatccaatgcctgttttctcatttttaggtaatgtggatcaacatcctgaacagatgccttgccatattactcatactaatgagcaaacacatgaaataattcgtaataaccttgatcgcagtcctatgtatgcaggggttattgaaggtatcggccctcgttattgtccatcaattgaagataaagtgatgcgatttgctgatcgcaattcacaccaaatctttttagagcctgaaggcttaacaagcaatgaaatttaccctaatggtatttcaacaagcttaccttttgatgttcaaatgcaaatagtaaattccatgaaaggtatggaaaatgccaagatcatccgacctggttatgcgatagagtatgacttttttgatccccgtgatcttaaacaaacactcgaaagtaagtttatcaatggactattctttgctggccaaattaatggcactaccggttatgaagaagcagcagcgcaaggtctattagcaggtcttaatgcggcacgttatgcttttgatcaagaaggttggttccctcgtcgtgatcaagcctacattggtgtattagttgatgatctttgtaccttaggtacgaaagagccataccgaatgtttacttcacgtgctgaatatcgcttaatgttacgtgaagacaatgctgatttacgtttaactgaaattggtcgtgaacttggtatggttgatgacaaccgttgggcgcaatttagtgaaaaagtcgaattagttgaaaaagagcgtcaacgtttaagagatatttgggttcatccaaaagcggataacctagaagaaatcaatcaattacttaaaacgccactgtctaaagaggcgaatggggaagacttattacgtcgtcctgaaatgacctatgagattttgaaaaagatccctcgttttgctcctggtattgatgattcgagaccacaagcggcagagcaagttgagatccaagtaaaatacgaaggttatatcaatcgtcaacaagaagagattgaaaaacaactgcgtaatgaaagtgctgtattgcctattgatatcgactacaaacaggtgagtggattatcaaatgaagtcattgccaaactaaacgatcacaaaccaacttcaataggtcaggcatcgcggatctccggtgtgacacctgcagctatctcaattttacttgtttggttaaaaaaacaaggtttattacgccggagtgcatcatga

SEQ ID NO: 3328 - DNA, 270 bp, Proteus mirabilis
cgtgtagacattaacaatgataaaaaaatcattgttaataatcgtttttttgattttttagagccaataataaataacagcagaatattaattataccaaatatatattgttgtttagcactcattggcataacaataagcgaaaacattgttattaataaaaaagctgttattaatagtttaaataatttatgcataaccccgtaccttgccattgctattattttattttttaagaaaaaattcattcttggtacgatagaccaataa

SEQ ID NO: 3329 - DNA, 1020 bp, Proteus mirabilis
gaaaatcgcatgatgttaaaaaaactgatacttgccaccagcttattattctctgcgggaacggtctttgcagcgactgaaattacggtatacaccgcaatagaaagtgaacaattacaagcttataaacaagcatttgaggctaaatatcctgatataaaaataaaatgggtaagagattcaacggggattatcaccgctaaattattagcagaaaaagatcgtcctcaagccgatgttgtgtggggattagctgcatcaagtttagcaatattaaaagcgcaaaatatgcttgagccttatgctccggcgcagttagatgatattgatgtgaaatttcgtgatagcaacaacccgccaacttgggttggtatggatgtctgggcggcaacgatttgctacaacacgatagaagcacaaaaattggggttatctaaacccacttcttggcaagatctcactaagcctgaatacaaaggcaaaatcgttatgccaaatccggcatcatcaggcactggatttttagatgtaagtgcttggttacaaatatttggtgaacaagaggggtgggcatatatggacaagttgcatcagaatattggtcaatatgttcattctggctccaaaccctgcaaaatggctgcatcgggggaatacccgataggcatatcctttgaatatccggcgctccaattgaaacgacaaggggcgccactagacatcatattaccgcaagaaggattgggttgggatattgaagcaacggcgataatcaaaggaactaataagcgagatgccgcgcaaaaattggctgatttttccgcctcaaaggaagcgatgaagctttatagtgctaattttgctgtattagctaataccagtgtacccgtaagccaaacagaattacctcgcgattatgctcaacgtttaattaaaaatgattttatttgggcagctgaaaagcgcgacaccattttaactgaatggcgtaagcgctatgacggtaagagtgcaaaataa

SEQ ID NO: 3330 - DNA, 528 bp, Proteus mirabilis
ctatatttaattatattattatttatgctcaatatcgtcttatttgaacccgaaattccaccgaatacgggtaatattatccgcctgtgtgccaacacaggctttcatcttcatttgatccaaccattgggttttacttgggatgataaacggctacgccgtgcggggcttgattatcgtgagtttgctgatatcaaacagcatcacgattattatgcttttttagaaagtgaaggattaagccctgataatgcacaatcaccgacaggtgcgcggttgtttgcattaaccactaaaggtacccccgcccatagtaatgtaagttatcaagatggggattatctgctatttggccctgagacacgaggtttaccaccttatgtgttggataatatgccaacacaacaaaaaatccgtgtgccaatgttagcggatagtcgcagtatgaatctttctaatacggttgccgtggttgtttttgaggcatggcgccaattaggctatccgggtgcattattaagagattaa

SEQ ID NO: 3331 - DNA, 1023 bp, Proteus mirabilis
agaagcttaatgaacgcttctatgacagttatcggtgccggttcatacggcaccgctttagcgattaccttagcgcgtaatgggcacgatgttgtgctgtgggggcatgatcccaagcacgttgcggcattagaacaagcgcgctgtaatcaagcctttctgcctgatgtttcctttcctgatagtttatatatggaagcttctttgcaaaaagcgattgaagcgagccgtaatattcttgtggtgatcccaagccatgtgtttggtgaagtactgcaacaaatcaaaccctttttacgtcaggatgcgcgtgttgtttgggcgacaaaaggtcttgaagcacatactggtcgcttattacaagatgttgcccgtgaagtattaggtaatgaaatcccgctcgcagtattatctggccctacttttgctaaagagcttgccgcgggtttgcccaccgcgattgcagtggcctcgacggataatctctttttagagcagttacaacagctatttcattgtggtaaaagtttccgagtctataaaaaccctgattttatcggtgtgcaactgggtggcgctgttaaaaacgtgattgctattggtgcgggtatgtctgatggtatgggatttggcgctaatgcgcgtaccgcactgattacccgaggtctagccgaaatgagccgtttaggtaaagccttaggtgcagatgcggcaacttttatgggcatggctggtttgggtgatttagttttaacctgtactgacaaccaatcacgtaatcgtcgcttcggtatgatgctaggtcaaggtttagatgttgatacagcccaagagaaaattggccaggtagtcgaaggttatcgtaacaccaaagaagttcgcgcattagccgaacaggtgggtgtagaaatgccaatcaccgaacagatctaccaaattttatatcaacataaagatgtaaaagaggctgcattggctttattagggcgagcaaccaaagatgagatagacagcagcctgtag

SEQ ID NO: 3332 - DNA, 843 bp, Proteus mirabilis
tcttatgtaataaataataaggaagttattatgaaaaaaataaacatttttacgggtactctatttgttttatctagcataagtatggcacaagcagaaatccattctaatcaaagtggccctttaaccaccatgagtgtgggggcgagtgatcccgtgactcgaggccctcatcaatcagcaggtggggagccgggtgtcggtatttctaatctatatggagggaaaaaaattggttttgcgtcattaacaccaaataatatgagtggtggggcggatagccatggtgtttatacaatacaacccaatgaaaatacaccagctagccatagtaatatgggggtatttcatttttcacaggtgactgatgccaatgtctattttggtacttgggcaaaaacagcctctgttacagatatcactcatcagtcttattatgtaggtaaagaggttactagtacgctaccgacagacagtgcaacttataccgtaacaggtatcagtcaatatagtggtgataatttactgtctggtacttttgatgttgatttttcacaaaagacaattggtggctcactggctaataacctacgtactgtcgagttagaacgtggcaatatttataccgcaaataaccaagtaactttctctgcagatgcaaaagaagataccacatccggtattgttgaaggggcgttctttggtgaaaatgctgaaacattggcaggtattgtcgtcttccacaccgatcatactaaagatattggttttgggggaagcaaaaatagtgctgaagtagatactgcaacagatagcgtaacagatagtgcagaagcctcttaa

SEQ ID NO: 3333 - DNA, 459 bp, Proteus mirabilis
atgagcacaatatcgatggcagtttccgttcaacttattgagcaagagcattatgctcaatggttagcatattggttaagttatcaggaattttataacgttgaattatcagaagagataacattaaaaacatgggcgcgcttttttgatgagaaagagccgatttactgtgctgttgcaacagatggcaaaaaaataatgggttttgttcattatctttttcatcgttcaacttgggctgaaagtgatttttgttacctcgaagatttgtttgtttcaccagaagctcgtggttgtcatgtggggaaaaaattaatcgattttgtaaatcaacaggctaaacagcgtaattgtgctcgtttgtactggcatacacaggaaaccaatttacggggtcaacgtctgtatgattgggtggctgaaaaaccaggtgtaattgaataccgtatggcgttgtaa

SEQ ID NO: 3334 - DNA, 1101 bp, Proteus mirabilis
tattataaaattatgaagagaatattaatcataacaaattattattttccagcaaaaaaagctggtggacctgttaaaagtattaaaaatttagtttcctttttaaaagaaaaatatagttttaatattattacatctaatcgagatttagatggtgctattcttaatactaaaaacagtgaagatatctcttatactaagaatacatatgaaattatttatttactactaaaaaaaataaataatgttgatataatttatctaaatagctttttctcattcaaatattctattttaattttagtacttaactcacttggtttatgtaaaaataaaaagattttgattgcacctagaggtgaattaagcaatggagccgttagtattaaaaaaagaaaaaaaatattttacattcgatgttttaaatattttttaaaaagaaaaaacatttcctttcattttacaactgtagaggaaaaaaacgaggctattgcaatgttaggaaatataaaacataaagtcgcccctaattgtcatgataaaattcctgcatatataaagaaaaagaaagaaagaaatgaattaaaaattatatatttatctcgtatcacacctaaaaaaaatctactcattttgagtaaaattctttctgagattaatagtaatattcagtttacaattgtaggtaatattgaagatagtagctattttaaagaatgcatgttaattttaaataaaaataaattgataacaacaaaatatattggtgcagtttcacctgaaaaaacatctacattattacaagatagccatttgtttgcattacttacattaaatgaaaattatggtcatgctattgttgaagcactaactcattcaaacttagttttattatctaataatactccttggtcaaatttatccaattataactgtggtatttttgatccagattctatcgatgagtgtaagctttatataaataaaatatttgaaatggatcaaatagaatacaatcaatatacctatagaacatatcagtatatatctaatatattatctattaatgaaaaatttatagaggaaacttttagtgattaa

SEQ ID NO: 3335 - DNA, 915 bp, Proteus mirabilis
gaggaaaaaatgagtgaattagtaattaataataatattgttaatgacttattaataaagcaatttactaattatgtatttatgatgatagtaacagatataaaaggtaatattatctacgctaataaaaaatactgccaatttaatcatattaattttgaaagtataaaaaataaaagatataacttgttttatttagttgatgaaaatcaagatgtgttttctaacattagtgataataaagaggtaataagattagaggcaaaacacccaaataaaaataaacaagaagtatgggaagatattaatatcgttccaatttttgataaaaataatctaatttctcattatgcatttttaagtttagatatcacggataaagtaaagttaagaaatgatttattaactaaaagctatattgactctttaactggaatggctaaccgtctaagtattattgagaaaattgaacaggagcgattaaatattgcgacaccttcatctttttgtcttgggattattgattgtgataaattcaaaacgattaatgatcaatatggccatgctattggtgatcatgttttatgtgagatagcgcagcgtttattagccttagaacgccagcaggtttactgtggacgacttggtggcgatgaatttgcggtacttttccctgctggattacgttcttgctctttattgttattggagatcatcgaatcgctatggcgaggaatggaaaaaccgataaaaatcaataaagaaaaaacaattgttccttctattagcttaggtattgctgaataccctaaggatggcaagacattatctgaactattaaagtcagcagataaacagctttatgcaataaaagagaaaggaggaaataaatacggtttttattcagagtattaa

SEQ ID NO: 3336 - DNA, 228 bp, Proteus mirabilis
gcatcagaaatggcacgctgttatagcgttattttacggaataacaccctagttttctggcatcataatagtaataaaaaggagtatttatgttggctagagccttgtttatccctctttcattccctttactcgccttatcttgctattgttgggcaggaaatggtctggtggatagaacatggacagcttcaggaatggatagctatagttatcgccaagcgctaa

SEQ ID NO: 3337 - DNA, 2442 bp, Proteus mirabilis
accataggaataaagcgagaaacgttgatgtcgaatacatatgactcctcaagtatcaaagtattaaaagggctggatgcggtgcgtaagcgcccggggatgtatatcggggatacagatgatggaaccggtctgcatcacatggtcttcgaggtggtcgacaacgctatcgacgaagccctcgcgggttactgtgatgagattattgtcactatccattcagataactcagtctctgttcgcgatgatggccgtggtattccaacgggtattcatgaagaagagggcgtttctgcagcagaagtgattatgacggttctgcatgcgggtggtaaattcgatgataactcctataaagtctctggtgggctgcatggtgtaggggtttccgttgttaatgcgttgtctgaaaaacttgaactgactatccatcgtgatggtaaaattcatcaacaaatttaccgttcaggtgtacctgacgatcgcttaaaagtgattggtgaaacagataagtcaggaacctttgttcgtttctggccaagtcttgatacctttaaaggtgagactgaattccaatatgatattttagcgaaacgtctgcgtgagctctccttcttaaactcaggagtctctattcgtttaattgataaacgtgataaccgcgaagatcatttccactatgaaggtggtatcaaagcattcgttgaatacttaagccgtaataaaacgcctattcaccaaaatgtattctatttttctacagagaaagatggcattggtgttgaagtggcgatgctgtggaatgatggtttccaagaaaacgtttattgctttaccaataatattccacaacgtgatggtggtactcacttagttggtttccgtaccgcgatgactcgtacgctaaacaactatatggataaagaaggctttaataagaaatcgaaaatcagtgcaacgggtgatgatgctcgtgaaggcctgattgcggttatttctgttaaagtacctgatccgaaattctcatcacaaacgaaagataaactggtttcttctgaagttaaaacagcggtagaaacgctgatgaatgagaagctggtggaatatctattagaaaatccgactgacgcaaaaattgttgttggtaaaattattgatgccgctcgtgcccgtgaagctgcgcgtaaagcacgtgagatgacgcgtcgtaaaggcgcactcgatttaggtggtttaccgggtaaattagcggactgctctgagcgtgatcctgctttttctgaactctacttagtggaaggggactctgcgggtggctcggcaaaacaagggcgtaaccgtaaaacgcaagcgattttaccgttaaaaggtaagatcttaaacgttgagaaagcgcgttttgataagatgctggcatctcaagaagtggcaacgcttatcacggcattaggttgtggtattggccgtgatgaatataacccagataaactgcgttatcacagcattattatcatgacggatgcggacgtcgatggttctcacattcgtacattattactgacgttcttctatcgccaaatgccagaaattatcgaacgtggtcatatctttattgctcagccacctctctataaagtgaaaaaagggaaacaagagcaatacattaaagatgatgatgcgatggatgaatatctgatgtctattgcgcttgatggtgcagcgctttacgtcagtgaacatgcccctgctatgcatggtgcacaattagaaaaactggttgttgactaccatgctgcgcataaaattattcgtcgtatggagcgtctctatccactgagtatgttaaatagcttggtctatcactcaacgctgacagaagatgatctctctgataaagcgaaagtggaagagtggatgagtggcttggtaaaccgtttaaataatgcggaagagcaaagcagtacttacagctataccatcacacaaaacgaagaaaatcgtttatttgagccagtattacgcattcgtacttacggtatcgatacagactataaattggattacgattttattcatagtagtgaatatcaacgtattactaatttgggcgatattattggtaacctgattgaagaaggggcctatattgagcgtggagaacgtcttcaggcgatttcaagctttgaagaagccatagaatggttaaccaaagaatcacgtcgtggtcttgctgtacagcgttataaaggtcttggtgaaatgaacccagaacaattatgggaaaccaccatgaacccagatacacgtcgtatgatgcaagtcactgtgaaagatgcgattgcgaccgatgagttattcacaaccttaatgggtgatgctgttgaacctcgtcgtgcttttatcgaagaaaatgcactaaaagcagaaaatatcgatatctaa

SEQ ID NO: 3338 - DNA, 1275 bp, Proteus mirabilis
cttattatgatgttgtttaaagacgatagtaaaaaatctttatggaatttatccattattggactttacattatattgatctacttacccgatatcactcgctataaaaatatagtgatggggctaattggtgcaacggcactttggtatctggtgcgtgattttcgcactattggtcagatttttaaaaataatctcgcctatgcgctgttttttttattgctcgccattggctattcagtggtgatttccgtagagccagtactgagtctaaaggagatgaataagccgattttaaatggcttactgctctttgctattgcgtttcccattgtattgtataaagaaacacctacggcaattgcgaagatggtgatggtgtcattcgccatgggtttattggtgattatggcaaaggagttggtgcagtattatttggaatatcagcaaaatattttgccttttacaagaaaaagtcagttggcgcatagagaaatctcttatgctctgctatttttctttcctattatattggccttatgggcattgaaaaaaaatcattcgataattaattggcttttattaagtgtggttagcctattatttttatttgcaatcttagggacattagcacgcggggcttgggtcgcattggcgattagtacattacttatcttaatcattaatcgccagtgggtgctgatattaatcagtatattagcctgtgttttattatttataagtattactaatttacctccaaacccagttgtcagtaaattctttcaatataaattaacccaaaccaatagcggactaagatttgatggaggcacccaaggctcagccttagatttgatcttagaacaacctattaaaggctatggttatggtaatcagctttaccataatgtttataatcagcaagtaaaacagcataaaaactgggtctttaaaaaatccattggtccccataatgtatttttagctttctggtttgccggcggtattttggggttaataagtctactctatttttgcgcgtcttttatcgctcagggtattcaactgatccgcaaaaatcaggggattattcgccaagcgtcactggtgttattaatgtcgtttttaggggtttatgtactacgtggattatttgaaaatgcctatattaatcaagtgggtattttattagggttaatgttagcattgcgctattcattattaaatcagccctcagcgacaccaacccaagaagataaatccgttagctaa

SEQ ID NO: 3339 - DNA, 264 bp, Proteus mirabilis
aagatgatgatcataattaatgcctatcaactcagtgtgcatctaaaagatgtccgattaacaaaaaaactgtctcaaagtaaagtcgcccaaaaagtagggatccgacaagataccgtgtccaattttgaacttaatcctaattccaccaaactagaaacctttttcaaactgctctccgcactaaatttagagatggaaattcatcctaaagatgctaaaaataatttagcacacaaaagtgaatggaaagaggagtggtaa

SEQ ID NO: 3340 - DNA, 1512 bp, Proteus mirabilis
ttaggagcctttatgcaacttgcagaacggatctcacaacttagccaataccttgaaactgggctttatgaacgtcaatcagcgatacggctttgcttactcgcggctttaagtggagaaagcgtttttttgctaggtcctccaggtattgctaaaagcttaattgcgagaagaatgaaagaggcatttaaacacgctaaagcgtttgaatatttaatgacccgtttttcaacacctgaagaaatttttggtccactatccattcaagcattaaaagatgaaggaaaataccaacgtttaaccgaaggttatttacctgacgccgaaattgtttttcttgatgaaatatggaaagccggtcccgctattttgaataccttattaacggcaattaatgaacgtaaatttcgcaatggcgaaaacgaagtaagtattcccatgcgtttgttagtttcggcttctaatgaactacctgattcagacagcagtcttgaagcgctttatgatcgaatgctgattagaatttggttatcaaaagtacaagataaaaaaaacttccgggcgttattagttaataaagaggtcagcgcttttcgtattcctgaacaactacaaattacaacagacgaatttttactttggcaaacagagttagaaaaaattactttgaatgaccacttattcgaattaatttatcaacttcgcgactcactcgataaaagtgatgcagcaccttatgtttcagacagacgttggaaaaaagcggttcgtctattacaggccagtgctttttttaatggtcgtagtgctatatcacctttagatcttattctgttaaaagattgcctttggcatgatcaagcttcttttgcgctgctaaatgacttattaaaaacactattaacagaacaagcataccaccagctaacacttttacagaaaatagaaaatctgtgggctgaatggatgcaatcgacaagaagcaaacaagatcaacaagcatttcgctttgaaaaacaaagtagtatgtttggtagaaatatacatttcaaattatcagaaaaaatgcagtctgataaatttacgctgtttttacatattccactgcatatacatagtattcaagttaactttataactgttgagaaaaaagcattagaaactttcttagataaaggtgatgaactctctgccagattaaatggtattggtttcccacaatctattaatgcacaaattcgtcaagatggtgtcttagaggtgttggatgttagtcgccgaacaacgtcgttataccaacagtcagaaagcatcaaaacagagcctattgaagataatcaacaatggttagataaattaaaagatctcacccaagagatttattctgaacaagaaaattttaatcatcatcaacccaatatctttattgataatgattggctcatttctatagaacaaagctttttgcaattaaatgaaaaattatctcaattaagaagtcaaataaagtga

SEQ ID NO: 3341 - DNA, 489 bp, Proteus mirabilis
aaaggtaagattattatgtcagaacagcaaaaccaagagatgacttttcaaattcaacgtatctatacaaaagatatctctttcgaagcgccaaatgccccacaagttttccaaaaagagtggcaaccagaagttaaattagatttagatacttcttctaatacgctagctgaaaatgtatatgaagttatcttacgtgtcactgttacggcaacaatggaagaagaaaccgctttcctgtgtgaagtacaacaagcaggtatctttactgttgaaggtatcgaaggtacacaattagcacattgcttaggtgcatactgcccgaacgtactattcccttatgcacgtgaatgtatcaccaacttagtaggtcgtggtactttcccacaattaaacttagcacctgttaactttgatgcgttgtttatgaactacttacagcaacaacagcaacaggatgcagcaaactcaggagttgaagaagcttaa

SEQ ID NO: 3342 - DNA, 1110 bp, Proteus mirabilis
ctcatgaagattggcttaattgatgtcacaatcacaatgtcttatggtgggatccaaaccgcagtatgggagcttgccaaacagttacatgatgcgggacatgaggtacatctttatgggggcaatggtgatgtcaggcatgaactagcaggccgacaaattcatattcatacctatccttatacaccaagagagaaagttatcgatctcggtggtcgttttcgtcgtattgttgaacgttatagttttgctcgctatgctaaacaagatgttattcgacaaaattttgattgggttattttaactaagccgtttgatttcttttggcctgcaatgatgcccaaatcttgctcgacacgtttttgttatatgagtggtggcaccagcttttttaaaggtgatcgtaaactggcgaaaaaaatctctgcttgggttgcgtgtagccattttaatgcttggcaaattcagcagcattttaaacaatttcctgcggttatctataatggtgttgatatggcaaagtttaagcctatgacaacatctttgcgccaacagctcggggtgagtgagcctacatttttattggcatttgcggggcgtgtagtcggttggaaaggcttaagtgttgctattgatgcaatagcccaattgcgagatgaagacgttaagttactgatcatcggcgcgggtgatgcgcttgaacaattaaaaaataaagcgatggtaaaaggtgttgctgaacaagttatttttcatcaacctgttgagcatgcaatgttacctgagttttatgccgcttgtgatgcgggggttttcccgagtatcggcgatgaagcatttgggatcaccattgcagaagcaatggcatgtggaaaaccggtgattgccagctatatcggcggtattcctgaggtggtaggcaatgagcaaagtgcaggattattggtaaccccaggtgatgtaaccgcgatggtgaaagccatcaaccatcttcgggcattgccggatagaggtaaagcaatgggtgaaaatgcacgccaacgcattgcttctcactatacttggcaacattcagcacaacgattactacaggcattaaaaacagaatga

SEQ ID NO: 3343 - DNA, 1704 bp, Proteus mirabilis
ggtagcgagataatgtcagtgatagtacctaccaaatctattaatcgtttagatagtttatttgttgctggtggtaagttatttattatttgcttacttattcttggggttttattgcctttattggctattttctggcgaggttttacgcctgatatatcacaaggtggtggttttcaggctgccattgatttgttcaccagtgctaattttctgtggttggtgggtaacagtattagtgtttcgctaagcgttgctgttattacggtgccactggcttacctgtttgcttatgctctacatcgcaccttgatcccttttaaatccttgtggcgtggaatatcactattacccttactcgctccttctatgctaccgggtattgcattggtttatctatttggtaaccaagggctattgcgtagcttactcacagagagtatttatggttattggggattagtgcttggtgaggtgatctacacttttcctcatgcgctaatgattttactctccgcattatccatgtctgatgctcgtttatttgatgctgcatctagcttaggggcctcttcttggcgcacttttcgtagtgtcacttggtcatcgagccgacatgggattttcgcagcattgtgcttggtatttacgttaactattactgactttggtattccggttgtcgtcggcggagattatcaagtactggcgttagaagcctataaagccgtgcttggtcagcaacaatttggccgcggtgctttaatcggtatgttgttattgctacctgcattgttgaccttcggtgtcgatgtttggttacgtaaacgtcaacgtgatgcaatgagctcgcgtgcccaattctatttaccaaaagctaattttcagcgtgacacgctttatctaatatttgtgatgcttatttgcgcgctatttttattggtattcggtacggccgtttattcctcttttattcagttctggccttataacttatcgttttcgttacgtcattataattttgaaggattgcctgggggatggctcgcctataccaacagtattattttggcattttacactgccactatcggctgctttctgatctttatgggcgcttacttaatagagaaaacggcttctcactcttggcttaacaatctgctacgtatgttaagttttgtaccgatggccgttccggggttagtgttgggattagggtatgtatttttctttaacttaccgaataatccactgaactttttatacggcagtatggtgttattagtgctgtgctccattgcacactttttcactactgcctatatgactgcgagcacggcactgcgccagttagataaagaattcgaggcagcttcattatccttaaaagcgcctttatatcgtcacttttggcgtatcactattcctctttgtttgccggcattattagatatttatcgttatctatttgtttctgctatgacaacggtttccgcggcgatcttcctttatagcccagacactattttagccgcggttgcggtattaaatatggatgatgcgggcaatattggtggcgcggcagctatgtcgacattgattttaaccacctcggcaggagtttcgatattgttatctattgcttcgcaaggtgttcttcgccgtacacaagcgtggcatcagcgtgaagctaaacaataa

SEQ ID NO: 3344 - DNA, 606 bp, Proteus mirabilis
ccaaaaaatgtattaaaatttggtgagtttacgctgaaatcaggtcgtgttagtccttacttttttaatgcaggtttatttaatactgggcgtgacttggctttattgggacagttttatgcacaaacattaatagataatcatgtgccttgtgatgtgctgtttggaccggcttataaaggtattcccatcgcgacaacgaccgcagtggccttagttgaacatcatgatatggatgtaccttactgctttaatcgtaaagaagctaaagatcatggtgaaggagggacattagtcggcagtccattaacagggaatgtggtgattgttgatgatgttattaccgctggaacggctattcgtgaatcgatggaaataatcaaacaacatgatgcgacgctgtcaggggtattgcttagtttagatagacaagaaaaagggcgtggttcgctttctgcaatacaagaattagagcgcgattatcaatgccaagtttattcaattattactttggatgatttaattagctacttaactgaaagtgagacattatcggcacatttgccagcagtaaaagcctatcgtgaacgttatggcattaattaa

SEQ ID NO: 3345 - DNA, 597 bp, Proteus mirabilis
aggcttatcgttatggatcgtctctggctaaaaagaagaatttatattctcggtggtttaactatccttcttttcttattacaaattatagggagcctcttccctgtccatcttcttcaatatggtattattccaagaagcagcgaaggtttattcggtatctttatttcaccttttattcatggctcatggtctcacctttttagtaatttattaccttttcttatacttagctttttattgatgacacagtcattacgagaatattgctattcaagtatttttatcattatcatcagtgggttattagtttggttgtttgggcgtaacgctattcatgtcggtgcaagtgggtggatctttggattatggtcactgctaattgcccatgcttttactcgccataaaattatcgatatcgtcatcgccttatttgtgctgttttattacggctctatggcttatggattaatccctgggcaattaggggtttctacagaatcacatatcgcgggcgttatctctgggttgctttatgcttggtgtgcaagaaaaatcattcgtcggaaaagccgtgtagtagaaataataaaatga

SEQ ID NO: 3346 - DNA, 474 bp, Proteus mirabilis
gagtctatcgtgagaacgctttattttactgcgctgacaacaggcattctttctgccatttgggcatttgttgctagccaatttgacttattaagttgggctggttttttaggttgcacggcttatttcgcctaccctaaagaaggttttaaaggcttagtcgtgacgattgcgactattatgagtggtgttatttgggcattagcgattatttatggtagccaactgtttaatgatagtgcgatttttggctacgccgtcaccggtgtaattgcctttgtaatgtgcgtacaagctaaaagcacattactggcttatattccgggtacttttattggcgcatgtactatttttgccgcacaaggtcatttaacacaaactatcccttcactcattctcggtattttatttggttactcgatgaaaatgagcggactgtggatcgcgaataaatcacagaagaaagccatttaa

SEQ ID NO: 3347 - DNA, 864 bp, Proteus mirabilis
acggttagcgtttttaacaacaaaagggtaattggcatcatgtctgcatcaggagaagcattaaccactagagactacataggtggacatctgaataaccttcagttggacctacgtactttcgagttggtcaatccccatgctgaaaatacgccatcattctgggtgttaaatattgactcacttttcttctctgtactcatggggcttttgttcctatggatatttagaaaagtagcagtaaaagcaaccagtggcgtaccgggaaaattccagactgcagtagaaatggtcattggtttcgttgatagcagcgttcgtgatatgtatcacgggaagagcaaagtcattgcacctttggcattgactgtgttcgtttgggtgctgttaatgaataccctggatttattaccaattgattttatcccatatatcggtgaacacatcttagggttaccagcgttacgcatcgttccgactgctgacgtgagtatcactctttcgatggcaattggtgtatttatcctgattctcttctacagcattaagatgaagggcgtaaaagggtttactaaagagctgacgttacagccttttaatcaccctgtatttattccaatcaacttaattctggaaggggtaagcctgctatcaaaacctgtttcactcggtcttcgactgtttggtaacatgtatgcgggtgaactgatctttattcttattgctggtctgttaccgtggtggtcacagtggttattaagcctaccttgggcgatattccacatactgattattacgttacaagcctttattttcatggttctaacgattgtttatctgtcgatggcatctgaagaacattaa

SEQ ID NO: 3348 - DNA, 1482 bp, Proteus mirabilis
ctaactggcttttttgctttcagaaatattttgtgtaacgaaatatgtagtattatttggcataaacaggtttacttgccattctttacgggagttatcaggttaattatgtctaattcagctaaaagtgttgttattcttgctgcgggaaaaggtacccgtatgtattcacagttacctaaggttcttcataaacttgcgggcaaatccatggtgcaacatgtcattgataccgcaaaatcccttggtgctcaacaaacccaccttgtttatgggcacggtggtgaacttatgaaagaaacattaggttcacaacctgtcaattgggtgctacaagctgagcaattaggtacaggtcatgctatgcaacaagccgcacctttctttgctgatgatgaagatatcctaatgctttatggtgatgtaccacttatcactaaagaaaccttagagcgtttaattgcggtaaaacctgctggtggcattggtttattaaccgttattttagataaccctatggggtatggccgtattgttcgcgaaaatggcgatgttgttggtatcgtagagcaaaaagacgcctctgaagaacaattaaaaattaaagagatcaatactggtatattggttgctaatgggggcgatttaaaacgctggttagcgaagcttgataataacaatgctcagaaagagtactacattactgatattattgcgcttgcacaccaagaaggtcgtaaaatcgaaaccgctcaccctactcgtcatagcgaaatggaaggggttaataaccgcttacaacttgcctcattagagcgtatttatcaaacagaacaagccgaacgcttattacttgaaggggtaatgttacttgatccggctcgttttgatttacgtggtacgctaactcacggaaaagacgtggtgattgatactaacgttattattgaaggtgaagtcactttaggtaataacgttgaaattggtacgggttgtgtactgaaaaactgtgtgatcggtgatggttcgattatcagcccttatacggtgatcgaggatgcaaatttagcgcaagagtgtactgttgggccttttgctcgtcttcgccccggcgcacagctggcagacaaagcacatgttggtaactttgttgagatgaaaaaagccagtctaggcgttggctctaaagcgggtcatcttacttatttaggtgatactgaagtgggtgctaatgtgaatattggcgctggcactatcacttgtaactatgacggtgcaaataaatttaaaactatcattggtgatgatgtgtttatcggctctgatactcaacttgttgcccccgtttgcgtggccaatggcgcaacaattggtgcgggtacaacattgacaaaagatgtcaacgaaaacgaattagtcattagccgagttaagcaaacacatatctctggctggaaacgtccggtgaagaaaaaacaataa

SEQ ID NO: 3349 - DNA, 1572 bp, Proteus mirabilis
cgtcttgcagtcttaaggggactggagcatatgcaactgaattccactgaaatcagcgaactgatcaagcagcgcattgctcagttcaatgtagtgagtgaagctcacaatgaaggtacgattgtttccgttagtgacggtatcattcgtatccacggtttagccgaagttatgcagggtgaaatgatcgcactgccgggtaaccgtttcgctatcgcattaaacttagagcgcgactctgttggtgcggttgtgatgggtccttatgctgacttagcagaaggcatgaaagttaaatgtacaggtcgtattctggaagttccagttggccgtggtctacttggtcgtgtagttaacacactgggtgaacctattgatggtaaaggtgctgtagagcatgatggcttctcacctgttgagatgattgctccaggtgttatcgaccgtcaatcagtcgaccaacctgtacagacgggttataaatccgttgacgccatgatcccaattggtcgtggtcagcgtgaattgatcatcggtgaccgccaaacaggtaaaactgctctggctgtcgatgcgattattaatcagcgtgactctggcattaaatgtatttatgtcgctatcggtcagaaagcatcgactatttcgaacgttgttcgtaaattagaagagcatggcgcgttagaaaacaccattgttgttgttgcttctgcatcagaatcagcagcgttgcaataccttgctccttatgcgggttgtgcaatgggtgaatacttccgtgaccgtggtgaagatgctctgattatttatgatgacctgtctaaacaggctgtcgcataccgtcaaatttcactgttacttcgtcgtccacctggacgtgaagcttaccctggtgacgttttctatctgcactcccgtttattggagcgcgcagcgcgcgttagcgctgagtatgtagaaaactttactaacggtgaagttaaaggtaaaaccggctcactgactgcgttacctattatcgaaacgcaagcaggggacgtttctgcattcgttcctacgaacgtaatctctattaccgatggtcagatcttcttagaatctaacctgtttaacgcaggtatccgtccagctgttaacccagggatctccgtatctcgtgtaggtggtgcagctcagactaagattatgaagaaactttctggtggtatccgtactgcacttgcgcagtatcgtgagctggcagcattctctcagttcgcttcagatctggatgatgctacccgtaaacaattgaaccacggtcagaaagtgactgaattgctgaaacagaaacagtacgaaccaatgtctgtcgcacaacagtctttatctctgtttgctgcagaacgtggttatctggaagatgttgaaatttcaaaagttgtgccatttgaagcggctttattagcttatgcttctcgtgaacatgctgatttactgaaagaaatcaaccagaccggtacttataacgaagaaatcgaagcgaagctgaaaggcgtgctagacaacttcaaagcgactcagtcctggtaa

SEQ ID NO: 3350 - DNA, 1869 bp, Proteus mirabilis
agacatcaagtgcgaaaaacgcacagttttaggaataacacaatgtgtggaatagtaggtgcagttgcacaacgcgatatcgcagaaatcttaattgaaggtttacgtcgtttagaataccgcggttatgattcagcgggattagctgttgtcgataatgattgtcatatgacacgtctgcgtgaagttggcaaagtacagatgctggcagaagaagcagaaaaaacacaagttattggtggtacaggtattgctcatacccgttgggcaacccatggtgaaccttgtcaagataatgctcatcctcatgtctcaggcactattgccgtggtacataatggtattattgaaaactaccaagagctaaaagctgagttaattaaccggggctatcagtttgcctctcaaactgatactgaagttattgctcacttagtcaattgggaacagcgccaaggtggcacattacgtgaagtcgtacagcgtgtgatccctcaattacgtggtgcttacggtactgtcattatggatagtcgtacaccagagctattagtggcagcacgctcaggaagccctctggtggtaggtcttggtgttggggaaaacttccttgcttctgatcaactggctttattgcctgttactcgccgctttatctaccttgaagaaggcgatattgtcgaaattactcgtcgtcatgtgaatatttatgatgttaatggcgaagaagttaatcgtgatattatcgaatcgaatgtgcaatatgatgcgggtgacaaaggtatttatcgtcactatatgcaaaaagagatctacgaacagcctttagccattaaaaacacccttgaagggcgtttaaaagcagaaagtattgatcttagtgagttaggatctaaagcaccagagatcttatctcaagtggaacatattcaaattgttgcctgcggtacatcttataacgcaggtatggtatcgcgttattggtttgaatctttagcggggatcccctgtgatgtggaaattgcatcagaatatcgctatcgcaaaccagcgactcgtcgcaatagtttactgataaccttatctcaatcaggtgaaacggcagatactctagcagcattacgcttatcaaaagagttaggttatttatcatcgctggcaatttgtaatgtggctggctcttctttagttcgcgaatctgaatttgtgttaatgactaaagcaggggctgaaattggagttgcctcaaccaaagcctttacaacgcaactggccgttttattaatgctagtggcctatatgggacgcattaaaggtgttgaagcccttgaacaacaagttgcaatggcgcttcatgcactacctagccgtattgaaagtatgttgtcgaaagataaagtgattgaagctttagcagaagacttctcagaaaaaagtcatgcactcttcttaggccgtggtgatcaatatccaatagcggtagaaggcgcattaaagttaaaagagatctcttatattcatgcagaagcttatgcggctggtgaattaaaacatggacctcttgctttaattgatgctgatatgcccgttatcatcgtagcgccaaataatgaattattagagaaattaaaatctaatattgaagaagtgcgcgctcgtggtggtttactgtatgtgtttgccgatcaagatgctggctttgaagaaagtgaaacaatgaaactgatttctctgcctcatgttgaagagttaattgcgccaattttctatactgtaccattacagttactttcttatcatgtggcgttaattaaagggactgatgtcgatcagcctcgaaacttggctaaatcagtgactgttgagtaa

SEQ ID NO: 3351 - DNA, 441 bp, Proteus mirabilis
atgaaaaaagtcacgctaattagtggcagcaccatgggtagtgctgaatatgtcgccgaacacctcgaagagatcttatctaaagagggatttgagacagatctacaccatgggccttctcttaatgatcttccgcaagaagggatctggttggtgatcacttccacacacggtgcaggtgagatcccagataacctccagccatttgctgacgaaatctcagcagacggcattgatctaagtaaagtttctttcggtgctgtaggtataggaagtagtgaatatgacactttctgtggtgcgatcagaacattagatcaaaaactaatagaaaaaggggctgttcgattaggtgatcgcctagaaatagatatacaagaacacgacattccggaagatccagcagaggaatggcttacaacttggaaaaatttactttaa

SEQ ID NO: 3352 - DNA, 837 bp, Proteus mirabilis
aaaatgagagtgagtatgtcgctagaagaactaacaagagtctgggatcatattaaaagcgaagcgcgtgcattggcagattgtgagccaatgttagccagtttctttcatgcgacacttctcaaacacgaaaatttaggtagtgcattaagctatatgctggccaataagctggcaactcagactatgccagccattgcagttcgcgaaattgttgaagaggcttatagtcacgatagctcaatgattgagtcggccgcttgtgatctctccgcggtacgcctacgtgatcccgcggtggataaatattctaccccactgctctatttaaaagggtttcatgcactacaagcctaccgtattgcccattggctatggcaacaaaatcgccaagcgctagctatttatctacaaaaccaaatatcagtcacctttggggtggatatccacccagcggcacgtattggacacggtattatgctcgaccatgcgacaggtattgtgattggtgaaacggcggtggttgaaaatgatgtctctattttacaatctgtgaccttagggggaacaggtaaaacaggaggtgatcgtcacccgaaagtgcgtgaaggggtaatgattggcgcaggagctaaaatccttggtaatatcgaaattggtcgtggtgctaaaattggtgctggctcggtagtattacatgaagtaccagctcatactacggtggccggggtgcctgcccgcattgtcggtcgtcctgatagtgaaaaaccgtcattcgatatggatcaacactttaatggtgttgtacccggctttgagtgtggtgatggtatttaa

SEQ ID NO: 3353 - DNA, 1095 bp, Proteus mirabilis
attggcgtggtaagcgatatgttacagttcaatataaactcacaaaatggctcaatgccacatattcgtgtagagaatattcaaaagagatttaatcaatttattgctttagatggtgtttctttagagattaaacaaggcgagttagtctgcctattagggccttctggatgtggaaaaaccacattattacgttgtattgccggattagaaacacaagatcacggtagtatctttaattacgataacaacatctcacaccttcccccccaagcccgtgactatgggatcttatttcagtcctatgcattatttcctaacctgacggtacagcagaatattgcgtatggtttagccggtcagcctcgtaatgtgattaaaaatcgcgttaatgaaatgctggagttagttggtttacaagaccgaaagaaaaaatatccaggagaattatctggcggtcaacaacagcgtgtggcattggctcgtgctttggctcctgccccttctttactattactggatgagccaatgtcggcattagatgcacaagtgcgtgaacatttgtgtgtggagctacgtaatttacagcaaagcttaaatatcactacgctaatggtcactcataatcaagatgaagccatgctgatggccgataggatagctgtaatgaataacggcaaggttgagcagtacggcagtagtgaagagatttacaaccatccacaaacaccatttgttgcagagtttgtaggaaaaggtaactggttacctttcaatagaaatcagcacggtgaggcgatgattggctcacgagaagtccaattaaaacatactgcaatacctcataatcaagggcgtctcttttgtcgacctgaatcaatcaaaattaacccaatacaaaacaaacataatcaatacgatgccaatatacaaaatgtggtgtttttgggaagtcgttgcattatgaagtttgaattagaccatttaccgggacatttattacaagccgagatctctgctgctgagctacatagtattcaaaacggtaaagttaaagtgactttaccggctaatgaactacacatatttgcgtaa

SEQ ID NO: 3354 - DNA, 1152 bp, Proteus mirabilis
ttacaagaggtaaataaaatgcaacacacaattaattcacaatatgatgaaatggttgattttctaaaggagttagtgaatatcgatagcggctcttatgataaacaaggggttgatacagtcgctgatcttttaattcaacgctaccaaaaattaggttttgttgttgaagtatttgaaaatgaacaactagggaataactaccgtttagttcataaagatgccacaaacccacaaatttttattgctgcacatttagataccgtatttcctaaaggcacagtagcagagcgcccatttagtatcgatggctcccgtgcttatggccccggtgttattgatatgaaagctagccatgttttaacttactatgcgattaatgcactcaaacaaagtggcgatctctcttatcaaaatgttgaaatattgcttaactgtgatgaagaaatagggtcaaaaacatcgcgtcatttaattgaaaaatatgcaaaaaataaagcttatgcattaattatggagcctgctcgtgcgaatggtgccattgttagcgctcgtcgaggtgttggaacttatgagctgttgattgaagggaaagcatctcactcaggtattgcaccagaagcaggaattagtgctattcaagagctttcatacaaaattcaggccctacatgcgctttctcgccatgatgaaggtctttccgttaatgtcggactgatttctggtggtacatctgtcaatacggttgctccccatgcacgagctgaaatcgatgtgcgtatttcaacggatgagcagggtattgaaattgataagcaagtcagagaagtttgtagtcaacctgtgttagcgggggttaaattaacgctaaaaggtggcattaatcgccctccaatggtgaaaacacctgaaagtgccaatttaatagaaatcattaaacagcaagcggatttaattggcttagctattgaagatatttcaaccgggggaggatctgatgcctcatttactgccggtgtgggcacaccaagtgttgatggtttaggccctattggcggctatcaacatagtgataaagaatatctcgatttaccgtcattgaccgaaaggacagtgctatttgcaaatgttattaagcgtctgtctcaataa

SEQ ID NO: 3355 - DNA, 555 bp, Proteus mirabilis
aaaggagtatttatgttggctagagccttgtttatccctctttcattccctttactcgccttatcttgctattgttgggcaggaaatggtctggtggatagaacatggacagcttcaggaatggatagctatagttatcgccaagcgctaaggcaaccaacggttggctcacgttatactctttttaatattacacccgatatgccaacgccaggtggtacgagtcctgttggtactaaaggaattcgctatattgcgatgaaatatggcccttatgggcaacctgaacactataaaacctaccaagtgatgttctctcactattccaccaccaccacacgtaaagttcgttatttaggtgagttatataccgttgtaggtgatatttatttaatcgatcctgctgctaccaccaatgaatggcaacgcggtcgtagccaaatagttgaagagtattatgagattttagatacacatggaaataggacaggcaaaggattgcgttttaaccgctgggatagacctataaatataacaaattggtctacatattaa

SEQ ID NO: 3356 - DNA, 2217 bp, Proteus mirabilis
ctattggtattttctttttttaaaaaattttattggtctatcgtaccaagaatgaattttttcttaaaaaataaaataatagcaatggcaaggtacggggttatgcataaattatttaaactattaataacagcttttttattaataacaatgttttcgcttattgttatgccaatgagtgctaaacaacaatatatatttggtataattaatattctgctgttatttattattggctctaaaaaatcaaaaaaacgattattaacaatgatttttttatcattgttaatgtctacacgttatctgtattggcgagcaacccacacacttaattttaatacctctattgaagggatattgggtacaggattatttttggctgagatctactcttggattattttagttttaggttatttccaaacagcttggccattaaatagaaaaatagcgccattaccaaaagatatctcgttatggccaacagtggatatttatgtacccacatataacgaaagtttagatgtggtgcgtgatacggttttagccgcacaaagtattgattatccaaaagataaaatgaaagtttatcttttggatgatggtagccgtgaagagtttaagcaattcgccaatgatgttggtgtgacttatattgagcgtgaagagcacgatcacgctaaggcaggtaatctaaatcacgcaatggcattaactgatggtgagcttatttgcgtctttgattgtgaccatatctctacccgtatatttttacaggcaacggtgggttatttccttgaagatccaaaattagctttggtgcaaacaccacactatttctattcacccgatccttttgaacgtaatttaagtgccgccaaaaacggccctcacgaaggtgcacttttttatggccctgttcaacgaggtaatgataattggaatgcaaccttcttctgtggttcatgtgcggtaatgcgtcgtagcgccctagaagaaattggtggtattgcggttgagacagtcacagaagatgcccatacggcattaaaattacaacgtttaggttggaattcggcatttattgatattcctttagctgcaggtctagcaacagagcgtttagcattacatgttaatcaacgtattcgttgggctagaggaatgacacaaatctttcgtgttgataaccctatgttaggccgtggcttaacgtttcctcagcggttatgttatctcaatgcgatgatgcattttcagtatggattgcctcggattatctttttaactgcacctttactgtttatgttattcaacctcaatattatcgcctcttctgccagtatgatttttgcctttgcattaccacatttaattatgtcggtgtatgtaaactcacgaaatattggtaaatatcgctattctttctggggagaaatctatgaaacagtgatggcatttagtttagtactgcctacattgctcagtttagtctcgcctaaattaggtaaatttaatgtcactgataaaggcgatttgcttgataaaagctatatggattatctaacggtacgccctttgattattactgcgctacttctagttatgggtatttcatgggtcatcattcgttatttattaaatgattttcaaggcatcgaccctttagtcattgtattgaatttggtttgggcaacttatagtttatttattgtgttggcatcgatcgcagtaggtaaagaaacacgccaaattcgtaaaaatacccgcattaaggcatcacttcctatcactttacattttgatgatggcgctgaattacaaactaccaccgaagatatttctatggggggagtgcgtattgcgattaataaaatagctgaattacgccagcgtaccgttaatagcattacgttaatggtgcaacgtgatgttgttacgcttcctgtggaaatgatcagtttagaaaatagccagttacgtctcgcttttttaccaatggatttaaatctacgccgtaagttagtacgggtgatctttggtcgagcagatgcttgggttcatcaaacacaatatcaagacaaaccattaaaagagttaggtgctatcactggctgtatttttgagttgttctttggtcgtcgtcaaaaagtaaaagcaccggtaaaaagagcaaaaacctctctctctgtgcaatctattaatggggatgactag

SEQ ID NO: 3357 - DNA, 267 bp, Proteus mirabilis
gaaagatttttttgggatgctgagcgttgttcgcttagttgcataataatagttacctttaccataatttgctttctatattacgtgagtaatagcaataaagctgtttggattttaatctatcagtgtaaaattagagcattttcattcgttttgttgaaaaatagagcgaacagaaaaaaaaatgaaataaatacttgcgctaatctgagaagcccctataatgcgcacccactgaccgacgatgagctgacaacgtcttcacac

SEQ ID NO: 3358 - DNA, 216 bp, Proteus mirabilis
tctttatcattagccttatgttgtagttgtacgcttgcaacacgtaatgtcgttaatgggttcataaacggttacctctacactgtcttatttatcaccttttcacctttattatctaaacgttttttttgtccaaaatataatcaattattttctatttttaataaccttttggaatggaaagggataagcatcagaaatggcacgctgttatag

SEQ ID NO: 3359 - DNA, 198 bp, Proteus mirabilis
tatgaaaaatttcagctactgatcttttttaaatgtaaaatatggctcacaaagcaaaatgcgatgttgtttttttgtgttgatcatcatcaaaaaaagacacatttttataagcgaaaagtgtatttttttcatagagtagctaacacattgtcatgctataaaaagaaaataactttatttattcagacccattaa

SEQ ID NO: 3360 - DNA, 1656 bp, Proteus mirabilis
cagagaaaattaacgatggattcgcaacgcaatcttctattcatcgctttactgttcgtttctttcctgatctggcagcagtgggagggtgataaagtatcacaaaacaccaccactactactcaggtctcgcaacaagcggacatgccaagcagtgatagtcttgctgtgactggtaacagcaatgagcaggcaaaattgattaccgtaaaaactgacgtacttgatcttcgtatcaatactcagggcggtactatcgatgaggctgatttgttagcctatcccgccgagcttaattcaaaaacccctttccgtttactggaaactacacctcaattcctgtatcaggctcaaagtggcttaattggccctgatggtccagatcagaaatctcgccctgtctacagtgccacacaacaagaatttatcttaggtgaaaaccaagatgaattacgtgtacctatgacttttgtgaatgaagaaggcgtgaaattcgtcaaaacctttattctgaaaaaaggtcagtatgacattggtattgaatacaaagttgagaacccaacagataaaacactgacaatgaacttttatggtcagttaaaacagtctgttaagttaccagaacaccgtgatactggaagtagcaactttgcgctacatacctatcgtggtgcggcttattcatcagatgaaaccaactataaaaaatatagctttggtgatatcgaagataaaaacctttctatcacaaccaacaatggttggattgcgatgttacaacaatacttcgcaaccgcgtggatcccagctaaagatagtcagaataacaacttctactctatcactttagataataaatctatcgcactgattggttataaatcagcacctattactgttgcaccgaatagcacacaggatatcacttcaacattatgggtcgggcctgagatccagtctgaaatgtctgcaatcgcaccacatttagacctatctgttgactatggttggttatggtttatctctcagccactgtttaagctgctgaaattcctgcacagctttatcggtaactggggtttctccatcatcatgatcacctttatcgttcgtggtattatgtatccactcacgaaagcgcaatacacctctatggcgaaaatgcgtttactgcaaccaaaactggcggcacttcgtgagcgtattggtgatgataaacaacgtatgagccaagaaatgatggcgttatacaaacaagagaaagttaatcctcttggtggttgtttaccgctgattatccagatgccaatcttccttgccttatactatatgttaatgggctcggttgaattacgtcatgcaccatttatattatggatccaagacttatcagcacaagatccgtactatatcctgccattattaatgggtgtgacgatgttcatcattcagaaactgtcaccaacagcagtcactgatccgatgcaacaaaaaattatgacctttatgccggttgtatttactgtattcttcctgtggttcccatcaggtctggttctgtactatatcgtcagtaacctagtaaccattatccagcagcagttaatctaccgcggtctggaaaaacgtgggctacatagtagagacaaaaaataa

SEQ ID NO: 3361 - DNA, 1410 bp, Proteus mirabilis
gtttacgaattacgtagaggattcaagatggctactggaaagattgtccaggtaatcggcgccgtagtggacgccgagttccctcaggatagcgtccctaaagtatacgacgctcttgaggttatgaatggtaaagaaaaactggtgctggaagttcagcaacagttaggcggtggtatcgttcgttgtatcgcaatgggtacatcagacggtttaagccgtggcttaaaggttgaagatttaggccacccaattgaagtaccagtaggtaaagcgactttaggacgtatcatgaacgttctgggtacacctattgatatgaaaggtgagattgaaaccgaagagcgttggtcaatccaccgtgaagcaccaacttacgaagagttatcaaactctcaagaactgcttgaaaccggtatcaaagttatggacttaatctgtccatttgctaaaggtggtaaagtcggtctgttcggtggtgcgggtgttggtaaaacagttaacatgatggaattgatccgtaatatcgcgatcgagcactcaggttactctgtatttgctggtgttggtgagcgtactcgtgagggtaacgacttctatcatgaaatgacagattctaacgttcttgacaaagtatcgttagtttacggtcagatgaatgagccaccaggaaaccgtctgcgtgttgcactgactggtctgactatggctgaaaaattccgtgatgaaggccgtgacgtactgttgttcgtcgataacatctatcgttacaccttagccggtacagaagtatcagcactgttaggtcgtatgccatcagcggtaggttaccaaccaacattggctgaagagatgggtgttctgcaagagcgtatcacttcaaccaaaacaggttctatcacctctgttcaggcggtatacgtacctgcggatgacttaactgacccatccccagcaaccacctttgctcacttagatgcgacagtggtactgagccgtcaaattgcttcgttaggtatctaccctgcggttgacccactggattcaaccagtcgtcagttagacccactggtagttggccaagagcactatgatgttgctcgtggtgttcagtctatcctgcaacgttatcaggaactgaaagacatcatcgctatcttaggtatggatgaactgtcagaagaagataaactggttgttgcgcgtgcgcgtaagatccagcgcttcctatctcagccattcttcgttgctgaagtatttaccggttcaccaggtaagttcgtttccctaaaagacacaatccgtggctttaaaggtattctgaacggtgattatgaccacctgccagagcaggcgttctacatggttggtactatcgaagaagcagtagaaaaagctaagaagctttaa

SEQ ID NO: 3362 - DNA, 204 bp, Proteus mirabilis; identical to SEQ ID NO: 1041

SEQ ID NO: 3363 - DNA, 210 bp, Proteus mirabilis
tgcaaggtccgaagagcccctgctttggtccgtagacattatgcggtattagccaccgtttccagtagttatccccctctatcgggcagatccccatacattactcacccgtccgccgctcgtcagcaagaaagcaagctttctcctgttaccgctcgacttgcatgtgttaggcctgccgccagcgttcaatctgagccaggatcaaac

SEQ ID NO: 3364 - DNA, 246 bp, Proteus mirabilis
cgttggacaggaacccttggtcttccggcgtgcgggtttttcacccgcattatcgttacttatgtcagcattcgcacttctgatacctccagcatacctcacagtacaccttcgcaggcttacagaacgctcccctacccaacaacactttgtgtcgctgccgcagcttcggtgcatggtttagccccgttacatcttccgcgcgggccgactcgaccagtgagctattacgctttctttaaatga

SEQ ID NO: 3365 - DNA, 270 bp, Proteus mirabilis; identical to SEQ ID NO: 2101

SEQ ID NO: 3366 - DNA, 348 bp, Proteus mirabilis; identical to SEQ ID NO: 3196

SEQ ID NO: 3367 - DNA, 1863 bp, Proteus mirabilis
tggataatatcaatgcgtttaaaatcaattaatgcttttgtgttatccttgttagtaagtccattttatgtttgcgcagatttaaatatggacttcttacatggaggagttcaactgcaagctgctggtgtatttgatgaaaataccaattatcctgctgggcattatattgttgaggttatttttaatcgaaaattaattagtaaaaaagaattaattatctcaccagaagataatgaaaatttatgtttaaaaaaagattggattaatgagttatcgcttccaataaaattaaatttatttgaattatattatcatcctgagcgcgattgttatgatattagccgttatcctggggctcaggttatttttgataattcgaagcaaactttaacatttagtattcctcaaattgcattagatgaatctctgcgccggcaggaatgggattatgggataacaggtattaaattaaactattcgggctatatttctaaaaccagttcttcacaagcacaaatttatggtgattttgatttatatgctaatttaggtcgttgggtcgcttatgttcgtagtagttaccaaaggaactcgggtacagaaacatcggaggcaacagtttccacagcaattaaatcaatacaaggaagttttaccgtaggtaaaacaataacctctttatcaatattacctaactttgctttttatggaatgtcactgcgctcggaaagggatatgcgcccatgggaaaaacgaggttatgcaccggttatttctggtgttgcaaactctaatgctaaaattactatatctcaaaatggatatgtattaagttcacaagttgttcccgcaggggcttatcaattaaaaaatatagcaccagtaagtaatggaaatataacagtgacagtagaagaaagtgatgggacaaaaacagttcgctattatcctgttgccacactttcttccttattacgcacagatgaaataaattacaacattgctatcggagaaaaagaaacagtaggtaaaagagaaaatagtttattttttctaggtgcatttgactacggattaactaatgttacggttcatgctgcgggaattttgcataataattataaaagtgcagcattaggaatgagtaaagattttggacgatttggtgcaatgtcatttactgctaatactgctgtaagtgtatttcaaaaacagacaccaacagcacccgaagttaggcagtctggtatcagctattcgttacaatatgcaaattcattgactgataatactaatttacagctactcgcatatcgctatactggtaaagattatgttgattttaatgaatttaattcaaatgctttatatcatcgcagtaatcgtaaagagcgttatgaaacgatattgtcccaaagttttgatggtagctttgttagcttatctgcttggatgcaaacatatagaaatagtattagtaatgaagttggcgcaaatattacttacaatacaacaattaaatctgtcgatttctcattatcagcggattatcaaaaattaaacgattatgagcatgataattatattatttctgttggaataaatattccctttagcttatatgataaaaatcatttttgggcaaattctgttagctacgataggaaaaataaagctagttttaattctggtgtttctggaagtattaatgaaaaaataaactatagtatcaatacaagtaaagatcgtgataactggtctaattctgcttattttggtattgatcatagtattattaatacgggatatgcgatttctcagaatggccatcaaactaccagttctattaatgcttcatga

SEQ ID NO: 3368 - DNA, 528 bp, Proteus mirabilis
attttaaaatctattgtcaataattgggtggatgcaatgagaaagcctactttttattctttcttactctgtattattctgctagctggatgctcatcgagtccctctaagcgtctcccacccgcgcccccgttaaaaacgcaactttctgatcctattatggtcattgtgcaattaaaatctcagctagagcaatggtatggtacgccttatcgctatggtggcatgagcccatcaggtattgattgctcagggtttgtgtataggacttatagtgatcgttttgatatacaactgccaagaatgactatcgatcaaactaaatatggtacacaaattagtaaaagtgatttgatgcctggtgatttagtatttttcaaaacaggaggaggggataacgggcttcatgttggtatttatgatactgacaatacctttattcatgcttctaccagtaaaggcgttattcgttcatcattagataatgcctattggaaaaaaactttctggcaggctcgtcgattgtaa

SEQ ID NO: 3369 - DNA, 309 bp, Proteus mirabilis
gggactagacctatggcgcttacaaaagctgaaatggcagaaaatctgtttgaaaaacttggcgttagcaaacgcgatgcaaaagaccttgtagaagccttttttgaggaagtgcgtcgttctctggaaaatggagaacaggtgaagctgtctggattcggaaactttgacctacgtgataaaaatcagcgcccaggtcgtaacccgaaaacaggggaagatattcctattacagcccgccgtgttgtaactttccgcccgggacaaaagttaaaaagccgggttgaaaatgcgacaccaaaagagtaa

SEQ ID NO: 3370 - DNA, 546 bp, Proteus mirabilis
atggagttaacgatggtaaaaaaatcttgttttatgtttagcgttattttatttcctatttatgttggagcaacaagtttcacctctaatgttactggtggaacagtcacttcaaatttaagtatgacagtgaaagcctcttgcagtacaacggttggtgatgtgacatttggtgaccaaagcgcgggtgatattaaaaaaggagctgtcgcagagaaggtaatatcattggctattgtatgcgatacaaaaatgactaattacacattagcatttacggcggctgatggtgttaaagatgtagcaaatggcattattaatactaaattaaattcaacggtgggttatcaacttaagtggggagattcgaccgttaaacctgtggatacagcaattactattaatggcagtacaattaccccaacaaacaagccaacgcaagaaagttttactattccaatcaaagttaaacctgttgctcttggggagactgtttctcctggtgcagcaaatacggcgttaaacattaaactaactttcaattag

SEQ ID NO: 3371 - DNA, 1290 bp, Proteus mirabilis
ccacaaaatgcgtcttcatttagccaatgtacgtggaaagttaaagcgtttacaacaagaaaaaaattaactcttatactggattatatgggtagtattatgacttatgacgtaattatcatcggtgcaggattagtaggattaggggttgccagtgcattacaagaaagccaacctgagcttaaagtactggtgattgataaggagtctggccccgccgttcatcaaagtggccataacagcaatgttgttcattcggggatttactatacaccaggaagcctaaaggcaagactcgctaagcaaggtaacatcacgacttacaatttttgtaaacagcatcatctctattacgatcgttgtggcaaggtgattgtggcaactgatgaaaaagagctaccagcattagaaaatatctatcaacgtggaatacaaaatggccttgaagtgattaaaatgaccgagagcgagctaaaagccagagagccttatgttaatggtattgctgctttgcttgttcctgatgccggtattgtcaactatccggaaattgccgccaaacacgttgaaatcattcaagctcgaggtggagtatttgcctttaaccaagcagtaaatgcgattaatgaaacggacgaaacggtaacagtcaccacatccacaacacaatttaccgcaaagtggctgattaattgtgctggattatttagtgatcgggtagcaaaaatggcgggctacgataccggcatgaagatagttccctttcgtggcgaatattttatgctcaactcaaataaaaattatttagttaatcatcttatttatcctgtgccgaatcctgatttcccatttttaggtgtccattttacacgtatgtataacgggcatcgtgacctaggccctaatgccgtattagcctttaaacgtgaaggctacaagaaaagtgatattgacttaaaagatctcactgaagtactaacctataaaggattttggaaaatagccggaaattatttaggtgaagggatggccgaattacgtcgttcctattcacgtaagctgtttgcccaaaatgcacaaaagcttattcctgctctacgtgaagcagatattcacccaggcccggcaggtgtacgcgcccaagctttaactcgcgaaggaaaattagtcgatgattttcactttgttaaaggtaaacgttcattacatgtatgtaatgccccttctccggccgcaacagcatcaattgaaattggtcgtgaaattgtaagagagcattttttattataa

SEQ ID NO: 3372 - DNA, 321 bp, Proteus mirabilis
agtttattagccaccccagatacaggattattattcagtaatgtcagaagagatactgtcgcaattgcaaaaattaaaaatatagagggtataacattcaatgattcaccgtcaactgacaaagaaggaaacactattgttggggtatcaccatacattgaaaataatttaaaaataaatacagaagaaattccgaataatgttgaattacttgattctgttcaaaattttactccagcagataaagctattatttatcgcgagtttaaatattcaacaattcacaggtatatatttacgaataaaaaaataaaatggtga

SEQ ID NO: 3373 - DNA, 210 bp, Proteus mirabilis
cagctaatttatatagttttaattgtgccatattataagcgctccatctgtttagtggctaataaccaaataaaaagaggtgcgcctaaggtggcagttatcacgccaatagggacttctgcgccatttaacatcagccttgatattaaatcagcgaatatcagtaaactcgctcccgttaaagcacagcccggtaacaaggttttataa

SEQ ID NO: 3374 - DNA, 1038 bp, Proteus mirabilis
tttatgggctatttactaaacaatatgaataatcaatatgatgatccgcttaatcaattacgacacaaacagcaaattagtgataagctaaaactcactttgctggtgttagttttatttgttcttattgttatctcactttcagccggtgaaatttggttattccccaataaatggctcactgaagaagctagtttatttatttggcaaattaggcttccaagaatattggctgtgatgatggttggcgcaagcttagcgattgctggtgccattatgcaggcaatctttgaaaatccgttagcagagccgggacttttaggtgtaagcagtggtgcgggtgtttgtgttgtgttactgattgttttccaattaggaactgcatactggttaataagcagtgccgcaatattaggggctttggggatcacctgcttattaatgtttttctcacaaataaaaaaactatctaatgctcaattattattaataggcgtagcattaggggtattagcaagtgctgttatgacttggctggtctattttagctctgcgttagatttaagacaattaatgtactggcttatggggagctttagtggcattgactggcgtcaccaaatattattttgggcattacttccaatcatcacacttcttatttggcaagccgatattttaaattacctttctctggggagttttgaagccaaaaaactcggcatttctgtgattatatggcgtaattggtttattttaaccgttggtttattaattggttttagcgttgctctagccggcgcaattagttttgtcgggttgattgtaccgcatttattacgattgtctggtatcacacattataaaaccttgttaccgggctgtgctttaacgggagcgagtttactgatattcgctgatttaatatcaaggctgatgttaaatggcgcagaagtccctattggcgtgataactgccaccttaggcgcacctctttttatttggttattagccactaaacagatggagcgcttataa

SEQ ID NO: 3375 - DNA, 213 bp, Proteus mirabilis
aatggtgattttatttctgctggaagtgctgttagaaataaaaatgatgaatatatagggtttgtttcaaattctggggttcttttattaaatttattagataagcctaataagctattcgttatatcacctaatggtgaaaaatgtactttaaatttggagaaagtagaatctaatgatcataaaattatggaaattgaatgtaatgaatag

SEQ ID NO: 3376 - DNA, 444 bp, Proteus mirabilis
aatagattacaaataacatacgttactattctatttaattgggcactatgtccccacctattgtgggaggtttttatggctgaaaatgtcgttaatgatattctgaaatggttagaaactcagttacaacgtaatgagggtataaagattgatacgattgcaaataaaagtggctactccaagtggcatttgcaacgtatttttaaagattttaaaggttgcacattaggcgaatatgtacgtaaacgtcacttattggaagcagcaaagtctttacaagaaaaagacatgtccattttagatattgctttgatgtatggctttagttcccaagcaacatttactcgtatctttaaaaaacacttcaacactacaccagctaaatttagagaacatggtgagttaccagatacacgtcgttttatgtcatgtgaaaatagctaa

SEQ ID NO: 3377 - DNA, 2013 bp, Proteus mirabilis
aaaacccaacaaaaatcaggaagaagactaatgaaagcaatagtatttgcctatcatgatattggctgtgttggtttaaaagcacttgaaaaagcgggtttcgatattcaagctgtatttacccatactgacgatcctaacgaaaatcatttcttctcatccgtagcgcgtgttagcgcagaaatgggattaactgtgtttgctccagaaaacgttaatcatccattatggattgagcgtattcgtgagatgaagccagatgtcattttctctttctattatcgccatatgctaagcgatgagatcctgaatttagcacctaaaggtgcatttaatttacatggctctttattacctaaatatcgcggtcgtgcacctatcaattgggccattgtcaatggtgaaactgaaactggtgtcactttacataaaatgacggctaaagcagatgctggtgatatcgttgcacaagaaaaagtaacgattgaagatactgatacttcattaattttacatgaaaaagtcagagaagctgcggcgaaattaatggctcatacgttaccgcatatcgcctcaggtaactattcaacaacagcgcaagatgaaagccaagcaacttattatggtcgtcgttgtgctgatgacggtttaattgactggaatgcagatgctaaaacggttcataatttagttcgcgccgttactgaaccatacccaggtgctttcactttcttaggtgagcgcaaaatgattatctggcgtgcacgtccagtggcagataaccaaggtaaacgtccgggtactgttatttcaactgagcctttagttatcgcatgtgcgaaaggtgcaattgaagttatcacaggtcaaagtgaaaatggtctttatgttcaaggcagccgtttagccactgaaatggggatcgtgacagatgtacgcgttggaccaaaagcaacagcacaagtgaaacgtcgtcaacgtgtcctgattttaggtgtcaatggctttattggtaaccacctaaccgagcgtttattaaaagatggtaactatgatatctacggtatggatatcggttcatcagcaattgaacgctttattggtaaccctcgtttccactttattgaaggtgatgtcagcattcatacagaatggattgaatatcacatcaagaaatgtgatgtgatcttgccattagtagcgattgcaacaccgattgaatatacccgtaatccattacgtgtatttgaattagattttgaagagaacttaaaaattgttcgttattgtgttaaatacaataaacgtattattttcccatccacatcagaagtatacggtatgtgcgatgataaagagttcgatgaagataattcacgcttaatcgtcggtcctattaataaacaacgttggatttactctgtttctaaacagttattagaccgagttatttgggcttatggtgctaaagaagggctaaaattcactttattccgtccatttaactggatggggccacgtcttgataacttaaattcagcgcgtattggtagctctcgtgcaattactcagttaattttgaacctagtggaaggttcaccgattaaactggttgatggtggtgagcaaaaacgttgtttcactgatattaatgatggtattgaagcattattccgcattattgaaaatcgtgataacaaatgtgatggtcagatcatcaatatcggtaacccaactaacgaagcaagtattcgtgagctagcagaaatgctgttagattgctttgaaaaacatgagttacgcggtcacttccctccatttgctggctttaagaaaatcgaaagtagcagttactacggtaaaggctatcaagatgttgaacaccgcaaaccaagcatcaaaaatgctgagcgtctattagattggaaaccaactatcgaaacacgccaaacggtagaagagacattagacttcttcttacgtggtgcagttgaagagttaggtaataagtaa

SEQ ID NO: 3378 - DNA, 1971 bp, Proteus mirabilis
gttatgactaataatgaccacctaactccggtagagccaccagcattagataaagaagctagctcaggcactcgtcaccttaccggtatctatttaaaaatcaccaccacgctggcgatattcatttcgttgtatgctatttactctaatgccttatccaacacccaagagttttatcgtaatactatttttcttagtggtattttgatccttggttttattttatttccattctctaaacgattttctaccgcaaaatttaatggctgggattatctttttatcgctttaacattaatcagctatggctattttttctttaactatgttgatctccatgtggtaagaaaaagtattcccaacacaatggattatgcgatggcaattcttggcattattgttctttttgaagcagcaagaagaacaacgggctattttattcctagcctagccacattcgctattatctatgccctatttggccaatactttatgggtatttttggtcatgcaggattttctgtagagagactgttatatcgtttatttatgaccagtgaaggtatttttggtattacactctctactgcctctaccgctatcgtggtatttattttattcggttcgtttttaagtgttagtggtgccacagcactatttaatgatttagcgctagctatggcgggacgtcgccgtggggggcctgctcaagttgccgtcatttcatcagcattaacaggttcattaagtggtagcgcggtcgccaacgtagccactacgggaacctttaccattccattaatgaaaaatattggcttaacatcacgttttgcgggtgccgttgaagctactgcatctacgggtggaatgatcatgccaccgattatgggtgcggctgcttttattatggcgggctttttgggaatttcttataccacgattgttattgccgcgattattcctgcgttgctctattacgcggccttgatcatggcaattgatattgaagcgaaaaaacaaggtttaaaaggacttagcaaagagaatattccacaagttaaagcggtattaaaagcacgcggtttattactattacctttaattattgtaattggcacattattaatgggtaaaactcctatttatgcgggttttcttggtatcttaaccattattgttgccagctggctaacacctgataaaacggtacgaatgacattaactaaagtggctgatgctttagcagaagcggctcgtggctcggtacaagtgactatcgcttgtgctgccattggtgtgattatttgtgttgttaccatgaccggtatcggtgcgaccttagcatttaatattgtctctatgactgacaatacattatggatgatcttactggttgtgatgttagtctgtattgtattaagtatgggcttaccatcgactgctctatatatcgtggttgccgttacagtgtcacctattttaattaaagccggtgtgatgcctttagcggctcatttctttgtcttctggtttggcgcgttatccaatattactcctccggtcgccctagcaagctatacggcagcaagtattgcgagagccgatccgatgcaaacttcatgggatgcggtacgtttagcactccctggttttattattccttttattttggtttataaccctgcattactgatgcaaggtgataatttaagtgttatctctatcgggttaatggtcattagtgcattagtgggaatttatgcactaagtattgccactgcgaatttttggataatcaaaacaacatggtttgaacgtatcgcctttgcagcggccgctattttaatgattaagcccggactatataccgatttattaggtatggcgttgatcttacttactggcgctttccatctgttgcgctctaaaaaacagttggtcaatgtagggcaagtatctggagaaaactag

SEQ ID NO: 3379 - DNA, 222 bp, Proteus mirabilis
gaaattcccaaaaagcccgccataataaaagcagccgcacccataatcggtggcatgatcattccacccgtagatgcagtagcttcaacggcacccgcaaaacgtgatgttaagccaatatttttcattaatggaatggtaaaggttcccgtagtggctacgttggcgaccgcgctaccacttaatgaacctgttaatgctgatgaaatgacggcaacttga

SEQ ID NO: 3380 - DNA, 1689 bp, Proteus mirabilis
ggtgccaacaagaggtctaacaaaactatgttgaataaccgggcgagtaaaatcggggccatcctcttggctcttttttttgttcttacctacttatttccattgaacagccggttattatggcaacctgatgaaacacgttatgcggaaattagccgtgaaatggtggtgagcgggaactggattgttccccatatgcttgatatccgctattttgaaaaaccaatagcaggttactggattaataatattagccagttaatatttggccacaccaattttgccgtacgctttggttcagttatttctattctattaagtgcgttacttatttatttattagcacgaatgatgtggcgtaatcgccaagtcgcttttgtggctagcttaatttatttatccatgtttttggtgtttagcgtcggaacttatagcgtacttgatccgatgttagcgctttgggttactgcaagtatggtgtgttgtttttgggcgttgaaagcaaccacggcaaaaacgcgtatactggcatggataacgctaggtttagcttgtggtatggcctttatgaccaaaggctttttggcattagctatccctgttattgtgatgatccctgtaaccctttaccaaaaacagttcactcggatgttactctatggtgtgcttgctgttttaagtgcggcgttaattagcttgccatgggttttagcggtggcgaaggctgagcctgattattggcattatttcttttgggttgagcatatccagcgtttttctggtgatgatgctcagcatagttctcctttctggtattacatccctataattttactgggtgttattccttggcttggattattaccaggggcactaactagtgcatggaagaagcgccgtaagcgtcctgaactctttttcttactatgttggtttgtagtacctttcctattttttagtatcgcgaaaggtaaattacctacttacatgttgccatttatgggaccattggcgatgttaatggccaaatacggtgtagactgtgctagaaaatttaaaatgaaagcactgcgcattaatggctatattaatatttttattggtgtcgctgctgttgttgcaatattaattattcaattggtttcttctaaacctatctatatgccttatgaatggtcaaaatgggtattagcgatagtcgctttctcattatggggcatcattggttatctctgctctacattaaatggtaaacattggctatgggcagcctcttgctctttaggggtaagcttatgtattgggcaagccattcccaatagctctattgatggcaaattaccacaagagtttattcgccaaaatatcgataccctcaatgcgagcaaatatatagtcagtaacagcgttggtgtgggggctggattagcttgggaattgcaacgtagcgatatctacctttatgagagaacaggggaattaacctatggaattgaatatccagattctcaacatagattactaaaacctgaaagttttgagcaatggttagaaaatgccagaaaagaaggtaatgtctctgtggtgatcacttataaagatccgaagaaactggcgcagatgccacgacctgaagagttagtgacgaatcgtcgtatggctattttgacctatgagaaacgtaagtaa

SEQ ID NO: 3381 - DNA, 714 bp, Proteus mirabilis
atgataaaaaagatctcacgccaaaaagcgtcgcaacaaattcttgatcaaattaagcaaaatatttatgacgggacctatcctattggtgaaaaactaccgtctgaaaatgtactcgctgacgcctttggcgttagcagagttcccatcagagaagcattaggggtattagaagcgagtggcattattacgtcacgccaagggggcggtagacgcgttattgaccactctatcttgagtaaatacgaacctattgtgatggaaattgcttgtcctcaagaaattgaatcactgcttgaaatgcgtgaggtcattgaacatgaagcggcagccattgccgctttacgccgaacaccagaagaattgctgacgatagagcaagcacatcaggcctttatcttagccacgcagaaaaacaacaacattggtcatcaagaagactatcaatttcatcgtgccattatggttgcttcacataatccttttttcgtgcgcatcctcgataacttacatgagctttatcttggcgtattgatgtattccttaagccaaaataaaggacgtattgccgaaactgagcgtgttattgcagagcatgaagctattgttgaagcaataagacaacaagatagtgatgaaactagccacaaaatgcgtcttcatttagccaatgtacgtggaaagttaaagcgtttacaacaagaaaaaaattaa

SEQ ID NO: 3382 - DNA, 339 bp, Proteus mirabilis
ttaacaatgaacgctggtcgtcggcccgcgctggtaaagcaagctaaaggttattacggtgcacgttctcgtgtatatcgtgtagctttccaggctgttatcaaagctggtcaatatgcgtaccgtgaccgtcgtcagaaaaaacgtcagttccgtcagctgtggattgcgcgtatcaacgcagcagctcgtcagaacggcatgtcttacagccgtttcatcaatggattaagaaaagcatctattgaaatcgaccgtaagatcctggcggatatcgctgtattcgacaaagctgcatttgctgctttagttgaaaaagcgaaaggtgctctggcttaa

SEQ ID NO: 3383 - DNA, 897 bp, Proteus mirabilis
gtaatgaagaaagttggcttgagagtcgatgtggatacttatcggggtacaaaagaaggtattccacaattgctggatgtctttaacaagcataacattcaggccagctttttcttcagtgtcggtccagataatatggggcgccatttatggcgccttttaaaaccgaaatttctgtggaaaatgctaaggtcgaatgccgcttcattatatggactggatattctattagccggtacggcgtggccgggtaaaaaaattgccaaaaatttaggctatttgatgaaacaaacccaagatgcggggcatgaagtcggattacactcatgggatcatcaaggttggcaagctaaagtaggccgttggtcaacagaagaattaatgcaacaggttcgtttaggtgtagaagcactggaaaaagcacttgaaaaacctgtaaaatgttctgcggttgctgggtggcgtgctgatgaacgtgttctaatggttaaagaagctttccaatttgactacaatagtgattgtcggggaacgcatccatttaggccagttctagaaaatggttctatcggtacagtgcaaattccagtaacattaccaacttatgatgaagtggtcggtactaaggtaaaggacgaagattttaatcaatttattattgatgaaatcaaaaaagatcagggtatacctgtttatactattcataccgaagttgagggaatgtcaaaagcggctcaatttgagcagttattggcaatgattgcaaacgaaggcatcgaattctgtccattaagccatctactaccacaagatatagacatgcttccgatgggtaaagttgtccgatctgactttccaggtcgagaaggctggttagggtgccaacaagaggtctaa

SEQ ID NO: 3384 - DNA, 561 bp, Proteus mirabilis
aatatatctgatatgagtttttgtatgaataaaaaaatatatatgtattttattattacttgtttaagtaattttcctcaaccaagtttatcagatgaaatcttacctgatgctcaattaacaatttctttggatgtagttagaatcacttgtgatattaataatggaaaaggatttaataaaatagtagattttgatgttatcaacgaaagtaatttattagctggtaatcaaccagccgtaaaaacacagtttattgttgattgccaaaaaagtggttttaaacctgagcatattgatatcaaagttaagcctggtagccaaggtgcattaaataatggtattggtggtgaacttaaaaccaatttatctggtgtaggaatttatttatcatgggcagactcaagcccaataaatctatctggagtgaataaaagttttagtgcagatcttaataatcaatttgatattagtttttttgcaaaaccatatgctcaatctcaaattgttgaaaaaggttcactaaaaagtagcataattattaatgcattatataagtaa

SEQ ID NO: 3385 - DNA, 432 bp, Proteus mirabilis
atgaataatgaatcgcgttgtattttttctgaaggcagtgtgctattacctgatggctacaaagaacaaactatcaatattctgatttcacctactggtcatgcggtcaatatctcacgagatgataaagcaaaagacctatcctttgaagagtatattcttaatcaaaaagcactgttacaacgttcattaaaagagtggcaactcttagaagaaaacccctccatgctggggcaagatctgatccaaggatatttaatcagctctcgctatcgccccaacaaaaaacaacaagtttatcaaatacaggccgtttatccccttactgatactcaagttcttatatttaccatgtcctccccacacgcttttaatgatacacaatggacatggatgaacaccttgctatcgagttttcaaccaaggggataa

SEQ ID NO: 3386 - DNA, 1023 bp, Proteus mirabilis
caactaatagacctcatcaggtcaaaggaagaggaaacgatgccacatctcgctgaactcgttgctcaagctaaagcagctatcgaaaaggcacaggatgttgctgcgctggattcggttcgtgttgaatacttggggaaaaaaggtcatttaacgctccagatgtccacgctgcgcgacttacccgctgaagagcgtccagctgctggagcggtcattaatcaggcaaaacaagaggttcagcaagcactgaacgctcgtaaagaacaaatggaatcagcactattaaacgaacgtttagcggctgagaaaattgatgtctctttgcctggacgtcgtattgaaaatggtggtctgcaccctgttactcgcacaattgaacgtattgaaactttctttggcgaattagggttctctgtggaatcaggccctgaaattgaagatgactatcataactttgatgcgttaaatattcctgctcatcaccctgcaagagctgatcatgacactttctggtttgatgctaaacgtttattgcgtactcaaacctctggtgtacaaattcgcactatgcaaaataaacagccaccgatccgcattattgcacctggccgtgtttatcgtaatgactatgaccaaactcatactccaatgttccatcaagttgaaggcttaattgttgataaagacattagcttcactaatttaaaaggaacactgcacgattttctgaaaaacttctttgaagaagatatggaaattcgcttccgcccatcctattttccatttacagagccttcagctgaagttgatgtaatgggtaaaaatggcaaatggttagaagtcttgggctgcggtatggtgcatccaaatgtgttgcgtaatgtaggtatcgatcctgaagtttattctggttttgctttcgggatgggtatggaacgcttaactatgttacgttacggtgtcaccgatttacgttcattcttcgaaaatgatcttcgtttcctcaaacagtttaaataa

SEQ ID NO: 3387 - DNA, 285 bp, Proteus mirabilis
taccccacagaactattatctttaaccttaatgatccctgttgtggcattattcacaccatctttaccagaaaaactgagtgtgtatgcaggtaatacagcattacacgtaaaagaaatatttatattttttcctgcaatagtattcatttttacgtcactagcggtttgttcaccaaatgcgacgtcattaacagacactgcacaagaagcattatttatcaacgtcatcgatgttggtgcactaagagcaacgctttccttttgtaacgtattgcccatttga

SEQ ID NO: 3388 - DNA, 4320 bp, Proteus mirabilis
tacacaatggacatggatgaacaccttgctatcgagttttcaaccaaggggataatcactatgttagaggcggcaagggttggagatattatcggtcactcaaaatcgatgtgggggatgcttgtcggtaccctattaggagctgctatcgccatcggtggcgccatgatttctggtgtattaatgggtgcgggtattgctgcaagctgcattggtattggcgtgcttgccattggtgcttccattgccgtcggttacggaactaccctattagccgactgggttcgggataaatgtgttgaaacaggttcaaaatccttaagcccctgtggggaaatccttgacggctccaaaaatgttcgtattaacggcaagcctgccgcaatgtctacccgtagcaacgtcaaatgtgataaagaaaacagtgaacgccaaatcgctcaaggctcgggtagtgtctatatcaacggttttccagcttctcgggtcggtgataaaaccacctgtgatgcgactatcatggaaggttcccccaatgtccggattggcggtggaacacaagcaaccgaagatattgaacctgaaattccctcttgggttaccaccgcatccgatctcacgatgttatttgccggtttcctgagttttggttcagcggcagccaaaggccccggggcagtagcaaagttgtggaacaaattaccgggtagtgccaaaataagtcgctttgcttgtcgttatggcaagatttttactgggcttagtctcgctattccggccattggcatcttaacccgccctgttgaagtgattggcggacaaaaaatcctcaatgacgaggatgaattggattttagctatgaggcggaattaccactttattggcaacgcaattacttaagtagctattgctatgagggtgcactcggtcgaggttggagtttcttttgggaaagccagctaattaaaagcgaagatggctttgtttggcaaaatctatccggtgatatccttccatttcctgacattccactcggacaccgtaactttaacgaagctgctcaaggctggatcatccaccatgaggatgacagttggacgtttcaagatgctggtgagctacgctatcattatcccccttttgatgacaaaggctatagtcgtttaagtcatatcgttgataatgtgggaaacgagcagcggtttcattacaacgagcaccaccaactgatccatattacgggatgtggtgatctcaatatcgagtgtgaatatcaatcttttcaacttgctgaaaagaccgtatcgcgtcttactgcagtctatcaagtaaacccccatcagatacgccgtcgtctatgtgcttatttttacaacgaaagtgcccaattaatacgtgttgagcaacagacaaatcacccttatcgccaatttgggtggactgatgccggtgttatggcgtggcatagcgataaatatggcttacgcagtgaataccgctgggcactttcagaagataatctttggcgagtgattgaaaacaaaaccagcgaaggcgaaagctatcgtcttgaatatgatgatatcaacctcacacgaaccgcttattggcacgatggttcaacctcattttggcaacttaatcatgatcaccaaattattcattatatcgaccgtacaggcattaaaacggcgttaatttgggatgagtttggattaccttgcggttgtcgcaatgcgttgggtcatacacatattagtgaatgggacgcattgggccgactactcagcataacggatggtaatggtaaccaaacgcgttggcaatatcagaatgaacgcgagcgccttatcactgtattttggccggataacacagagtcgcgtttagcgtatgacagtttggggcgactgattaaggaaatttctccccttcatcagatcaccgaataccgctatgactttaaaaccacattgcgccccactatacgcattgatgccaagcaaggacgcagtgagtttctctggaacaaacgtgggcaattactgcgccatactgattgctcaggcaaacaacatatttggtgttatgatgacgaaggccgtgttgtttctcaaaccaacgccttgcaggaagccaccgagtaccagtacgatgaggtgggacacctcgctcgcatcatattgcccgataattctaccgtgcaactggcatggaatgccgcaggattacttactcatcatcaacgcaatgacaataccccatgtcaatggcaatacaacgcctttggtcgtgtcaccacagaaattgataaactcgctcggcatatccactaccattacaatgcacaaggtgcattaatttcaattgaaaatgccaatggcgggcgttatctcctcaaccgtgatgccgaagatcggttagtcgaagaaatacgtcctgatgagacgctactccaatacacctataacgtcgctggacgactggttgaagaagctcacttaggcgaccgagtcttcacatctgcaccacgcacaatattactcgactatgatgcggcgggtaaccttgtcaaacgtgagaccttaactgatcgctatcaatatcaatgggatagtatgaaccgcctattggtcgccagcaaacaacctaatcaacgtggtcttgaaatgggtttgcaagcgaatcaagtccactttacctacgatgcacttggccgcattattcgtgaacaaacaggcgacgatatcgtcgaatttaattatgatgaactcaataacctaagccgtctgacgttacctcaaggtgacagcctcaactggctctattatggctctgggcatgccacggctatcaaccaccttgttgatagtcgctctcagttaattactgaatttgaacgtgacgacctacaccgtgaaatcagtcgaactcaaggagagctcacccaatatcggcaatacgataaactggggcgaaccattagcactttcagctcgcgtgataagcaacatccattaaatggtattactttatggcgtaagtggttttatgatccccaaggtaatcttggcgccatggaagacacctatcgaggttgggtagaatacctgtatgactcagagcaacgtttaaaaaaagtcgccagcagtgaaaacctcgatgctatgctgttttacgatcgcgcggataatctactcgaacgcccacaatccgaaatggatgctgaacactcccctactttagaactaagtccccaaggggataagctacgtcaatttcaaggctggcactatcagtatgatgcctatggtaatgttattgctcgccgttaccgtaaccaatcatcacaaacctatgcttatgatggtgataatcgtctggttatcgctcataatcaaggcataaaagctcaataccactacgatgccctaggccgtcgtattcacaaaaccgttgaaaaccgagaaagtggccaagttaaacgacaagagacgcattttatttggcaagggctacggttactgcaagagcaggatatcaacaccggtaaacaccaaacttattgctacgaagagcacggcagttatacccctcttgccgttatcgtgaaacaatccagcggttttcattattactggcaccactgtgatattaacagcgccccacttgaagtcaccaatgcacaaggcaatacgatatggtcagggaaatatgaacgctttggctttgttcgcagtagccctctgagtttttattcaagtcctgaacgtgtgatggcgtcctttgagcaaaatctacgctatgccggacaatattttgacaatgaaaccggattacattttaatacctttagattctacgacccacagataggccgttttatcatgcctgacccaattggattattgggtgggattaatctgtatcaatatgcgccgaatccgttgggatggattgatccgtgggggttgtcatctcaggaaatggttagagtaaggcaccatacctcagttgaaggcctagaagggataaaaaacacacagtcaatcaaccctgcaagaggaacaccaataggagtgcatatcgagattgctccgtttggagatcccaaaacggcaggtgcagacataggatcttggaaaagtggttcatatgttgagtatgaggttccgaaggaaatgatagttgaaactaacgttggaccaagaaaaacaggggtcataccaaatgaacagccaccatctctacataataagaatactgtgtttaaaaaccaatcttggtggtctcgtttaacagaaaaaggttgtcgataa

SEQ ID NO: 3389 - DNA, 2406 bp, Proteus mirabilis
ataaggtgggattatctcatgaaattcagtgaactttggttacgtgagtgggtaaacccagcaattagtagcgaagagctttctgaacagctaaccatggctggccttgaagttgatggtgtagagcctgttgccggtgattttaacggtgttgttgtgggtgaagtggttgaatgtggacaacacccaaacgcagataaactacgagtgacaaaagtcaatgtcggtggtgagcgtttattggacatcgtgtgtggtgcgccaaattgtcgtcaaggcttaaaagttgctgtagcaacggttggggcggtattaccgggtaactttaaaattaaagcagccaaactacgtggtgagccttcagaaggtatgctgtgctctttttctgaattagctatctcagaaaaccatgaaggcattatcgaattacctgctgatgcacctatcggtaccgatattcgcgaatacttaaaattaaatgataatgcgattgaaatcagcattacaccaaaccgagcagattgcttaggtattatgggggttgctcgcgatatcgcggtcattaataaaatgacatgccaaatccctgatatgtcaccaattgcagccacttcttcagcgacatttcctgtgcgagttgaagcaccacaagcttgtcctcgctatttaggtcgtgttttcactaatgtgaatgtgaaagcgaacacaccattatggatgcaagaaaaattacgtcgtggtggtattcgctctatcgatcctatcgttgatatcactaactttgtcttacttgaaatgggacaaccattacatgcgtttgatcttgaccatgtcgatggggctgtggttgttcgtatgggcaaagagggtgaaaaactaactttacttgatggtaatgaaattaccttaaaagatgatgtactggttattgctgatgaaaaacaagcattaggaatggcaggtatttttggtggtgaatcttctggtgttaatgaagaaactaaaaacgtatttttagagtgcgcattcttctctccattagcgatcaccggccgtgcacgtcgttatggtttacataccgatgcatctcatcgttttgagcgtggtgttgattcagagctacaatatcaggccattgaacgagcaacgaaattattactcgaaatttgtggtggtgaagtgggtgaaattattgatgtcaccaatgacagctatttaccccatgtcgctcctatcaaattaacacgtgcaaaattagaccgtttattaggtcatgttattgatgatgaacaagttgttgattcgttaacacgtttaggttttggcgtcaccgttgaaaatgacgggtggttagccactgtgccttcatggcgttttgatgttgaaattgaagaagacttaattgaagaagttgcacgtatttacgggtataacaatattccagatgtacctttacgtgccgatctgattatgacagaccaccgtgaagcggatctgccattaaaacgtgtaaaaaccatgctggttgataatggattccaagaagctatcacttatagctttgttgatccgaagatccaaagcttactacatcctaatgaagaagcgttgatcttacctaacccaatttctgccgatatgtcagccatgcgtttgtcattgttgaccggattattaaccacagtggtttacaatcagaaccgtcaacaggctagagttaggttatttgaagcaggtctgcgttttgttcctgataatcaagcagaatatggaatacgtcaggaacttatgctagctggtgtgatcgcgggcaaccgttatgaagaacattggactttagagaagcaaactgttgatttctttgatttgaaaggtaatattgaatcaattctggaattgacaggccagttagatgaaattacatttaaaccagccaatcattcagcgctccatccgggacaaagtgctgagatttatctgagaaatgaatatattggctgtattggtgttgttcacccagagcttgaacgtaaacttgatttaaacggccgtacggtagtattcgaaatacgttgggacgcaatcgcaaaccgcaatttaccgcaagcgaaagctgtttcacgtttcccttcgaatcgtagagatatcgctgtagttgttccaaatgatgtggctgcagaagatattttagctgaatgtaagaaagttggcggaaatcaaatagttggcataaacttatttgacgtgtattgtggtaagggagtagcggagggttataagagcctcgctattagcttaatcttgcaggatatcgagcatactctggaagaagatgagattgctgccacagtcaatacctgtgttgcagcattgaaacagcgattccaagcatccttgagggactag

SEQ ID NO: 3390 - DNA, 1728 bp, Proteus mirabilis
aggtcattctgtttttattcattcacttgcaaacttaaagaaggttttatgaactctcatcattggaattgcggtgctgacttggtggttaagcaattagaacaacatggtgttaaacaagtttttgggatccccggagccaaaattgaccgtgtttttgattctttggttgattcaacaattaaaactattgttgtgcgtcacgaagccaatgcggcttttatggcgggtgcggtaggacgtttaaccggtaaagcgggtgtggcgatagccacttctggtcccggttgttctaatctagcaacgggcattgcgacagctacatcagaaggtgatcctctagttgccttaggaggctcagttaaatctacggatagacttaaactggttcatcaaagtatggacacagtaacaatgtttaacccaatcactaagttttgtgctgaagttgattcttcacaatcaatttcagagacgttagccaatgcttttcgtcatgcggagtcaggtcgtcccggctcggcttttttaacctttccaatggatatactcaataatgaggtagatagcccgttattaacacctaaatccaaacctaatttaggtgccgcgagtgatagtgcaattcaagaagcgatcagcttattattacaagcgaaaaaccctgtgatattaatagggcttcaagccagcgatccggaaaatgctcttgccttacaaaatttccttgatatttttcctgttcctattgtaggtacttatcaatctgccggggctattgctcatcgccattttccactctttgccggacgaattggcttatttaataatcagccaggggatgaattactggcacacgctgatttagttatcactttaggttatagcccgattgagtatgagccttccttatggaacagtcataatgccaatattatccatattgatgagatccaagctgaaatcgatttagcttactgccctgccttagaattaacaggcaatattaaattaacactggataagttaacgcaacaattaactcaccagcctaattcaaaattacaattgtctaatcagagccaaggaatactagagaaaatacgtcagcaaagggaaattttgcaacaaaatagttattttagacaaggcacacctattcatcctttaactatcatacatgaaatgcaagatatcattgataacgatgtcactctttgtattgatatggggagttttcatatttggcttgcacgttacctttatagttttagagcgagacaaatgctaatttctaatggccaacaaaccatgggagttgcattaccttggggaataggcgcttcttttgtacgtccttgcgataaaattatctctgtttctggtgatgggggatttatgcaatcttcaatggagctagaaaccgcagttcgtcttaataccaatatattgcatattatctgggttgataatgcttataatatggtggagatgcaagaagaggtaaaatatggccgtccttctggcgtaaaatttggtcctattgattttaaacgctatgcagaatcttttggtgctaaaggattttctgttgagtgcgcatctcaacttcgtgaaaccttacgtaaagcgatagctgttgatggtcctgctgtgttagccattcctgttgattatcgtgataacgataaattaatgaagcacattaattataatttaattatttag

SEQ ID NO: 3391 - DNA, 855 bp, Proteus mirabilis
ataaggatctgcttcattatgaaaactagctttaaccatatcgagcgagataatagtgatatcacccataaccataaaaatactcatagttcctgcaactgcacccaagaaataataacttctttaaatcattatattaataaacatccagaatgtactatctaccaaaattctttaatgagtagtcttattgctggtgtttatgatagtaatgttactattgctgatttattaaagcatggtgattttggtttaggtacttttaatcatcttgatggcgaattggtcgcctttgatagtaacgtttttcaattacgttcagatggcagtgcgcgagaagcccgtccagatcaaggctcgccttttgctgtaatgactttctttaaacctgatattacacatcagttttcagatcctgtctctcaacaacaggttcacaatattattaaccaatatgtcccttccgataatctattttgtgccatcaaaattgaaggcgaatttgaattagttaaaacacgtacagtgccacgtcaagagcctccttatgtgcccatgctagaagccattgaaaatcagcctatttttacctttcacgatgaaatgggtattattgccggctttcgttccccacaatttactcaaggccttaatgttgctggatttcatgagcattatattaatcaccaacgtgaaggtggtggccatgtacttgattatcaattaaaaaaaggcaccctacaaatcggtgttatctctcgttttactattgacttacctcatcaatcaacattcttagaagctaatttaatgcccgatgaccttcatcaggcaatagaacaagccgaaaactga

SEQ ID NO: 3392 - DNA, 375 bp, Proteus mirabilis
gggactatgtgcaaatctatattgcttaccagcctgttaatctttatcacaagaagttgttatggctctgagttaaatgcaacctcaatcattggcggtgctgttcaatcgcaatttagtatgaatgtaaaaatagctacatgcttacccgctactgttgacaatgttacttttggagcagttgatacagcgactattttatcgggtgaagttgaagggcactcaacactctttttggattgtacgggcacaattaagccacaaagagttacaatactttttgaacctgctaatcctcatttaaccatgggtagtgtgggttatattggttcaaaaaataccacacttggctattttgtgtcgtgggaaaaatga

SEQ ID NO: 3393 - DNA, 996 bp, Proteus mirabilis
ccgttgaagctattgatgattatggtgctagacgtgttattgagcttaattaaggaagtaaaaatgaaaaataaatcattttatttcacgctattattattttttattgctatggatacttctgctgctcgatgtcggaatgtgtcaatcaaatataattttccagcccaaatagatattacaaataaaaaagtgggagataagctttattcttttggtgcgccagacgcccctataaacgttgctggtcaatgtctacgtgctaatagtggggcgggaaatacaaatggaaattatatttatattgttgatcaatatggatcatcaccaacattatgcccgactactggtacagttgataaaaattcaccagatggatacttgcgttttcgttcaacgggaagttgtgctaattcttcttggctgctagttcttgattataaaatatctggggttggctggaccaatttaacaggtcccggtggtggtactgattcaggcgttgtttatttacaaaaaaagccacctgtaggaaaaacggttattaatcctgtctatatgttgaaacgtaattattattctcgaattggtcaaatgggcaatacgttacaaaaggaaagcgttgctcttagtgcaccaacatcgatgacgttgataaataatgcttcttgtgcagtgtctgttaatgacgtcgcatttggtgaacaaaccgctagtgacgtaaaaatgaatactattgcaggaaaaaatataaatatttcttttacgtgtaatgctgtattacctgcatacacactcagtttttctggtaaagatggtgtgaataatgccacaacagggatcattaaggttaaagataatagttctgtggggtatcaactttcttgggcagatagcacggttaaacccattaatagtgctgtagttattaataatgtggcaatagctcccgaatccagaggcgaaaatcccaataattttacttatttccgataa

SEQ ID NO: 3394 - DNA, 777 bp, Proteus mirabilis
ccactaaacagatggagcgcttataatatggcacaattaaaactatataaattagctgtcaataaaagactatatggtattactgaacaagttaatgatggcgaacgcattcatttaattggcgcgaatggggcgggtaaaagtacgttgttaatggccattgctggtgaagtttcatacgttggaaatatatttttaaacgaaacttcaatgagggattataaaattgccgaactttctagaatacaaagcgttgttagacaacaatcgttagctttgccatttatgccagtgtttcattatctttctttatcctatcagttatcaaaaatggatattcaagaattgaatgcactattaagcgattttcaaatcaataaattattgtcaaaaaatattcatcatttatctggtggggaatggcaacgcgttcggattgttgccacttttatacaattatggtcaagcgatgatttaacaggaaaattaatgatgcttgatgagccgacaaataatttagatattgtacaacttactttattggataaatggctagataaattttgtctacaaggtggcagtattattatgagtactcatgatttgaatcattcttatctaaaagcagataagttatggtttatgttagagggaaaaataatcaactcaggtgactcagcacttttgttggatgaaaatttattatctactacatttaatactaagattagatgtaatagatcagcaaatagtgtaatttggcaagtaatagagtga

SEQ ID NO: 3395 - DNA, 252 bp, Proteus mirabilis
acagaatcaagtaattcaacattattcggaatttcttctgtatttatttttaaattattttcaatgtatggtgataccccaacaatagtgtttccttctttgtcagttgacggtgaatcattgaatgttataccctctatatttttaatttttgcaattgcgacagtatctcttctgacattactgaataataatcctgtatctggggtggctaataaacttcatgaagcattaatagaactggtagtttga

SEQ ID NO: 3396 - DNA, 1002 bp, Proteus mirabilis
aattctttcggagcatatctagtgtcaacatttgaaaaaatcaataaagtatcagtcgttattcccgtttataacgaggaagagagtctcccacagcttttagagcgaacaatcaaaagctgtaaacagttagaacaagagtatgagctgatccttgttgatgacggaagtagcgataattcagcaaaaatgctagaagaagctgccaacattgaagataaccatgttattgcgattattttaaatcgcaactatggtcaacactccgctattatggcgggttttaaccaagctgatggggatttagtcattaccttagatgctgatttacaaaacccaccagaggagatcccccgtttagtggcaaccgcagaagaggggtatgatgttgtcggaactcgacgccgtaaccgtcaagattcgtggtttcgtaaaacggcctctaaaatgattaatgccatgataaccaaggcaacaggtcgttcaatgggggattatggttgtatgttaagagcatatcgtcgtcatattattgatgcgatgttgcaatgccatgagcgtagtacttttatcccaattttagcgaataccttcgctcgtcgtacgattgaaattgaagttgctcacgctgagcgtgaatatggtgattcaaaatacagtttcttaaaactcatcaatttgatgtacgacttattaacctgtctgacaactgcaccattacgtttattaagtgtcgtaggtagtgtgattgctgttgccggctttttacttgccgtattattgattgtactacgacttattttcggtgcaatttgggcggcagacggagtgtttacactctttgctatcttattcatgtttatcggtgcgcagttcgttgcaatgggtctattaggtgaatatataggccgaatttataatgatgtaagagcgcgtcctcggtattttatccaaaaagtggttggcgttaaaaaacccaacaaaaatcaggaagaagactaa

SEQ ID NO: 3397 - DNA, 1029 bp, Proteus mirabilis
ggatatcttatgtcaggcaaattgcgtctacttctttctgagtcttatgatccatggtttaacctcgcggttgaagagtgcatttttaaacagatgccagctgatcaacgagtcctttttttatggcgtaatgataatactgtggtgattggtcgagcacaaaacccatggaaagagtgtaatacccgaaaaatggaagaagatggtgtgaaattggcgcgtcgctcaagtggtggcggtgcagtatttcatgatctaggtaatacctgttttacctttatggcaggcaaacccgaatataataaaactatttcgacgcaaattattttagatgggttatcgaaagccggcatacaagcaacggcatcaggacgaaatgatttagtcgtaccattggctgatggtgaaagaaaaatttctggctcagcctataaagagacaaaagatcgtggttttcatcatggtactttattaattaatgctgatttatctcgtttagctaactatttaaatccagatccgaaaaaactacaggcgaaagggatcacctcggtgcgctctcgtgtcactaatttagtggaattaaaacccgatataactcatgaaaagttatgccacgcgattactgacagtttttttgactattatggtgagcgtgttgaagctgaaattatttcaccacaaaaattacctgatttaccgggttttgcagaaacatttgcaaaacaaagtagttgggagtggaattttggtcaagcgcctgcgttttcacatctattagataatcgctttaaatggggtggtgttgagctgcactttgatattgaacgcggtacgattattagaagccaaatttataccgacagtttagatcccgcaccattagaaaagctatcgcagatgttagttggacagcgttatgcttctagttcgatgaaaagactattagcgcaattaatagagcagtacccaaataaccaatcagagcttgaagagctgcaacagtggcttgttcatgcgctttcttaa

SEQ ID NO: 3398 - DNA, 366 bp, Proteus mirabilis
aagtttattatcatagtaaatattcattatcgacaacctttttctgttaaacgagaccaccaagattggtttttaaacacagtattcttattatgtagagatggtggctgttcatttggtatgacccctgtttttcttggtccaacgttagtttcaactatcatttccttcggaacctcatactcaacatatgaaccacttttccaagatcctatgtctgcacctgccgttttgggatctccaaacggagcaatctcgatatgcactcctattggtgttcctcttgcagggttgattgactgtgtgttttttatcccttctaggccttcaactgaggtatggtgccttactctaaccatttcctga

SEQ ID NO: 3399 - DNA, 525 bp, Proteus mirabilis
aaaccaatcttggtggtctcgtttaacagaaaaaggttgtcgataatgaatatttactatgataataaacttttattagccctgtattcatatttacggcaaactgagttatccatagatagagggttaaatgaatggaagaatgctagatcttacttaaaacatcgctatttagctgataaactaatcatggcattggctataaataaaacactacatcagaagaacacctttagtaaggtatattgctatgcatacctaaagttacgacataaacaatatttgacacgacaagagtctgatacaatatgttgtttattaagaactattggaagttatctttctgaagattcacctgatagatctaatttaattaaactaagaatagaactgtataatgctgcaaaattagttagaaaaaggattaccaataataatcgaataatattagctgatagagtagagcattataatcagcatttgcatggtactttttattctatagaagaaataactagtttatag

SEQ ID NO: 3400 - DNA, 1161 bp, Proteus mirabilis
ttaggctacatctttatgagtcactttcttccattctcccgtcctgctatcggggatgaagagattaaagcagttgaaagcgttttacgctccggctggatcacaacaggtcctcaaaatcatcagctagaacaagatttttgtgaaaaatttggtagcaaacatgctattgcggtttgttctgcaacagcgggtatgcatgttgttttgatggcgatgggaatagggcctagtgatgaagttattacaccttcccaaacttgggtatcaactatcaatatcattacgttattaggcgcagagccagtaatggtcgatattgatcgtgacacattaatggtcagcgctgaatcggtaaaaaaagcgattaccccaagaaccaaagcaattatccctgtgcattatgccggagcgccttgtgatcttgatgcactaagagcggttgctgatgaggcgggcattcctctgattgaagatgcagcacatgcgataggtactcgatataaagatgaatggataggtgagaagggaacttctattttttcttttcatgccattaaaaatgtcacttgtgccgaaggtggattagttgttacggacgatgatgaattagccaatcgagtccgttgcttaaaatttcatggtttgggtgttgatgcttttgatcgtcaagtccaaggacgtaaacctcaagcggaagtcgttgagcctggttataaatataatctctcggatattcatgctgctatcgcggtagtgcaattaagtcgcttagaagaaatgaatgctaaacgtgctgagttagttgccctttatcgtgaaaaacttcaagattcaccattggaaatgttaagtgtgccggaatatccacacttacatgctaaccatctctttatggtcagagttgataaaaatgcctgtggtatcgatcgtgatacatttatggaaaaactcaaacaaaaagagattggtacagggcttcatttccgtgctgcgcatacacaaaaatattatcgtgagcgctacccttcgttatcccttcctcaatcagaatggaactctgcaacgttatgctcgctgccgctgtttcctgatatgagcaataaagatgttattcgcgttgtcgatgcgatcaatgaaattctttcggagcatatctag

SEQ ID NO: 3401 - DNA, 543 bp, Proteus mirabilis
aggggcaaaatattatcaaaggagaataaaatggagatactccattcaatgcttgacacattaagtcatgtttctcctatcgctttattttttactattaccctgctcactgcgggaaaatctactattggtatttcatcctttttacctcccgcatcgttaatgctgatcttaatatttggggtttgcttgcccttccattcgcctattttactttggttagcaactagtttaggtgccttattaggatctatagtgagttatcagttagggcgttccatttattatttccctcgcttaaataaatgggttacccgctatcaaacaaagatcttacgtatacaacaactgttaaaaaataaagcattctttattctttttatttcacgctttttagctgtgtttcgctaccttacgccttttagcgcaggtttattaaaactccccatttatggtatttatctaacaagtactgtttcagccttagtgtggtcaggagtatttattttaatagccaatggcgtaatctccatctcattataa

SEQ ID NO: 3402 - DNA, 285 bp, Proteus mirabilis
gaaaaaggaatgctttcacaaatgaaaaaagatgataataatagcgttagtatgtcggatttttttaataaaaaaacagggttgtttataaagtataaaaggaaagagttaggtttaacaggacaggatttagcgatcatattgaatgttagtcagcaacaaatttctcgatatgaaaatggaactacaaatattactgttaccttacttaataaaatactgatgatattggactcatcatggagtgagtttttaacatttaatgaattaactgataggtattaa

SEQ ID NO: 3403 - DNA, 705 bp, Proteus mirabilis
aatctaatgatcataaaattatggaaattgaatgtaatgaatagaatagtatttgtttttgctttaatcatatcgtcattaacctgttttaaagcatattcagcgtttacgcttaatggtactcgctttatttatgatgaaggtcgcaagaatatcgcgatagaagttaagaataatagtgataaaacctatggtggccaagtttggattgataatcttaatgggaatgaagtgttctttattcctgcacctaatttattcaaaataactggaggagaaaaacaattaatccgcttgctatatgtaaatgatattttacctaaagatagggaatcattgttttggctcaatattcaggaaatcccgccaatttcttctgccgatgacagtaatgtgcttgctgttgcattaaacacacaagttaaactgatttatcgccctaagattttagctgaaaaacgcgaggatgcagaaaaaagtctgacatatagtggttcagttttaaagaatcctacaccttactattttgcattaactcaagtgtcagtcaataataatcctttggtcttgtcaaaagacattgagcaatctattagtttatttccacctttcagtgaggtaaatgtgcagcgcccattgttaggtaaagtaaccgttgaagctattgatgattatggtgctagacgtgttattgagcttaattaa

SEQ ID NO: 3404 - DNA, 345 bp, Proteus mirabilis
gtaatggccttttttttgttacttattgttagtttgctaacctgtattggccaagtttgtcagaaacaagcagtggtgagttggcaaaataattcaaccactaaagccagaaagacgattttctggcttattactgccatcgctatgctaggctttggcatgttattttggttacgtttactgcaaatcctcccacttagtattgcttatccgatgttgagtattaactttattgtcgtcactttgataggccaatttatctataaagagacggttaatgtgaaacattgggttggtattgcctcgattatgttaggtattgtgttaatgagtatgcagtcatga

SEQ ID NO: 3405 - DNA, 252 bp, Proteus mirabilis
ccatgggtagtgtgggttatattggttcaaaaaataccacacttggctattttgtgtcgtgggaaaaatgaacaaataggtgctattggtgaaggggtaccaatggggaaggcacttttttttaaaaaaacggatgcttcattgatgaaagttaaacttaaaataaaaccagttgtacttccattaggaggaaagtccgttcatttgggtaatggaaatacccatataactatcaaaataaaatatatctga

SEQ ID NO: 3406 - DNA, 1077 bp, Proteus mirabilis
tgtgaaatattcacctgcgtttttatgtacaggaacaacatcatgagaataagaaaaacaaagcttgccatcggtattgttgctgttattgctgttgtatcactagcaatgatcggcaaaaaagagaatgccaataagcaatttctctctgtagcaacggcctcaacaggaggaacttattacccgatgggagtcggtttagccaatgtttggagcacccacctcaaggatagaggaatacaagtcacagggcagtcctctgctggctcaattgaaaatatctatttaatgcaacaaaacgaagctcagctttctattctacaaagtctattagctgtggaagcttacgaaggtgtacgtaattttgaaggcaaaccagaaaaaaatctacgttctatatcaatgctttggccaaatgtagagcactttgtcttaatgaatgacaaagtaaaaacaggaacattggatgatattcgtgccaccagcttctctgtcgggccacaagccagtggcactgaacaatcgaccattatcattcttaaaggtgtgaatttaactaaaaaagagatcactcctgaatatcttggttatggagataccgtttcagcaatgcgtgatggacgccttgatgggggagcattacctgcgggtgttcccgcctctgcggttaccgatatgtatgccagtggtgttaatgccaaattacttgaagtgactgataagcaacttgatgatattaatcatattgctaactcttggtttcgctttgaaataccagcaaatacctaccctcgccaagcagaaaaagtaaacaccattgcacaacctaatatcttaatgacaaccacaagtattgatgaccagttagtttatgaattgactaaaaccatgtttgaaaacttaccagaagttcatcaagtacatagtgctgcaaaatacatcaccaccgaaaatgcgttaaaaggtgtttctgtgccattacaccttggagcttatcgttattacaaagaaattggattagatatccctgactatttaattccacctgaagctcaaacgcaaactaataataaataa

SEQ ID NO: 3407 - DNA, 465 bp, Proteus mirabilis
tgtgaaacattgggttggtattgcctcgattatgttaggtattgtgttaatgagtatgcagtcatgaaaaccggttacttatgggccatcgccagtgcattattagtcacagttgcacaactactgttaaaaataggtatgtcagaattacctgatctgcaattagaaaaacagtggtttgatcttcattggttatgggcaaacataatacctatcagcgttgttttcgtgggactgattggctacgtactgtcaatggtttgttggttattgactttacgtacaattcccctaaacaaagcttatccactcatcagccttagctatgtctttgtttatattctcgcggtagttttaccttggtttcaagaaacgctgtcgtggtctaaaacaataggtatcatttttattatgctaggtgtttggttaataagccaaaaaacggagcaaacaacatcgcattag

SEQ ID NO: 3408 - DNA, 519 bp, Proteus mirabilis
atgaaaaaattattattacctttagtcatgagcagtgcattatttagtggatatacattagctaataccggtgaagttcaatttattggtgcggttacgtcggaaacgtgtgatattgatacagaaattggtggtttagttaaatcaacaatcgatttgggtaaaatgaccactgcagataccaatggtaaatatgttgaatttgaattagtccctcgtacggatgaatgcctgaaaaaaaccagtggccaagttggttggcaaagtgcaggttttactaattcaggtcttgctaatatgaaaggtactgccggtggtgtatctattcaattaacagcgattaattcaaccacacctaatcaggatgtaacttataataaccaaagtgttgattttggtaatggtaatgatccaattggtaatatgaaatttaaagcaagaatgacagcaacggcaggtcaaactgttacagagggtactgtaatttcaagcgcaacttatgcagtagcttataaataa

SEQ ID NO: 3409 - DNA, 483 bp, Proteus mirabilis
ttagttttttctaattgtagtcggaggtcagactttacatataggagaattttatgtctgaatggacaggcgaattatatggattttatacgaacaaaccaacggaaagtattttttcttttttttttaaatgagatccttaaaataaattatctatacgaatataattcatacaacaacgaagaatctttattttttataaatgataaaaacatgttacttcatcatgaagatatttgctataacctcgatattgacaataaaggatatttttgcatagaagctaagatagttaatttacatggaatagctaaattatttgaatttaaatctgaatcaaattttggaccatatgatataaatatacagttagatgatattttctattatgttttagttttacctgacttcattgaaaactctcaattttgttcggatatacatagtctttttgtaaataatctcgaaagaatacgcttataa

SEQ ID NO: 3410 - DNA, 219 bp, Proteus mirabilis
tcattagattctactttctccaaatttaaagtacatttttcaccattaggtgatataacgaatagcttattaggcttatctaataaatttaataaaagaaccccagaatttgaaacaaaccctatatattcatcatttttatttctaacagcacttccagcagaaataaaatcaccattttatttttttattcgtaaatatatacctgtgaattgttga

SEQ ID NO: 3411 - DNA, 588 bp, Proteus mirabilis
attttcagctcatgcgacactcattgcggagtttatgtaatgaaaaacagcataataaagtcagctataacttgcttgttattgctctctcctagcacttttgctgccactgatattattggtggagagatggaatttaaaggtgttgttgttgcacatggctgtacgattgttgcgggagatgaaaataaagttattgatttcaaacaaatatctgcaaaagatctctattcactacaaaaaagcaaccccgttgcttttagtatcagtttagaaaattgtagccaagatatttataaaagtgtcactatcacattagatggtcaagcgcattcaacaatgcccaatcatatagccgttactgggagtggctcagaagatccgaaaagtattggcatcgcttttaccgacaaggcacataatattattgaattaaaaaaaccaagtgctcctcaacagcttaataataaacgagtacaatttgattttatggcctatgttgaagcaacatcatcagctattcaaaatcaaacgatactcacaggaccatttcaagcacaagcaacctatacactcaattaccaataa

SEQ ID NO: 3412 - DNA, 186 bp, Proteus mirabilis
aggaagaggtcgatgtttcaaacccatacccgccacccattttttttatttttcgtgacaaacccttatttatgcgctatccttaccttagcctatacctatcccttaataataaccatagagcctatttgtgttcaggtgtgtactaaaatactggacccattagtcttttatcaatgggatttt

SEQ ID NO: 3413 - DNA, 351 bp, Proteus mirabilis
caggataatccgatgaaaaaaattgaagcgataattaagccgtttaaattagatgatgtaagagaagcattagccgaagttggtatcacgggtatgacggtaacagaggtaaaaggctttggtcgtcagaaagggcataccgaactttatcgtggtgcagagtatatggtcgattttttacctaaagtaaaaattgagatcgttgttgctgatgaaatagctgaaacttgtgtcgatactataatgactaccgctcaaacggggaagattggcgacggtaaaatttttgtttttgatgtgaatcgagttatccgtattcgtactggagagcaagacgaagaagctatttaa

SEQ ID NO: 3414 - DNA, 348 bp, Proteus mirabilis
tcaatttgtccggcgttcgagtcgcccacgacccaccattcacaatactaccttaagtttttacgtaaaatattaaatgggtcgatagctcaatcggtaaagcaattgcttttaattaattttccggccgttgagtccccacaaacccacctttattatttaaccggggggttactaattgggaaaacattttctttaaaggaagaggtcgatgtttcaaacccatacccgccacccattttttttatttttcgtgacaaacccttatttatgcgctatccttaccttagcctatacctatcccttaataataaccatagagcctatttgtgttcaggtgtgtactaa

SEQ ID NO: 3415 - DNA, 735 bp, Proteus mirabilis
aaatcaatgttagaaaatattcgcattatccttgtcgaaacttcacatacaggcaatatgggctcgacagctcgtgctatgaaaaccatgggattaacgaatctttattttgttaatcctaaagaaaaacccgactctcactctatagccttatcagcaggggcaagcgatgttattggcaatgctcatattgttgatactattgatgatgccattgaaggctgtgggttagtggttggaacaagtgcgcgtaatcgtacgctctcttggccaatgctagcacctcgtgaatgtggtgaacgttgcgtaaaagaggcagcaaataagcccgttgcggtgatctttggccgtgaacgcacaggcttaactaatgaagaattacaaaaatgtgattaccacctctatattcctaccaaccctgaatatggctctttaaacttagcgatggcggtgcaacttgtttgttatgaaattcgcatggctgcacttgctcaacaggaaaaacaagaggaaaatgcttcatcagagattgattatccacccgctgaagatattgaacgcttttatgttcacttagagcaggtacttaatgagtctggttttattcgtcctaaacatccaggacaagtgatgagtcgtttacgccgcttgtttacgcgcgcacgtccagaaacacaagagcttcatatcttacgtggtattttaacatccgttgaaaaatgggctaagaaataa

SEQ ID NO: 3416 - DNA, 447 bp, Proteus mirabilis
accaaatacccaaattctgatatgccattagaatttgattttgtgcccacattggaggtcgaaatgattactggtatccaaattactaaagctgataacgacgatttattacattctttttggttgttagatgatgaaaacggcgaagcacgttgtatttgtgcaaaaaaaggctttgaagaaggccaagttgttagccgtgatgcattaggcaacatcgaataccgtgaagtaccggtagaatctaaaccggtagtacgtgtagaaggtggtcaacacctaaacgttaacgtattaagccgtgaaacattagaagatgccgttaacaatcctgagaaatatcctcaattgactattcgtgtatccggctatgcagtgcgttttaactcactgacaccagaacaacaacgtgatgtaattactcgtactttcactgaaagcctgtaa

SEQ ID NO: 3417 - DNA, 207 bp, Proteus mirabilis
ccatccaaccccccatttttaacatgcaaaaaaacccgccaagaacatgttctcgaagcgggcttgtataacgggttttattatatcgttacaaacttatgcgtaaactggaaatttagcgcagatatccaagactttttgtttcactttttcaatgttcgcttcatcattgatattatcaaggacatcacacatccaaccggctaa

SEQ ID NO: 3418 - DNA, 1497 bp, Proteus mirabilis
aaaacaacgttaacgagaaccaacctattgaacaatataaggattaactatttcgttatcgttatcatagcgctattttcagccgcgattattgcactgaatattacttggcctgacaggcaaaaagcgcagataaataagattttatctcgtggtgagcttagagtgagtactatcccttcaccactgataacgataaatgataaaaaggaccccgtaggtttcgattatgaattagtgaaacgctttgctgattatcttggcgtgaaacttgtcgttaatatgcggacgaatatcaaccaactctttgatgatctggagaataataaagcagactttattgccgctggattaatttataataaagaaaggctagatacgacacgaagtgggccagcctatttctcagtttctcaacaactgatctatcgtaaaggcacattgaggcctcgtcgttttgatgagcttaatgggcgccttgtcgtcgcagccggttcagctcatgccagcttattaaaaacattaaaagaaacgcaatatcctgaactcgaatgggaagaatcagagactaaaacgacgtcacagctacttgaagagttatctgaaggtaaaataacttatgtactggccgattcaatcagcgtcgcggtacaacaacgcattcaccctaatgttgcagtcgcttttgaggtgacggaaagtcgtccattaacgtggtatttaccaaatcaagatgataatagtctgtatgcagccatgttggattacttcaatcaactttcccaagacgatgtgctcgcaagactagaagagaagtattttggtcatgttggttcatttgactactttgatacactctcttttattaccgccattgactcaatattacctaattatcaacctctgtttgaaaaatatgccgagacttttgattggcgtttattagcagcaatggcttggcaagaatcacattgggatccccatgccacgtcaccgacaggtgtaagaggcttaatgatgctaacacgtccaactgcatcaagtatgggtataacagataggttagatcctgaagaaagtatcaaaggaggtgcacaatatttaaaacatcttctttctcgcctaccagatactatccctgatgatgaaaaaatctggtttgcacttgccgcttataacatgggatatggtcatatgttagatgcaagaaagctagccgaacagcaaggcgccaatcctaatagctggttagatgtaaaagcgcggttacctttgatcagccaaaagaaatactatttagatcttccgtatggttatgcgagaggacatgaagcttatcgttatgttgaaaatattcgtcgctatcaactcagtttagagggatacctacaagcaaaagagagtaaaaataagatcctatcgaaagacgaaaaagacgattcagccaatactgctttattaccgcctcgctccgtaggaaccccctcttcatcttag

SEQ ID NO: 3419 - DNA, 1476 bp, Proteus mirabilis
catcgcattactctaataggtgttgagatgatttcattgaaaaagtggcgtattttcccccgatctttaagacaattggttatcatggcattttggatggtgctgttaccgcttctcgtccttgcctatcaggcttatcaaagtttggatcagcttagtaaccaagccgctattaccaataaaaatgcgttagcggataccgagcgtagtgaggtgatgcgtaatttagctattgaaatggaaggaaattatcgacgatattgtgtattgcgtgataaaactgatgaagaaatgtatcaacagcgttatcaacaatacagcaaaatgttctctaccttgcagcagactatcatccctctttctgagtctaaagaagcacaagccttgaatacttctttgaaaacgctcaaatcaattcaatgcaaaaatagtgaacccacttctcaaatgcaacaagcattagagcaattttcttatgccaataaccgcattgtcgtgttaactaaagagattatttttagtcgtggcgagcaactacaaatggctattgctgaaaaagggcgttattttggttggcaaagtttaattgtttttgtttttagcctgattttaattgccttatttacccgtatgatcatcggtccggttaaaggtatagaaaaaatgattaaccgattgggggaagggcgtacattaaataataacttgaattcgtttcagggaccacgtgaattacgctctttagctcaacgtattatttggttaagtgaacgtcttgcatggctagaatcgcaacgccatgagtttttacgtcatatttctcatgagttaaaaacaccgttagccagtatgcgcgaaggaacagaattattagcggatgaagtagcagggcctttaaccttagatcaaaaagaagtcgtagctattcttgataatagtagtaaacaacttcaattattaattgagcaactacttgattataatcgtaaactttccgaagtacctcagcaaattgaggaagttgatttaaccacattagtgaatgatgtggtgttagcgcatagtttacccgcccgagcgaaaggcattaagacgataatttcacttgatctgaaaaaatgtcgagcagaaacgacgttattatcaagagttattgataatctctactcgaatgcggtgcactatggcgctgaatcgggtaatatctggatctctagttatcaaattgaacagaaaatagttattgatatagccaataaaggcactccgatccctgaatcagaacaaaaaatgatttttgagcccttttttcaaggttctctattacgtaaaggggctgtcaaagggagtggtttggggttaagtattgctcatgactgtatcaaaagaatggatggcgagttaaatattgttcattctgactatgctgatgtctgttttcgtattgaactaccgctactttctgagaataaataa

SEQ ID NO: 3420 - DNA, 1443 bp, Proteus mirabilis
gtaaaacgtactaaggcaatctcaatgagtaaaataaaaacccgttttgcaccaagtcctacaggctatctacatgttggtggtgctcgtactgcactgtattcctggttatttagccgtcacaacaagggtgagtttgtacttcgtattgaagacaccgatttagaacgttctactcaacctgccattgatgcaattatggacggtatgaattggttaaatctaaactgggatgaaggtccttactatcaaaccaaacgctttgatcgttataatcaagttatcgatcaaatgttagcagctggtactgcttatcgttgttattgttctaaagaacgtttagagaaactacgtgaagatcaaatggcgaaaggtgagaaacctcgctacgatggttgttgccgtcacggtgatcacaaccataccccagatgaacctcatgtagttcgttttttaaatcctcaagaaggatctgtgatttttgatgacaaaattcgtggcccgattgagtttagtaaccaagagcttgatgacttaattatccgccgtactgatggttcgcctacctataacttctgtgtggtgattgatgactgggatatggaaattacacacgttattcgtggtgaagatcatatcaacaataccccacgtcagatcaatatattaaaagcacttggtgctccagtacctgaatatgcacacgtatccatgatcttaggtgatgatggtaaaaaattatctaaacgctataacgcagtaagtgtaatgcaatatcgtgatgacggttatttaccagaagcgttattaaactacttagtacgtttaggttggtctcatggcgaccaagagatctttagcatcgatgaaatgattaaagagttcactttagaagctattagtaaatcagcaagtgcgtttaatactgacaaattactttggttaaaccatcactatattaataccttacctgctgaacaagtagccgtacacctagattggcatatcaaacaacaaaatattgatactagtaatggcccatcactggttgaattgattaaattactcggcgagcgttgcaaaacattaaaagagatggcggaaagttgtcactacttttatgttgactttgatagtttcgaagaaaccgcggcgaaaaaacacttacgtcctgtcgctcgtcaaccattagaagtagttcgtgataaattatcagcaattactgattggacggcggaaaatgtgcataaagcaatccaagaaaccgctgaagaattagaagttggtatgggtaaagtcggtatgcctctacgtgttgctgtcacaggtgcgggccaatctcctgcactagatgttactgttcatgctattggtaaagctcgtagcatcgctcgtattaataaagcattagattttattactgacagagaaaatcaagcttaa

SEQ ID NO: 3421 - DNA, 471 bp, Proteus mirabilis
tatgatcgcacacagtgttgtcgtacaggaataactatgcctcagattagtcgatctgctctagttccttttagtgcagagcaaatgtttaaactagtgaatgatgttcttacttatcctgattttctaccaggatgcgttggaagtaaactgatcaaaagcactccagaagaaatgattgcatctgttcaggtttctaaagcagggatcagtaaaacatttactacccataattttttaaaaaccaatgaacgtgttgatatgcgtcttgtggatggcccttttcgtaaactaaccggaggctgggtatttaccgcattagatgataatgcatgtaaggttgagtttcagctagactttgagttcaccaataaattaattgagttagcttttggccgtatttttaaagacttaacaaataatatggtgcaggcgtttactcaaagagcgaaagagatttatcgtgactaa

SEQ ID NO: 3422 - DNA, 348 bp, Proteus mirabilis
agtgggcggttagctcagttggtagagcatctcccttacaaggaggaggtcgttggttcgagcccaataccgcccaccacttcatccggttattttacgcaatatcacacagttaggtatgggtcgttagctcagtcggtagagcagttgacttttaatcaattggtcgggcgttcgagtcgcccacgacccaccattcctaaatatacaacaaagagtagtgaacattgtgacgggtcgttagctcagtcggtagaacagttgacttttaatcaatttgtccggcgttcgagtcgcccacgacccaccattcacaatactaccttaagtttttacgtaaaatattaa

SEQ ID NO: 3423 - DNA, 288 bp, Proteus mirabilis
attacagtaacttatatcttgcacttatatgttacttttagtttattggttgtatttttactgcaaattgacagtgttactacaaataatagagcactgccacacaaaataaatacacaattatatacaaaagagtgtgagattatcatatacgtgaaagattctaaatatattgatgttgcagaggggaatatcttttataacatttcacacgctaatatctttagttatcaatctaaaacaggctacaataccgcgctgtataataatgaagagatgttcttgtga

SEQ ID NO: 3424 - DNA, 417 bp, Proteus mirabilis
agaaatgaaacgcctaatgagagaagcgcgtcgctaatggctattgttggtataggtatggatatcgttgagatatcacgtattgaagagataatagggcgttcaggagaacgcctcgcgcgacgcattcttactgataatgaatggattatatatcaatcacataaacaacccgttcgttttttagctaaacgatttgcggtaaaagaagccgcagccaaagcattaggtacaggcattcgcttaggattggcctttaaccattttgaagtcgctaatgatgaattaggtaaaccaacattgcactttttagctgtggcaaaagagatggcgcaaaaagcgggaataaatgctattcacgtgacactggctgatgagcaacgttacgcctgtgcaaccgttattttagaaaaataa

SEQ ID NO: 3425 - DNA, 531 bp, Proteus mirabilis
cacaatttgactattgttcaccacggagtatttgttatgagactgacatcaaaagggcgttatgcagttactgctatgcttgatgttgcattgcattcgcagcaaggccctgtccccctcgctgatatttctgagcgtcaagggatttccctttcttaccttgagcagcttttttcacgtttacgtaaaaatgaattagtcgcaagtgtgcgtggcccgggtggtggttatttactcggtcgtgaagcggggcaaatttttgttgctcaagtcatttcagcagttgatgaatctgttgatgctacccgttgtcagggtaataaagaaggatgtcaaggtggcgatcgttgcctgactcatactttgtggcgtgatttaagtgatcgtattaccagtttccttagcagcattagccttgaagagttagttaataacgaagaggttatggatgtcgctgatcgtcaagacaatgaaaaacgtcatgctatcaatggtcgtttacaagaaaccattgttaatatgcgagtttaa

SEQ ID NO: 3426 - DNA, 192 bp, Proteus mirabilis
tcatgggtgacaaaaacactggtaaatttaagctcactatgtaattcccgtagccaactgcgtaattcagttctcactttggcatctaacgcaccgaaaggctcatcgagtaataaaatttgtggctctacagccaatgctctcgctaaagctacgcgctgtttttgccctcctgaaagttgtgcaggataa

SEQ ID NO: 3427 - DNA, 192 bp, Proteus mirabilis
cgacctgagacaggtaaacaccggaattgctttttaggtactaaatgcgctaatctactcatgctaatttctcttcacacaattgaaatttggcaaaccgaagccagaggccgtacacctttggcttcaccctttctggatatagccatctttaatttctcttttgatgtaacaaaacaaacgcattcataa

SEQ ID NO: 3428 - DNA, 198 bp, Proteus mirabilis
ttttattgtgccctaattgtggctacatgttttatttcaataaaatataaaaataaactgaatatgctggttgttgccgtggaaatagaacggcaacaacaaatacacttgatagcatactttaatgggcaattattgttttatagaaagagaagcaagaatacgcaacctactctaaccaatactattttttactaa

SEQ ID NO: 3429 - DNA, 336 bp, Proteus mirabilis
gtgaggtgtgccatgtcaatttcccttacagaagccgctgctaaccgtgttcgctcttttcttgctaatcgtggcaaaggcgaaggtttgcgtttaggcgtaagaacatcaggctgttctgggatggcttatgttcttgagtttgctgatgtcatcaatgacgaagataccgtttttgaagataaaggtgtgaaagttattattgacggtaaaagcatggtctatttagatggaacagagcttgatttcgttaaagaaggattaaacgagggctttaagtttaacaacccaaacgtggctaacgaatgtggttgtggagaaagctttaccgtgtaa

SEQ ID NO: 3430 - DNA, 903 bp, Proteus mirabilis
tccatctattttatcacaaatgtagccaaaaacgcgaacgcctgttatacttcgcctcgttttttatccccgttctttaacatcttgtggaagataaccatgcatccgatgctgaatattgccatacgtgctgcacgtaaggctggtaatttaatcgccaaaaattacgaaaatcctgaatctgtagaaacgagccagaaaggtagcaatgattttgtcactaatgttgatcgcgaagcggaacaggcaatcattgaaatcattcgtaaatcttatccaaaacacaccattattacggaagaaagtggcgagttactcggtgaagatcacgatatccaatgggttatagatccacttgatggcaccactaactttattaaacgcctaccacatttttctgtttctatcgctgtacgtatcaaaggtcgcacagaagttgctgtggtttacgatcctatgcgtaacgaacttttctcagctgttcgtggtcaaggtgcacaattaaatggttaccgcctccgtggctctaatgcacgtgatttagatggtgctgttttagcaactggtttcccattcaaagcaaaacaacattcagcagcttatatgaatatgctgactaaactgtttgtaccatgcgctgattttcgtcgcacaggttcagcagcattagatttagcttatgttgccgcgggtcgtgtggatggcttctttgaaattggtttaaaaccttgggatttcttagcaggtgaacttattgctcgtgaagcgggtgcaattgtatctgactttactggtaatcacggctatctacaaactggtaatattgttgcgggtaatcctcgagttgtccgagcattattggcagaaattcgtagcgaattaactgatgctttaaaacgttaa

SEQ ID NO: 3431 - DNA, 2148 bp, Proteus mirabilis
gattgctatttttttggagtcacgatggattttcatcataaaaataattatgggttatatgcattggaaatattagcccaataccataatatttctattaaccctgaagaaattaaacataagtttgatattaatggtgttggattagatttaacttcatggttgcttgctgcgaaatctttagaactaaaagtaaaggcagtaaaaaaaacaattgaacgattaaactttatttatcttcccgcattagtttggcgagaggatggacatcattttattctaactaaagtaaataaagaatcaaatagatatctaatttatgatttagaacaacgaaatccgcgagttcttgaacaagctgaatttgaagatttatatcaaggtaatattattctaattacctctcgatcttctgttatcggtaaattagcaaagtttgatttcacatggtttattcctgctgttattaaatacagaaaaatatttattgaaacattaatcgtttctgtatttttacaattatttgctttaattacaccactttttttccaagtggttatggataaagttttagtacatagaggcttttcaactctcaatattattactatcgcattagctgtcgtagccatatttgaaattacattaagtggcttgcgcacttatatttttacacatagtacaagtcgtattgatgttgaacttggcgcaaaactttttcggcatttattagcactacctatttcttattttgaaagtcgtcgtgtaggtgatactgttgctcgagtgagagaattagatcaaattcgtaattttctaactggccaagcattaacctctattttagatttactattttcatttatattctttgctgtaatgtggtattacagtccaaaattaacgttagttattttattttcattaccttgttatgctacatggtctatttttattagccctattttacgccgccgtttagatgataaatttgctcgtaatgcggataatcaatctttcctagttgagtctgtaacagcaattaacacaattaaagccatggctgtttcacctcaaatgacaaatatatgggataaacaattagcaggctatgttgcagctggatttaaagtaacggtgttagcaactataggtcaacaaggaatacaattaatacaaaaagccgttatgattattaatctttggctgggtgcacacttggttatttctggtgatttaagcattggtcaattaattgcctttaatatgctagcaggacaaattgttgctcctgtgattcgtcttgctcaactttggcaagattttcagcaagttggtatttctgtgactcgcttaggtgatgtacttaattatcctactgaaagttatcaagggaaattaacattgccagaaattaacggcgatatctcatttcgtaatattcgatttcgttataaacctgacgcgccaattattttaaataatattaacttaaatattaaacaaggcgaaatcatcggtattgttggacgttcaggttcaggaaaaagtacattaacgaaattaattcaacgtttttatatccctgaaaatggccaagttcttattgatggacatgatcttgcattagcggatcccaattggttacgccgtcaagttggcgttgtattacaagataatgtactacttaaccgcagtattattgataatatagcattagcagaccctggtatgcctgtggaaaaagttattcatgctgcaaaactagctggcgctcatgatttcatttcagaattacgtgaaggttataacacaattgttggtgaacaaggggctggtttatctggagggcaacgccagcgaatcgctattgctcgagctttagtcaataatcccaagattttaatttttgatgaagcaaccagtgctttagattatgaatctgaacatgtcattatgcgtaatatgcacaaaatttgccaaggcagaacagtcattattattgctcatcgtttatccacagtaaaaaatgcagatcgtattattgtcatggaaaaaggacaaattatcgagcaaggcaaacacaaggaacttctctctgatcccgaaagcctatatcactatttacatcaattacaatcagattaa

SEQ ID NO: 3432 - DNA, 1215 bp, Proteus mirabilis
actgaatatttttcaggagcaattatgttagatgcacaaactatcgcgacaattaaatccactattcctcttattgctaaaacaggccccgcgttaacggcgcatttttacgacagaatgttctctcgccatcctgagttaaaagatatttttactatgagccaccaaagcagtggcgcacaacgtgaagcgttatttaatgcgatatgtgcttatgcaacgcaccttgaggatttacctgctattttgccggcggtagaaaaaattgcacaaaaacatgccagtttgaatattcttcctgaacattatcctattgttggagaaaacttattagccaccattgatgaaatgtttaacccgggcaaagaagtgcttgatgcttggggagccgcttaccaagttttggctgatgtctttattaatcgggaagagcaaatttatcaacaaaaagaacaagcttcaggaggctggcgaggattacgccactttaaagttaagcataaagtaaaacaaagtgaggttattaccagctttgaattagagcctgaagatggacaagcggttacaccttaccgtgcaggccaatatttaagtatttatattcgtgatgagaaacttgcaaatcaagaaattcgtcaatattccttaacgcaatcgacaaacaataaaacctatcgtattgcggtaaaacgtgaagacaagggaattttatctaattttcttcatgaccatatccaagaaggagacatcttacaagttgccgcaccagggggcgatttttatttagatatctcatcaacaacgcctgtcacattaatttcagcaggtgtaggcttaactcctatgttagcgatgttgcacactctctcttctcaccaagcacaagtcaattggttacatgcagcggagcatggtggcgtgcatgcttttaaggaagaaatcgcacaagcaggaaagcaaattgaacaatatcaacaagccgtatggtatcgtctccctcgtactgaagatataatcaataaagactatcaatttgaagggttgatggatttaaccaagatacatgaatggctatcaatacctaatatgcagttctatttctgtggaccattaccttttatgcaatctgtcgctaaacaacttattgctctcggtattgaaagcgataaacttcattatgagtgctttggccctcatgctgttattagccaataa

SEQ ID NO: 3433 - DNA, 768 bp, Proteus mirabilis
ttcgattttttcgagacggaacattttctttccatgggtgaaatcggtaagcttagccccataagatatcaacaaggattttatgttatgactacaccattaacttggcatgatgtaataggtgctgaaaaagaaaaaccctattttcagcaaattttgtctcaagtcgcacaacaaagacaagcaggcaaaataatttatcctccacaagaagatgtatttaacgcttttcgcttcactccctttgaaaatgttaatgttgtgattttaggtcaagatccttaccacggccccaatcaagcccatgggctttccttttctgtacgtcccggcgttccggctcccccttcattagttaatatgtataaagagcttgaacaagaataccctgacttcaaacgacctaatcatggttatcttgagagctgggctcaacaaggggtattactacttaataccgttcttacagtagagaaaggccaagctcactctcatgctaactatggttgggaagtttttactgacgcggttatcgaacaaattaatcaacgtcgtgaaggcgttattttcctactttggggcgctcatgctcagaaaaaaggtcgttttattgatactaataaacactttatcttaaaagcccctcacccttcaccactctctgcacatcgtggttttttaggctgtggtcattttaaacaaaccaataatctattagcgcaacaaggacgcacgctcattaattggcagcttgatcctattaaataa

SEQ ID NO: 3434 - DNA, 1026 bp, Proteus mirabilis
aaactgtattttctcgtgttcatcaatgttaaacatccaatagccacagtgcctagattgctaatgaatactgaaaacaaaaccgaagaagtgaaattaacagcgggtcaacttttacgtcaggcacgtgaaaaagcggggctaactcagcagactgttgctgatcgactttgtttgaagttaacaacagtatgtgaaattgaagctgatactatctcttctggtattgcaccgacatttttacgtggttatatgcgctcttatgcaaaacttgtcggtgttcctgaaagcgcaattctaggtctaattgatcaacaagccccaataaaacaagttaaagtcacaacaacacaaaattactcattgggtaagcgtcataaaaagcgtgaaggctggttgatgaaattgacttgggttattgtaatagcaatgatagctttagtcggtttatggtggtggcagggtcatcaagccgatcaacaagaattagtctctatggcttcgcaagacataggacaaaatagtccgcaagaaaacaccaatacgatagaatctcctttatcaaccttagataataatagcccatcatctgagggtgaaaatgtacaagtgcctgcttctccattagtagataatcaggctaataaggttgccgagccatcagtaacagatgccacacctgaggcagaagttaaaacagttccattaccggtgtcaccattaaccacatcaacgacttctcgtgctgattctgctgaaggcaattcaacacccgcaccaattgtggaaaatcaactggtcttgatgtttgatggtgaatgctggttagaaattcgtaatgctcaaaataaagttttatttaatggtattaagaaagccggtgaccgtttggaatttaatggtgagcaaccttataaactaaaaataggcgcaccttctgttactcgtttacagtttaatggtgaagctgttgacttaagccgttttactggaaaaatagcaaaaataacagtaccgagcgcttaa

SEQ ID NO: 3435 - DNA, 2208 bp, Proteus mirabilis
ggatttatggccatactcactctccgaaatgttaaaagctattctgctgataaagatgtaaatatagatctaagtaagcctgttaccctcatttatggacaaaatggtgcaggaaaatcaacaatttcaagttttttttcaggttttcaacaagaaaaataccagcattgtcattttgcaagtcgtgaaaattttgcttattttgtatttaatcaggaatatatagaacagaagtttcaccaagaaatatatcaacctggtatttttacattgaatgagaagaatgatgacgttaacggtaaaattgaaagtaataagagaagaattactgaaataaacaacttactaaacactttggatacagagataaaaaataaaaatgatgcaaagtctactgttatcgaaaagtactctaaagttatttttaaaaaaactatcaatgatcggcaatcgttagattattttctagatagagctaaacgagtaaataatttttatcaaaaaatgagggaaacttcattaggaattcaaaaatatgagctggtacaacttacagagagactggagttgttacttaatagtgaaggaactcaatatacagagattattgaaccagaggtttatggcctatctgacgaaatgctgactctacttcaaagttcgttgacagcatcgtccgatacaccattttcagccattattcagcagttaggtaacgctgattgggttcatagtggaacaggttatattaaagataatatttgtccattttgccaacaaaaatttgattctcagcatcttcttcatgaattgacactcatgtttgataaatcttatgaagatgctctggcaacgcttacccacagtcagacagtcatttcccatgaattagacttattggagtcattccatgagcatttacgacaacaccctgtagttagtgatgatcaccaagtttttagtattattaaatctctgcaacaaactttacgtaataatctacaatcactcagacaaaagctactacagccttcgcaatccatacaacctgacgttattacagatatacgtcagcatttgaaccagatactggtaactttaaatagtaacattagagacaataatcagctggcagccaattttagtcaggagcgagctcgcttggcggcagattcctttgcatatcttagagaagtgagtgatccttatttgcgtcaatgtgatcaggaattagcagaaatacaacaacaattgcaagctgagataaatcaagttgatttattgagagatgaagagcgagcactttcggtcgaaactactcatcttatagggcaattatcagttatacagcctacaattgataacattaattataatctgacacaattagggatcaatgatttcaatattatttgtcatgatgagagcttgaaactatatcgcttacatagacaaaaccagccagatgattctgaggtctttaaatctttgagtgaaggcgaaaaaacaatcatatctcttctctatttcctagaatcatgcattggtcacgtacctgatagccagacaatacaacctaaactgattgttattgacgatcctatttccagcctgtcacataactatatttatgaagttgcttcgatgataaaacataaattaattttaccgaagattgcgcaacacattgttatattgacgcataatatatttttctttcaagagattctactttcagtttataaacgactggctcccgaacgtacaacaccaaaggggtgtgcactttatcgcatcattaaaggagaatatagtgattgtatcccattatcgatgcacgacatgctaaatgagtatcaggctttatggcaaaccatacgggatgtccgcgatggaagaagtttaccggtagtattacctaatacaatgcgaaatattcttgagtactatttcagtttttcttgcaaacaggaaaaactggataaagcgctaaataagctagcagttgaatattcagcaggggaatatgactcattttatcgagcaattaaccgtcattcccattctgatggcagaaatatcatggctacaggagtgattaatgtagaaatgtatttccgtttatttcagaaaatttttgaagaaacgaaggattctgatcattacaacacgatgatggggattactgttgagcaaacagaaggttga

SEQ ID NO: 3436 - DNA, 390 bp, Proteus mirabilis
atcatggcttatagcgataaagtaattgatcattatgaaaatcctcgtaatgtgggttcatttgataacaacgaccctacagtggggagcggtatggtaggcgcaccagcttgtggtgacgtcatgaagctacaaatcaaagttgatgataacggtgtaattgaagatgcacgttttaaaacttatggttgtggctcagcgattgcatcaagctctttggttaccgaatggatgaaaggtaaaaccttagatgaagcagaagcgattaaaaataccgcaattgctgaagagttagaattaccaccagtgaaaattcactgttcaattctggctgaagatgcaataaaagccgcgattgcagactataaaagcaaacgccaaggcaaataa

SEQ ID NO: 3437 - DNA, 5151 bp, Proteus mirabilis
gttaggtattattgtagcctgcataaaacatcatataattcaggggttgaattaaaggaaatggatatgaatcgagatcaatttagacagtacacggaaaaaagagggtaccgttggtgtacacttgcagtggtactggcttcagcattagctttaacaggctgtgatgataacaaaacagaagatgagcaatcttcgacgagtgataactcacaaccaacacaagttgcggaacaaaaaagcacatcgcaacaaacgacaacacaacttggtgataaaaccgcagttacaaccaaaacgaataatcaaactgcattaactagccaagaagtgcgcaatgaacttgctcgtcgttatgcaggtaaagaggtgactgtactagatgcctctgaattacaacgcgatggcgcaagtacgatggtagtgactttttcagtaccactcgatcctgatcagaaatttgatgatgttatccgtcttgttgatactaaaaaaggtaaattagaaggggcttgggagctatctgataatctgatggagttacgattccgccatttgccaccttcaacagagttaaacctgactattgatgctcaaattaaaggaattaacgaacgtaaattagtagagccatttagccaaaaatttactacagaagagatttatccatcggtcggctttaccagtaaaggctcattattaccgttagaagcaacggaaggtttgccaattagcgcattaaatgtcgaacaagtcgatgttaactttttccgagttaaagatgatcggttgacacaatttttaactcaatgggaaagccgctctaatattaactattgggaatcagacgattttctgtcacaagcggatttggtgtatagcgggcgctttgaacttgatacagaaaaaaacacccgtgaaaatgtcttattgccactcaaatctattgaagccctgaaaaaagagggtgtctatatcgctgtaatgcagcaggcaggtaaatactcctataccatgccggcaacggtatttacttttagtgatatcggtttatcagtacatagctaccttaatacgctagatatttttactcaatccctgaaaaatggcgcagcattagacaatattgaaattcgtcttttggatgaaaaaggtaatttaatatctaaaacaaaaactgataatcaagggcatgccacattagaaaagagtgataaagcacgtttattactcgctattcgtaatgggcaaaccagtatgattgatttgcgtaaaccagcccttgatttatccgaatttgatatcggcgggccacaaggttatagcaaacaattttttgtttttggtccacgcgatctgtaccgccccggcgaaaccttaatcgttaatggtttattgcgagatggtgatggaaacccgattaaagagcaacctgttaaagttgacttattaaaaacggatggtcaggtttcccgtagttttgtttggcaacctgaaaatggtttttatcagttgaaactgatgatccctgaaaatgagagtacaggtattcggaaattacgttttgatttaggcgatggcactccgcgcttctaccaattccaagttgaagattttatgcctgagcgtatggcattagagatcaccggtaaaaaaggcattttactcagtggtaataatgcttattttgatattaaaggtcgttatctttatggtgcaccggcagcagataatcgcttgcaagggcaggttttcttaaaagcttcgcgagaagcagtcagtcaactgccgggttatgaatttggtgccgtaaaagatgaaaatttaagtcgtttattagatgaatttgaacttactcttgatacggatggtgaaggggcattaacggttgataaagatcgttatgctgaagtgaaatcaccgattaatattatcttacaagcaagcttacttgaagccggagggcgtcctgttactcgccgttatcaacaagcggtatggccagcgacacatcttgcgggaattcgccctgtttttgctaaaaaagaggtgtatgactaccgtaatgataaatataaatcaggctatagtgttgatgaaaactcaatggcggagtttgaaatcgtttataccgatcaagagggtaaaaaattacctgctgatgacctaaaagtaagatttatttacgaacgttatgattattattggcgttggtctaattcaaatggttgggagtctggctacaatcaaaaagatctgcaaatggatgagcagactatcaaaatagctaaagatggtaccgcaaaagtggctttccctgttgaatggggctcttatcgtatagaagtggtcgatcctaaaacagaacttgtcagtagcttacgtttttgggcgggctattcttggatggataatactggcggaaccggggcagtaagacctgatcaagttaaattaaaattagataaagagagttacttaccgggtgaaaaagtcaaactcaatattgcagcccctcatcctggtaaaggttatgtgctattagaatcgagtgatgggccactatggtggcaagagattgatgtacctgaaaaagggcttgatgttgaagtacctattaataaagagtgggcaagacacgatttatatttgacttcggtggtggtaagaccgggggatacatccaaacaagcgacggtaaaacgtgcagtaggtattttgcatttaccactacaagataacaatcgccgtatagatattgcactggatgcacctgaaaaaattcgtccaaatcaagatctaaaaattcggattaaagctaagcccgtagcaggccagccattgccggaaaacatcaatgtattagtgtctgcagttgatacaggtgtcttaaatattaccgactataaaacgcctgatccgtacgaagctttctttggtcgtaagcgttatagcgttgatcaatacgatgtttatggtcagttaattgaaggtgaagggcgtttagccaacctacgttttggtggtgatggaagcgaagaaagcgcattatctcgtggtggtaaaaagccattaacagatgtgcaaattattgctcaacaagcaacacctgtaaaattaaatgcacaaggtgaaggtgaggtttctttacctatacctgagtttaatggtgaagtccgccttatggctcaagcatggactgcggataaatttggtagccaagaaggtaaagttgttgttgccgcgccattagttactcaactctcattaccacgctttatggctgggggagatgatgcgttactgtcattagatttaactaacttaacggatgcaccacaatctattacgttaaattatacggcatcaggattagttgatttagcgggtgtcgacagtaaaaccgtttcattatcgaaaggtgaacgaactcaagttcaaatccctattacggcaaaacatggatttggccaaggcgaattttccctgtctatttatggtattaaagtacctaatgaagagataaaaccttatcaaaatacttggaaaataggtgtacgccctgcgtatcctgctgagacaatacattacgccaatacattagcagatggtgagtcttggcgcttaccaaacgaagcattaaatcaatttaatcgctcaacgcttgagggggaattattacttactagtcgccctccgttacaggtagcgcgttatgttagagagttatttgcatatccttatggatgtcttgagcaaactgttagtggattatatccatccttgtattcaacagagaaagagttgaaacaattggggatcaaaacacaaacagatatgcaaagaaaagaagccatagaaaaagggattgctcatatcttaacaatgcaaaaatccgaaggaggatttgccttgtgggctcaaggtgggcgtgaagagttttggttaacggcgtatgcaacagatttcttatttagagcgtctcaacaaggttatgaagttcctactgaggcattaaaacgggcaaatgatcgtctactacgttatttacaagataaaaatattgttaatgaagagtatgtggttaaccaagatgcggctcgattctcagcaagagcatatgcggctttagttctggctaatcagcaaaaagcccctttgggagaattgcgccgtttatatctagaacgtaatcaagcgggtagtggtttagcgcttgtgcagttaggtgttgctttgaaattgatgggagataactctcgtgctgaaagcctaattgctgaaggtgtcaccatgccacgtaaatataattacggtttaggtgattacggcagtactattcgtgaccaagcgttgattattgcgctactcagtgaaaacaatttggaaactcaaactcgtgatgccagtgttattacattatctgataacttaacagggcgtgaatggttctctacacaggagagtaactcactataccttgctggtcgtttctttattgatatggcagagaagccttgggaagtaaccattaatcgtcaagtgccagcaatgagtagtgatcgcgcagttaatgaagcattgactgcaacacaattgcaagaaggtttagagctaaacaaccaaggtggtacaaccatttactctcgaatgaatgttgtcggatatccaaaagttgccccagcgccttatagcaatgtattgaagatcaatcgtagttattacgatctaaaaggcaatcgagtcgatcctaatcgcttacaaagtggtgaaatgctggtggtaaaattagaggtttcagctaatagagatgtacctgatgccttagtggttgatctattaccagcggggcttgaaattgaaaatcaaaacttagcatcaagtagcgcaagcttaagcgatagcgctgctgatttgcaggagtttattgatgatatgggacaagccaatattaaacatcttgaatatcgtgatgatcgttttgttgccgcaatagcggttgataaatatcgtcctacgacattactttacttagcaagagcggtaactccggggagttatcaagtaccgcctccgcaagttgagtcaatgtatgtgccttattggcgtgccgtaggggcaacaaaaaataaaatcgatgttgtgccttaa

SEQ ID NO: 3438 - DNA, 675 bp, Proteus mirabilis
tacaagagttataagatggctgaaccctcattcactgaagggtacttttacatgcaaaaagagaaactttctgcatttatggatggcgaagttcttgataaagaattaatgggatcgattgcccgtgatgaatctatgaaagaaacatggcaacgttaccacttagttcgtgatgcaatgcgtggtgatgtaggagaggttatccactttgatatcgcaagtcgcgtagcactcgctttagaaaatgagccagtccgcataagtcctgaacaacagcaagagcagcaacctgcgccttctcaatggcgtcagcactctttcttacaaaaattacgtccttgggctagccagttaacacaaattggtgttgctgcctgtgtgtcattagctgtcattgtgggtgttcagcaatataatggcaacaatagcgctgaggatttccaagttgatacgccggtgtttaatactcaacctattatggggaatggggcaccagtcagcttaaatttacaaagtgataatttaggccaaaaccaacaaacacgtctacaagagcgtaatcaacgccttggacttatgttgcaacagtatgagttagatcgccgtatctacaatgcaccacaagatgaagtgcctgtagcatcgcaaaacacaactcagcaacaggctcagtaa

SEQ ID NO: 3439 - DNA, 597 bp, Proteus mirabilis
atgtctattcttgaatggccaaaagaggtgatccccacacaggaaaactggcaattattgagtaacagcaaaacctttacctcgccatttaatggaagtagtcaaacggtacgctttccggggagtcgttggcgttgtgagctgacattcaataatttaaatgaagagaaatctcgccagttagaagcgctggtggcttcattggatgggatgtcggggcgagtcaaaatagccagttggataagaaaagggcgttatgggtatggttcgcctcgcattgcaataccgagccaattaggtcatcggctagaaacaaaggactggaagcgcaatatgcgcgtgttacagcaaggggatcgcttaactgtgggcaatgaactcaaaatggtggtggcggatgtggtcagtgataatcaaggccgtgccattattcttatttcgccgatgttaagaacgtcacctactgttaatgaaatgcttgaggttgagcgtccttttgggatttttcggtttgttgataatgaacagggtaaatttcagcatcgtcgcttggggtatacccatatcacgttatcttttgaggaggtgttgtactaa

SEQ ID NO: 3440 - DNA, 543 bp, Proteus mirabilis
agagatgttcttgtgaataaaattaaagatgatatttattggatgcataaagcgattgagcaggcacataaagcacaacaactcggtgaaattcctgtaggagccgtgttagtcgctgataataaaatcattgctaaaggttggaatcactccattattgataatgatcctactgcacatgcggaaattatggcattgcgtaaaggtgggaaacatctacagaattatcgcctacttgacgccacattatatatcacgttagagccttgcgttatgtgtgcaggagcaattgtgcatagccgtgtaaaaagagtggtctatggtgcatctgatctaaaaacaggtgccgcaggctcatttattgatattttgcaacatcccgggatgaaccataaagttgaaataacatcgggggttttaggtgaggagtgcgcacaactcttgagccagttttttaagatgagaagggcagagaaaaaacaactgaaacaacagcaacgtttaattactcaaggcttaatcatacaagagaaagccaaatag

SEQ ID NO: 3441 - DNA, 210 bp, Proteus mirabilis
tatttactatatgggcggtgcaaaagcgcggttatatgcacaagagcgtcccttaacaacagtttcactggcatacacagcttaaaaaatagcattattcttttattacagttaatgactgcccatgcagatttttttgcatgggtattttggctattgagtaaaactgactatacaggctataacacgaaaaagaataaaatctattaa

SEQ ID NO: 3442 - DNA, 1599 bp, Proteus mirabilis
actatgccatattggactaccgcttgccctgactgggaggagcgaataaagcatgggcgctcgatcattcctccaccgatatatcctgaacaggcagagcttgcgttaaatatctttaagcaattaaaaatagttgatgctccgggcagcccaacgtttggtgaagcttgtgctcaatggatatttgacttagtgtctgcgctatttggctcgtatgatgcgcaaacgggacggcgatatattactgaagtttttgtccttatcccaaagaaaaattccaaatccacgttagctgcggggatcatgatgacagcgttactgttaaattggcgccaagctgcaagttataccatcattgcacctactgttgaggtcgcgacaaatgcttttaaccctgcaagggatatggtgaagtatgatgaagatttggatgatttgtgccaagtacagacacacattaggaccatcacgcatagaaatacggataccacactgaaagtattagccgccgatgcgaatacgatctcaggtattaagtcagtaggaacgctgattgatgaactgtggttgtttggcaaacaagcgaatgcggacgatttgcttcgcgaagcgatagggggggtggcttctcgaccagagggatttgtggtgtataccacgactcaatccaatgagcctccatcaggggtatttaagcaaaaattacagtatgcccgtgatgtgcgtgacggcaaaattcatgaccctaactttctccctgtgatttttgaacatccacatgacatggtagaaagaggagagcacttgttagcggaaaacatggccatggtaaatcccaatttggggtattcggtggatgaagtttttttaatgcgagaattccgcaaagcaaaagagacaggagatgcctcttttcgcggttttatggcaaaacatgccaatgtggaagtggggctcgcattgcgttctgatcgttgggtgggcgcggacttttgggagccacaaacagatgacactttgacgcatgacgaaatccttcgtcgttcagaggtggttactgtcggtattgatggtggcggattagatgatttgctcggtttatcgatagtggggcgatgtaaaaatacgcgtcaatggttgtcatggtctcatgcttgggggcattcatcggtgtttgagcgtcgaaaaagtgaagtggccaaattgctcgactttgaaaaagacggtgatttcaccctcgttgcacaaataggggatgacacgaaggaagtggctgatattgttgaacgaatttatcagacaaggttgatggataaaattggcattgacccttcagaaattgggggattacttgatgaaatcgtgcaaagaggcattgaacaagatgctattgtggggatttctcaagggtggcggctaggcggtgccatacaaaccactgaaagaaaactggctgaaaaagtgttatttcatgctaaacagcccttaatgaattggtgtgtgggtaatgcaagagttgaacctaaagggaatgccatactgattaccaagcaagccagtggtcgattcgaagatagatgcactgatggcgctgtttaa

SEQ ID NO: 3443 - DNA, 2547 bp, Proteus mirabilis
ttaaataaatatttattatttaattactttttatttaatataataattaggcgtttattcatgttaattccttattcaccccacacaatatggaagaccatttgtgcgactttgctattaagcttggcgtttttctcacaagcagagcaggacgattctgtggaatttaacattcatatgctagacgcggaagatcgcgataatgtcgacctttcacgtttttctacctcaaattatatcattccgggtatgtactatttagatattcgtctaaatggtcgcgactttcctcgccaaaatattaattatattgaagtagcagataatcattccgtggcgtgtatcgaccctactcttttaaaaaagttaacaatcaaccaagaaaaccaaaaatatatcaaacaaatatcaccagattgttttgatattagccaattacccggtatctcgattaaaaatgatggtggtgtacttgatatcacgttaccgcgctcattaatgaaatatgaagaatctgattggactcctccggagctttgggatagcggggtctctgggcttatttttgattatacactaacaggaacgtcaactcgccctaataaaggcaataataacaataccttaactggttatggtcaagcgggattaaacttgggtgaatggcgtttacgagctgaatatcaaggcaattattcttctgaatattcgtctaacaatcgttttgattggaaccaaatttatgcctataagccattacctgatctcgcagccaaattaacggttggggaaacttatttaaactctcaaatttttgatagtttccgttttacaggagccaatttacaaagcgatgagagaatgttacccccttctctccaaggctatgcacctgaaattcatggcatcgccaataccaatgcaaaagtgacggtaactcaaaatggacgtttaatttatgagacaaccgtacctgctggccctttcgtgattaaccatctacaaaataccgtacagggtcaactcgatgttagagttgaagagcaaaatggtaagattaacgaatttcaagtgcaaaccgctaatttgccttatatgactcgcccaggatctgtgcgttttaatacctcactgggacagtcatccgtgaacaaccataaaatgcaaggccctattttctatcaaggggatttttcatggggaatgaataatacatggtctctctatggtggtgctttacttaccgctaaagattataacgcatggtctttaggtatcggccatgatatgggacgttttggtaccctttctggtgatattacacagtcttatagcaaaacctatgataatgaaaaaatcaatgggatgtcttttaaactaaactatgcaaaaacttttgatgagtaccacagtaccattacctttgcaggttatcgtttctcagaaaaaacatttcgctctttttctcagtatattgatgagcgttataacggcatcaataataatggctatgaaaaagaaatgtacaccattaccggtaataaaactttttgggcagatgatgcagagaaatcgaccaccctatatctctcttatcgtcaccaaaattattgggataaaaatactcaagagcagtatggtgtcacagtaagtcgcaatttttccattatggggattgagcaaatcaataccaacttgtcagcatttcgtacccaatataaagggaatactgacgatacgctctcttttaatatttcactaccattaggaagtggtcgcaatattggttataacttgcaagataacaatggcaaagtgacacaaatggcctcttatgctgataatcgtgattataataatttatggcgcataagagcaggcttaagttcggataagaaagccaataccgatggttattatcaacatcgttctcagtatgcagaaatcaatgccaatgcaagctatcaacaagataattacttagcagtgggcgcaacgataaaaggcggttttactgctactcgttatggcgctgcattacacagtagcagtatgacctctagcaccgcaagaataatggtggatactgatggtgttgcaggggtgccctttaatggtcaaagcacgactacgaaccgcttcggcattggtgtactaaccgacttaacaagttataacaatgttgatgcacgtattgacgtcgataagatggatcaagatatcgaaacgcgtaaagccattgcttcaacaaccttaacagaaggtgccattggttattaccaatttccggttcgtcaaggtgaacgcttaatggctgtcttacagacaactgataataaataccctccttttggtgcagaagtcaccaatcaaaaaggggaaagtattggtatggtgatggaagaaggccttgtttatattgcgggtgttaaccttaatgaatcattaaatgtaatttggaacggtaaaacacaatgttcaattaccattcccgcggaaataacagatcccttaaaacatctatcgctcgtttgtcaggatcgttaa

SEQ ID NO: 3444 - DNA, 192 bp, Proteus mirabilis
gtcaacgatttttatcggttttttatcgtaaaaatgatcgttcgttttatttttagtcaagatgctttttttagcaccataactgacacagcaattaaccaaaataatccgttgttgttacttcgtcaaacaaaaaataacctatttgaaatttttctgcaggttaaaagcttaatgccattgaggaattag

SEQ ID NO: 3445 - DNA, 1020 bp, Proteus mirabilis
tcattgtggtatcaatttataattacgtgtaggaacaatagagtcgtaatgaaaaaatcatggttatccgctttacttttagcgggttacctatcaataccaacacaagccttggcacaacctcaaataggaaatgccgaggctttgttgcaaaagatgggtaatacaacgcaaaccgctacttacgaattatcttttattaatatcaattctcaaggtattgttcctattcgttatcgtcatgcacttgtcgatggtaaacctgtagcacaattaatgcagatggatagcactcgtcgagaaatcgtgcaacgagggaatgaaatcagttattttgaaccaggtttagatgcgtttagtttgcgtaatgaacatatcgttgattatctccctgcaatcatttatcaaaattttgctgaactcgctgagtattacaattttattgatgcgggaagaacgcatatcggcgacattccaagtcgtgttgttcgtgtgctatcaaaaaataatgaccgttatgaatatgtcttatttattgatgaagagagatatttgccattaagggtcgatctgcttgataaaaataatgacgttattgaacaatttcgggtgatcaccgctaatcaaaataaagaaatcatcagtgagttagattcactcaataaagtgaatatgcccccgctattgttgatccccaaagccactcaagcactgaattacaattggcgtgtgacaacgttacctgaaggatttaaagaggtaaaacgtagcaatcatcaaattgctgaaaatgaatttagccaatctattttatatagtgacggcttattcgatttctctatttatgttaacaaaagtggtcagcaattaaattcccccgaacgtgataaagcattgagatatggtcgtaatacaatttatacctatgataaagatggcaatgaaattacctttattggacaattgccatttataacagcacagaaaatcgtcaacagtgtggtgtttaccaaaaagtaa

SEQ ID NO: 3446 - DNA, 480 bp, Proteus mirabilis
cccctaattcacctctttcattatttctcttctcccttctcgataaaaatcttaggagtgattatgtctaacgcgttattgcgtgaattagtgttaaaccaagcactgaaagtgacgccttttacttatttagacaacaccttttatgtcaaagagctggatgttggcaccatgaattacattcagcgcaaacttcgtcaaattaaaattaagctcgccgaagcgcaggacatttatttagatgaagacgatcccgaacaatttaatgaggcgataaatcgtgtctatgatgaatatgatgtcgccagaatgttggcctttaagttgtgtgatgaaaaaggggaactgctttttgatgctgaaaatgaagaagacttaaaaggtcttaatcgtttagggcaagggttttctaatgcggtgtttacagcagaagcggggaacagtgaaaaaaacttggagaacggcgacaattccaactga

SEQ ID NO: 3447 - DNA, 243 bp, Proteus mirabilis
ataatggatcaaataagtgccacaaccgcaataaaaaaagcatgtaattatgtcggtgggcagtctgaaatggctaaacgcttgggtatttcaccgcctacagtaaatcaatggatcaatggaactcgaaaaattccagcacgacgttgccctgaaatagaaaaagtaacttcaggagtggttcgatgtgaagaactaaggcctgatgttgattggtcttatttacggggaactcaacaatga

SEQ ID NO: 3448 - DNA, 534 bp, Proteus mirabilis
ctcatgtaccaaagaccaagtgagtttagaaaagcgctgtcagattgcactctcatatcatcggtactaatcatgaaatacggaaaactctatgccgtcattgcgatggtaggcattattgtgggaggctattgggtgattaattggcaagctaacagaattaatctattagtagaaacaaacaaagaactaacggaggctctcgaagaacagaagtctattaatactgactatcaagcacgcataatgcgattaaatcagttggatattcaatatacgcaggagctagcgaatgctaagaatgaaattagtcacttgcgtgatattagtgagcgtcatccagagcgggtgtacatcaaagccgagtgtcccaaagtcaaaaccactccctccaccagcttggcttatgcaaccaccgcccgacctactgacaccgctatccgaaattattggttactcagagagcgaattgcagagtcagagcaaatgattttggggttacaggattatattagagtggagtgtgtgaactaa

SEQ ID NO: 3449 - DNA, 705 bp, Proteus mirabilis
  unsure (266): Identity of nucleotide at the above locations are unknown.
attaacaaccacatggcatcaagacggtgtgatcgacttggttggtaccatgataatcatattcgccattcatcagctgaatgggttgctgaattggctcataaaattcgtattgcttggatggtagatactattcgtagtcgtttgagattagatgatagccattcgctgacgatacctgatttttttgcttttgccgtgatgcataaactggttgataaattacctgatgctatattgcgccgtatcttaaattggcctgatanaactaaagatcgtagagtgcatggcggttttcctgaagctgatattgttccaaatgaagtgacagcactatcagcaatgaatgcgcgtttagatgctataaaacccgttattaatgtgactgtcgatcctgaacctccagcctcatttcttcttaaacctaaaatgtgccgttgggagaatacccaatggcttcaatgggtaaaaacacagccatgttgtgtttgcggacaacaagctgatgatccacatcatatcatcggccatggtatgggaggcatgggaacgaaagctcatgacttattcactattccattatgtcgtcaacatcatgatgaattgcatcatgatccgaaattgtgggaagccacttatggcaatcaaattgaattgttattttcttttttaaaccgttcattaggaatgggggcattggtttaa

SEQ ID NO: 3450 - DNA, 252 bp, Proteus mirabilis
cggtcattacacaacccagttccaatcttgggtcacagatttttatttatattattaaagactaatgttgccgttaatattacattgtttaagattgtatatattgttgtaaataaaggtatatatttaaattatcacattgtgttatcgcttttttcttggcaaattgcagattggttggtgattacaacgacagttttttgtgattcatctcttattattataattgaattgaacttcattctattttaa

SEQ ID NO: 3451 - DNA, 1296 bp, Proteus mirabilis
atgaataaacaaattatgcctatcatgctgtctaatgaacctgcagcagcatgttggggagaaaaagcactaattagcactaacgaaactggcatgaccgttcacttaacggaagaaaaccgcttaggggccattcagcgtggtgggcgcaaaattgatggtcaaggtattcgtaatgttgctctagttggtgacggctgggatttagaacgtagttgggcgttttggttaggttttagagcacctaaaggcgcacgttcaatcgaatggccacaattaagtgaagcggacaaaaaagaattagagtcgcgtatccgcattgttgattgggtgcgtgacacaataaataccccagcagaagagttagggcctgaacaactggctcagcgtactgttgatctgttctgtggtttagataaagaagatatcagctataaaatcaccaaaggggctgatctgagagatcagaactatgcgggaatttataccgtaggtcgaggctcttcacgtgatcccgtctatttagcattagattttaatccaactaaagatgctgaagcccctatctttgcctgtcttgttggtaaagggatcacctttgattcaggcggatatagcatcaaaccttcttcttccatgaattctatgaaagcggatatgggcggtgctgcaaccttagcaggtgctttggctttagctattacacgaggtttaaataaacgcgtaaaactattgctctgtattgctgataatatggttagcggtaatgcctttaagttaggagacattatccgttatcgtaatggtaaatccgttgaaatcatgaacacggatgcagaaggtcgtttagttttagcagatggtttaattgatgctagcaactttgcccctgaattaattatcgatgcggcaacattgacaggtgcagctaaagtggccgtaggtaatgattatcactctgtattaagttttgatgataaattagcgaatgaattattagcaagtgcagatcaagaaaatgaactgttctggcgcttaccattagctgatttccatcgtagccagttaccatcaagttttgctgatctcaataatattgccgcaccttcacataccgcaggcgcaagtacagcagccgctttcctttctcactttgtgaaagattataaaaaaggctgggtacatatcgactgttcagcaacttacagaaaatcatctgtagagcaatgggctgctggggcaacaggatatggtgttcgttctatcgctaatttattattaacaaaagcaaaataa

SEQ ID NO: 3452 - DNA, 312 bp, Proteus mirabilis
gctagatcgcacatcatgagtcgattaaaagtactaaaaccacgtattcccgtgttaaagacgaaagtggttaaaccattagatgttgtcacaaggcgagtgactggatcacaacggcaaaaacgaaggttattaaagtggcaagagaacccgcattgtgccgcatgtgggagcttgttagctttccctgatggatttgaattagaccatatcattcctctatttaaaggtggaaaagacaccattgaaaactgtcaggtactttgtattgaatgtcatcgaaagaaaacaaaagaagaattatcttgctaa

SEQ ID NO: 3453 - DNA, 183 bp, Proteus mirabilis
aaggcccagcagcaggcaacgtggtggctctctaaaggcgctattactattcgcctctattttaaatgcccttgttgtagcggttcacaatatagaacatcacaatttgatgtcacagtgaacaatccacacggcgcaaaatgtatcttttgcaaaagtgtgatgacagcacaaatgagttaa

SEQ ID NO: 3454 - DNA, 210 bp, Proteus mirabilis
  unsure (14): Identity of nucleotide at the above locations are unknown.
acctcatttaatcngctgtttttgttctttttgaggcacatctcgctaatttatgtaaaccctcaacatcattctctaagatttccccattttcctaaaaaaaataaaaactcagatttacaaataaagcaaaaagatataagttgtattaaaaatacatgttataaaaatcatattaaactgaatatttttcaggagcaattatgttag

SEQ ID NO: 3455 - DNA, 486 bp, Proteus mirabilis
gctatgcttaatggtaaagatttaggccgagcgatagagcaggcaattaataaaaaactatcatcaggatcagttaaatcaaaaactgagattgctcgacatttcaatgtaaagctaccatctatttatgattggataaaaaaaggctccatttcaaaagataagctacctgaattatggagttatttttctgatgttgttggacctgaacattggggcttaaaggagtttcacctcccagtaaataaagctgaatcaagatgtacacatgatgaacatcaacttaatagccttattcatgcttatatgtcagcttcggcagaaagaaaagaaataataaaatatcttttgctgcaaaataatacaaaagaaccttcttgggttaatagtgatactagggcatacattataactttagaacgacaagcctctgaatggttaaataacaataaaagcaataaaaaatcctcaaagcgtccagcttaa

SEQ ID NO: 3456 - DNA, 609 bp, Proteus mirabilis
aaaaacattaaattgattatcattctcttatttacttttttcaaaaaaagtattaaactacgcagtcctaagtattgtattcataatgagataatgatgaataaaaacaatccattggaggtccttgggcatatttcatggttatgggctagttcttctctacatagaaattggcctatttctttatttgcaataaatgtattacctgcaatacgagctaaccaatatgctttattgactcgggatagctttcctattgcatattgcagttgggctaatctaaatttagaaaatgaaattaaatatcttaatgatgttacttctttagttgctgaagattggacttctggtgaccgtaaatggttcattgattggatagctccttttggagataacggagcgctatataaatatatgcgaaaaaactttcctaatgaattatttagggctatcagagtagatccaaaaactcaggtcggtaaagtgtcagaatttcatggaggtaaaatcgataaacaattagctaataaaatatttaaacaatatcactacgagttaataaccgaagttaaaaataagtcagattttaatttttcattgataggttaa

SEQ ID NO: 3457 - DNA, 777 bp, Proteus mirabilis
gagataattaacatgaactcattcagcacactaaaaacactattttgtggctctttgctggcactgagtctagtgaatacaacacaagcgggtgtttcactggatagaactcgtattgtattaacgggtaatgaaaactcagccagtgttaatttaaaaaataccagccctgatattccttttttagcgcaatcttgggttgaaaatgaaaatgggcagaagatctcttcacccttagtggcacttccaccgttacaacgccttgatggtgctcaaaaaggcgtagttcgcattacaaaaacagctgaagttgggctattacctcaagatagagaatcactgttttatttaaatgtgcgtgaaattccccccgcaccaaaacaagccaacgtattacagatggctatgcagtcacgcattaaattattctatcgccctagtgccatagtacctgaaaaaccgggaatggtttggcaagatcaactggtgtttaaaaaacaaggtaataaatttattgttaataatccaaccccttattacatcacgattatctcactttctaataaattaaatggtgaggatagcgataaattaaccaccttccccggattaatggttgcgccaaaagcttcactggatataccagtaaaaaccagtaacgttaatcagttttatatgatgtatgtaaatgattacggtggacacccagagctcaaatttgtatgtcagcaagatagctgcaaagtagcccctaaagatcaacaacctaaatattaa

SEQ ID NO: 3458 - DNA, 468 bp, Proteus mirabilis
gttatggttaaagagtgggcaacagtcgtacattggcaacaagggagggctttactacgttatggctcatcgtccggttgcgggagttgccaagctcgagcagcttgtggctcttatttattgaataaaataggccctgaaactgttcatcagttagaacttcctgttgaacaacctttagtggtggggcaaaaagtggaagttggtataccagaaaatagtttacttcgctccgctatgttggtttaccttactcctttgttgggattatttatcgttgcagggatagccagtctgtggctttctagtgagttggctattttttgtagtggtttagtggggggagtgttaggctttttattagctaaaaatattgcccgctggtggagtaaagatgaaggatttgaacctattattttacaaataggacttccacctaatgaattgcaagtacaatatcaagaataa

SEQ ID NO: 3459 - DNA, 1125 bp, Proteus mirabilis
tcaatgcataaagaatcacctattattcgtcgtaaatcgacgcgaatttatgttggtaatgtacctattggcgatggggctcctatcgcggtacagtcgatgacgaacacacgaacaacagacgttgaagcgactgtaaaccagattaagtctctggaacgtgttggggtggatattgtacgtgtttctgtaccaactatggatgcggctgaagcattcaaactaattaagcaacaagtgaaagtacctttggtcgctgatattcattttgattatcgtattgcacttaaagttgctgaatatggtgtcgattgtttacgtattaatcctggtaatattggtaatgaagagcgtattcgtcaagttgtcgattgtgcccgggatcgcaatattcccattcgtattggtgtgaatggggggtcactagagaaagatattcaagaaaagtatggtgagccaacccctgaagcgctagttgaatcggctatgcgccacgttgatatcttagataaattgaactttgatcagtttaaagtcagtgtaaaagcttctgacgttttccttgctgttgattcttatcgtttattagcgaaaaaaattgatcagcctttacatttagggatcaccgaagctggtggtgcaagagccggatcagtgaaatcagctataggccttgggatccttctatcagaaggtatcggtgatactttacgtatctctttagccgcagatccggttgaagaagtaaaagttggctttgatatcttaaaatcattacgtattcgctctcgtggtatcaattttattgcttgcccaacatgctctcgtcaagagtttgatgttattggtacagttaatgaattagaacaacgtcttgaagatatcattacaccaatggatgtttctattattggctgtgtggttaatggtcctggtgaagccgaagtttctacactaggtgtaaccggagctaaaacgcgcagtggtttttatgaagacggtgtaagacaaaaagagcgtcttgataatagtaatatgattgatttattagaggcgaaaatccgtacaaaagcggcaatgcttgacggcaacctccgaattaatataaatcaattggataaataa

SEQ ID NO: 3460 - DNA, 183 bp, Proteus mirabilis
ccccttaataatacacagttccataaaataaaccacctttctttgaataatgtagtcattctatgtcttcgtagtgttatacatagttgtaattgtagttgtcctcagaatgaagggttgaagtcagtagaatggcctaaagttattcatcaaaagatagtatgctcaggttgtccttgttga

SEQ ID NO: 3461 - DNA, 1239 bp, Proteus mirabilis
cgatataataaaacccgttatacaagcccgcttcgagaacatgttcttggcgggtttttttgcatgttaaaaatggggggttggatggttattccatcaacactgtggcttgccttagattattttacgtattttttctcatatggtattttcttgcctttttggtctatctggttaaagggcgagggggttgatcctgcgatgataggcttactacttggggtgggcttaaccgctcgttttgtaggaagcttgattttaacgccggctgtaaaagatccatcaaagctcattactgcactgcgactttttgcttttttatctctcctatttaccgttgcatttatgttgggcactcattgggcttggctctttttggtaatgaccggatttaacgttttttttgcacccatggtgcctttgggagattcacttgcgggaacatggcaaaaacaatttcctttagattatggaaaaattcgggtttggggatctattgcatttattattagttcctcattattggggatattgattgatgcttttggacacccgattattctttatggattgattgccagtactcttgcattattccttacctcaatgttacgtccgaaaatcatgccccaaggtaaggtcaaaaaagcggaacaccatcatgtttcatttatgaaactgatttcagatggcccagtctggcgttttctattatgtgtttctttactacaaggtgctcatgctgcttattacggttttagcgcactctattgggaaaaagcaggctatgatacagcaacgattggttatctttggtccttaggcgtagttgctgaagtggttgtctttatgtttagccgtcgtttattccgccgttggagtgctcgaaacttattattactttcagcatttgcagggctattgcgctgggggatgatgggcagttttacagcattaccggcacttattattgtacaaattttgcatagtggcacatttaccgtatgccatttagcggcaatgcgttttattactgcacgtcaagagcatgaaattattcgtttacaagcggtttattctgctctagcaatggggggaagtatcgctattatgacgattgtatcgggatggttatatgaaaaacttcctaaccaagaataccttattttctggttgatggcggcattaactattcctgcaatgtttattagaccgaaagtacaaccgcaaaatacttaa

SEQ ID NO: 3462 - DNA, 1257 bp, Proteus mirabilis
tcacatcgtaatgttacgcgttacataaaatgctctccaagatttatttttatttttatttttggagcatgcatgtcttctatcattcactttgttttggctctcgcagttattggtgcattagcatttattgcaagtaataaccgcaaagggatccgtctgcgttatattgtgcagttattaattattgaaatcgcattggcatggttcttcctcaattctgatattggtgaaggctttgtccgtggtttcgctgggctatttgatcacttattaggttatgccgcacaaggtactgagttcgtcttcggtggtatgatgaaaggtggtctagcattcttcttcttgaatgtattatgtcctatcatctttatttctgcattaattggtattttgcaacatatcaaagtattgcctttcgtgatccgcattatcggtacagtgctgtccaaagtgaacggtatggggaaactagaatcgtttaatgcggttagctccttagtgcttggccaatctgagaactttatcgcttataaagatgtattgggcaaaatgtctcagcgccgtatgtacactatggcggcgacagcgatgtctacggtatcaatgtcaattgttggtgcttatatgactatgcttgatcctaaatacgttgttgctgcactggttctgaatatgttcagtactttcgttatcctatcagtgattaacccatattctgttgaaaatgaagaagatatccagatggggaatctgcatgaaggtcaaagcttcttcgaaatgttaggtgaatatatcttagctggtttcaaagttgctttaatcgttgcggcaatgttgattggttttatcgcattaattgctgcggtaaacgctatctttagtatgattttcggtattagtttccaagattgcttaggttatgtgttctatccattagcatgggtgattggtatacctgagcaagatgcattacgtgtaggtagtgtgatggcaactaaattagtctctaatgaattcgtcgcgatgggaagcttgcaagatctagctgctgaattaacacctcgctctgttgggatcttatctgtcttcttagtctcatttgctaacttctcttctatcggtattgttgcaggggctattaaaggtctgaacgaaatgcaaggtaatgtggtttctcgttttggtcttaaattactatttggttctacgctagttagcttcttatctgctgctatcacaggcctgtttgtttaa

SEQ ID NO: 3463 - DNA, 429 bp, Proteus mirabilis
aaggttttcaattgctgcattgtcgattatcatcgtcactatgaccctaaaaggaatgtaatagccatgcgttttaaactgttaaaagttgccgccttatctttagtcgtaatgacttcaggttgctcgatgttcgaaagactggtttatcacccagatatcaatcagggtaattatttaacaccagccgaagtcgccaaagttcaacaaggaatgacacagcagcaagttcaatttgccctcggaacacctatgctgaaagatcctttcggaactcaaacttggtattatgttttccgtgaacagccaggccatcaaaaagtgcgtcaagaaactctgacactgacatttgataataatggcatactgactaagattgacaaacaaggtgatatgccgagtttttctaatcaaaccagtaaagactaa

SEQ ID NO: 3464 - DNA, 207 bp, Proteus mirabilis
catttcgacaagtgtgtaaattactgcaggcgaaaggaaactgattttcgttgttttttaattgataagaaaattatgtatcgcttgaataatacgtttacgccttatcaaactcatgtcgatcttggtcgctttgagataaaaacgggaacgaaccaaaaaataaccacgcttttgcacaatcaaggtttactactaaaggtgtga

SEQ ID NO: 3465 - DNA, 246 bp, Proteus mirabilis
aaaaatagcaaaacccatagttatttttttcaaagtaaaaaactcattaatacgaatagtaatcagttacaatttaactgttttttgaaaaaaataattaatttttgcttaaattgtttcgatttcttttatgaaagtatgaagaattcatcaataatcaataaaaaaactgagtccagtgaaacgaactcagtttttattctacatttaactggctatttaatttattttgatttctttaaatga

SEQ ID NO: 3466 - DNA, 1122 bp, Proteus mirabilis
aacgtcagcaataacgcaaaacaggggcaaaatatgagtattgaaattaatcatgtcacaaaatattttgatcgcactgaagtgttgcatgacgtgaatttaacggtcaattccggtgagatgatggcgctattggggccatcaggctcaggtaaaaccacactattacgtatcattgcaggacttgagcatcaaacggaaggtaaaatctgttttgcagggcaagatgtcagtcgtttacatgcccgcgagcgcaaagttgggtttgttttccaacactatgcactgtttcgccatatgacggtatttgaaaatattgcctttggcttaaccgtattaccacgtcgcgaacgtcctaacaaagccgcgattgataaaaaagtcacgcaattattagagatgatccaactgcctcatttagcacagcgttatcctgcacaactttcaggagggcaaaaacagcgcgtagctttagcgagagcattggctgtagagccacaaattttattactcgatgagcctttcggtgcgttagatgccaaagtgagaactgaattacgcagttggctacgggaattacatagtgagcttaaatttaccagtgtttttgtcacccatgatcaacaagaagcaatggaagtcgctgatcgcatcgttattatgggaaatggcaaaatcgaacaagtgggtacaccgcaacaagtttggcacacgcctgaaagtcgctttgttttagaatttctcggtgatgttaatcatctccaaggtgaaattaatggtgcgcaattacaaattgctggctatcacttacctttatcggttacgccgctctatcaaggcaaagttgatgtttttttgcgcccttgggaaatttcacttaacccgcatagtgatagcttatgtaaacttcccgtcaaagtaatagaagtgactcctaaaggacactattggcaattggttttacagcctattgagtggggaaatacgccaattagcgcggtatggaatgatatgacatcaataccccataaaggtgatatttactatatgggcggtgcaaaagcgcggttatatgcacaagagcgtcccttaacaacagtttcactggcatacacagcttaa

SEQ ID NO: 3467 - DNA, 1197 bp, Proteus mirabilis
caacgaggcaatgtcatgacccaatctaccactccagcgccaagcgcttctgtcgctgtttctaaagaaaatactgtgaatcaaaaaacaaaaatcaatctgttagatttaaatcgtaaacagatgcgtgagctttttgtctctatgggcgaaaagcctttccgcgctgatcaaatcatgaaatggatataccattattgctatgatgattttgatcagatgacagatatcaataaagtgctgcgtgcgaagttaaaagagattgccgaaatcaaggcacctgaagtgtctgaagaacaacgctctgcggatggcactattaagtgggcgattaaagtaggctctcaacaagttgaaacagtctatattcctgaagatgatcgtgcgacgttatgtgtttcgtcacaagtgggttgcgcgttagagtgtaaattctgttcaacggcacaacaaggttttaaccgtaaccttaaagtttctgaaattatcggccaagtgtggcgtgctgctaaaattattggtgctttaaaagagacaggccgtcgtccaatcactaatgttgttatgatgggaatgggtgaaccattacttaaccttaacaatgttattcctgctcttgaaattatgatggatgactttggctttggtttatctaaacgtcgagtcaccgtgtctacatccggtgtcgtacctgcattagataaattagctgatgcggttgatgttgctttagcgatttcattgcatgcaccaacagatgatattcgtgatgaaattgttcctattaacaagaaatataatattgaaatgtttcttgatggcgtgcgtcgttatattgctaaatctaatgcaaaccaaggtcgagttactgttgagtatgtcatgcttgatcatattaatgacagcactgaacaagcacatcaattagcagagtgcttaaaagatacaccttgtaaaatcaacttaattccatggaacccgttcccaggcgcaccttatggacgtagttctaatagtcgcattgatcgtttctctaaagtgttaatggaatatggtttcaccactattgtacgtaaaactcgtggtgatgatattgacgctgcctgtggtcaacttgctggtgatgtgattgaccgaactaagcgtactctgaaaaaacgtctgcaaggtgaaccaatttcagtaaaagcagtctga

SEQ ID NO: 3468 - DNA, 210 bp, Proteus mirabilis
agcatctcccttacaaggaggaggtcgttggttcgagcccaataccgcccaccaattacattaaagcgtggtaatgagaatttagtcattatgaagtgggcggttagctcagttggtagagcatctcccttacaaggaggaggtcgttggttcgagcccaataccgcccaccacttcatccggttattttacgcaatatcacacagttag

SEQ ID NO: 3469 - DNA, 915 bp, Proteus mirabilis
acgagggtaaaaaaaatgccagataataccgtaacggaagaaaaacaatttaaatgcattggcatcgtcggtcatccccgccatcctgaagcactttcgacacatgaaatgctctattattggctccttgataaaggatatgacgtcattatcgatacccaagttgctgaagaattaaagctcaccgatgcacaaacgggcgatttaacacaagtcggcaaactcgctgatctggttattgttgttgggggtgatggcaatatgctaggcgccgcccgtgttttatcgcgctataatatcaaagtgattggtgtaaaccgcggtaacttaggttttctgaccgatcttgatcctgataacgcattacaacaattaactaatgtattagcaggccattatcgtgaagaaaaacgcttcttacttgaagctcgtgtctgtgctgaaggacaaagaacacggattggcaccgccattaatgaagtcgtacttcaccccggcaaagtggcgcatatgattgagtttgaagtctatattgatgatcgttttgcattttcacaacgttctgatggtctaattattaccacaccaaccggatcgacggcgtattcactctctgcaggtggccctattcttacacctaatcttgatgcgattgcgctggttccgatgtttccccatacgctctcttcacgccctttagtcattagtagcgacagtcaaattcgcttaaaattctcacaaaccaatattgattacgaagtcagttgtgatagtcagcttgtattacctatcaaagaaggggatgaggtaattattaagcggagtcgacaaaaacttaatttagtccacccaactgactacaactattttaatacactcagctcaaaattaggttggtcaaaaaaaatgttctga

SEQ ID NO: 3470 - DNA, 885 bp, Proteus mirabilis
tggattacaaagtcgctttggcaagcgattaagggggcactaatgtcggatatagcgcaacaacgctctctttatcgtcgccaaattgattgggtaaaatggggattgatccttacaggcgttgtgttatccattttatttttagtggtgcctattgcgtggatctttatgactgcgttttcaaaaggcatagaaatatttaccgacaacttgctagatagcgatatgttacatgctgtttggcttacgctacttatcgctttaattactgtaccgataaatatgttgtttggtattagtatggcatggcttgttacgcgttttcgttttccgggtcgtcagtggttaatgacgctgattgatatcccatttgcggtatctcctgtcgttgcgggactgctctatctgcttttttatggtagcaatggttgggcagggcagtggttggaacaattcgatattcagttaatgttctcttggcccggtatggtattagtgacggtatttgtcacttgtccttttgtcgtgagagagcttgtcccagtgatgatgagccaaggaagccaagaggatgaagctgctgtattattaggtgccagtagttggaaaatgttttggcgagtgacattacctaatattcgttgggcattgctctacggtgtggttttaacaaatgcacgtgctataggggaatttggtgccgtctctgttgtttcgggtgctattcgtggtgaaacctattcactgcctttacaggtcgaacttttgcaccaagactacaacactgtgggggcttttacggcagcagcattacttgccatgatggcaattattacattaatggttaaaagtgcgttgcaatggcatttagaacgtcagcaataa

SEQ ID NO: 3471 - DNA, 1770 bp, Proteus mirabilis
gttggtcaaaaaaaatgttctgatttttgtgcctcgctactttactgtataaaaaaccagtttatactgtatgtaattacagatatgtttttatacaggagaggcactatgctgactcaattaactattagtcattttgccatagtccgtgaacttgaaatcgacttttctggtggcatgaccacaattaccggtgaaacgggcgcaggtaaatctattgcgattgacgcattaggcttgtgtttaggaaaccgtggtgatgctaatatggttcgccctggtgccactagagcggatttatgcgcacgattttcactctctgataccccttccgcccagcgttggttagaagaacatcatcttgacgatcataacgaatgcctattaagaagaaccattgcagcagatggccgctctcgtggttttattaatggtacttctgtccctttgtctcaactaagagagcttggctcattgctgatccaaattcatgggcaacatgctcatcaacaactgttagagcctcgctaccaaaaacatttacttgatatctatgctaatgaacctgctttattaaaaaagatgaaagcggcttatcaaacctggcatcagagttgccaaaccttagcgacttttcaacaacaatctttagaaagagaagcaaggcaacaactgattgattatcacttaaaagagcttaacgagttccaacctgttgcgggggaataccctgaattagatcaagagtataaaaggttatctaattgtggtcaatttctgaccttgagccaaaatagtttgcagatcttaagtgataacgaagaacaaaatattttaagtatgctgaatgtggccaaacatgagatcagcgaactttccacaatggagagccaatttaattcactgttagatatgctggaagaagcaagtattcaaattagcgaagtgagtgatgaactacgccactacagtgatcgtttagaaatggatcctaaccgtttattcgaattagaaaaacgtatttccaaatatattagtctatctcgtaaacatcgcgtcacccctgaagagctatatgaactgcatcaacaattaattgaagaaaaagaggcactattacgccaaaatgatgactgtgatgcattaatggaacaagttaaaattgatcatgcagccgcattggacgtggcaaaacaacttcatcaaattcgtcaacagtatgcacacgaattaagtcagcttattaccaatagcatgcatcaattatcaatgcctcatggctatttaactgtagatacattgtttgatgaaaatgtcttacaaattgatggtgcgacaaaagttgagttcaatgtcaccaccaacccggggcaacctcatcaagctctctctaaagttgcgtctggcggtgagctatcacgtatcgctcttgctatccaagtgatcaccgcaaaaaaaatggatacacccgcgctgatttttgatgaagtagatgttggtattagtggaccaacagcagctattgtcggtaagttattacgtgaattaggcgaatcgacacaagttatgtgtgttactcacctaccgcaagtagcaggttgtggtcatcaacactattttgttaataaagagactaatggtgaagagacagaaaccaccatgaagctgttaactaaaaaagagcgtttacaggagttagcccgcttattagcaggaagtgaagtgactaaaaacacccttgctaacgcaaaagatctgctggcagcctaa

SEQ ID NO: 3472 - DNA, 228 bp, Proteus mirabilis
attaaaggaaattctatgtctaatacaatgactggtacagtaaaatggtttaacgatgataaaggttttggtttcatcactcctaaagatggaagtaaagatgtatttgtacattactctgcaattcagagtgatgacttcaaatctctgatggaaggccaagaagtttcatttaccatggaaaatggtatgaaaggcccagcagcaggcaacgtggtggctctctaa

SEQ ID NO: 3473 - DNA, 702 bp, Proteus mirabilis
tacctcatgaatcaaaatattcaacaacaaattgatgaacttcgcgttacactacgtcaccatgaatatctctatcatgtcatggacgcacctgaaattcctgatgctgaatacgatcgcttaatgaataagctaaaagcattagaagccgaacatcctgaactcattaccccagattctcctactcaacgggtaggggcattacctttaacggcttttgagcaagttagacatgaaattccaatgctctctttagataatgcttttgatgaaacaacctatttagcatttgataaacgtttacgtgaacgtctgaaaaataatgaagagatcactttttgttgtgaattaaaattagatggacttgcggtaagtctactgtatgaaaatggtcgcttagtacaagctgcaacccgtggtgatggtaccactggagaaaatattactgagaatgtcagaaccattaaagccattcctttgcgtttatatggcgataatatccccgcacgaattgaaattcgtggagaagtctttatgactgaaaaagggtttgagcatttaaatgaagaagctcgacgcacgggaggaaaagtatttgctaatcctcgtaatgcagcagcgggttcattacctcagttagatcctcgtattacaacccagcgcccctttgatttccttctgttatggtgttggcgtgcttga

SEQ ID NO: 3474 - DNA, 687 bp, Proteus mirabilis
tcgcacatgaatactctattagttaaccagttacaaaaaaaactgggttatacttttaaacaaaacgaattacttttacaggcacttactcaccgtagtgcaagtagtaaacataatgaacgcttagaatttttaggtgattcaattctaagttatgtcattgctaatgcgctttaccatcgtttccctcgtgtcgatgaaggggatatgagccggatgcgtgcaaccttagtgcgaggtaataccctcgctgaactagcacgtgaatttgaactcggtgaatgtttacggttagggccgggagaattaaaaagcggtggttttcgtcgcgaatctattttggccgacacagtagaagcgttaattggtgctatttttcttgatagtgatattcaaaatatcgaaaatatcatcttaaaatggtatgagaatcgcttggctgaaatcagtccgggtgataagcaaaaagatcctaaaactcgcttgcaagaatatttgcaaggacgtcatttaccactaccttcttatgttgttgtacaagtacgtggtgaagctcatgaccaagagtttacgatccattgtcagataagcggtatcgaccaacctgttaaagggatgggtacaagccgtcgtaaagccgaacaagccgctgctgaacaggcattaatacaattggagcttgaatga

SEQ ID NO: 3475 - DNA, 453 bp, Proteus mirabilis
gatttaatgaaactactcttaacgccctatattcagtctgaccttggcgttgttttattgaagcgtggagcggagttgcttaagcaatttaaaccacattcgcgcgtgattattagcgatgtaccaaaaagtttagataaatggccttctggggcattaacaggaaatgaacagccattattggataacaagggcattgttgattttttgaataataaaaaagttctccaagctatgggaggattgtcatcgatgaatatgtggataggcagaaatatccattgttgtcagattaacgataagcatgacagttatcatcatcatgaattaacaaccacatggcatcaagacggtgtgatcgacttggttggtaccatgataatcatattcgccattcatcagctgaatgggttgctgaattggctcataaaattcgtattgcttggatggtag

SEQ ID NO: 3476 - DNA, 765 bp, Proteus mirabilis
actgaggtgaatatgagttattttgaaggcaaaacggtgttagtgactggggctgcaacaggagtaggggaaggcgttgcccaacgattatatcaagcgggtgcaacagtctttataagtgggcgacaattagaacaggttaaaaaaaccgcttacacaatcgatcctacaggtgaaaaagtcatagcattacaagcagatatgacatcacctgagcaagttaaaagcatgtttgaagcaatattagcacaaacaggcgcattacatggattagtgaataatgcaggtattacaggtccgcataatacatcgattgttgattataatattgatgattggaaagcggttatggataccgatattaacggcgtattttacggattgaaaatatgtattccggccctactaagaagtggtggagggagtatcggtaatttatcctcgacaaatggtattgtcggtattgccggtattttttgttatactgcaagcaaacattctgtgttagggatcacccgttcagccgccttggaatttgcccagcaaggtatacgtgtgaatgcaatagggcctgggtatgtagacacaccgcgaatgcaacagttaccggatgaagttcgtcaatggatggcatcaacacatccgatgaagagaatggcaacgcgaaaagaagtggctaatatggtggcttttttactttcagatgagagtagtttttcaacaggcgctttttatgcggtagatgggggatatactgcgcagtag

SEQ ID NO: 3477 - DNA, 654 bp, Proteus mirabilis
caagaggtgaatatgactattgaaacagtgttttcttcgctaaaagattatctgctaaaactaaatgatgagcaaaaaatcgaagctatcaacaaaatcaaattatttcttcatcacattagtccattcaaaaatgaacctatagattgtgttctttggataaagcaaaatcaagtcgtagcaaatgactacaaccctaatgttatgtctcccacagaaaagagattactcaaaacctcattgataaaagacggttatactcaacccgttgtagtattatctgcacaacaaaataaaactaaacaattgcaatggcaaatcattgatggctatcatcgttatttattaagtaaagaaaataccttaaaaaaacgaattaataattatttaccagtcactatccttgatgttaaaaaccacacaatgtcagatcaaatagccacaactattcgtcataatcgagcaagagggcaacaccaagtcgcagctatgtcagatatagttagagatctatctcgattgggatggagcgataaacggattggtgatgaactaggtatgtcacaagatgaagtattgcgcttaaaacaaatctgtggattagctgaattattttcagagcgccatttttcagaagcttggacagtaaaataa

SEQ ID NO: 3478 - DNA, 231 bp, Proteus mirabilis
tgtaacgcgaagttcatcaatttgttgttgaatattttgattcatgaggtatcaccaaagaaagaaaagcccccgcaagcgggggctgaggttgttggcaatgtgagaaaaaccaagtttccccactttgtattatcagccgaaaatcaagtcattaattttcctgatttctttaaatctatccaacctagcaccgcaagcgagcttttgataaaaagactattgatgtaa

SEQ ID NO: 3479 - DNA, 219 bp, Proteus mirabilis
aaagagaagaataatatgaaaacatggttaatgggtgtttatgagttttttttacgctataaagtcgtttggagtgaaacttggaagatccgccaacaattagatgcgcctatacgtgaaaaagatgaacatgaatttttacctgctcatttggaattaattgaaacccctgtatctaaacgtccacgtttaatcgcttattttattatggctttttag

SEQ ID NO: 3480 - DNA, 450 bp, Proteus mirabilis
acattatgtgatttggagtttgtaatggatgtatctgaacaatttgaagtacaagaaattgttgctgttgaaggttcttctctacaactgagtgtgcttgagccacagcctgaaaaattaacacaagcattgagcgaattttttggtcaacataagcctattcgtcgtgcatttattgttaatgctttggagcaaggtgatgatgagtcattttatttgattgggctagaaatcactggagaagaaaatattattgctcagatactcccacaagctgctgaagccgcttttgagcatctagaagaaggacaatctctggatttctgttttgtgaataaagatgagcaaggtgtaagtcattttatgactcaccatgtaacccctttttatcaacgcaaattagggggctttcttcgtaagggtattccaatcgttaatttgaatacctaa

SEQ ID NO: 3481 - DNA, 501 bp, Proteus mirabilis
attaatggtgaaagcgccaaaggatatttaatgtctctcaaacagaaaatagcggcggtaacaacagcaggagccacagccatcgcgttagtagtaatagcccattttgaaggtgtacgttatgaaccttatcgtgatgtggcgggtgttctaacagtttgttacggacacacaggtaaagacattattcaaagtaagacatactcacaacaagaatgtgatgcgttattacaaaacgattttattaagacacaacagcaagtcgatgcattaatcaaagtaccactcgatgactacaccaaagccgctttatattcctttgcttttaatgtgggaacgaccacatttgctcgctcaacattacttaagaaactaaatgcgggtgatagagcgggtgcctgtgaagaaataaaacgttgggtatatgcgggtggaaaggtttggcgaggtcttgttagtcgtcgagaggcggagtcagtactatgtcatggaaacctttaa

SEQ ID NO: 3482 - DNA, 426 bp, Proteus mirabilis
aaggatatcgacatgaaaaagagtattatatttttattactaccacctttaataatgactcccgctatttcaattgcggcaagtaacttactaagtgttcatatactaaatcaacaaacaggtaaaccagctcctaacgttgaagttacattagagaaaaaacagtcaagtaattgggtattactgaattcgggaaaaactgacaatgatggtagaattaaagctatttggccagacaactctacttccccttctactggtgattatagagtagtgtttaaaactggcgactattttaaaaatcaaggaaaagaaagcttttttcctgaaatacctgtcgaattccgtatagataatgttaatgagcactatcatattccattgcttttaagccaatatggctactctacttatcgaggtagttaa

SEQ ID NO: 3483 - DNA, 909 bp, Proteus mirabilis
atgagcgaagaacaaacctattgcggatttattgcgatagtcggtcgccctaatgtagggaaatcaacattactgaaccaattattggggcagaaagtttctattacttcacgtaagccacaaaccacccgtcaccgtatcatgggtattgatactgatggtgcatatcaggctatttacgtggataccccaggcttgcatattgaagaaaagcgagccattaaccgtttaatgaaccgtgcagcaagtagctctattggtgatgttgaactggttattttcgttgtcgaaggaaccaattggacgcctgatgacgaaatggtattaaacaaattaaaatcactacgttgtcctgtgctattagcgattaataaagttgataacgttacagataaaaccaagttactgccacatattggttttttaagtcaacaaatggattttctagatgtagtgccgattagtgctgaaaaaggcatgaatgtcgatactattgctaaaatagtgcgtaactgtttacctgaagccattcatcatttcccagaagattatattactgatcgctctcaacgttttatggcgtcagaaattattcgtgaaaaattgatgcgctttttaggtgaagaattaccttattctgtgacggttgaaattgaacaatttgttactaacgatcgcggtggatatgatattcacggtttgattctggttgaacgtgaaggccagaagaaaatggtgattggtaataaaggcgctaaaatcaaaaaaatcggtacggaagcccgcatggatatggaagatttatttgaaaacaaagttcatcttgaactttgggtgaaagtaaaagcgggttgggcggatgatgaacgtgctttacgtagccttggctatgtggacgatttaaaatag

SEQ ID NO: 3484 - DNA, 447 bp, Proteus mirabilis
gtactaatggagcaacttgagctagaaaatgccctatcgcttttacagtgtactctggttgcacaacgcacccgttatacaccagagcaagtaacttggggacaatatgatattttagaattattgcgtttacgcggtgatttaacgccctctcaactttgtgaaattttagctatctcacgccaaaatttatctaagtttatgcgaggattaaaatcattaggttttattgctcaggatcgttctaagaaagataaacgtgaattaattacgcatttaacagatgaaggtaaagcttttttagcaagagccgctttaggccgaaaacagaacgcacagaagctacaagcgcaattaacacctgcagaacaagctatgtttattgaattgagtcataaagttattaacgcactaatagcggataagttacctacagagcctgattaa

SEQ ID NO: 3485 - DNA, 630 bp, Proteus mirabilis
aactacgcggagatattcatgagtagtaaagaacaaaacgtacatgaagagcaagtctcaaaagaaaaagaaggaatggaatcggtaatgaatgaatctcaagagcaagtgaaaagcgaagacgctcaggcggagtttgatgcacaagctgagttagttcaagcgcttgcacgcgttgatgagctggaaaaacagttgcagcaatcacaaaaaacggaacgtgaagcgatgatccgtgctcaagccgaaattgagaatattcgccgtcgtactcaacaggatgttgaaaaagcacataaatttgcgcttgagaaattttctaatgagctactacctgtattggataatttagagcgtgctttatctgccgctgatcatgaaaatgaacaaatgaaaccgatgattgaaggtttagagttaaccctgaaatcattcttagatgcggtgcgtaagtttggtatcgaagtcgttgaagaaaaaaatgtcgccttcaatcctgaagtacaccaagcgatgacattaattgatagccctgagcatgaagcaaaccatgtcgttgatgtgatgcaaaaaggctataccttaaatggtcgtctattacgtccagcaatggtagtggtatcgaaataa

SEQ ID NO: 3486 - DNA, 474 bp, Proteus mirabilis
atgatgggggagattaaaatcagtgggttagctgaactatcgcaatgcttaaaagcgttggagaaaaatgtgggtaaacgtattgcccgaaaagcgatgaatgcgggagcgatggaattaaagcaggaaatcaaacatcgagtgcctatccttaaggaaaaggtaccgcatcgacgcaaaggcaccctcaagcgcaatattcgttctaaaacgaaagtacagcgcaatgggcaagtcaaaacacgtatttgggtaaaatcattatcgggtaaaaaggtgtctgcctttaaacaggcaacggggaaaagtgcggcattgaacccaaatgatccgttttattggtggtttgttgagtttggtactgccaagatgcccgcacaaccgtttatgcgccccagctttgaggcgaaaaaggaagcgacggctaaagtgattgttcaaatacttaaagaggatattgaaaaagcaaggtag

SEQ ID NO: 3487 - DNA, 591 bp, Proteus mirabilis
aaacttttactaaagaaaaaacactgtgctaataacgttagccagagcccggtcccaactaaaataattaggagaagattcatgggtctgtttgataaattaaaatcactggtttcagaggaaaagaaaggcagtggcacgattgatattgttgcaccactttctggtgaaatcgtcaatatcgaagatgttcctgatgttgttttcgctgaaaaaattgtaggtgacggtattgctatcaaacctgctggtcataaaattgttgcaccagttgatggtactatcggtaaaattttcgagactaaccatgctttctctattgagtctgacaacggtatcgaattatttgtccacttcggtatcgacacagttgaactaaaaggtgaaggatttaaacgtatcgctgaagaaggtcaacaagttaaagtcggtgatactgttttagaatttgatttagctgttttagaagaaaaagcaaaatcggtattaacaccggttgtaatttctaatatggatgaaatccaaggtttaactaaaatgacaggcccagtaactgttggtgaaaccgttgtaatgcagatcaaaaaataa

SEQ ID NO: 3488 - DNA, 198 bp, Proteus mirabilis
gtattggcttgcacttataagcattggcaaatactcttagtaaaagtaatattcgccattgtggctattaaacctcaagacaacagagatagaaatgatgcagcaaaatttgcgtctgatattaatcgttgttggtgcgattttaatcatagctttgttattacacggcttatggattggtcgaaaagagcgttctaa

SEQ ID NO: 3489 - DNA, 3909 bp, Proteus mirabilis
aagagagaactcaatattatggaaatcctgcgtggctcccccgctttatccgcttttcgtattaataaactattaactttatgtcaggaaaaccaacttcctgtccgtggtatttatgcggagtttatccattttgtaaaagtggatggacagctatctgaagatgaacaagctaaattaagcaagttactgcactatggcccttcattaacagagcatgagcttgttggagagatgcgtattgttgtaccacgaccgggaaccatttcgccatggtcgactaaagcgacagatattgcccataattgtggtttagcacaagtggttagaattgaacgtggtattgcttattatatagatagcgatacgatggacgaagaacagtggcagttgttatacggttttatttatgatcgtatgatggaaacaatttttaccgattatcaacaagttaatgcgctatttgctgaacagacacccaccccattaaaaacaattgatgttcttgctcacggtaaagatgcgctagttgctgccaatattgaaatggggttagcgctagctgatgatgaagttgattatctagtagatgcttttaaacgtttgcaacgtaatccaactgatgtagaactttatatgttcgctcaagcaaactcagagcattgccgtcataaaatttttaatgcagattggataatcgacggtaaagcgcaagacaaatcattatttaaaatgattaaaaatacttttgagcaaactcctgattatgtcttgtcggcttataaagataatgctgctgtaatggaaggctccgttgctgggcgtttttatcccgatacggaaaaagggcattaccgttatcatcaagagcctgttcatatcttaatgaaagtggaaacgcacaatcacccaacggcaatttccccgtggcctggtgcagcaaccggctctggcggtgaaattcgtgatgaaggggcgacaggccgtggggcaaaacctaaagccggtttagtcggtttttccgtttctaacttacgtattccggggtttgaacaaccttgggaagaagattttggcagaccagaacgtattgtcagtgcactggatattatgacagaaggccctttaggtggagccgcatttaataatgaatttggtcgccccgccttattaggttatttcagaacctatgaagagcaggttaatagtcataatggtgttgaaattcgaggctaccataaacctattatgttggctggtggtattggtaatattcgcgaagatcacgtgcaaaaaggtgagatctccgtgggtgctaagttaattgtacttggtggcccatcgatgaatatcggcctaggaggtggtgcggcttcttctatgacttccggccagtcagatgctgatttagattttgcctctgtgcaacgagataacccagaaatggagcgtcgttgccaagaggttatcgatcgctgttggcaattaggtgatgataacccgattttatttattcatgatgtcggagcgggggggctttctaatgccatgcctgagcttgtcaatgatggcgggcgtggaggtcgttttgagttacgtaacgttttaaatgatgaaccgggtatgagtcctctagagatctggtgtaatgagtcgcaagagcgttatgtattagcggtatccccagaaaaaatgccactatttgatgcgctatgccaacgagaaagagccccttacgctgtcattggcgaggcaacacaagagcgtgaattagtgttaaatgatacacactttgataataaaccaatagatatgcctttagatatcttgttgggtaaagcaccgaaaatgttgcgtgatgtcacatcacataaaacagcaggtgaatatctcgatcgtaaagatatcgatttaaaagaagcggtttatcgcgtacttcatttacccgccgttgctgagaagacgttcttaattactattggtgatcgtagtgttacgggaatggttgcgcgtgaccaaatggttggaccttggcaaattccggtggctaactgtgcggtaacaacggccacattagatagctattacggcgaggcgatgtcaataggggaaagagcccctattgcactattagattttgccgcttcagcgcgaatggcggtaggtgaagccttaaccaatatggcgggttgcgatgtacagtcacttaatcgtataaaactttccgcaaactggatggctgcggcgggtcaccctggtgaagatgcaggattatatgatgcagtaaaagccattggtgaagagctatgcccacaattaggtattactattccggtgggtaaggactcaatgtccatgaaaacgcgttggcaagatgaacaagggaaaacgaaagaagttatttcccctctctctttagttatcaccgcattttcccgtgttgaagatgtacgtaaaactgtcacccctgagctttctacccaagaaggaaaccgtttatatctaatcgatttaggtaatggtcataatgcattaggggcaacagcattagctcaagtttatcgtcaactaggacaaaaagcggctgatttacgtgatgtagagcagttaaaacagttttttaatgtcattcaacaattggtgagcgatggtaaattactggcttatcatgaccgctctgatggtggcttatttgtgactttggccgaaatggcgtttgcgggacattgtggccttaatgttgatatcagtgcttatgacgaagatattttagcaggtctatttaatgaagagctaggtgcggtgttccaaattaaaggggagcatcaagaaagcgttgaaacactgtttactgaacatggtttagcagattgtttacattacttagggcaagcaacaccaagtgatgacattattattcaaagccgtgaaacggaagtttaccatgaaaagcgtagtacattacgtgtctggtgggctgaaacgacatggcaaatgcaacgtttacgtgataatcctgaatgtgcagatgaagaacatcgtgccaaacaagatagtcacgatccgggattaaatgttcacttaacctttgatccagcagaggatattgcggcgccttatattgctacaggcagtcgtcctcgtattgcggtattaagagagcaaggtgttaactctcatgtggaaatggcagcagcttttgatcgcgctggatttgatgctattgatgttcatatgagcgatttacatacggcacaacgctcattaagtgattttgatgtattggttgcttgtggtggtttctcttatggtgatgtactcggtgcgggtgagggatgggctaaatctattttatttaatcatcgtttacgtgatgagtttgcccaattctttgcacgtcaagatacgttatcacttggggtttgtaatggttgccaaatgatgtcaacgttggccgagcttattccgggggcagatttatggccacgctttgtacgcaatcgctcagagcgttttgaagcccgctttagcttagtaaaagtaactgatagcccgtcgctattattacaaggtatggcggggtcacagatgccaattgcggtatctcatggtgaaggttttgctgaatttcgtgacgctgcacaattagcgcagttagaagcaaaaaatttagtaggactgcgttttgttgatcactatggtcaaccaacagagcaatacccattaaaccctaacggatcagtaaaagggatcaccgctgttaccacaacagatggccgctcaacaatcatgatgcctcaccctgagcgcgtttttagaacagtgagccattcttggcatccagaaaattggggagaagatagcccttggatgcgcttattccgtaataccagaaagcaatttgactaa

SEQ ID NO: 3490 - DNA, 462 bp, Proteus mirabilis
gaaatgagttgtcaatcaataaaacaggtagtgaaagcgatgtgtgaggcgacagctggtggacgtgaagcaatggctggtgcgctcggtctgtctttaacatcattcaataacaagctttatgagaaaaacggttgtcgttcatttgatttaaatgagttgttagcgatgcaagatatttctaaaaccgttttgtttgctgagtttgttgctcgtgaatccaatcgcttgttagtggatagagtcaatccagctgaactagacacaaccgagttattcacattacgcagcaatgttgatgaaatgcaagggcatttagcgttactgatgaaaaatagtttggctgatggtgttattgataacgaagaagagcagaaaataaaaatgatgttggatggattaatttcgcagatccacacatttatgaatgcgtttgttttgttacatcaaaagagaaattaa

SEQ ID NO: 3491 - DNA, 1635 bp, Proteus mirabilis
ctggagagactaatttttatgagtcgtaaattaaaactcgcacttgctcagttaaactgggttgttggcgatattgaaggcaactgtgaacgcatgttagccaccgtaaaagcgcaagaagatgccgatctggttttgttttctgagcttgcgttatgcggttactctcctgaagatctactatttcgccctgatttccaacaacgttgtgaagagcaactggttcgtttagaacaagcaagtaagaaaacggccattgtggttgggcatccttggtggcaaaacggtactatctataatgcactgtcatttttctatcaaggtgagttacaggcgcgttacttcaaacaacagctacctaattatggtgtatttgatgaaaaacgttatttccaacaaggaaatgaacgttgtgttgtgccttttaaaggctatcatttaggattattaatttgtgaagatatttggatcaacgagcctattgatgcactaaaacaagcgggtgctgatctggttctttctattaatgcttcaccttatagtcgtgaaaagccacatattcgtacccaattaattaaagaacattgccaaagaacgcatctgcctgtggtgtatctcaatcaaattggtggtcaagatgaattggtttttgatggatgttctaaagtctttgatgaacgaggaacaatcacccatcgtttagcggcttttgatgagcaagtggccgtggtggagtttgatgagttaactatcgtaccaatgcaagatgcggcacccgagctttctcctttagcgcaagtttatcaagcgttagtgctggcaacgcgtgattatgtgacaaaaaatggttttaaaggcgctatattaggattatcagggggcatcgactcaggcttaacagttgcaattgccgttgatgcattaggtaaagagagcgttcaagcggtaatgatgccatttcgctatacctcagaaatgagtattcacgatgcgaaagagcaagctgatttattaggtgttgagtttgatactgtctctattgagccgatgtttgatgcttttatggatcaactttcgcctatgtttaaaggtagcgctgtcgataccacagaagaaaatctacaagcgcgttgtcgtgctgttattttaatggcgatgtccaataaacgtcgtcggttagtgctcaccacgagtaataaaagtgaatctgccgtaggctactcgaccttatatggtgatatggcggggggctttgatgttttaaaagatgttcctaaaacactggtgtttgaactggctaaatatcgtaatactctttcacccgctattccacaacgtgtgattgataggcccccttcagcagaattagcaccaggacaaacagatcaagataatctgccaccttatgatattttagatgcccttcttgaaggctatgttgagcaagataaatctgtttctgacttggttgcggctggatttgatgaagccattgttcgtaaagtggtaaaattagtcgatattaatgaatataagcgtcgtcaagcaccggtaggaccgcgtattaccagtcgtaattttggtaaagatcgtcgctatccgatcacaagcggttttggtcgccataactggtaa

SEQ ID NO: 3492 - DNA, 342 bp, Proteus mirabilis
caaataatatggtgcaggcgtttactcaaagagcgaaagagatttatcgtgactaaaatatgggttgaggtagcctacgcgttaccagataaacaatatgttatccctgtggagttaacactgggggatactgttgaacaagcaattattgcctcaaatattttaacgatttgtaatgatatcgatttaactaaaaataaagtgggtatctatagtcggccagcaaaattgagtgataatgtgcgtgatggcgatcgcgttgaaatctatcgaccgttaatcgctgatcctaaagagatgcgccgtaaacgcgctgaaaaagcacgccagaaaactgaatag

SEQ ID NO: 3493 - DNA, 1254 bp, Proteus mirabilis
atgttaaaacgtgaaatgaatattgctgattacgatccggaattatggaatgcaatggaaggtgaagtgactcgtcaagaagagcacatcgaattaattgcttctgaaaactatactagtcctcgtgttatgcaggcgcagggatctcagctgaccaacaaatatgcagaaggttatccaggtaaacgctactacggcggttgtgaatacgttgatgttgttgaacaattagctattgatcgtgccaaagcactatttggtgctgattatgcaaacgtacaacctcactctggatcacaagcgaatgcggctgtgtatatggcattacttaaaccgggtgatacagtattagggatgaatttggcccaaggtggtcacttaactcacggctctccggttaacttctctggtaaactctacaatatcgttccttatggtattgatgaagccggtaaaattgattaccaagatatcgctgagcaagctaaaaagcataaaccaaaaatgatcattggtggtttttcagcttattcaggtttggttgattgggctaaaatgcgtgaaatcgcagatagtgtaggggcttacttatttgtcgatatggctcacgttgcaggtatgattgcagcgggtgtctatccaaacccagtaccacatgctcacgttgtgactacaacaacacacaaaacattagcaggtcctcgtggtggtcttatccttgctaagggtggcgatgaagagttttataagaaattaaactctgccgtattccctggctctcaaggtggtcctttaatgcatgtgatcgcgggtaaagccgttgcattaaaagaagcaatggaacctgagtttaaagtttaccagcaacaagttgcaaaaaatgcgaaagcaatggtagacgttttcttagcgcgcggttataaagtagtatctggtggcacagagaaccacctgtttttattagacttagttgataaagatattacaggtaaagatgctgatgctgcactgggtcgtgctaatatcactgtgaacaaaaatagtgtgccaaatgatcctcgcagtccatttgttacatctggtattcgtattggttctcctgcgattacacgtcgtggttttaaagaagcggaagcaaaagatttagccggttggatgtgtgatgtccttgataatatcaatgatgaagcgaacattgaaaaagtgaaacaaaaagtcttggatatctgcgctaaatttccagtttacgcataa

SEQ ID NO: 3494 - DNA, 858 bp, Proteus mirabilis
attattattagaaggacgccaataatgtttgccacagccagcaagcgagtattacccggatttgggcttagtttaggtagtacgcttttttatacttgtttgatcttattgctacctatgagtgcgctggttgtgcagttatctgaaatgagttgggcacaatattgggcggtgataacccaccctcaaattgtggcagcgtataaagtcactttgttgtcagccggtgttgcaagtatttttaatgctatttttggcatgttattagcgtggatcattacgcgctatcgtttccccggcagaaagtttcttgatggattaatggatttaccttttgccttacctacagcggtagcgggattaaccttagcaacgttgttttctacacaaggatggtatggcttggtgttagataagtttgatatcaaggtgatcaatacatggattggtattgctgtggcgatgtcttttactagtttgccgtttgtggtcagaacagtgcaacctgttttagaagagttaggccctgaatatgaagaagcggctgaaacattaggggcaaaccgttggcaaacgttccgtaaagttgtgttacctgaattgtctccggcgttattagccggtactgcgctctcttttacgcgtagtttaggggaatttggtgctgttatttttattgctggcaatattgcatggcagaccgaagtggtttctttgatgatatttattcgattacaggagtttgattatcctgcagccagcgcggtcgcttctgttattttattggtttcattagtcttactgttttcaattaatggattacaaagtcgctttggcaagcgattaagggggcactaa

SEQ ID NO: 3495 - DNA, 222 bp, Proteus mirabilis
agagaaattagcatgagtagattagcgcatttagtacctaaaaagcaattccggtgtttacctgtctcaggtcgtcagtcatttcgctatgtagaaatcatagtctctgacaaacaaccagacaactacaagaaacctgcatgtttggtagataggcaggctcttaaaaaggcgtggactgatttttatttttcaagtggagggcggggcaatgagcaatga

SEQ ID NO: 3496 - DNA, 420 bp, Proteus mirabilis
gcgaattacagtttagtcttcactatgcctcatgcctcagaaacagacagtgaaaagaatacctccgccattttaacggcgaatatccatacgactgatggtgaaactcaacaactgacacaattaatttgcacgacatcttccgcaggtaaaaagcaatatcgaatcggcttgcaaaaaattagtgatgcaggtgctccattgctggtggcgattgaatcctattggcgtaaaaacacacaagagagttgtgtttatttgttagagaaagcgaagcaatttattcaaggacacttacaacaaacgaatacatggatatctatgtatggtcttgtgattgtttctaatgcgtcacttgaagagcagttgcctgaggctttattaacattaattcattcaaaatatgctagtctttcttga

SEQ ID NO: 3497 - DNA, 543 bp, Proteus mirabilis
aaagaaaacagacgcttaaatgatttctttctattgctcatacagtataatgtggaaattatgacaaagaaaaaatcacacaaacccagctctgccactattgcactcaataaacgtgctcgccatgaatatttcattgaagatgaaatcgaagcgggactgtcgttacagggctgggaagttaaatcactgcgtgcgggtaaagccaatatcagtgatagctatgtaatcatgcgtgatggtgaggcgtacctgtttggtgccaccattacaccgttaaacgttgcctctactcatgttgtttgtgatccgacacgtacgcgtaagctgttattaaaacaacgtgaattagctaatctctatggccaaataaaccgtgatggttacaccgtggttgccctttccttatattggaaaaatgcatggtgtaaaatcaaaattggcgtagctaaaggtaaaaaagatcacgataagcgtgacaccataaaagatcgtgagtggaaattagacaaagcacggatcatgaaaaatgctaaccgctaa

SEQ ID NO: 3498 - DNA, 288 bp, Proteus mirabilis
tggaaacggctacccaactctttttcgatcgcttgctctgtcactgccgttgaagcagtgatattacctaatccatttgcagaaaccgttaacgtctcatttgagaaccaattcattggattaagtgcagaaaaagacattccccccatggatgaacagccacttaatagcaagacacttgtgcttaagcacaagggtaaccaaaatttaggcattataaatactccatttcactttttcgttataaattcaattgatgctaaggcaacaagtttttactcgcgttaa

SEQ ID NO: 3499 - DNA, 537 bp, Proteus mirabilis
tccaagagcagaagtatggactatttcaccctattaggcatgcctaatcgttttgatattgataaacaacagcttgcttctcgttatcaagagatgcaacgtcaatatcaccccgatcgttttgcgggtaaatctgacaaagagcaagtacaagcaatttcgtttgcttcgactatcaatcaggcttatcaaaccttaaaaaatccactttcaagagctgaatatatgctctctttacagggcatcgatattgctaatgagcaacaaacgatgcacgatacggcttttcttatggagcagcttacgcttcgtgaagagctggatgatatagagcatagtactgatgctgaaaatttactggctgatttttctgcgcgcttagagaaaatgtacactgtacgctatgatgaaatggtgaaaacactggacagtcagacttgggacattgccgcagacaatgtgagaaaattacgttttctcgcgaaattaaaagagcaagtcgagcatcttgaagaacgcttgtttgatggtttttaa

SEQ ID NO: 3500 - DNA, 231 bp, Proteus mirabilis
ataggcaggctcttaaaaaggcgtggactgatttttatttttcaagtggagggcggggcaatgagcaatgagaacccaaaccaacttaatcgctactacaaaaatcaccgaggtgttgttgttcgttatgacagagaaaaacagcgcgttatttttatgcttgatggttgtgacgacccacagtgtgaacctgtacagcgttttaaagagaagtacacaggtattaagtaa

SEQ ID NO: 3501 - DNA, 1872 bp, Proteus mirabilis
tggtttttaaggaaaattgttatgtcattattacaaattagcgagccaggacaaacacctgcgccacatcagcgtcgattagctgcgggtattgacttaggaacaacacactcacttgttgccactgtacgtagtgggcaagccgaagcgctttctgatagtgaaggtcgctatttattgccatctgttgtgcagtatcaagttgataatattaatgttggctggcaggcgaaacaagaagccgaaaaagatcccgccaataccatcagctcaataaaacgaatgctggggcgctcgctaaatgatataaccagtcgttatcctaacctcccttaccattttcatgacaataatagtggactgccattaattaaaacacctgctggcattgtcgatcctattcaagtttctgcggatattttaaaagccttagcagagcgtgcaatacaatcattaggtggtgaacttgatggtgtggttgtcactgtacctgcttattttgatgatgcacagcgtcaaggcactaaagaagcagcacgtcgtgcaggtttacatgtattacgtttattaaatgaacctactgctgccgcgattgcttatggattagattccggaaaagaaggcactattgtcgtttacgacttagggggcggaacttttgatatctctgtcttacgtttaactaaaggggtgtttgaagtcttagcaactggtggtgatactgcgttaggcggtgatgactttgatatgatgttagccgactggatcagagagcgtgcgggatttggctatcaaaatgatgttattttacaacgtcaattacttgatattgcctcagaaactaaaatcgctttaagtgataatgatgtggctgatatcaatatcaatggttggaaaggggaaattacccgcgctgaatttgaattattaattcaacctttagttaaacgtacgttgttatctgttcgtcgagcattaaaagatgctgatgttgacgtggatgaagtgctcgaagtggttatggtgggcggatcaactcgcgtgccgctggtgcgccaaatggtaggcgattattttaaacgtgaaccattaacttcgattgaccctgataaagttgttgctattggtgcctctattcaagcagatattctggtaggtaataaacctgatagcgaaatgctcttgttggatgttattccgctttcattaggtttagaaaccatgggcgggctggttgaaaaagtgatcccacgaaataccactatccctgttgcgagagcacaaaaatttaccacttttaaagatggtcaaactgccatgagtgttcatgtggtacagggtgaacgtgaaatggtgagtgattgtcgctcattagcccgttttactttgcggggtattccaccaatggcggcggggggagcacatatacgtgttaccttccaagtggatgctgatggtttattaagcgttagtgcgatggaaaaatccactggtgttgaagcctcagtacaggtaaaaccttcttatggtcttagtgatacagaaatcgctaatatgatccaatcttcaatggaaaatgccaaagaagatttacaagctcgtcgtcttgccgagcaaaaagtcgaagccgctcgcgtgttagaaagtttaaccgcagcattacaagaagatgctcatctcttaactgaagatgagaaaacggctatcgataatgttgtagatactttaatagaaagcgttgagggaacagatcctgttgccattgaaaacgccattaaacaactggataagcaaactcaggaatttgctgcgcgtcgtatggatacttccattcgtcaagcgttggcaggtcattctgtggatgagatataa

SEQ ID NO: 3502 - DNA, 456 bp, Proteus mirabilis
attaatttaaggaagataacgatgataaggatgtcatcaaaggttgttgctatctgcttggtgttattgacaataggctgccaatcaacagcaaataaaaaacatgttgcagtgcctcttcgtcttcaattaggggacgcttatctggctgagcaacaatatcagatagcccaatatcattttcaaaaagtgctgtcagtgatgcctgagcatcctgaagcaaatttaggaatggcattaacatcccagttattgggaaatcctattcaggcgctagattattacaaattagcgatgaagtcgaagccagtaaatgttaatgtattaaggttttatggtaatttcctttgtgaacaaaatttattaaacaacaataatgtgttaattgaggatataccgtcagattatttggtttgtcagcatgctgaataccaaaaatcaccaaattcgcgatga

SEQ ID NO: 3503 - DNA, 201 bp, Proteus mirabilis
cgaatgctaagaatgaaattagtcacttgcgtgatattagtgagcgtcatccagagcgggtgtacatcaaagccgagtgtcccaaagtcaaaaccactccctccaccagcttggcttatgcaaccaccgcccgacctactgacaccgctatccgaaattattggttactcagagagcgaattgcagagtcagagcaaatga

SEQ ID NO: 3504 - DNA, 270 bp, Proteus mirabilis
ataacaataagaggcgatatgaaaattaaagaaccagatgagcttatagcggatgcggataaatatgagtcaaaagtaatgtttaaatcaatgagaatagcttggttgatatttaccattgtactacttaatttaataccaatgcttattcatggaggagtattgtcattatctaactttttgattttcaatgtgtttattatttgtattatgttatggatatatatcagaaaaatattttatacatattccaagagaaattcacattaa

SEQ ID NO: 3505 - DNA, 3114 bp, Proteus mirabilis
cccaatcaaagcgtggagagtggaataatgggtgggagtggtggattaatttcaaaagtcgtgggtgctggcttaatgattgcggggctgtttaccggaggcgtgacctcggcgataggcatggcactgatggcagcaggcgttgcggttcaagtcgcgggttcgcttatctttaagcctaaactaccttccatgaattatcgagatactggtgaacgcaaacagatgttacgttcatcgtctgcgcctgaaaccgtgatcgtcggaaaaacagtgatatcgggtttgcttttctttgccgaagaagaggcgggtgaacaagatgaaaacgaaaaaatcacactggcattagcgttggcagggcaccccatagaaaaaatcgggaagatttggttaggggacgatttaattgagacgtttggtgaatataccgttcatgaagtcaaacacctttggttgaagagtttaaaaatcacggcacctgttgttgaagtggagttacataataacagagaagatgtcgatccctttatgctaaaaaattgcccgtcatggaaagaggatatgattggtcgaggtctggcgtggttacgtgtgacactcacgtttgaccaagaaaaattcccttatggattacccaatgtaaaatgtgaagtttggggaaaacatctgtttgatcctcgcactgggcaaaccgagtggagtaataatggggctttagtcattttggattattaccgccattatttaaaagtacctgatacggatattgattttgacagctttaaacaggcggccgatttatgtgatgaaaaagtgagtctaccagaaggtggatttgagtcgcgatatacccttaatggtgcctatgacttaaatgagagtccatcgagtgtcttggaagcgatgcacaaatgcatcaacgcggaaccgacattcaccgcaggaaaacacggtattcaaatcggtgcttattatgggccggcaataaaaactatcaccgaatcacaattgattggcactgtcacgtgtacccctgaaacaggtttaaaagacgcgaccaatgcggtgtatggcacgtttattgatgctgaacagttatacacaaaaacggatttcacgcctgtaattgtggatgaatgggtgaaagaggatggcttagaaattcgagagaatatcgactatcgttttgtcaccagcccttatcaagcccaacgattagctcgccaatatctccgtaaaaagaaagcaggaagacgggttcaactcacgatgaacttagacggctatgcttatcgtccgggggaagttgtgcttttagaattaccttctttggggattagtgggctggaatttcgtattgccgaatggtctttccatgctttagacggtgtggctttaacgttggaagaggatggtgcctatttatatgaagatgtgattgacaaaccgtttgagcgtccgccatttgtgagtttacccactggcggtgttgcttcaccgattaatcttacctttgttccacttgccgtcagtgacatcgtacaaggtacactttcttggcagaatgtggcgtctgatgtgcgttataatacggttaatatccttcaaaatggtaaagtgattcaatctattcaggtaccggccgagcgtgttgatattaacggattagcacgagggacttatcgtgttgaagttagagcgacgaatatggctggtgcgatgtcggcacccgctatcagtgattttgccatccaagcaccgcctgctcccattaaggttgatgttacttcgggaatgttcagcctcaccgtctcgccaaaacaaggtgatagtgctgtcttgggttatacctttgagttttggtttagtgaggaaaagctcgctaatctttctgaaaatgaagtgatcaccaaaacaaataaagttggtcaagggaatttctggacgcaagagaatttaaaagcaggacatacgtattatttttatgttcgaacaatcaacagctatggcaaatcgccgtttgtggaggcttctggtgtttgctcagctcaaaccgatttaattcttgaggaattgacggggcaaattagtcgagatcaactcgcacaagacttattgggtgagataaatagcaaagctgacctatcagccgttgttgagttaaacacgcaagtgaaagcgaaccatgatgcgattttagctgagcaagttgcacgaggagcggtaattaaccaagagcaacaagctcgcgctgaagctgataaagcggaggctcaacaacgccaattcttagctacacaacttcgtggtgattatactggcaatgatttatcgaaagtgaccgcaggacttatctccgctgagaagcaagcgcgagttacaggtgaccaagcggaagcgaaagccagacagtcattggaaacacggatgaataggaatgtttccgcgattaataaatcattaggaaccctcacctcgaaacagcaagcgcaaacacaagagatttcaacgctcaattcaaatttgaaagggaaagccgatagcagtgcggttaatgcgttaaatacgcgagtgtcgaatattgatggaaaaatgacggctaccgctcagcaagtcactcgtctagaaagccaagtgggtacaagttcagccaaaatagagcaaacctcgaaagtggtcactgatttaaatggcaaaatctccgcatcatggacaatgaaagtccagcaggatagcaaagggaataaagtcattaccggcattggcttaggatttaatgcgcaaggaaatagccaatttctggttaatgcccaaaactttgcggtgatatcgtcattaaacggcaaagtggtgacaccgtttgtcgtgaagaatggacaggtggttattcatgaagccttaatggataaagcgtggatacagaaactagtggtactcaattattttaaatcatcgggatttgataaagggaatggctttttattggatgcaaaaaacaatattttccgctttacgggtggtaatggggcattaaatatcaccaataatcaattggtcgtcaaagatgagaaaaaacgccttgtgatgaaaatcggttatctagggaattga

SEQ ID NO: 3506 - DNA, 201 bp, Proteus mirabilis
cgtacactgagtcacgatatccttaaatgggtgaaagatatgaaagcttttaatgtaataagaatgtttcaagacgcactagtagaagttacctgcccaagttgttcttatgtcgcaaagcaaaacaaacacaagcttaaaaagaacctaattttattgtgccctaattgtggctacatgttttatttcaataaaatataa

SEQ ID NO: 3507 - DNA, 915 bp, Proteus mirabilis
gttattatgagtttacctgatattcatcgtgtgcaatcattttttttgtcgttgcaagatagtatttgccatgctattgaaaatatagaccaaaaagcaacctttcagcaagataattggcaaagagaagctggcggtggtggtcgtactcgagtgctcacccaaggtgctatttttgaacaagcgggtgttaatttttcccatgtttatggagatgccttacctgcatcagccacggctcatcgccctgaattaagcggtcgtcgttttcaagcaatgggcgtttcattagttattcaccctcttaatccctatattcctacttcacatgcaaatgttcgtttttttattgctgaaaaagagggagaagatcctgtatggtggtttggtggaggctttgacttaacgccttattatggatttgaagaagatgttatccattggcataaagttgctaaatctgtgtgtgatccctttagccaagattattatgctcgatataaaaaatggtgtgatgactatttttatttaaaacatcgtaacgagccgcgtggcgtcggtggtctattttttgatgacttaaacactcctgatttcgatcactgttttgaatttgtacaacatgtcgggcaaggctacctggatgcctacttgccgattgtcgaaaaacgcaaatctataccctggggagagcgtgaacgccaattccaactttatcgccgtggccgttatgtcgagtttaatttggtttgggatagaggcacgctatttggtttacaaagtggcggacgtactgaatccattttaatgtcaatgccaccattagtgcgctttgcatatgattatcgccctgaacctaatactcccgaagctaagctgtatactgattttttaattcacaaagagtgggtatag

SEQ ID NO: 3508 - DNA, 513 bp, Proteus mirabilis
aacgtggagagaaatagcatgatgcaaaaaataatggaagtttcagtattacccataatgaatcgtgaattaactatgtcgagtcgagagattgccagtttaacgggaagtaatcattccgatgttaagcgttctgccgataggctttttgttgctcaaattttaacccagccattggctgagttcccttttgaacataacggcaatcaatatactgaatatcgttttaataaaagagactctctggtgttggtagctcgattgtcacctcagttcacagcaaaaatagttgatcgctggcaggaattagaatcaaaaatgcagccagtcattcctcaaacattaccagaagcattgcgattagcagcagacttagcagaagaaaaacaaaaattggaaagtgaactggcgattgcgacacctaaggctcagtttgttgataattatgttttatcccatggttctatgacatttcgacaagtgtgtaaattactgcaggcgaaaggaaactga

SEQ ID NO: 3509 - DNA, 636 bp, Proteus mirabilis
gttaaggagagacttgtggaagtttatagcaccgaaaacgaacaagttgatgcaattaaacagtttttaaaaaattatggtttaacgatcattctcgctattgtcattggcgtgggtggaatttggggttggaaatattggcaatcacatcaagccaaccgtctacaagagagtgcgggtgaatttgcaacaataaatgaagcattaacgaaaccaacgcctgaaaatatcgcattagccgaaaaatttgtttctgaaactaacgatatttatggtgctttagcctctttagagttagctcaattagcaattgatgccaacgatttagccaaaggtgaaactcacctgactaaagcaatatctatggtaaagaatgaagcatttgcagatatgcttaaccttcgcttagctcgtgtgcaactggcattagataaaactgatgctgcgttaatttcattagagcaagtgaaaagtaaagcatgggatggaatgaaaaattatatccgtggtgatgtattagcgaaaaaaggcgataacgcaggtgcagccgccgcttatcgtaatgcattgaatgatgaaaatgcaggcgctattcgctcattggttgaacttaaactcaataatttatccaattaa

SEQ ID NO: 3510 - DNA, 600 bp, Proteus mirabilis
cttcgggagagtccatctctaatgagcgagcagttaacggaccaaatgttggtcgagaaggtacaactgggtgaccagaaagcgtttaacttgctagttatccgctatcagcacaaggtagcaagtctgatttcccgttatgtacctcagggtgatgtgccagatgttgcacaagaagcctttataaaagcctatcgagctattggatcattccgtggtgatagcgcattttatacatggctttatcgcatcgctgtgaatacagctaaaaattatctggtagcacaagggcggcgtccgccttcaaatgacttagatgcgagtgatgttgaaaattttgaaacatcaaacgcattaaaagaaatttcgaaccctgagaatttaatgttgtctgaagagttacggagagtagtttttcaaaccatagagtcgttacccgaagatttaagggttgctattacacttcgggaacttgacggcttaagctatgaagagatagccgttattatggattgccctgtaggtacagttcgttcacgtatttttagggcgcgagaagctattgataataaggttcaaccattaatacaagagttataa

SEQ ID NO: 3511 - DNA, 309 bp, Proteus mirabilis
aaaaaacttggagaacggcgacaattccaactgatattgtcgctggcactgggaaaaacgctcgcagaaatcgaacaaatgcctgaaagccacttgtgtgaatatgaggccttttatcgcaaacaaccctttggtttgtggcgagaggattatcggatggcacaagtggcacatcttttagcgatgataaatcgtgatccgaaatctaccccacctcaattaactgactttatgccaatgtggcagaaaaagcccacagaagctgaagagtgggatagtgttactcagaatgtattggctcatcgatag

SEQ ID NO: 3512 - DNA, 573 bp, Proteus mirabilis
ataattgttggaagaaacaaaatgagtagaaaacttttagttccccttattatgacgagtctatcgctatgcgcagcaaatgcacaagccgtaggtgaaaatacgctttcattaggttatgcacaaagtcatgctaaagtggatggcgataaactaaaagagaaacccaaaggatttaatgttaagtatcgttatgaattcgataatcagtggggaatgattggctcctttgtttatacgcatcaagggtatgattatcactggaactctcgaaagattgggagtattgatttagattattactcgttggctgcgggacctgtttatcgttttaacgattatataagtgcttatggattagttggggtagctcatggacaaatggaagtggcattgaataatttttcctataatgggaaagaaaatcaacaaagtaaatccgcattcgcttatggtgcgggtattcaatttaacccatatcccaatatcgcgattgatgcttcttacgaatacactaaattagatgcttttaaagtgggcacatggatgcttggtcttggctatcgtttttag

SEQ ID NO: 3513 - DNA, 1005 bp, Proteus mirabilis
tttatgtatggtcttgaaatttttcctgctgaaggcggtaaaccttaccgtttaacgcatgatacgcaaattctctgttatttaacctcttatcagatagggccagaagattggccccattatcgacaaccgaaaaaaacacggagcaaagtcattcatgaagccatggggtatgaggcgttcgccatcccgagagtggcttctgtgtatatggcggtgaatgattatgcgtattttcagggaataacgcatatccgaatggaaggacctgtattacgttatgagtatgtttatgacaatgttcaggttcaagacccacagatggccaaaagagccaatatggtggtcgatatttatggtatcccgttaccggatagtacaaaaccaacgtatggtgtggagtggtatggagcctttcagggatttcgaagtgcgattacacgtaatacacaaatgacttattgtgtgtttcgacaaaaaatccaccttgaaggcgggcgctattggcctttgccgacaacattaccgcatttagataagtgtgttgtgttttatcatgccaccaaccctcaagcggaagtgagctatttagcgcataaaaagcaattatacagttcagcccaaacagacatttatgtgtgtgttttcgtttcaggaatggttttgaccccgaagagacgttgggggttatcactgtacagtgaagatggaacactggtctttaatacggactatttgccttttacccgaggacaatcaatggaattgttattacgggaggggagtgtagagactccatatagcttgcctttagtctgtgcaacaagtcagtttgtgaatgcgtcttatcaggatgaccatattgattgggccaagcgcaatacggggatacgttttcggggaaaacagatttttgtgagtgaacggatacgtgatgctcatcggcaacatcatgtagagcaacgtattcccttttatgtcctcaatggctcactttatttttaa

SEQ ID NO: 3514 - DNA, 426 bp, Proteus mirabilis
cgtgtatacggcacggggagtattagtatgagagatatgcaggaagttttatcacgttggggtgcgtggtcagctaatgagggaaatagtatcgattactcatcaattgccgcaggttttaaaggattaattccaagttcaagacgaagccgagagcaatgttctgatgatgatggcttaaaaataaataaagcggtattacatttaaaggtaaataatagttacttgtttcagttggttattatgtactatgtgaagaattatcctttacgctcaatggcttcaaaacttggcatttctcataatgaagtggctaagcgattgcagacagcagaaggatttattgaggggtgtctatcggttgataacgtaaaattagatatggataaaataattagaaaacacagcatttatagtcttgtgtaa

SEQ ID NO: 3515 - DNA, 624 bp, Proteus mirabilis
ccttatttaggtaaggataaagtgatgctaacagggcgaaaaaagaaatttgcacaagccctgaaaaaagggatgacgcaacgagaagccgcgattgaagcgggatacagcgagaaaactgctcaggtaaaagggagtcagttagccaaagatccggatgtaacagcttatctaaggcgcagtattaatggtaatactaaagttaatactcatttaaatcaaaaagttaactctaaggttaattttgacgttaacactgaagttaattatcatttaaatcatgaggttagcaataaagttaaccctacaattaatcgaaaaattaactctagagttaactctaatgttaattctgacattaacgctgttatcacggataaagagaggtcgtcacaggtacacgactatcctgatcctctggccgtgattgccgaaatcatgatgaaaaataaagacatcgaccctaaattatcgcttgatgccgccgcaaaattggcaccttatctgtgcagtaagaaaggggactgtggcaaaaaagacgaaaagaagaaagcagcgaaaaaagccggtaatcgtttttcaccaatgcctcccccaaaattaatcatcaacaacaagggttaa

SEQ ID NO: 3516 - DNA, 2322 bp, Proteus mirabilis
atgaaactaggatataagcggttaatcgccgcgagcgttatttttctattagtaacaccattattgctatggatagcagataagatctggccactgccagatcccgagcctcaaatcgccaccatagtaacggctgaagatggaacaccactttggcgttttgctgataaagaaggaatatggcgttatcacgttaccctttctgatgtttcccctgaatatttgcaggccttgatagcttatgaagatcgctggttttatcagcaccccggtgttaaccctatagctattttacgtgccgcatggcaagacttaagctcgggaaaaattgtttctggaggcagtacgctttcaatgcaagttgcacgtttgattgacccccactcacggactttagggggaaaattaaaacaattatggcggacattacagctcgaatggtattactcaaaagatgagattttagaaatttatcttaaccgtgcaccttttggtggcactttagaagggattggcgctgcaagttgggcctatttaggtaaatctcccgctgatttatcagcaggtgaagcaacattaatggcggtattacctcaagcccccagtcgtttaaggccagaccggtatccagagcgtgctcaagctgcacgggataaagtattagatagattagcggaatatcaaatttggcccaaagagaaagtggctgaaataaagcaagagcaagtgctacttgcaccaagacaaacgccacaactcgcgccattattggctcggcgtatgtataacgagcaaaaagcgccggtgatcacaaccacgattgatattaatcttcaacgacaactagaagagctagccaaacagtggaaatatcagctagccgataaaacttctctggcaatacttgtggtcgatcacacggatatgagtgttaaaggctatgttggatcggcagactttaatgataatcaacgctttgggcatgttgatatgataagtgcatggcgttcaccgggatcaactttaaagccttttatttatggtcttgctttggatgaaggattgatccatgcagaatcactattacaagatgttccacgccgttttgaagattaccgtcctggtaattttgatactggatttaacggtgccgtgagtgccagtgaagcccttagtcgttcattaaatttacctgccgttcaattaatagaagcttatggcgcaaaaaaatttgcagctaagttgcgacataatcaccttgaaatgcgttttccttatggctctgaacctaatttagcgcttattttaggaggaacagcaacacgaatggatcaattagtggcgacttttagtgcgcttgcaaggcatggaaaaacagcgccgttacgttttacgccagagcaaaccatcaatgaacgtatgttaatgtcacccggtgctgcgtggatcattcggcgaattttagcgggagaggcacggcctcgtcctgatagtgctatttcagcggttgttcctttggcttggaaaacaggaacaagttatggttatcgtgatgcatggtcgataggcgttaatgcgcgttataccattggtgtttgggtggggagacctgatggcacacctgttgcggggcagtttggatttgcaactgctgtaccgataatgaatcaagttaataatttattgacgagttatttttatcaaaataaacagcggcctcctgttgatcctaggccaaatagtgtctcagccgcagctatttgttggccaacgggaaaagctttgcctaaagaagatagcaactgccgagtcagccgacgaagctggatccttgataatactattcccccaacactattgaatgaaagccaagagggcattttaggcatcaatgaaaaagtatggatagataaagaaggaaaacgtacagggcctaattgtcctggtgctcaattaaaggatattgctttatggccgatagcattagatgcttggttgcctgaaaaagagcgtagagcaaaacgattaccaccaatttcattaacatgtccaccgattaaagaagatatgatccccttgtatatctctgggataagaaaaggggatttattgcgtccattgcctggtgaaactcagcttgaaataacggtttctacacaagggggaagtggtatgcaatggtggtttttaaatggtgaacaaatcggtaaaactgaaaatggggcaacgttctcttatttattagaaaaacgtggcaaataccaactttcggtgcttgatcttagcggtcaaacggatatggtgaattttagttttcgttaa

SEQ ID NO: 3517 - DNA, 807 bp, Proteus mirabilis
gagagaataggaagtatgacaaatttgacagaatcgaccaaaaatttaaatggatttcactattttgcacttgggtggcgattaattactcgcccgggtctaaaacgttttgttattttacccttacttgccaatattattattctcggtagtgccttttggtggttatatggccagattggtgaaatggtcaattggatgatggaaaaagtccctgattggctacagtggttaagctatgttatctggccactgtcagttatttttattttgctggtctttacctatttctttagcaccatagccaatattatcgcttcgccttttaatggattattagcggaaaaattagaaggccaaataacgggtattaatcctccggataccggcttattaggtattacaaaagatattccacgtattttaaaacgagaaatcatcaaggtcgtttattatttgccaagagccattgtattgttattgctctattttgttcccgttgttggacaaactatcgccccaattctttggtttatatttggtgcttggatgatggcaatccaatataacgactttccattcgataaccataaagtctctttcgccaatatgaaatcaacgctgaaaaaagacaaatggaacaatttacaatttggtatggtaattaatatcttcactatgatcccaatcttaaacctagtcattatgccggttgcaatttgtggtgccactgccatgtggtgtgatcgatatcgtcatcaacatgtacaagcaggcccaatgttattaccactggtttcattgtga

SEQ ID NO: 3518 - DNA, 456 bp, Proteus mirabilis
aagataacaggcaaaacaatggaaatacgtgtattccgtcaagatgattttgaggcaatcattacactttgggaacgttgcgacttgatctcaccagaaaatgatcctgaaattgatattgaacgaaagattaaccactcccccgatctctttttaatcgcagaggttgctggcgaaatagtcggtagtgtaatgggaggctatgatggtcatcgtggctcgctttactatttgggcgttcatcctgagtttcgcggtagaggaattgccaatgcactaatctctcggctagagaaaaaactcattgcaaaagggtgtccacaaattactttaatgatccccgaagagaacgatgccactatttgtatgtttgaaaagcttctctatgaagatcaaaatcaagagaatacggcttacactaaacgcctaattatcgatcaggacttcgatctttaa

SEQ ID NO: 3519 - DNA, 411 bp, Proteus mirabilis
acccaccaaggacaagccaggagaattacattccaaaggctggacgctgatagtgaaacgtggacgagacgggagagacacgaaatgatgaacatcgttacattgcaggaggtgaaatctcacttacgtattgatcatgattttgatgatgcggatttgcaattaaaaattaacgcggcgacagcagctgtctttgatcatgtgaaaagttgggtagaacgatttcaaggagacgaaacgaaacttaagcaatctcccgatttttatcgagtaaaggatgccattttaatcttaattggtataagagatagggatagagaaggtgtcgatattgcgctttatccccaaggaatgctgccttatcccgtcacctgtttgttggggtccatgcacaaaccgactattttgtga

SEQ ID NO: 3520 - DNA, 279 bp, Proteus mirabilis
gttataaaaggaaaaaatcctatgtaccagcaagaagttactattacagcaccaaacggcttacatactcgtcctgcagcacagttagtaaaagaggctaaaactttctcttctgatattagtcttatttctggtggtaaatcagccagcgcgaagagcttattcaaattacaaactttaggattaacccaaggtactgtagtcactatttctgctgaaggcgaagatgaaaaacaagcagtagaacatttagttaagttaatggctgagttagagtaa

SEQ ID NO: 3521 - DNA, 1287 bp, Proteus mirabilis
atagaagaaggtattactatgaaaagtaaatcagtgatcccagctagtttttctttacaagaaagagaccgacgctggcagttagctagagacattatgagagataaccaattagatacattgattatttatggtgatagagaatcggcagcacctgcaccgttttgtattgaccactattttacaaatgacagattaggatcggttgttatttttcatgaagataagaaaccattgatagttacttttgcaccaatgatgatagctgatcatatgcaggcaaaactacgtggtgatttgcagtggattgatgaagataatcttgttgtaggaaaaacagggcgtagtattgctcattttctaaaagagatgggagtacaacaaaatgcacatattggtattattggcttagaaccttatcccccattttattttgatggtgcaatgccatttaatactctaaatggtattaaggaagcatttccttatgcaaaatttagcagtgtgtatcgtgatttctttagacgggcatcagttaaaagtgaagaagagctcgctcatgtaagatatgctgccgccattggtgaagcaatgagcgaggcaatgcgagtgactgcaaggcctggtgcaacagaggcggagcttgcggccgcaattactgccacttgtttatcaagggggggatttaccgctgaaattttaatgggatcaggatctgagtatatcggttgggggcctcctgtttggcaatatcgctcacaagcacctcgtgaaattcaaatgggtgatattatattatcagagatttttgctttatatggaatgtatgaaacgcaacatcaagcggtggttgctgtaggtaaaattcacgaaaacttagaaaaagcagcattagttgcacgtgaatgctatgaaattggcgttgaacatttaaaagcagggataacctttggtgaagtagttgatttaatggaaaaaccactattagaatcagggggatggcatgttcatccacttattcacagtattaatccttatggtccaatcggctttggcacagcgccaggtattgaatcattacctcttgctcatcgttataaacaaattgagcgattacctaatccagggagagaattggtattacaagaaggtatgacatttgcttttgagcctaattgtggcttcggccaccacttatgtaatttaggtggcactgttgtggttggcaaaagcaaagggattgagttaaattctaactcaacacaattaatgcgggcagatatatag

SEQ ID NO: 3522 - DNA, 207 bp, Proteus mirabilis
agacgaagaggcactgcaacatgttttttatttgctgttgattggcagcctattgtcaataacaccaagcagatagcaacaacctttgatgacatccttatcatcgttatcttccttaaattaattcattcttgcaactctctactttgttttaaaaccacagcacaaagcgagagttatccacctctatcagactgcttttactga

SEQ ID NO: 3523 - DNA, 183 bp, Proteus mirabilis
tcgtcgagaggcggagtcagtactatgtcatggaaacctttaatcatcattatcagctttattcttgcattactcattacagtcgctggtggcatttatctcttgattgataactcatgtaccaaagaccaagtgagtttagaaaagcgctgtcagattgcactctcatatcatcggtactaa

SEQ ID NO: 3524 - DNA, 3261 bp, Proteus mirabilis
ggagtttttatggctggcgcattggggagactaaatatcgatttgacgctgaatacggcaaatttcataaatgcgatcaaccgtagccagcgccaaacagaacaatttgggcaaagtattcgcgtcagtcttcaagctatcaccgtacaacaagagcgaatggtatcgcaaaccgcaaaatcttcggcgctttttgcccgttttgcgagtgtcaccgcaagtgcattatccattcatcaagttattaattatgctgatagttggacggaattacagaaccgcttaaaactggtgacggaaagttctgtcgagttaaataaagccacacaagcggtctatgatattgcccaaaaaacctatcaatcattggatgccacagcacaggtttatcaacgttttgcggataatgccgatcgcctaggattaagtcagcaaaaagtggcagaactcacggaaaccgtctcaaaagccgtggcgatttcaggcgcgagtgccaccgcagcccaagcggcattaactcaatttggtcaagcattagcctcgggtcagttacgtggcgaagagctaaattcagtgatggagcaaacgcctgcgttagcgaaagccatcgctgacggaatgggtgtcagtgtgggtgaactaaggaagaaagcccaagacggtgaaatgacgatagagaaagtcattcaagccttagaacgtgcagccgacagtgtggataaaaaatttgctaccagcgtgacaacggttagccaaggtttcactaatcttcaatcggcgataacaaaatttatcggtgaagcgaatcaaagtacaggtgcgactcagcttttaacaacggggctttctgcattatcgaatcatttttctgaagtgatgagagtaacggaagctttagccatgacggctattgcaataaaaatagccaaatggactcaagccacttatgcacaagccgctgcaacgaaattaaaagttcaacaagatttaatcgccgctaaagccacaaaagccaagatgacggctgaattagagctagcccgtgttgaaatgcgttctttacaagcgcaacttcaactcgctcagacagaagcacaacgcagtagtattcgaatgcgaatgaaagcgcagtcttccattattgtgtcagccacaaatgcagaaacattagcgatacaacggttgaatgcggcacaaagagccagttctacattagggagaagttttggaggggcacttgcatttctaggtgggcctcttgggattgcgacaggattattgaccgcgggggcaatggcttactatgagtggcaacaacaagcagaacaatcaagacaaaaagctcttgagtatgcagagtcattagacgttgcaacggagtcattaaataaattaagtgatgctgagcgtcaagcttcaatcggaaaactggctgaaggtttagatgcacaaattgagaaaatagaagagctaaagagaaagcaagaggatttaaaaaaatcatcggatttgggtggggcaaataaaggtatctctttttattatacaggagattacgagtcattttcagcggaagtagttaaagctagaaaagatgaactccaagtaactgctgatcttgaaacaaagaatagagaattagaagttacacgtaaaaaaatggcattattgcttgatgcggaagttcaaaaaaatgggatggtctctaatgcctatgcgctttatgccagccgtatttacgatgcttccgtaaaatctgatgaattgattggtaaactccatctacaaggttctgcttttgataatttagcacaatccattcgttcagctacccaagagcaacagcagttttcggcacaatcgttaattgtgatttctgatgatgcgcaaaaatcaatcgatgcttctcttcgtactattgaaaaatctaaagcaacgggcaaagctttagccaaactcaacgccgaagatgtattggcgagtagaaaaatcacaccggacatgatggggtatgacaaagcgttacaagctgaaattgaagcccaacttgctttacagtctaaaaaaattaagccacccaaaacaccaaaatccaccattgattatgccaaacagtacaccaaaatcttgacggaattagaggaaaaacaagcctcactgattgcgtatggacaaagcattcagctgtatggcactacctcttcctttaatgaatacacatccgcattagccgatatcaaacagaataaagacaagtttgatgccatcttaaaaatcgatcccaaagcgattgagatgataaaagaaaaagcgaaagccattgatgatctagcgcgtgccaattcggtcgcgcaatttgcttatgatcgcggtaaagaaattgagcagatgcaatttgaaactaccttgataggaaaatcacgcgcagagcaagaaaaactcaatgcccttcgtcagattgatgtgctgtatcagcaagccagtgtggatttaggcgagaaagagctggtgaacttgcaacgtaatgtcgagctcactaaacagcagattgaggaagagctgaggaaacgagaggccatgaaaggtgatccgatggcgggattaaaacaaggcttatcggatttcagtgagtcggccatggatgtgatggagaacgtcagaaacgtcactactaatgcgcttaataatatgtctgatgcattagccgattttgctttaacgggcaaaggaagctttaaagattttgccaatgcggtgatttccgatatcactcgaatggtgatgaaaatgctgattttcaaagccattgaagcaggcgggcaggcaatgggctttgatatgggatggatgagcaaagggcatgcttacggtggttatacggggcatggaggaaaattcgaacctaaagggattgtgcatggtggtgagtttgtttttaccaaagaagcgacggctaaattgggtgtcggcaatctctatcgcttaatgcatgcggcgcaaggttatgcttcggggggctttgtgggggcggtcgcagggcgaatacccgttacaccacaaccgacgttagcccgtgcgggtggtgtacaaatgacggtcgttaatcatattacggtgacaggaaatggtgacgctgtacttgcgcaagcaatgaaagaagccgcacaacaagggacagaagccggtgcacagaaagctcacgcaatgatgttacaagactttcaaagtaatggcgcagcacgcagaacattaggagtctaa

SEQ ID NO: 3525 - DNA, 828 bp, Proteus mirabilis
ggagtttttatgaaaaatttgaagttgctactgttagcatttgttaccgcgtcaatactatctgcttgtagtaatcatgccaatgttgaaaatcatgaacaattaacattacaaaaccaagcagtattaggtcttgtttggacacagcaatctggtgaatatcaagctttgacacaccaagcttttaatatagccaaaacagcttttgagcatgcaattgtagcaaaagataagaaaaaagctgtcgtggtggatttagatgaaacgatgattgataacagtgcttatgctggttggcaaattgagaatggtcagggttttagccaagaatcgtggacaaaatgggtaaatgcacgccaagtctatgctattcctggtgccgtggattttgcgaactatgtcaatacactcaatggtaccatattttatgtatcaaatcgtttagataaaagtgaacgtcaagcaacaattgatgatatgaaacgtttaggtttcccgaatgtttcagataaaactttattattaaaaacagataaatcagcgaagtctgaacgttttaatagtattttgaaccaaggctatgacattgtgctttatgtaggagataacctaaatgattttggagatacaacttatcataaatcaaactcagaacgtcgagattttgttacattaaatgcgaaaaaatttggtacaaaatatatagttttaccaaatcctaattacggtgattgggagggagggttagataaaaattactataaaggtgatttaaaaaataaattaaatatccgtaataatgctattcgtgcttgggatggtaaataa

SEQ ID NO: 3526 - DNA, 678 bp, Proteus mirabilis
acagttattatcatcaacttaaatatttattattctatgggtaatatcgtgcttagctatttattaaagcgttttgctttatttttgttttccgccatgattgtggcaataacaacagggtttattttcctcgatattttggtgctgaataatggtatttctgaaacctcagcaaccgaactggggcaagaacttattgtggctataatatgttttcttttctttatacctgcttataaacagccagaaatgagagggggatacacactgattatgggctttttcttgtgtatcttaattcgtgagttagatggtgtttttgaccaattagcacatggttcatgggtttggtttgcattaacggtaacatttgtctgtatagcgatcgctatcagagaagggaaaaaaacattatatggcttaacccattttataacgcattctagtcaaggaatgcttatggcgggtttactcagtgttttactattctctcgcttatttggtatggggattttgtgggagaaattgttaggtgaagactataaccgcacggtaaaaaatatggtggaagaaggtagcgagttgttcggctatacactctgtttaattagtgttatttggtatcgctattcgtctaaatatcatgttataccgacatcaataaaagttacttattaa

SEQ ID NO: 3527 - DNA, 759 bp, Proteus mirabilis
tacaacgttatttttcaggagaagagcatgtctgatattctacttggcgttaatattgaccatattgcaaccctacgtaatgcccgtggtacaacttatcccgatccggttcaagcggcatttattgcggaacaagcgggtgctgatgggatcactattcatttacgtgaagacagacgtcatattaccgatcgtgatttaatgctgatcagccaaacggttcaaacaagattaaatttagaaatggcggtaacagaagagatgattgagattgcttgccaaactcaacctgacttttgttgtttagtgcctgaaaaacgccaagaagtgaccacagaaggtggtttagacgtggtgggtaatgaagagaaagtggctgatgcgattaaacgtttgtcattagcggggattaaagtctctttatttattgatcctgaccatgagcaaattaatgcagcagatcgtgtcggcgcaccttttattgaaattcataccggtgcttatgctgacgccgaagatgaacaggctcaagagaaggagtttgttcgcattcgtgatgcggtaacctatgcagcgtctaaaggtttaaaggtcaatgcaggtcatggtttgcattatcataatgtacaacgtattgctgcattacctgaactttatgaactcaatattggtcatgcgattattggtcgagcagtatttagtggacttgcaccagccgttgaagaaatgaaacgcctaatgagagaagcgcgtcgctaa

SEQ ID NO: 3528 - DNA, 1362 bp, Proteus mirabilis
aagcgagttatttgtggagaccgtgaacgaagcatcggtgcaggacgaaaaacactattttgcggagtgtatcaagtgaatcaacgtgaaaaacaatttaccgataacttgattgaggctgtgaataatgcgttagcgaagcgtgatgcgcgtattgatagcttaatggaacagctggcactttatcagcaactgctccagaaacaagagaatgatattgctgccttactcttgttgttagaagagcaagccagtgtctcactgaatcgccttgaacaacggtttgatgctgaaaaaaatagctttgaacaatccttacatgcttttcttattcagcaagtaaaggctattcctatgcctaaagatggtagagatggtcacagtgtgacattagaagagattaaaccgctggttgattcgacggttaatttggctatctccgcgcttcccaaacccttagatggtaaagatggaaaagatggtcatagtgtgacattggaagaggtaaaaccgctggtcgatttggcggttaacttggctatttccgggcttcctaaacccttagatggtaaagacggaaaagatggccacagtgtgacattagaagagattaaaccgctggttgattcgacggttaatttggctatctccgcgcttcccaaacccttagatggtaaagatggaaaagatggtcatagtgtgacattggaagagataaaaccattggtcgattcggcggttaatttagctatttccgcactccccaaacccttagacggtaaggatggcagagacggtaaagacggctcgagtgtcaccgtagaagaggttaaagcacttgtcatgtctgaagtgagtgctacggtaaaagcacttcctgtgccgaaagacgggaaagacggtcgagatggcaaggatggtcgagatggtaaagatgcctttaatattgacatccttcccgatattgatgaaaccaaaagttatgcgcgtggcactctagcgacgcatcatgggggattatggcgcgcctacgagcaaacaaaagggatgcatggttgggagtgcattgtcagagggtgcagtagcctagcttggtcacttcaagatgaaaggaccttattagttaattcaatactaagcaatggggagatggtacaaaccaaatatgttttcccaacaatgatatatcaaggtgtttttgccataaacagagcgttgccttatcaaaaaggggatgtagtcacttggggaggctcattgtggcactgtaatgaacccaccaaggacaagccaggagaattacattccaaaggctggacgctgatagtgaaacgtggacgagacgggagagacacgaaatga

SEQ ID NO: 3529 - DNA, 216 bp, Proteus mirabilis
cgtagtcctataagattgctattaactgaattaaaatattatgctaatgaggttaaagttattgagttactattatacgaagaaccactaatattattggatagctgtaataaagatgccgcagctttctcttctttaacatcaaaactaccagcagctgaaattattttgctaatctcatttattaatggggtaagattttctttattcgcataa

SEQ ID NO: 3530 - DNA, 402 bp, Proteus mirabilis
ctgattactattcgtattaatgagttttttactttgaaaaaaataactatgggttttgctatttttttactttctggctgtgctacgccagaaaaatggcaagtaaatatgaaaaatcccacacctttagatatcgctaaaaatctatgtatgcaagaagcaaaacaacgctaccctgagcattatttgagttcaacgccaaattatagctatccttcttcttcaacgataacagtagatggtaaagaagttactattcctaattcaaattatcattcctattctcgttatgatgccaatgaagcagagcgtaaacagtattttgatatttgtatgagaggagaggggtgggaaaataaaaataaagtgactggattactcgcctttttatttaatgactaa

SEQ ID NO: 3531 - DNA, 345 bp, Proteus mirabilis
gatataactatgcctaaaattgtatttttaccccatagcactctttgcccggaaggtgctgttgttgatgccactgaaggtgagtctattcttgatgttgcattacgtaatggcattgagattgaacatgcgtgtgaaatgtcgtgtgcgtgtaccacttgtcactgtatcgttcgtgaaggttttgattctcttgatgaaagtacagagctggaagacgatatgttagataaagcgtggggattagagccagaaagtcgtttaagttgccaagcgaaggtaactgatgaagatttagtcgttgaaatacctaaatattctatcaaccatgcgagagaacactga

SEQ ID NO: 3532 - DNA, 279 bp, Proteus mirabilis
ggggtgactatgcgtatggaaaaattaaccaatgtaacttatggaaccgcaggcttaacggccttttttgccagtctttcgttatatgaatggggatttgttatcgggatggcgttcagcatggttctcggtttagccacttactttatgactcgtcgagaacaacgaaaacgcactcaattatttgaagagattgttcgacatgttgacccacaaaacccaactgaaaccctaaaaaggtttgctgaattaatggtgaaagcgccaaaggatatttaa

SEQ ID NO: 3533 - DNA, 1233 bp, Proteus mirabilis
gtcctggctattattttaacaattttgggtaaaggtgaaaatggtgccccgccaaatggaaaattagcattaagtggacgaagtaaagaaataaaacctattgaaaactcaatagttcaagaaattatggtaaaagaaggtgagttagttaaaaaaggccatgtattattaaaacttaccgcattaggagctgaggctgatacattaaaatcacaatcatcattactacaagcgaaactggaacagtttcgttatcaaatactggttaaatcaattgaatcaaataagttaccagagataaaattacctaatgatccagaccttcaaaatatttctgaagatgaaatgttacgtttaacatctttaattgaagagcaattttcaacttggcagaatcaaaaatatcaaaaagaattaagtttagataagaaaaaagcagaaagattaacaatacttacacgcataaatcgttatgaaaaattatcacaaattgaaaagagtcgtttagatgattttaagaaattattacaaaagcaagctatttcaaaacatgctgtacttgagcaagagaacaaatatcttgaagctacaaatgaactacgtgtttacaaaactcaattagagcaaattgaaagtgaaattttattagcaaaagaagaatatcaactagtcactcagttatttaaaaatgaaattttagataaaatacgacaaacaacagatagtgttaagttattaacactagaattagagaaaaatgaagagcgccaacaagcctcagttattagagctcctgtttcagggaaggttcagcaattgaaagttcatacccaaggtggcgtcgttacaacagctgaaacgttaatggtaatagtgccagaaaatgacacactggaagttacagcattagtgcaaaataaagatattggttttattaatgttgggcaaaacgtcattattaaagtagaagcatttccttatactcgatatggttatttagttggtaaagtaaaaaatattaatttagacgcaatagaaaaccaacaattaggacttgtttttaatgtcattgtttctattgaagagaataatctatcaattggaaataaaaatattccattaagctcaggtatggctgtaactgctgaaattaagacagggatgcgaagcgtaataagttatcttcttagtcccttagaagaatcagtaacggaaagcttacatgagcgttaa

SEQ ID NO: 3534 - DNA, 429 bp, Proteus mirabilis
tacatggctattcagcgcactttttctattatcaaaccaaacgcagtgaaaaaaaatgttattggtgcaatctataaccgctttgaaagtgcgggtttcagcatcgtagcagccaaaatgttgcatttaactcgtgaacaagcagaaggtttttatgaagagcataaaggccgtcctttctttgatggtttagttgagtttatgacttctggccctatcatggtacaagtattagaaggcgaaaatgctatccaacgtcatcgtgacttaatgggtgcaactaatcctgataacgctttagcgggtactttacgtgctgattacgcggatagctttacagaaaatgcagtgcatggttcagattcagaagcttcagctgcgcgtgaaattgcttatttctttactgaaaacgaaatttgcccacgctaa

SEQ ID NO: 3535 - DNA, 1014 bp, Proteus mirabilis
ataatgcatatcaggtcacaaaaacaggtgtcttttcatcagtataaaaaattaaagcgaaagacactggctaatgagcaattatctatggcccctgcatcaattaagaggatcgcttcacactggaaacagtatctgtgttggataatgttgcctatgtttcttgctggatgtgcacaaaaatcgctgaccgaaactgctaatattgagcctgaaccccccgttgttaaacaaaaaactatcgattatcgttgggcagaatgtaaaactttagctgctttttatcatgaagggctcaataatccgctattttggttacgtaccattgagtgcacacagcgtattatgtctacagaagcacaacgtcaagccagtagtgttatcgttgccggatgggacggtgccttttataaaagtattttattagagcgagcgggaatgacggttgctgaacgtcgtgctcagctggttttattagaaagctatcaattgcaatttccaagctctatgcgtgttctattatctacttggattgagaatcaaacgcttacgcttgctctcgctgatgagaaaaatcgtaatcgccgttttgttacagaaacggaaaataaaatggatttactgaaaaaacaaaataatgcattagagcatgagttaaataccacacgtaaaaaactcgaaagcctcacacaaattgaacgtcaattatcgagccgaaaacaaggggcttctgtggatgctatttctcaagaagaagcgctgtctgatgttcaatcttcagatgcgagtaatacagaaaaaccagccgataaaccgatagcggagcaatccaataagtcaacggcaagcgagcaatcgataaccaaagaaaataatgaggtttcacaaccttcggtatcagcagttaaacctgaaccaccaaaagcagagcaagtaaaacctgatgcgaaaaatacctcgacagaaaaagagaatagcgcaacggttaaacctactgaaacaggatctaaataa

SEQ ID NO: 3536 - DNA, 906 bp, Proteus mirabilis
ggaagcaatatgtctcatgcacaaagcggtattttagtcgcacatagtaaattcggtctatttattgaagcaatggtggtgggggaaattgatcaactacgtcaaggctgccaacaatttatgcaatcccttagcgaattacaaaaacagtatcctgatgcttcattaggtgccgtagtagcttttggttcagatctttggaaaaaattatcagataataatagtgcgccagagttaaagccatttcgtccattaggtaaagggttagctcctgcgactcagcgcgatatgcttatccatatccaatccatgcgtcatgatgtgaatttctcattagcgcaagctgcaatagctgcttttggtaacgtgctccaaatagaagaagagatccacggtttccgctggattgaagagcgtgatcttagtggttttattgacggctcagaaaatccagttggtgacgagcgctatggtgttgctttaattaatgaaggtattgatgctggtggtagctatgttttagttcaacgctatgagcataacctaaaaaaatgggcgcgttttagtgaatcagatcaagaaaaaatgattggtcgtactaaaaaagagagcattgagttggatgaatcagaacgcaatattacctctcatgtatcccgtgttgccattgaagaaaatggtgaagagttagcgattttgcgtcatagcttaccttatggaactgctagtggtaaacatggtctctatttcttagcttactgtggtcgtttatataatattgaacagcaattactcagtatgtttggtgaagttgatggtaaatacgatgatttactgcgtatgagtaaacctgtgacaggtagctactatttcgctccttcttatgaagtattagccgctctgtaa

SEQ ID NO: 3537 - DNA, 981 bp, Proteus mirabilis
ggagaaaatatggctagcacgtttgccttgatcctaacgttggcaacgctaattacgggtattttttggtgtatagatcgttttaaattaaagccagcccgtaaagcgaagttaaaacgtttacaagagttaacgcagggaagtgaggatcagcaagagttagcaaaatcgattaataaaccaagctgggcagagacattaggctctctgtttcctgtattggcgattgtattgattttgcgttcctttgtgtatgagccgtttcagatcccatctcgttcgatgatgccgactttattagtcggtgatttcatcttggttgaaaaatttgcttatggattaaaagatcctattacacaaacaaccttgattagtacgggtaaacctaaacgtggtgatattgcggtatttaaatacccacgtgatccatcaactgactttattaaacgggtgattggtttgccgggggataaaatagtgtatgacgtgacgtcgaagaaattacacatttacccaaattgtaataaagcaatatgtgatgatgaaatagcggtaacctatggtacagcgtatcctagtgaatggacattactgttacaaagtgtacctggtggtcaacgtattagcggtatgaaatcgattccgattgaagagccaatttctacagctacgcaatttcgccaagaagagagaattgaaacgattggtgatgtctctcatcgtattatgactattccgggagatgttactgtacctgaatttattcagccgggattacctcaaggtacgtggattgtccctgaaggtcagtattttatgatgggtgataaccgtgatggtagttcagatagtcgtttctggggctttgtgcctgagcaaaacttagtcggtaaagcgacaacgatttggatgagcttcgagaaacaagaaaatgaatggcctacaggtgttcgtttcagccgtattggtggcattaagtaa

SEQ ID NO: 3538 - DNA, 456 bp, Proteus mirabilis
acagagaatataaaagtcggcattatgccggcttttttgtttttaggcattttgataatgaaacaacccaactggacatttaaattacctgaaaccatcagggcggcgatgagtcgccctttttcatggggtgaatttgattgttgtatttttgcctcagaatgtattgacgcacaatgcggtttctctccgataaagccttatctcaatcactataaaactaaagctgaagccttcaacctgatcaaatctaaatttggctccttagagaaagccgtatcacgctatttcaaatccattgagattgagcacgtccagcgtggcgacctcgtactgttcaaaggtgaggacggtgacagcttagccgtggtctgggcggggcattattggggcgtaaccccagaaggcgtgaagccggtgcagattaacccaatcaaagcgtggagagtggaataa

SEQ ID NO: 3539 - DNA, 270 bp, Proteus mirabilis
gtgactgatatggctttactaattacgaagaaatgcatcaactgcgatatgtgcgaacccgaatgtcctaacgatgccatttcaatggggaatgatatttatgaaatcaatcctgatctttgcactgaatgtgtaggacattatgataaaccgacttgtcagtcggtatgccctatcacgaatacaattatcatcgatcctgctcatactgaatcgcaagatgaattatgggaaaagtttgtactgatccaccacgctgacaaaatctaa

SEQ ID NO: 3540 - DNA, 675 bp, Proteus mirabilis
ggaatggatatggcaaagtcaaaaaaccataaagcgacgcctttcctcggcacgaagatctttgtgcaaaccggcttaggggaggcgatgaccgtgacggaagcgacgttatcacccgcaactattactatcgccaataataagctgaaagccgatgacatgattatgttatcgggattcggggagttagatggacgttttcctgttgcacaagttgatggcaacaaagtgaccctgtgcgacgaagtggattggagtgataaaacgttacccacggattttgcaaacgccaaagcacaacgtattcaatggtctaataacttttgtgcggtaaaaagcttcagcaaagacggttcaacgactgaacaaatcgatgtcaccaccatttgcagtgatggcaaggaatatgaatctggcgatacggaatacggctcaattaaattgacctttttcttacggtatagctccagtgatgtgcaacgactcttgcgtaaatatgaaaacagcaaagaaaaatttgcggtgaaaatggtcttaacgcgagatgaaggctccatgttttattacggctccgtcgaaacgggcatgaacattgatggcagtgtggggcaaatgatggattcggggatctcgattaaattgtctggccgtgattatttgaatgcgaagaaataa

SEQ ID NO: 3541 - DNA, 936 bp, Proteus mirabilis
attagtctcatggatacgttgagccaactcttatacctttctcaagggcaattgcaattagatgtgttttgtcaaatgaaaggacatttttccttaccgcatgtttcatctgttgaacatgaaactatttttcacttagttctatcagggcagtgttatgttcagattgaaaaatcagcccctatagttttatccgaaggtacttttttaatgttaaacagaaggcaatcacataccctttggagtggagaacgagatatagaacctcccccttttttgcataaaaataatggcttcttacctgttaagtacacaaaatctgaagatcagactcaacatgttgatttgctttgcgggcgaatggcttatgctaaaggaagcgggttactattattaaatgggtttcctgatatggtagtggcaaatttggtggaaatgccagggctaacagtattgaatttatttagccagttgcttcgagaggaagccattaatgcaaatcaaggggcggctgcgatactaaatgggcttgctcagactttattcgcttttgcattacgtgtttatgggcaaaaaccagatataaactcaagttggttagcattattagctgaacctcggttaagtcgtgtatttaattctatgttaaatgaaccacaaaaagggtggacacttgattctttagctaatgtcgcttcaatgtcacgagcgacttttgtgcgtcaatttaaagcaacggcgaatacgacacctggcgaagttctacaatccattcgtatgctaaaagcactttcattattacaacaaaataaatatacattatcagatatcgcagaaagagtcggataccaatctgaagctgcatttagtaaagcatttaaaagtgtatttaattgcagaccagggcagtggaagaagcaacagagtaaagtgtaa

SEQ ID NO: 3542 - DNA, 1953 bp, Proteus mirabilis
ggagtctgcatggaaaatcaacgttcctacagtctattaacgattaaatcagtgaatgaaaaagacagagaaatcgtgggcatggcgacaacaccgtcaactgatgcttatggcgatattgtcgagccagaaggtggcgtatttacactaccgcttcccttgctatggcagcacaacatggaacaacctattggcgaagttatcgacgcgaaagtcacaccacatgggatcaaaattaaagcaaagatagcccaaatagccagtccaccgggattatctgcacgactcgaagaggcgtggcaatccatgaagtctgggctggtgaaagggctttctatcggatttaaaccgttggaatatgcttttttagatgagggagggatccgatttaccaaatgggtgtggacggaattatctgtcgtgacgatccccgccaataaggattgtcatcttcaaacccttaaatcgatgtttcaaccgccggctgcgtctggctcaaggcgagttgtccatttatcttctcaattatccgctggcgtttcagcaaaaaatgcatttaataaggaacatacgatgaatattgccgaacaaattaaatcattcgaagcgaaaagatcggccaatgatgcggcacgattagatatcatgaacaaagcagctgaagaaggtcgtactttggatgtggaagaatcagagcagtacgataatttaacctcggaaatcaaggcagtagatagtcatttagtgcgtttgcgtgaaatggaagcctcccaagccaaacaagctaagccgattgatgttgagcaaaactcatttcgtgaagcctctcaattgcgaggcgggattataaaagtagacgaaaaattagcgccaggcattgaatttgctcgttatgtgaaatgtttagccgcctcaaaaggtaacacaacacaggcgttggaaattgcaaaatcacaatacccagagcaaccccgcatacagaatgtactcaaagcggcggtaaacgcagggacaacgaccgatccacaatgggcggggacattgacggactatcaacattttgcgggtgattttattgactttttacgccctaaaaccattattggtcaatttggtatcggggggatcccgtcattgtttcgtattccgtttaatgtgcgtatccctggacaaatcagcggaggaaaagggtattgggtggggcaaggtgatcccaaaccactgactaaatttgattttcaatctattcaacttggctttgcaaaagtcgcaaacattgccgtgctgacggatgaattagtgcgctttagcaaccccgcggcggatacccttgtacgtaatgccttggcggctgccatcattgaacgcattgatattgatttcatcgatcctaacaaagccgaagtcacaaacgtatcacccgcttccattacgcatggtgtgaaagccatcccatcaacaggcaatcctgaagcggatgttgaggcagtgtttgaagcctttctgaaagccaatctttcgccgacaagtggtgtttggatcatgtcttccatgacagcattagccttatcaaaaatgaaaaatccattgggtcagaagatgtaccctgatttgagtttcctcggtggggctttccaaggcttacctgcgattgtgtcacagtatgcgggggaacagttaattttggttaacgcgcaagatgtgtatcttgccgatgatggtcaggtggtaattgatgcgagtcgtgaagcgtctttacaaatggaagatagcccaactaacagcagtaaaacggggaccggagcccaattggtgagcatgttccaaaccaacagtgtggctattcgtgcagagcgctttatcaattggcgcaaacgtcgcccagaagcagtggcctatgtgtcgggtgtcaactaccgcacagtcacagggggagataaaagcccaaagtga

SEQ ID NO: 3543 - DNA, 594 bp, Proteus mirabilis
tcaataataatacgtactaccttcaagggatcatctataatgaaactgagtaaaattgctttggctgcggctttagtatttggtattaattctgttgctacagctgaaaatgaaacgcctgcaccaaaagtaagttcaactaaaggcgaaattcaattaaaaggtgaaattgttaattcagcatgtggattagcagcatcttcaagccctgtaattgttgatttcagtgaaattccaacttctgcattagcaaatctgcaaaaagcaggaaatatcaaaaaagatattgaattacaagactgtgatacaactgtagcgaaaactgccacagttagctatacaccaagtgttgttaacgctgtaaataaagatttagcctcttttgtttctggtaacgcatctggcgcaggtattggcttaatggatgcaggtagtaaagcagttaaatggaatactgcaactacaccagtacaattaattaacggtgtatctaaaatcccattcgttgcttatgttcaagctgaatcagctgacgctaaagtaacgccaggtgaattccaagccgttatcaacttccaagttgattatcagtaa

SEQ ID NO: 3544 - DNA, 768 bp, Proteus mirabilis
agcgattcaatgaagcaaaagaaagtaaagaaagcaggtttacgcaaaggcgggtttacatttaaacaattttttgtcgctcatgataagtgtgaaatgaaagtgggtactgatggcgttttattaggtgcttgggcgcctatcactaaagcaaaaacggtgctcgatattggtacaggaagtggattaattgccttgatgttagcgcaacgtgccccgcaggttgagcgtattgatggtattgaacttgatgaagatgccgcattacaggcgcgtgaaaatgcgcaacaatcacagtggagttcgttaatccatatttatcatcatgatatttatcaatatgcgcaacaagcgccaactcgctatgatcttattgtgagtaatccaccctattttgagccagcggttgcatgccgtaaccaagagcgcgagcaagcccgttatacgaaaacattgacccatgaaggtttgcttgataatgcacaacagcttattacagatgaaggcctattttgtgtggtgttaccctatttaatcggtgaacagtttattgaaatctcacaaagaaaagggtggaatgtcgtacagcgagttaatattaaagatagtgcagataagccttaccatcgcatattgctagcctttcaaagacagtatcaaggcgaaactaaaccatgtaatattgaagagctgattatccgcaataatgacggtcattacacaacccagttccaatcttgggtcacagatttttatttatattattaa

SEQ ID NO: 3545 - DNA, 1365 bp, Proteus mirabilis
aggtatacaatgacagccacgacattttccagtcttgaacttgatgaaagtttattgaccgcattagaagaaaaaggatatcaacgtcctactgctattcaagcagaagctatccctgccgcaatggaaggacgtgatatattaggctctgcaccaacgggtacagggaaaacagcggcattcttacttcctgctattcaacatttacttgattatccacgaaaaaaatcagggccacctcgtgttctgatcttaactccaacccgtgaacttgctatgcaagtcgctgatcaagcaaaagaattatgcgctcatacccatctagacatcgccactatcaccggcggtgttgcttatatgaatcacgcagaagtttttagtgagaaccaagatattgttgttgccacaacaggtcgcttattgcagtacatcaaagaagagaactttgactgtcgtgctgttgaaatgctgatcctcgatgaagctgatcgtatgttagatatgggttttgctaacgatattgaaactattgctggggaaactcgttggcgtaaacaaacattactcttttcagccacattagaaggcaatgctgtgattgattttgcacagcgaattcttaatgaaccggttgaactgaacgctgacccttctcgtcgtgagcgtaaaaaaattcaacaattttactatcatgcagataatcttgaccataaaactgccttacttgcacatttactcaaacaagaagaagttaaaaaatcgattgtttttgtacgtaaaagagagcgagtcagagaattagccgcagcattagaaaaacaaggtatcaaagccagctaccttgaaggcgaaatggctcaaacacaacgtaacgaagcgattaaacgtgtagagtctggcaaaatgcatgtgctgattgcgacagatgtggcgtctcgaggtcttgatttagaagatatcacccacgtctttaactttgacttaccgcgcacagctgatgtttatttacaccgtattggccgtacaggtcgagcgggtcgtaaagggactgccatttcattagttgaagcacacgattatccgctacttggtaaaattagccgttatatccaagagccgattaaatatcgtgttgtagcccaattacgtccagtgactaaagcccctagtcaaaaagcatcatttaagccttctaaaaaagtattagcaaaacgcaaagcgaaaaaagtagaagagaaaaaaaacgttaaagagaaagtacgcgcacgcgatcgtaaaaatattggtaaacgccgtaaaaccgctactgataaaaccaccatcactgcggaaaaaactaatcatataaaaacagagcaacaataa

SEQ ID NO: 3546 - DNA, 1827 bp, Proteus mirabilis
agcaaagcaatagagaaaaataatttcagaatgaaaaacatacgtaacttttccattatcgcacatattgaccacggtaaatcgacgctatcagatcgaattattcaaatttgtggtggcttaacagatcgtgaaatggctgcgcaggttcttgattctatggatcttgagcgtgagcgtggtatcaccatcaaagcacaaagcgtaacactcaattataccgctgatgacggtgaagtttatcagcttaactttatcgatacgccaggacacgttgacttctcttatgaggtttctcgctctcttgccgcttgtgaaggtgctttactggttgtcgatgcagggcaaggggttgaagcccaaacattagcaaactgttatacggcgatagatatggatcttactgtcgttccggtattgaataagattgacttacctgccgcagagcctgagcgtgtcgctgaagagattgaagatattgtcggtattgatgcgaccgatgcagtgcgttgttctgctaaaaccggcgtgggtgtaaaagaagtgattgaacgtctggtgaaagaaatacctgcgccagaaggcgatcctgacgcgcctctacaagcacttattattgactcttggtttgataattaccttggtgttgtctcacttatccggatcaaaaacggtaaagtcaacaaaggcgataaaatcaaagtgatgagtacagggcaagtttataatatcgaccgtattggtatttttacgcctaagcaagttgatacaacatcgctaagttgtggtgaagtaggctgggtcgtttgcggtattaaagatattcttggtgcacctgttggggatacattaacagccgcacagaagcctgctgacaaaccattaccgggctttaaaaaagtcaaaccacaggtttatgcggggttattcccggtcagttctgacgattatgaatcattccgtgatgcattaggaaaattaagcttaaatgatgcgtcactcttttatgagccagaaagttcatccgcattaggatttggtttccgttgtggtttcttaggccttctccatatggagattatccaagagcgcctagagcgtgaatatgatcttgacctgatcaccacagcaccaacagtagtttatgaagtggaaatgaccaatggtgatatcatcatggttgatagcccatcaaaactgccggcactgaacaatattgaagagatcagagagcctattgcggaatgtcatatgttactaccgcaagaatacttaggtaatgtgattactttatgtgtcgaaaaacgcggcgttcaaactaatatggtctatcatggtaatcaggtttcattaacttatgaaattccgatggctgaggtggtattagatttctttgatcgtttaaaatcgacctctcgtggttatgcttcgttagattataacttcctgcgtttccaaggctccaacatggtacgtgttgatgtcttaattaatggtgagagagtcgatgcacttgcattaatcacccataatgataacgcaccgtatcgtggccgtgaattggtggaaaaaatgaaagaattcattccacgtcaacagtttgatattgcgatccaagctgcaattggcaatcatattattgctcgttcaactgttaaacagttacgtaaaaacgtattagctaaatgttatggtggtgacgttagccgtaagaaaaaactgttgcagaaacagaaagaaggtaaaaaacgtatgaagcaaattggtaatgtcgagttaccacaagaagcgtttttagccatactgcatgttggtaaagataaataa

SEQ ID NO: 3547 - DNA, 1110 bp, Proteus mirabilis
ttatatcaaataacaaaagctaactacactgttataaataaagccgatagagtaaccattagaataagacttacgctgatgggtactataatgaagaacaaaacaatccgaacttttgcattacaggcaaccgttgcattgtctttggttgcgagtagttatgcaaatgcagctcaattacttaatagctcttacgatattgctcgcgagttatttacacagcttaatagtgattttaaaactcaatgggatgctcaacatcctgatgacaaagtcactatcaaacagtcccatgctggctcttctaaacaagcattagccatattacaaggtttacctgcggatgttgtcacttataaccaggtgacggatgtacaaattttgcatgataaaggcaagcttattcctgctgattggcaacaacgtctacctaataatagctcaccttattattccacaatggcctatttggttcgtaaaggaaatcctaaaaatatcacttcttggcaagatttgacccgtgaagatgtcaaagtggttttccctaacccaaaaacatcaggtaacggtcgttatacctatttagccgcatggggagcgtttgaaaaagcttatggaaatgaagcgcaaacccgtgatgctatgacaaagttacttaaaaatgttgcggtatttgataccgggggacggggggcaacgacctcatttattgaacgtggacttggtgatgttttaattagttttgagtctgaagtaaataatattcgccagcaatatggtgaagatgattatcaagttattgtccctcctgtagatattttagcggagtttcctgtggcatggattgataaaaatgtgcaacgcaataaaacagaaaccctcgccaaagcttacctaaattatttatatagcccgagagctcaggagatcatcacacaatttaactatcgcgtaaatgataaagcggtgatggcgaaaaaagcagatcaatttccagccacttcattatttaccattgaagatgtgtttggtgattggaaccaagtgatgaaaacgcattttgctacagatggcacgctagataaattattattagaaggacgccaataa

SEQ ID NO: 3548 - DNA, 912 bp, Proteus mirabilis
tacaaacaaataaatgatcagggatttattgtggcaggcttagaacaatttattggtaatacaccattggtcaaattacaacgactttcacaaggattagatgcagaaatatgggttaagcttgaaggtaataatccggcgggttctgtgaaagatagagccgcgttatcgatgattgagcaagctgaattacgcggtgaaattaaacctggcgatacattaattgaggcaaccagtggtaatacagggattgctttagcgatgatagcggcagtaaaaggttatcgactaaaattattaatgccagaaaatatgagtaaagagcgtcaagcatccatgcaagcgtatggcgccgagcttattttggttagccgcgaaattggtatggaaggggcgagagatttagcgcaagaaatggagcgtaaaggtgaaggcaaggtattagatcagtttaataaccccgataaccctcgagcgcattttacttcaactggccctgaaatttggcaacagactcaagggcgtattacccattttgtttctagcatgggaacaacaggtacgataactggggtggggagttacctaaaaacacaatcggacacagtaaaaattgtcggtttacaaccggaagaaaaaagtcaaattccgggtattcgtcgttggtctccagcctatttacccggtatttttcgaaaagagttggttgatagtgttatagatatgtcccaaacagaagcagaacaaaccatgcgcctattagcgagtaaagaaggtatattctgtggcgttagttctgggggagccgtagctggtgcaatacgcgttgctaaagagaacccaggggctgtgattgtggcgattatttgtgatagaggcgatcgctatttatcaactggggtgtttggttga

SEQ ID NO: 3549 - DNA, 204 bp, Proteus mirabilis
gagtttaaaatgaaatggagtgatacacgtgaaataggggaagcactttatgatctctaccccgatacagatccaaaaaccgttcgttttaccgatatgcatcagtggatttgccaattagacgattttgatgatgatccacaaaaatcgaatgaaaaaattcttgaagcaattttattagtttggcttgatgaatttgaataa

SEQ ID NO: 3550 - DNA, 1353 bp, Proteus mirabilis
ataaggagaatgtgcatggctggccataaatcagcgaatcttttacttgtcgatgatgatccgggattattaaagctactgggtatgcgattaacaagtgaagggtttcatatcgttaccgctgaaagtgggcaagaagcacttaaactattattaaaagaaaaaatcgatctggtgatcagcgatttacgtatggatgaaatggatggtatggcgctatttgcagaaatacagcgccaacaacccggtatgcctgtgattattttaactgcacatggctccattcctgatgctgtcgcggcaactcaacagggggtgtttagtttcttgactaaacctgttgatagagatgcgctttataaagctatcgatgaagcattagaattagtgacgacggtatctgatgaagagtggtcaaaagatatcgtgacccgtagcccccaaatgttacgtttattagagcaagccaagttagttgcacaatccgatgttagcgtactgattaatgggcaaagcggtacaggtaaagaagtccttgctcaagcaatccaccgcgccagcccacgagctaaaaaaccctttattgctattaactgcggtgctttacctgaacaattattagaatctgaactatttggacatgctaaaggtgcttttactggcgcggtaagtagtcgtgaaggacttttccaagcggcagaagggggcactctatttctggatgaaattggtgatatgccaatggcattgcaagtgaaattactgcgtgtattacaagagcgtaaagtgcggccattaggcagtaatcgtgatattgatattgatgtgcgtattctttctgcaacccatcgtgacttgccaaaagcgatggagcgtaatgaatttcgagaagatttatactatcgtttaaatgtggtgaatttacgtatccccacgttgagcgaaagagccgaggatattcctgttcttgctaaccatttattgcgcgaatcagcaaaacgacataaaccttttgtgcgtagcttctcaacggatgcgatgaaatgtctaatgacagcaagttggccgggaaatgtgcgtcagttagttaacgtcatcgagcaatgtgtcgctttaacgactgcacctgtgattagcgaagcccttgtcacacaagcattgcaaggggaaaataccgcattacctacttttgctgaagcaagaggccattttgagatgacctatttaaggaagttattgcagatgacaaagggcaatgtcactcaagctgcaaggatggcagggcgaaatcgaacagaattttataaattgttgtcacgtcatggacttgatgccaatgatttcaaagaatga

SEQ ID NO: 3551 - DNA, 717 bp, Proteus mirabilis
tgcgggcagatatatagtcctaatagtaaccagttgattataatgaaaaacaccagtaaaactgcagtaagtacagaacaaactcaagagaaattagtgcaagaaggtattaggctttttgcactatatgggatcagtggattgagaacgcgacaacttgcgcaagatgctggtgttaatcaatcagcaataccttaccactttggcggaaaattaggggtttatacagcagtgatccgatatattgcgacagaattagcctctgaaattcagtttgaccaatttgataataagcttcagtttttattgaaagaaaaccgaccttataaaaatgaaaaagtggctgaattagttctattactagtcacaggtttaactcgtgcattattatcatcaaaacgccattattacagtcagttgattctacgtgaacagttagaaccgacggaaaattacgatcttatttatagtaatctgattgagccttttcatcttcgtctttctcgtttagttggattaatggatacaaagagtgatgaagtaacaatcactattcgtgctcatgctcttattggtcagatattagggtttgtcattgcaagaaaagcttttctattacgtgttaataagcaagagataacatcacaactattagataagattgtacaagaaattagccaactttcagtaaatgcccttttaattgaaaacgcatag

SEQ ID NO: 3552 - DNA, 1101 bp, Proteus mirabilis
ggtggcaagatgagtttattattactaaaaagtcgccctttagtcgttattcctgagttagcggtacgtcttggtttaaatgaggcgatgctgttacagcaaattcaatattggttaactgaaactacttcaggtgttgaatatgacggctcacgctggatttataacaccgttgaggagtggaaggagcaatttccttttttctctgaatcaacgattaaacgcgcttttgctaatttgaaaaagcagggtgttttacgcatcgagcaaattaataaatcgaaccatgaccgcactaattattatgcgattaattacgatcaccacttgctacccgatgaggtcaatatgacccaatcgaccagtgataattcatctaatcgaatagttcaaaatgaccttatcgataagcgcaaattgaaaccgtcaaacagttcaaaatgcgctgttctgaacaggtcaaaatggcctgatcttcaagagaatacaacagagattacttcagagagtacaacagaaacagatcattcgtcgcagaattctgacgaatccagcgaccagccgaaaaatgattttttaactcgttatcctgaagcagtgatttacagcgctaacttccaaaaatggggcgatgaaggtgatttaaaaacggcgaaatggatgtttggtcgtgttaaaaaactaaatccatctgcgctagagcctacttggtatgactgggcgaacgatattcgtttgatgcgtcaaatcgatgggcgtacccatgagcaaatttgtgccttgttcgattgggccaacaaagactcattctggtaccaaaacattttaagtcctcgtaagttacgtaaacactttgatgaactattcgttcgtagtcaaaagccaaaggatgagctaaaggttcaagttgacaccgttgaacgtgatagtgccttttcccgcttgattggctctcggtctaaacctaaaaaccgcattgaagaagttgcacttgagctagcaggtaaaacaggtattcgtcgtatgagtgagttttcaggtcgccaagcatggaacagcatttggaagcaagcgatagaaatgttacaggagactcagtaa

SEQ ID NO: 3553 - DNA, 1128 bp, Proteus mirabilis
cccctaaagatcaacaacctaaatattaataaacttgatgccggtaggaataaaatgatcctcaataaaaaaaacattcattccaaatcagtaatgctattttgtgccggcattgtttctttaatgccgttgcacgcaattgcttatttacaaggtgaagtgagaaccaatggtggccctaatattttctatgcagtattagatcacaccacctttcctaataacaaagcgggagaattagcaacagtaaacttttcgttgcctgatcgctatgatgggacagtatattgtcctaactcacgtatctatgatcgtgcattaacctattttaaagcaacgactgatttaccccctgttggtaataacttttatcaattaaatgagtatgttgatatcaaaattaattttgaaatttgggggcctaatcctttacccacagtgcccttttctgacatacctaataatagaaataaccaacaaggttgcagagtcccctcttcacctaaaccgcatatttcctcaggaagtagcggtcaactcactttccgtttaagaaaacccattattaatggtgttagtcttaatgggcaatctcttgcacaaatgtatgccatggtaagtcacagcggtacgccaaaaacctatggttcagagcctatttctaaattagtgatcacctcggggatcattaccactaaagataaatgtatctttaataatggttcaccaattacctttgactttggtaatgtgggaaatacctctgattatctcaatgggcaaaactacaaaattactcgcaacatccccatcaaatgcgaagggggaagctttactgatcctaatagcagaataatgtttaaagttcagactggtagctcaggtattgcgagttttaattctaattaccttggtacaacaggctctgtagatagaagtaacttaggtatcgtattaagagataagtcaggtacgattatcccacctaaccaatatttttcagttggcaaactcaataatttcaacggaaattgggaagtaagtgcagcccccatcgccaaagcgggcagtaaaattactgaaggtgaattttcagctcatgcgacactcattgcggagtttatgtaa

SEQ ID NO: 3554 - DNA, 459 bp, Proteus mirabilis
gagatagggatagagaaggtgtcgatattgcgctttatccccaaggaatgctgccttatcccgtcacctgtttgttggggtccatgcacaaaccgactattttgtgaggtgacaatgataggaacagctgcaggacgatttcgtcatatcatcacccttcaacaacctgagcccaagcctaatcggataagtggggatgaagtcatttggcgtgacgtgttaaaagatattcatgcaagtgttgaacctctacgtggacgtgaatattttcaggcgcaacaggtgcaaagtgaaactaccttcagaatacgtatgcgctggttccctcaggtaaaatccactatgcgagtccgttttggctcacgtatattcgatattgttgccattattgatcctgaagagcgtcatcgagagcttcaattgatgtgcaaagagggcgtgaatgatgggggagattaa

SEQ ID NO: 3555 - DNA, 597 bp, Proteus mirabilis
ggaggtgttgtactaatgcaatatcatccattttctgatgccatggtcaacgcgattaatgagggggcttatatcgttttagctgccagactcgatttgaaatcaggcgtgacctgtgcgcataccggtgttgggcaactgattattgcgggggaaacctatttaggtgtaggaagtttaggcgaaatcagtcagctaaaagaaaataagacaaccagtcccccacaattacagcttaaattagcgggttttgataaatcgctggtggggatggtgatgaatgagcaaagtcgagggcgagaagtgcggttgatgatggttgccatcggtgaagagggaaaaccgcttcttgctgaaatcttatttgtcggacaaatcacatcgattaatgtggtgtctggcgaagaaaatgccgtatgtgttaatgtttctaatcgattcgagcgatggtcaattgggttacccgatagattcaccgatgagtcgtggtcatctcgacggcaaggtgatcgtatctttcgctatgttgctcaaatggctgaacgggcgatttattggggcagcaagaaagatgcaccttcatttatttataaataa

SEQ ID NO: 3556 - DNA, 1548 bp, Proteus mirabilis
tatttacatgtaaaataccatcagatttatgattgtatttttatgaggcatcaaaaaatgatacccgttattgccttagtagggcgccctaatgtgggaaaatccacattatttaaccgactaacacgcacaagagacgcattagttgcggattttcctggacttacccgtgaccgtaaatatggtcgtgcagaattagacggtgaagagtttattatcattgatactggtggtattgatggtgcagaagagggtgtagaaacccatatggcatcacaatcactgcaagccattcaagaagccgatattgtgctatttttagtcgatgcgcgagcaggattaatgccagccgaccaaggtattgctaaacacttgcgtggtgttgagaaaaaaacctatttagtggcgaataaaacagatggtatcgatattgataccgctttggctgatttctactctttaggattaggggaaatattccctattgcagcttcacatggtcgtggtgtttctcaactgattgagcaagcgttgttacctattgtgggtaaagtcgtcgaagaagagaaagaattaacagaagaagaagagaatgccgcttattgggctgctttagaagcagagcagaaagagcaagaagaagaggaagaagaggaggatttcgatccgacaacacttcctgttaaattagctattgtaggccgccctaatgtaggtaaatcaactctgactaaccgtatgttaggtgaagagcgtgttgtagtttacgatatgccaggcactacccgtgatagtatttacataccgatggagcgtgatgataaggagtatatccttattgataccgctggcgttcgtaaacgcggaaaagtaaaagaaacggtagaaaaattctcagtgatcaaaacattacaagcgattgaagattgtaatgttgcactacttgttattgatgctcgtgaggggatttcagatcaagatctctctttattaggttatattcttaattctggacgctctttagttattgctgtcaataaatgggatggtatgacccaagaagatcgcgaacaagttaaagatatgcttgatctcaaattaggttttgttgattttgcccgcgttcattttatctcggcattacatggtagtggtgttggtaatctgtttgagtcgattcaagaagcctatacttgcgcgacacgtcgtgttggtacatcaatgttgacgcgcataatgaagatggcagaggatgatcaccaaccccctcttattcgtggacgccgtgtaaaaatgaaatatgcccatgctgggggatataatccacctgtcgtggttattcatggtaaccaagtgtctgatttacctgatagctataaacgctatttaatgaattatttccgtcgcacactacaagtgatgggaactcctatccgtattcaatttaaagaaggggaaaacccttatgcggataagaaaaataaattaacagcttcgcaaatacgtaaacgtaagcgtttaatggctcatttaaagaaatcaaaataa

SEQ ID NO: 3557 - DNA, 192 bp, Proteus mirabilis
  unsure (166): Identity of nucleotide at the above locations are unknown.
ccaaagagcgtgggcgtgaaaaaaagtaacctgcagccagctagaaatccgaatcccaatcgggctgatgcaaccacaggtggtccactctttttgattatgactctaacaataagtaagggtactaatattacttgtgaaatgtcttatccgggttgtatcaacntcctagtgccctttcttattgtgtga

SEQ ID NO: 3558 - DNA, 1293 bp, Proteus mirabilis
agaaaaaaagtggcacaaaaaatccaagccattcgtggtatgaatgactacctacctgctgatacgcgggtatggcagaaaatcgaaaatacgctaaaacaaattttagccggttatggttttagtgaaattagaacacctatcgtagagcatacccctctatttcagcgagcaattggtgaagtgaccgatgttgttgaaaaagaaatgtatacttttaccgatcgaggtgaagacgcacaaagcttaaccttacgtcctgaaaataccgcaggttgtgtccgcgcaggaattgaacatggtttactttataaccaagagcaacgcttatggtatttagggccaatgttccgttatgaacgccctcaaaaaggtcgttatcgccaatttcaccaattaggtgcagaagtatttggcctacaagggcctgatattgatgctgaactgattatgttaacggcacgctggtggaaggcgttaggtattgcagagcacgtgactttagaactgaactctattggttcactcgaagcgcgggcaaaataccgtgaagcattagtcgcatttttagagcaacacgttgatcaattagatgaagattgcaaacgtcgtatgtattctaacccattacgtgttttagactctaaaaatcctgaaattcagactttattgaatgatgcgcctgaacttttcgattatcttgatgacgaatcaagagaacactttgatggtttatgtgcattacttgatgctgtaggtattacttatcgtgttaatcagcgtttagtccgaggcttagattattataaccgtactgtttttgaatgggtaaccagtgcattaggttcacaaggaacggtatgtgcgggtggtcgctatgatggattagtgaaacaattaggtggacacccaacgcctgcggtcggttttgccatggggatggagcgcatgatcttattagttcaagcggttaatcctgagtttgttgctgatactcatgtcgctgatgtttaccttgcgtcttttggtgataatagccaaagtgcagcattaatgctggcagaagaaatccgtgatcaattacctacattgcgcttaatgaccaatcacggtaaaggcaattttaaaaagcaattaggacgtgctgataaacatggtgctaaaatcgcgttaattttaggtgaagatgaaattaacgctggcacagtagccgtgaaagatttacgttcaggtgaacagaccattgtatcgcgtagcgaactggcccaacaattgacgctgttattaggttaa

SEQ ID NO: 3559 - DNA, 750 bp, Proteus mirabilis
gttactgaagtggaaggctggcaacgtgcatttgttatccatgctcggccttacagtgaaacgagtttattgctcgattttttcactgagaatgaagggcgagtgcgcatattgtcaaaaggtgcgcgcggccgtcgctctcctttaaaaggagctcttcaaccttttactcccttgctcattcgttggagtgggcgaggtgagataaaaatcctccgtgatgctgagcctatctctttagcattaccattaacaggcacagtactttacagtggtctgtatcttaatgaattactttctcgtgttttggaaaatggcacatcatatagcacgctttttttcgaatacttatcttgtttgcaaatccttgctgccagtgaaaccacgccagaagctgctctaaggcgctttgaattagcgttattaacgcaattgggttatggcctagactttttgcattgtgcaggaagtggtgaacctgtttctgataccatgacttatcgataccgagaagaaaaaggctttattgccagtttggtggttgatcactatagttttactggattggaattaaaatcgctggcaaaacgagaatttcctacggctggcacattgaaagcagcaaaaaggtttacacgaatggccttgaaaccttatttaggtggaaaaccattaaaaagtagagagctgtttcggcaatttgctattaaaaagtgtgcgaaaaaaagcgtattgatagaggataaataa

SEQ ID NO: 3560 - DNA, 1245 bp, Proteus mirabilis
tctattttggtaatagttatgtcctgtaaacgaaaaattcctcttagaataaatgtattagatgcaactctagatagagttaaatggctatttgatactttcgaacaaatcaccctatccttttctggaggtaaagattctacggctctttttcatcttattgcgactgaagcacgtaaacgtcaccgaaaattcaatgtcatgtttcttgactgggaagtgcaatactccgctaccattagtcatgttgcaaaaatgaaatcgctgtatgaagactgcacggagcgattttactggatagcattacctatcacgacagaaagcgggatctcacaatatgaacctacttggacggcttgggaaccaggaaaaaaatgggtaaggcaaccgccagaagacgcaatcactgatccagactttttccctttttatcatccgaatatgatttttgaagacttcactcctgcatttaatcagtggatcacaggaaatcattgtagttcagtcattttattaggaattagagccgatgaatcattaaatcgctttattgctatcaataataaccgaaaactacgttatgccgatgacatcccatggacaacggcatcacccgaaggtttttattatatggcctatcctatttatgactggcatgtaaaagatatttggacatacatttcacgctttaatctaccctataattctatttatgatctaatgcaccaagctggggttagtttaaatcaaatgcgcatttgtgagccatttggccctgaacaacgtaaagggctatggttataccatgttttagaacctgagacgtggagtctagcctgtgaacgagtgagtggcgctgatgcaggtatgttatacacccaccctcgtaataaatcaggcttttttgggcaacgtaaaatcagtaaacccgcccatcatacatggaaatcttacgcccactttttactagcgagcttaccagaacaaaccgccgaacattaccgaaataaaatcgcagtttaccttcattggtatgctgagcgagattacccaaatggaataccagatgaacaagacggtgatactagcagtaaacaaatcccgtcttggcgacggatctgtaaaactattttacgtaatgatttttggtgtagaacattagcatttagtcctaccaaatcacactgttatgaccgatattgcaagcggatacaggaaaaacgtaaaaattggcagttgatttaa

SEQ ID NO: 3561 - DNA, 1008 bp, Proteus mirabilis
tggcgtatggtaatttcatctgaccttataaaaaatcatgtaccgaggataaaaatgagcaaaattttcgaagataactcgcaaactattggccatacccccctagttcgtttaaaacatttcggtaatggcaatatcttagctaaagtagaatctcgtaatccaagctttagtgtaaaatgccgtatcggtgcaaatatgatttgggatgcagaaaaaaaaggtatcctgaaacccggcgtagagctagttgagccaaccagtggtaatactgggattgccttggcttatgtagctgctgcgcgtggctataagctgacactgactatgcctgataccatgagtattgagcgccgtaaattattaaaagcattaggtgctaaccttgtgttaactgagggcgctaaaggtatgaagggagcgattgataaagcgaacgaaattcgtgatagcgatcctagccgttaccttctactacaacaatttagtaatccagcaaacccagaaattcatgagaaaaccacaggccctgaaatttggaatgacactgatggcaaagttgatgtagttatcgcaggtgtcggaacgggtggtaccatcacgggtattggtcgctatttgaaaaatactcaaggtaaagctgtcaccatggttgcggtagaacctaaagattctcctgttattagccaagcattagcaggtgaagaaattaagcctggtccacataaaatccaaggtattggtgcaggttttatccctgaaaacttagagttatcactattagatcgcgtgatccaaattactaacgaagaagcatttgaaacagctcgtgacgttatgaccaaagaaggtattttagcgggtatttcatccggtgcggcaattgcggctgcagtgaaattagctaaagagccagaatttgctaataaggaaatcgtagtgattttaccttcttcaggtgaacgttatctcagcaccccactttttgctgatatctctgacagctaa

SEQ ID NO: 3562 - DNA, 354 bp, Proteus mirabilis
ctcaataaggttaatatcatgcttaattggaatgaatatcgaaaacaattaatgggacgtattggtgagttaggaaaattaacacctgatacggttactggctaccaagcactttccaatgcaggtaaaaaaactaatcatttagatgcaaaaacaagagaattaatcgcattagcagttgcagtcacaacacgctgtgatggttgtatcgccgtacatgctgacaccgctttaaagttgggtgctagtcatgaagaaattgcagaagcactcggtgttgctgttgcattaaatactggtgctgcgatggtttattctgctcgagtattggatgctattgcacctgaaaattaa

SEQ ID NO: 3563 - DNA, 360 bp, Proteus mirabilis
aaaagcaaggtagagatcatgatacagcaattaaaagagaccctttcaccgcttgtcgatggaagggttttttttcaggtattacccgaaggcaaagggcagtatcccgccattgtgatccagttcgccagcatcacacctaacagtgcgctggaggatatggatttagataactatcgtgtgcaacttgatgtgtatgcgccacagccacaaccccttatggtcttgcgtaaaaaaattgaggctaagattgtcgaggcgatcccatttgcacaacgggtgaatgcggtctttgggtatgaagccgatgtcaaattgcatcggcttgttcttgaattaatgattttatcagataaataa

SEQ ID NO: 3564 - DNA, 3111 bp, Proteus mirabilis
gttaaatttttcattgataggttaaaagtgaattatatgtcaacaatgaccactgcacaaattaaaacgtcacttcaatctgcaaagcagttagcaacaaaaaaatttcaatctgcaggacaaaccacaaaagatgcgttaaaaaaagtagctgatcaagcacgtaatgcaggaaataaacttattttgttaattcctaaagattatcaaggacaaggctcaagtcttaatgagcttgttaaggttgcagatgaattaggtattgaagttcaatatgatgaaaaaaatggcactgcaatcactaaacaagtattcggtacgacagagaaattacttgggcttactgagcgaggtgtagctatatttgcaccacaattagacaagataatacaaaaatatcaaaaaataggtaataaattgggaggaagtgctgaaaatataggcgataatttaaataaagcaggtggtgtattatcaactcttcaaaattttttaggtacagcactctcttcaatggagataaatgaattaataaaaaaacaaaaaaatggtgaaaatgttagttctagtgaattggcaaaagcgagtattgatcttattaatcaactcgtggatacagcctctagtttaaataacaatatcagtgctttttctcagcaattaaataaattaggaagtgtattatctaatacaaaacacttaaatggtgttggtaataaattacaaaatttacctaacttagataaattgggtacagggttagatactgtttctggtattttatcagctatttcagcaagctttattttaagtaatgcagatgcagatacaggtaccaaagctgcagctggggttgaattaacaacaaaagtattaggtaacgtgggtaaagcagtttctcaatatattctcgcacaacgtgttgcacaaggtttatcaacttcagctgcaagtgcaggtttaatcgcctctgcagtaacattagcaattagcccactatcattcctagctattgcagatcagtttaagcgtgcaaataaaattgaagagtattctcagcgttttaaaaaatttggttacgaaggagatagcttacttgcagctttccgcaaagaaacaggagctattgatgcatcattaaccactatcaatactgcattaggtactatatctgcgggtattagtgcagcttcaacggcatcactcattggagcaccaataagtgcattagttggagctatcactggcattatttcaggcatattggaagcttcaaaacaatcaatgtttgaacatgttgcaaatagaatggctaatactattgctgaatgggagaaaacacacggtaaaaacttttttgaaaatggatacgatgctcgccattctgcttttttagaagataactttaaattgctatctcaatataataaagaatattctgttgaaagatctgttcttattactcaacaacattgggatgagcttattggtgagttagcaagtgttactaaaaatggagcaaaaacacttagtggtaaaagttatattgattattatgaagaaggaaaacgcctagagaaaaaaccaaatgaatttcaaaaacaaatatttgatccattaaaaggtaatattgatctttctgatagtaaatcatcaacattacttaaatttattacaccattattaacaccaggcgaagaaattcgtaatagaaaacagtctggaaaatatgaatatatgaccgaattattagtcaaaggtgttgataaatggactgtaaaaggagttaagaataaaggatctgtatatgattactccaatttaattcagcatgcattagttggtcgtgaccaatatcgtgaaattcgcattgaatcacaactgggagatggtgatgataaaatatttttagctgcaggctctgctaatatctatgcaggtaaaggtcatgatgttgtttattatgataaaacagatactggttatttaacaattgatggtacaaaagcaacagaagctggtaattatactgttacacgtggattaggtggagatgttaagattttacaagaagtcgtgaaggagcaagaagtttctgttggaaaaagaaccgaaaaaactcaatatcgtgattatgaatttaaacatattgacggtaaagatttaacagcaattgataatttatattcagtggaagaaataatcggtactaatcgcgccgataagttttttggcagtaaatttagtgatattttccatggtgcagatagtgatgattatatcgaaggtaatgatggtaatgaccgcttatatggggataaaggtaatgataccttaagaggtggaaatggtgatgatcaactttatggtggtgatggcaacgataagctaattggtgggactggcaataattacctaaacggtggtgctggtgatgatgagctgcaagtacaaggcaattcttatgctaaaaatgtattatttggtggaaaaggtaatgacaagctgtacggtagtgaggggatagatctacttgatggcggagagggaaatgatgttctgaaaggtggatatggtgatgatatttatcgctatctttctggatatggtcatcatatcattgaagatgatggtgggaaaaacgataagcttagcttaacagacattgatttccaagacgttgcctttaagcgagaagataatgacctcgttatgtataggtttgaaaataatgccctttcaattggtcataaaaatggtatcacatttaaaaattggtttaaaaaagaatcaaatgatatctctaaccaccagatagagcaaatttttgacaaaaatggtcgaataatcacaccagagtctcttaataaagcatttgagtatcaacaaaaaaataatcaggctaactatgtgtatggacatcatgcatcaacttatgcgaataaagaaaatcttaccccattaataaatgagattagcaaaataatttcagctgctggtagttttgatgttaaagaagagaaagctgcggcatctttattacagctatccaataatattagtggttcttcgtataatagtaactcaataactttaacctcattagcataa

SEQ ID NO: 3565 - DNA, 1347 bp, Proteus mirabilis
cccctttctttttcatgggttggggactttatgccaatattaacgaacattgcccaggccgtggttaagagactggctggtctcggagaaggttggctcacgattttcagagaaccttttactggcgcttggcagcaaaatatggcgcttagccgagaagaggtattaacttaccatcctgttttttcctgtgtgacattaatcgcctcagatattgctaaaatgcccttgttattaaaacgaaaagggcatgatgggatatggcacgagcaaaataaaggtgcttacacggtgatagtgacacctaactcgctacaaaccaggaatcaattttttgaaaattggctcaattcaaaattgacgacggggaatacatttgtttttaaggtgcgaacacctaaaggaaaagtgcaagaactgaaaatactggatccaaaccgcgttaaaccactgataaccgataaaggggaggtgttctaccaattatctacggataatatttcaggaatagcgcaatcggtgacggttcccgctagagagattatccatgatagatttaattgtctctatcatcccttaatggggttaccgcctgtttatgcgtgtgcattatccgcggcacaagggacagcgatcatgaaaaatgccacacatctctttgtgaatgggggcaagcccagcggtgttatcgaagtgcctggcaaaatcagtgaagaggacgctcacacgctaaaaaaattatgggagacgaattatggtggtaaaaatgcgggtaaaacagcaatattaacagagaatgccaagtacaaaaccctttcatttaacccagtcgattctcagttagttgaacagttgagattgacggctgaaattgtctgttcggtgtttcatgttcctttgtataaagtcgggctaggagaggttccctcatacaataatgttgaagcattagatcagcaatactattcccaatgcttacagtctcatatcgaagctattgagatcttattggctcaaggtcttgatttaccgttgtttgaaaaaattgaatttgatttagacacattaatgcgaatggataccgcaacacgctttaaagctcacaatgaagggattaaaggtgggtggttatcgccgaatgaagtgcgtaaaaaggagaatttagcgcctgtcgagggcggagatacaccttatttgcaacaacaaaattatagtttggcggcgttatcatggagagataaacaaaaaatgccgacatcctttgataaaagcgagttatttgtggagaccgtgaacgaagcatcggtgcaggacgaaaaacactattttgcggagtgtatcaagtga

SEQ ID NO: 3566 - DNA, 1395 bp, Proteus mirabilis
atcctcgtattacaacccagcgcccctttgatttccttctgttatggtgttggcgtgcttgaaggcggtgaattaccgacaagtcattatgcacgtttacagcaatttaaaaaatggggattacctgttagtgatgctattaaattatgtaccggaactaaagctgtacttgatttttaccatcatgtagcagaaattcaccctaatctaggctttgatattgatggtgtggttatcaaagtagatgatatagctctacaagaagagttgggatttgtgtctcgtgctccccgttgggcgattgcttacaaattccaagcccaagagcagatgacggtgattaaagatgttgaatttcaagtggggcgtacaggggcgattacacctgtcgctcgtttagatcccgtacaagtggcaggggtaatagtcagtaatgccacacttcataatgctgatgaaattgaacgtttaggattacgtattggtgatacggtggttattcgccgtgcaggcgatgttattcctcaggttgtgagtgtgattgaagaaaaacgccctgagaatgcacaagaaattgtttttccaacccaatgccctatttgtcaatctgatattgagcgtatagaaggtgaggctgttgcccgctgcacggggggattaatttgtgcagcgcaacgtaaagaggcgcttaaacatttcgtttctcgtcgtgcgatggatgttgacggcatgggagataaaattatcgaccaattggttgaaaaagagtatgtcaaaacaccggctgatttattccgtttagatgaaaagatcttatctggtttagaacgtatgggggagaaatcagccaaaaaactgcttaatgcattagaaaaagcaaaatcaaccacttttgcccgttttatctatgcccttggtattcgtgaagtaggagaagcaacggccaatggattaaccgctcattttgtttcattagaggcattacgtgaagcaaatattgaagccttaaaggcagttcctgatgtgggtgatattgttgcaaagcatgtggttaattttttccaagaagaacataataaaaatgtgattgatcaacttgttaatgacattggcattacttggccggcaccggttgtggctactcatgaagcaggtgataatccttttgctggtaaaacagtcgtgctgacaggctctctttctcaattaacgcgagatgaagcaaaagatagattagttgcacttggtgcaaaagtgagtggtagtgtttcgaaaaagacaaatatggtcattgctggtgaagcggcgggttctaaattagccaaagcaaatgaattaggtattactgttattgatgaagacgaaatgatccgcttgcttgatcaatctaaataa

SEQ ID NO: 3567 - DNA, 222 bp, Proteus mirabilis
agcaacgtattcccttttatgtcctcaatggctcactttatttttaaatctttctgcattcacattaataatgtgatgaatttcaaattttatttattgattttcttgacttattttatgaacattatcacaacagcgaacgcacgttataccgtgttaatatcaataaatcataatccatatttagcccacgtttgtgtaggcttttttttaacattgtaa

SEQ ID NO: 3568 - DNA, 606 bp, Proteus mirabilis
aatggagtatttataatgcctaaattttggttacccttgtgcttaagcacaagtgtcttgctattaagtggctgttcatccatggggggaatgtctttttctgcacttaatccaatgaattggttctcaaatgagacgttaacggtttctgcaaatggattaggtaatatcactgcttcaacggcagtgacagagcaagcgatcgaaaaagagttgggtagccgtttccattaccgacaaggaatggaaatgcaacaaggcaatattatagttattgtgcaagcacttgaagatgaaaaagtacaagtggctttttatggccaagaaaagggcacagtagataaaatcacggtatctgatcctaatgcgaaaacagcgtggggaacgacaataggtacaccatttaaagatatttataaaaaagcatttggtatgtgcagtaacgggccgaaagttgataagcaaaaaaccattcaatgccaatcagaacaagcaaaatcagtgagctatgtttttgctgggcaatgggatggccctgatggtctaatgccacccgatgaaacattagcaaattggcaggtaacacaaattgtttggcaaaaatag

SEQ ID NO: 3569 - DNA, 258 bp, Proteus mirabilis
tccttatcattccttctcgataaagcgatagagatcatgctagaaaaacagcatcttatagatatagccaacacacaaatgccatttggtaaatataaagggcgaatgctggtggatttacctgaagagtatttattgtggtttgccaagaaaggcaccttccctgaaggaaagctagggcaactaatggaaatgaccctagcaattaaaattgatggcttagaagggttactaaaaccattaaagcagtcgcattaa

SEQ ID NO: 3570 - DNA, 1101 bp, Proteus mirabilis
tattcgccattgtggctattaaacctcaagacaacagagatagaaatgatgcagcaaaatttgcgtctgatattaatcgttgttggtgcgattttaatcatagctttgttattacacggcttatggattggtcgaaaagagcgttctaagcttttccgtaatcgcccagtaaaacgtcagaaacagaattatcagtcagatgagaacgatgatgaaccccagtatactgaggcaaatcatcagatgtcgtctttaacttcaacgcaggaggctcaaagtgtgccaccggttaaatcggagccaacacttgcgccacaatcctcagttgcagataaagatccacttatgtctggaacaccagcacagggacattctaacgatacttcattacaacgagagcctagtcttggtgtttttgatgttattgaacaaaataatgactctgcgcctcagcaaaaacaaccgatacccgaggtagaggtaaaccatgctgatgtaaaagaaggtgatattagtgagacaaaacttgccgatgtagagccgataccagaatcgtcgaactctgttgctagtgatgaaatacataccactgatacagataggccattggatgctgaaacctcatcggatgtgaaacaagctgagcaagctttatccggatcagaagagccaaaagcagaggaagagctggtattagtattaaatgtcagcgctcatcatggtcaaatgcttgacggtgaggtgttaatgcagagcattattcaagcgggtttccagtttggtgcgatgaatattttccatcgacatcttaacccgacgggtaatggccctgtattgtttagtcttgccaatatggtaaaaccgggtactttcaatattgatacgatggctgaattaaccacgcctggcgtatccatgtttatgatggtgccatcttatggtgatgctaatcaaaactttaaattgatgttgcaagcagctcagcgtattgcctctgatgtgggcggtgttgtgcttgatgaagagcgcaaactgttaacaccacaaaaaattgaactttataaatctagaattcgtagaacactagatttacatcaatag

SEQ ID NO: 3571 - DNA, 1200 bp, Proteus mirabilis
tttatccaattaaagggatcttcagacatgcaactgcgtaaaactctcctgatcggtctactagcatcagcattattagctgggtgttctagtgagcaggataatgtgacaatgtctccattgcctgaggtgcagagccaatttaccccttatgtggtgtgggacaaatcggttggcaatggtattggaaaatactattcccacttgtcaccagcatgggatggttcagttgtgtatgtcgctgatcgccatggggtagttaaagcattagaattagaaacgggtaaagagatttggtctcaagatctctcaactaaaaaaggtttcttctcctctaatgaatcagcattactttccggtggtttaaccgtctctggtactcgtgtttttgtcggcacagaaaaagcaaaagtgtatgctttaaatacagatgatggctctattgattgggagacagatgttgccggagaagcgatttccaaacctgttgttagtgatggtttagtgcttattcataccagtaacggtatgttgcaagggcttgatttgctgacaggtgaagtatcatggacggtcaacttagatacaccatcattatccgtacgtggtgaatcagcaccggctgttgcttatggtgcagcgattgtgggcgctgataatggccgtgttagtgcggtggtgttatctcaagggcaattagtttggcagcaaaatatttcacaagtgaaaggttctactgagatcagccgcttaaatgatgtcgatattacgccaattattgatgaaaatactgtttatgccatggcttacaacggtaatttagtcagtctagatatgcgttcaggacagatcatctggaaacgtgatttaggttcagttaatgacatggtacttttgggtgacaatctataccttgttgaccaaaatgaccgagttttagctgtgcgcaaatctgatggtgtgacattatggacacaagaagatctactgcaccgtaatttaaccgccccggctatcgttgatggttatttagtggtgggagatgcagaaggctatctccattggattgataccagtacaggcaaatttattgctcaaaataaagtaaatagctcaggtttattaagccgtccacaggctgttcaagataaactgatgatccaagcacgtgacggtaaactttatctatatcgtcggtaa

SEQ ID NO: 3572 - DNA, 234 bp, Proteus mirabilis
gaggataaattaatggctgtcattcagaaaattaatgtgggcgaaaaagccaatgatggcacaggcgatacgttgcgagacgctttcgtaaaagccaatcaaaactttgaagccttaaatactgctgtgcagaaagggggagctgatccgaacggtgacttaggaaaagagctttctaaggagcttgaggcactcacattacgtgtcgaatcgcttgaaaagacgaaagagtaa

SEQ ID NO: 3573 - DNA, 234 bp, Proteus mirabilis
aattatttttctctattgctttgctctataaatctggctttagcgtcgttcatggacacaaagcgaaaactctatattgcaggagttatgattgatgacgcattctacacactagagacattatactcaaagaaacgttcatcaaacacaaacatttatgataaagcttacctttatttatgcatcgtaactgcactttcactagatagaaatttgatttttatctatcaataa

SEQ ID NO: 3574 - DNA, 1218 bp, Proteus mirabilis
gcaatgaaattacccatttatctagattattcagcaaccacacccgttgatcctcgagttgctgaaaaaatgatgcaatgcctgactattgacggcatttttggtaacccagcctctcgttcgcaccgttttggatggcaagctgaagaagcgatcgatatcgctcgtaatcagattgctgatcttattggtgctgatcctcgtgaaattgttttcacctcaggggcaactgaagcagataacttggcactaaaaggtgttgcaaacttttatcagaaaaaaggtaagcacatcatcacatcaaaaactgagcataaagcgattttagatacttgtcgtcagcttgagcgtgaaggttttgaagtgacctacttagcaccaaaaagcgatggcttaattgatttgaaagaactcgaagccgctatgcgtgacgacactattttagtttctatcatgcacgtgaataatgaaattggtgtggtgcaagatattgctgctattggtgaattatgccgtagcaaaggcattatttaccacgttgacgcaacgcaaagcgtcggtaaattaccaatcgatctctccaaattaaaagtcgatttactttctctttctgcacataaagtttacggacctatgggtattggtgcgctttatgttcgccgtaaaccacgcattcgcttagaggcacaaatgcatggtggtgggcatgagcgtggtatgcgttcaggtacattagccgttcaccaaattgtgggtatgggtgaagcttaccgtatattgaaagaagaaatggctgatgaaactaaacgtttaaatgaattacgtttacgtttatggaatggcatcaaagatattgaagaagtgtatatcaatggttctttagaacatacagcgccaaatattcttaatgtcagcttcaactatgttgaaggtgaatcattaatgatggcactgaaagatcttgctgtatcttcaggttcagcctgtacatcagcaagtttagagccttcttatgtactacgtgctttaggattaaccgatgaattagcacatagttctattcgtttctctttaggtcgtttcaccactgaagaagaaatcgattatgcaattgaacaaattcacagtgcaattggtcgcttacgtgatctttctccactttgggaaatgcataaacaaggcgttgatatcaacagtatcgaatggtctcaccattaa

SEQ ID NO: 3575 - DNA, 1731 bp, Proteus mirabilis
attatgatttcaggaattttagcttcaccgggtatcgcatttggtcaagctcttctacttaaagaagaacctattattattagccaacgtaaaatccaaagtgacgaagttgacacccaaatcgaacgttttaaagatggtcgtaataaatcagcgcaacaactagaaatcattaaagcccgtgctgaaaaaaatcttggtgccgataaagctgagatttttgaaggccatattatgttattagaagatgaggaactcgaacaagagatcatatccctcatcaaaagtgacaagaaaaccgcagaagcagcggttcaatctgttattgaagatcaggcaaccgcattagaagccttagatgatgagtacttaaaagagcgtgcggctgacgttcgtgatattggtaagcgcttaatgcgtaatatcttagagatgccaattatcgatttaagtgctatttctgaaaaagtgattttagttgctacagatttaacgccatcagaaacagcgcagcttagcttagacaatgtgttaggctttatcactgacttagggggcagaacatcgcacacctctatcatggcacgctctttagagatcccagcgattgttggcacatctaatgcaacagaaaccattaaaaaagaagattatctggttcttgatgcgattaacaataaaatcattattaatccttctgatgaagagctcgaagcattaaaggctatcaaagaagagtacctacatgaaaaagaagagctggcaaaactaaaagatttaccagcaattacccttgatgggcatcaagttgaagtttgcgctaatataggtactgtacgtgatgtcgcaggtgctgagcgtaatggtgcggaaggtgttggactctatcgtactgaattcctatttatggatagagattccttaccaacagaagaagagcaattccaagcttataaagctgtggctgaagctgtaggcagtcctgcggtcattatccgtactatggatattggtggcgataaagacttaccttacatgaatttaccgaaagaagagaatccattcttaggttggcgtgcaattcgtatttgtcttgaccgcaaagagatccttcatccacaattacgtgctatcttaagagcgtctgcttttggtaaactacgtattatgtttccaatgattatctctgttgaagagatccgagcattgaaagcggaacttgaaatactgaaaagccagcttcgtgaagaaaataagccttttgatgaatctatcgaagtcggtgttatggttgaaacgccagcagcggctgttatggctcgccatatggcaaaagaagttgactttttcagtattgggactaacgatctaacacaatatactctggctgtagaccgtggaaatgagctgatatctcatctatataatccaatgtcacctgctgtacttaatctgattaaacaggtgattgatgcatcacacgctgaaggtaaatggactggaatgtgtggtgagcttgccggggatgaacgggcaacaatgttgcttctgggcatgggattagatgagtttagtatgagtgctatatcaattcctcgcatcaaaaaaattattcgtaacgcaaattttgatgatgcaaaagcactggcagagcaagcacttgctcagccgactgcaaaggaattaatggacttagtagaaacttttactaaagaaaaaacactgtgctaa

SEQ ID NO: 3576 - DNA, 222 bp, Proteus mirabilis
cgtacaccttcaaaatgggctattactactaacgcgatggctgtggctcctgctgttgttaccgccgctattttctgtttgagagacattaaatatcctttggcgctttcaccattaattcagcaaacctttttagggtttcagttgggttttgtgggtcaacatgtcgaacaatctcttcaaataattgagtgcgttttcgttgttctcgacgagtcataa

SEQ ID NO: 3577 - DNA, 216 bp, Proteus mirabilis
acaaccggctcaatgtctaagagtgaatcacgaagtaccacttctaatgtctgctcatcacgcttaataagttggtgcaagactaactggttaatatctagactcatgggcgccctcctttatcccgattctttttgtgcgcgtattcaaacatcccctacttttactatcaaggggtataaccgcaaaataattaatttaatagcagaaaaataa

SEQ ID NO: 3578 - DNA, 396 bp, Proteus mirabilis
gctaaactatcgttttatccttctgttatacttcctcctaaatcaataaataaggctagtcaaatgaagaagcttttatttctacttatatttacattggctgggtgtgattctcaaagtgagatctatggtcactggaaaaatataaatagtgattgtgatgttttgtgttctttttccataaaaaaacaagataccgcttattcagatgcagttgttatttttgataaaggccctttttataaggctgctagtggcccattaattcaagataaaaataacaaaaataggtatttagtcagaggtgctacaggtgacttcttgcttgttttaaagaacggtaggtttttcggcaccaataacaactttatctatgaaaagataagcgaagaataa

SEQ ID NO: 3579 - DNA, 927 bp, Proteus mirabilis
acaaggagattagccatgctagaattactcctacaaccttttgagtataactatatggtaaaggctatctgggtaagtgccttagttggtgctgtctgtgcctttttatcttcttaccttattcttaaaggttggtcattaatgggagatgccctctcccactccgtcgttcccggcgttgccggtgcttatattttagggctgccatacgcagtgggtgctttttttacgggtctacttgctgctttatcaatgacttttattcgtcacatcacacgattacgtgaagatgcggtgattggctttattttttctactttttttgcttttggtctgttgctggtttcattaaaccctactgccgtcaacgttcagaccattattttagggaatattctcggcattgctgatgaagatgtctggcaagtcgttatcattactggtgtctcttttcttattctattttgtatgtggaaagatttattagttgtattttttgatgaagtacatgctcgctctattggtttatcccctttaaaactaaaaatcatcttctttaccttgctcagtgcatgtaccgttgctgcgctacaaacggtcggcgctatcttagttattgctatggtggttacgcccggcgctaccgcttatttactcactgaccaatttaaacgactcgctattatcgctatttgtattggtacagtaaccagtgctgttggtgcttatctaagttatttctttaatggtgctacggggggcgttatcgtcacaatgcaaaccgcccttttcttattagccttcttatttgcgcctaaacatggcatgttggcagcccgtcgccgcgcacgtcaaagttcacaagcacttatttcacaatcccagcatccaaaagacgttactcaacaagaagaggtgcaactatga

SEQ ID NO: 3580 - DNA, 1437 bp, Proteus mirabilis
ggaaccttgtcaaattcagctaatacccccactttctatatccatgactacgagacctttggtacgcatcctgcgatggatcgccctgcgcaatttgccggtgtcagaacagatatggattttaatatcattgaagatcctctggtcatttattgcaaaccgaatgatgattacttacctcagccagaagccgtcatgataacggggatcacaccacaaatagcactaaagcatggtgtatcagaagctgaatttactcgccaaattcatcaagcctttagccagcctaacagttgtattatgggttataacaatttacgctttgatgatgaagtcaccagaaatatcttataccgtaatttttatgatccctatgcttatagttggcaaaaaggaaattcacgttgggatttacttgatgttttacgtgcatgttatgcattgcgtcctgagggaattaattggcctgagaatgatgatggttttccgagttttcgccttgagctattaactaaagcaaatgggatctcccacgaaaatgcgcatgatgccatgtcagacgtttatgcaactattgcgatggcaaaaaaactcaaacaagcgcaacctcgtatgtttgattatttctttaatttacgtgataaacgtaaagtacaagcactgatagatatcccaaccatgacgccgcttgtgcatgtctctggtatgtttggtgcagcgcgttctaatttaagccttgtagctcctttagcttggcatccagataatcgtaatgcggtaattgtttgtgatttagctgcggatatttcccctttattaaccctcacttcagagcaattgcgtgagcgcttatatactcctcgcagtgagttatctgccgatgagccaccagttccgataaaattactgcatattaataaatgccctatcgttgcacctaaaaataccctcagatctcaagatgccgatagaattgggttagatattgataattgtttaaataaccaagcaatattgctgtctaatcctgagatccgcaataaagtcgtcgagatttttgctcagcaaacaccatttacccctgcagatgatgttgatgctcaattatacaatggcttttttagcgataatgatcgtagcgcgatggaaattattcgctcaacacagccacaaaacttaccagcacttaatttaacttttgaagatccacgtatggagccgctgtttttccgttaccgtgcgagaaacttcccagccacattaacttatgatgaacaacaacgttggttagcgcatagaaaagagcaattaacgccagaaaagctgactgaatatatcaataccattcagctgttagcagaagaacatagcgataacgaagaaaagctaaaacaactgcaagagctatatttatatgctcaagaaattgcgagttaa

SEQ ID NO: 3581 - DNA, 1314 bp, Proteus mirabilis
cgttatatgtcattaacaaaaattgttatagtcggtggtggagctggtggattagaactagcgactaaattgggtgataagttagggcgcaaaaaaaaagcagaaattacccttgttgatagaaataatagtcacttatggaaacctctgttacatgaagttgccacaggctcgttagatgatggtgttgatgcattaagttatctcgctcatggttataaccatcactttaattttcaattaggcactttaacagggcttgatcgccaacataaaaatatcactttggctgctatttatgatgaaaatcaagagctattagttccagagcgtcaactcgattatgatattttagtcatggccttaggcagtaaatctaatgattttggcaccccagggatcaaagagcactgcatctttttagatagcccacagcaagcacaccgttttcataatgaaatgctcaatttatttttaaaatattcagcagactccaacgcagaagctgaaaatcgtaaagtaaatattgcgattgtgggtggtggtgcaactggagtggaattatctgccgaattacacaatgctgttcgccaactcaatagttatggtttaaaaaaattagcgccatcagcccttaatatcacgcttgttgaggcgggtgagcgaatattacctgcattacccgtgcgtatttcaagtgcagcacaccaagagctgactaagttgggtgtgcgcgtgatgacgaaaaccatggtaacaagcgccgatgaaaaagggttaaataccaaagatggcgagcatattgatgctgatctgatggtttgggctgcggggatcaaagccccagactttatgaaagatatcgctggattagaaaccaatcgtattaaccaattagtcgttaagccgacattacaaacaacattagatgatgcgatttttgcgattggtgattgtgcatcctgtccgcgaaaagagggagggtttgttccgccaagggcacaatccgctcatcaaatggcaagccgttgttatagcaatattttagccatgttaaagggtaaaacgttaaaagaatatgtgtttaaagatcatggctcgttagtttcgctctctaaatttagtacggtagggagtttgatgggcaacttaatgaaaggcgatatgatgatagaagggcgtattgcacgtatcgtttatatttctttataccgtatgcatcaaatcgcgttacatggttatcttaaaacgggtttgatgatgttagttggatcaatcaatcgtgtgattagaccaaaactaaaacttcattag

SEQ ID NO: 3582 - DNA, 1071 bp, Proteus mirabilis
gtaaaagagtcttttatactcaaaaatggaaactactttatgaacgataaaaaaaccattaacacgcacacccctttacttacgaatattcgaaacctcttgatacaaggtagaaaaaacacagtacaagcagtaaacagcataatggtacaaacatattgggaaatcggtcgtttaattgttgaagatgaacaacatggagataatcgagcaaaatttggaaaaagagttttacaaactttatcagctgaattaacaaaagaatttggtaaaggatttgatacctcaaatcttcgatatatgaggaaattttatctcacatttccaattcgtgacgcagtgcgtcacgaattaagttggactcattatagaacgctactaaaactaaagaatgaactcgcccgtcaatggtatatagatgaagcaattacacaatcttggtccgcccgtgcattagaaagacaaattagcacattatattatgaacgattactttcaacacaggggaaacagcaaagtatttatcctgtattagctgaaggaaaacaaaaaactactgaactcgcaacttcagtcaaagattatttacgtgatccctatatttttgattttctaggactacctagtagtatcctgcaagaaaataaactagaacaaactttaatagaaaacctaaaagaattcttactcgaattaggaaaagggtttgcttttgtcgaacgacaacaacgtattagtactaatgatggtgatttctatattgatttagttttttataactttcacttaaaatgctttttgttaatagacttaaaaatgcataaactcacccatcaagatgttgggcaaatggatatgtatgtccgcatgtatgaagagaaaaaacgccgtcatgatgataatccaaccataggactaattctttgcactgaaaaaaatcacacagtagccaaatactccattctaaatgaaagtaaacagctattcgcttcaaaatatatgcttgaattaccaagcgaaaaagaattaattttacaattagaaaaagaacgccaaaaattatttgaataa

SEQ ID NO: 3583 - DNA, 183 bp, Proteus mirabilis
ggagtaaggtcaatggccgtacaacaaaacaaaccaactcgttctaaacgtggtatgcgtcgttctcatgacgcactgacagcaactcatgtttctgttgacaaaacttctggtgaaactcacctgcgtcaccatgtaactgctgacggttactaccgtggccgcaaggttatcaacaagtaa

SEQ ID NO: 3584 - DNA, 336 bp, Proteus mirabilis
aaacacatgtttgtatttaacggacaacaaatcgagacagatagtcacggttatttaaaaaacagcaatgaatggaccgaagagatggtgccaatattagctgaacttgaagaaattgaactcacagagcaacattgggaaattatccgttttgtgcgccagttttatttagaatttaatacctcaccggcgatccgaatgttagtgaaagcattagcacaaaaatatggcgatgaaaaaggcaatagccgttatctatatcgcttattccctaaaggtcctgctaaacaggcaacgaagctcgcgggcttacctaaacctgtcaaatgtatttaa

SEQ ID NO: 3585 - DNA, 1938 bp, Proteus mirabilis
tttacaatgccgttaattagtttgactggggcttatttagcgtttagtgatgcccctttattagataatacagacttgtttattgatgaaaatgaacgcgtttgtttagtcggtcgcaatggtgccggaaaatcgaccctattaagagtgttagccaaagagcagcccttagatgatgggcaagtggtgtatgaacaagatctggtgactgcacgtttacaacaagatccccccagagatatcgaaggcactatttttgattttgtcgcgcaaggcgttgcagaagatgcgcaatatattaccgaatatcatcgtgtttcaaaggtaatagaaacggacccttctgaaaaaaatcttaatcgattagctcagttacaagaagtgctcgataaccgtaatctctggttattagatagccgtattgctgaagtattggaaaaattagggttaaatggcgaagctgagctttcctcactttctggaggatggttaagaaaagccgcattagggcgcgcattagtgagcgcaccgaaagtgctctttttggatgagcccaccaaccatctagatatagaaactatcttatggttagagaaattcttaaaggatttccaaggtagcattgtctttatttcccatgaccgatcatttattcgtaatatggcaacccgcattattgatttagatcgcggaaaactatcctcatggccgggaaattacgataaatatctggaaagtaaagaagaggcattgcgtgttgaagagcaacaaaatgctgagtttgaccggaaattagcgcaagaagaagcatggatacgtcaagggatcaaagctcgccggactcgtaatgaaggtcgtgttcgggcattaaaagcattgcgagttgaacgaagtgaacgtcgcgaagtattaggtagtgctcgtatgcaggtcgaagaagcaacgcgctcaggtaaaattgtgtttgaattagaagatgttaattatagcatcggtacgcgtaggctcgttcgggacttctctgcaaaagtacaacgaggagataaaattgccttagttggccctaatggttgtggtaaaaccacactactcaaattgatgttaggggatttaaaagcagatagtggtcgtattcattgcggcactaaattagaagttgcttattttgatcaacaccgtgccacacttgatcctgataaaacagtgatggataaccttgcagaaggtaagcaagaggtgatggtaaatggtcgtcctcgtcatgttttaggttatttgcaagatttcttatttccaccaaaacgtgccatgacacctgttagagcactttcggggggcgaaagaaatcgtctattgcttgctcgtttgttcttaaaaccaagcaatttacttattcttgatgaaccaactaatgatcttgatgttgaaacattagaactattagaagagctggtggatgcttatcaaggcactgtgttgttggtcagccatgatcgtgaatttgttgataatagtgttacggagtgttggatctttgaaggtgatggcgtaatcaatagctatgttggtggctattatgatgcgcagcagcagcgggcacagtctgtttctcttaaaaatgaagcgaataagtcacgtaatgcaccagaaaaaactgaaaaagagactaaaccaaaacagaacgccaaaaaggctacacgaagtaacaataagttaagctatcatttgatccgcgagcttgaacaactgcccgctaaactggaacgtttagaagaggaattaggttgtttacaagaagaagtggctgcagctgatttctttacacgtcctcatgaagagacagaaaaagtgctaaaagcattagctgataaggaaaatgaacttgaaacagcttttgatagatggcaagagttggagatgatgcaaaacggtgaataa

SEQ ID NO: 3586 - DNA, 201 bp, Proteus mirabilis
atggccgcgttccaattaatactggttatttttggcggtgttggtacaacctctatgggtggctcgataggtttaggtggctctgttggctctgtgggagtaacaggctctacaggtgctgggggttgttgtggtaacatcgatggacaacctgccagtaaaaataccgctgccaccacaaatagcatttttttcatatga

SEQ ID NO: 3587 - DNA, 1017 bp, Proteus mirabilis
aggagggcgcccatgagtctagatattaaccagttagtcttgcaccaacttattaagcgtgatgagcagacattagaagtggtacttcgtgattcactcttagacattgagccggttgttcaagagatggtcgaagagttacatcgtgtttatagtgcaaaaagtaaagcctatggtttatttaatgaagagagcgaattagctcaagcattacgtttacaacgtcaaggtgaagaagaatttttaggtttttctcgtgcagcgacggttagacttaaagatgagttagcgaaatacccttttgctgaagggggaacggttcttttttgtcattatcgttatctcgcggtggaatatttattaatcgctgtattgaatagctgtaatagcatgtgggtcaatgacagtcttgatgtatcttcaacacgctatttagatattcctcatgcagatattatcgctcgtattgatttaactgaatgggagacttcacccgattctttacgttatttaaccttcttaaaagggcgtgtaggacgcaaagtttcagatttctttatggactttttaggggcgcaagaaggtttaaatactaaagtacaaaataaaggcttattacaagcggttgatgacttttgcgaagcatcagacatgaataaacaagagcgccaaacttgtcgtgaacaagtctacagctattgtaatgagcaattgcaatcgggtgaagagattgcattaactgaacttgcacaagagttaccgccattaggtgatcaaaactttgcacagtttacagaagaaaaagggtatgaattagcggaaacttttcccgcagatcgcagtacattacgccaattaatgaagtattcaggaagtggtggggggttaacggttaattttgatgcgaaactgttgggggaaagaattttttgggatcccgctaccgatacactgacgataaaaggaactccacctaatttacgcgaccagttacagcgtagagtctcagaaaaatag

SEQ ID NO: 3588 - DNA, 267 bp, Proteus mirabilis
catatagcgttttatccatttagtaggaattcagattttatgccacaaaaatcccgttatagtgatgaacaagttgagcaattacttgcagaacttgtcagcgttcttgaaaaacatcatactcctacagatctttctttgatggtgttggggaacatggtgacaaacttaatcaatacaagtattgcccctgctcaacgaatgctgattgcagactcttttgttcacgctttacgtgcttcaattgatgaaggcaatattcactaa

SEQ ID NO: 3589 - DNA, 465 bp, Proteus mirabilis
aatcgcaagcctctatttttttatccgtatgctattttggagtctctcatgtctgtagtcgttggtgttggagtgatcatcgtcaatgaaaaaggtgaagtattattaggtaaacgctgtggtaaacacgccccttattggtcaatttttggtggccatgttgatccgggggaaacctttgagcaatgtgctattcgtgaaattgaagaagagattggcattaccatccctactcctgaagtgattgggatcagcaacaatctacaaacttatcaattagaaggtaaacataccgtatctatctgtatgctagcgcaatatcaaggtggcgagcctaagttaatggagccagataaatgttctgaactacgctggtgctcacctgatgatttacctgaacctcattttgaagcgagccgtaattctattgctttatggaaaagtaaacgtttctatcaaccttaa

SEQ ID NO: 3590 - DNA, 192 bp, Proteus mirabilis
cgactggcttttgccattaatgctggaattatcgccgcccaaattgtggctgcaagtcctgcaaagccaatagcatacaagaagccatcaggaaaaataatcgctaaaatagtaggtggtacaaaagttacgatggccgattttaaacgtcctgtccctgtatttgagaatttaaagaaatcagctaaataa

SEQ ID NO: 3591 - DNA, 567 bp, Proteus mirabilis
tacgagtatactggtctgcattataatacgttcaggtactatgccccggatttaggccgttttacccagcaagacccaatagggttggcaggggggataaacttatatgcttatgcgccaaatccattgacatgggtggatccgtggggttgggctaagctgtttgcattaggtacttatggtgaattaaatggttctgtgcatgtgggcgatcaattacaggctcatgaattattgagacacgaatatttaaaacaacaaggccttgcaaacacatcacggttatctggaaatccatctatagctttagacctagatcatcatactagaggcccgttgaaggatactagaggaattgggggggctcattggcatgaagctgaaattcgagctaatcaagggctaggtaaaaatgagtttgcttcaacactaaaacgtgaattagatataacatcaggtggtttaagaaaatcaggtgttcctgctagtcgagttaaacaattaagacaagaagcattaaaattttataaacaacaagttgctgcaaaagtaaaaagttgtaaatag

SEQ ID NO: 3592 - DNA, 525 bp, Proteus mirabilis
tacgagtatactggtctgcattataattataatacgttcaggtactatgccccggatttaggccgttttacccagcaagacccaatagggttggcaggggggataaacttatatgcttatgcgccgaatccattgacatgggtggatccgtgggggttagcgggctgtcctgtcgatatattaaagaatgctagaaaaaataatcatgccatttcagcagaacaaaggcagcaaataatagattcaatagagaatcctaagctgcaaaaaatgtttaaagaactatatcggccaggtgcaaatattcctgatggaggtacagtagcttctattctgtatacaaagaatactggacaattagtcggcggttcagaccatataaataaaggtaaggattatttaacagcgttgaaaaatttatctagtggtaatggaaggtataaaaatgaggctctaagcccatcggatagaagcttagcaagttacatgataaatgatttaaggaacgcattggggcatttatga

SEQ ID NO: 3593 - DNA, 1050 bp, Proteus mirabilis
ctcgttgatactttgacaaatctaaccatagcgttagatgcgatgggcggggacttcggtcctcgtatcacagtgcctgcatgtttgcgggcgctggcatctaatcctcatttaaaaatattgctggtgggtcaaccagactctatctctcctctgcttgcaaatcaaaatgctgagctaatctcccgtttacatgttataccggctgaacatattgtcgccaatgatgccaaaccttcacatgctattagagcaagtaaaggcacatcaatgcgcgtggcactcgatctggtgaaaacaggggaagcacaggcatgtgtaagtgcaggtaacaccggtgtgttgatggggttagcaaaacttcggctaaaagcgattgatggaatagaacgtcctgcattggtttctgtgttacctaatcagaaaaaaagcaagaccgtcgttcttgatttaggcgcgaacgttaactgtgatagccaaatgttagttcaatttgctgttatgggtgccgtgatggcagaagaaattgcaggtatacattcacctaaagtggcacttttaaatattggtgaagaagagagtaagggattagataatatccgcgaagccgccaccgttcttaaggcgacaccaaatataaactatattggttatgtggaaggtaacgagttactgaccggcaaaacagatgtgttggtgtgtgacggcttcgcaggtaatgtttcccttaaaacaatggaaggggtgattagagtcttcctttcattgattaaatcttctactggtgacaataaaaaaacgtcgtggtggatgaaattattgaagaaatggttacaaaaacgcctaaataagcgttttggccatatgaaccccgaccagtataacggtgcttctctgttaggattacgcggtatcgtcattaaaagccatggtggcgcaaatgaaaacgcgtttacagcagcaatagaacaggctgttcaggccattgagcgacaaattccagaacgaattgcctcacgtctgaatacagtattacccaagagtgattga

SEQ ID NO: 3594 - DNA, 2088 bp, Proteus mirabilis
agttctgatacggaggccaaccagagcatgaacaaacttttaaatgtggcttttgctatcggattagcgttaacaggcacttccgctgtcatggctgataaaccagccacgccagccatggtgactattaatcaattaccgacattaaagcaagagccacaacattccacagtgagtgaacgtgtcaccgctcgttttgaacgttcccactatcgtcaattctcgttagacgcgagtttttccgaaaagatttttaatcgttatcttaatttattggattatagccataacgtattattagcgtcagatattgcccagtttgataaagataaaactaaagtgggtgaatatttaaaaacaggtgaattaggtcctttatatgatctgtttaaccttgcgcaaaaaagacgttttgagcgctttcaatatgctttaaatcgattaaatcaacctatcgatctcactggacaagataaatttcagttagatagaaccaaagcgccatggccgaaaacgcgagctgaattagataagctttgggatgaaaaagtaaaatacgactggctaacacttaaactctctgacaaaacagacagtgaaatcaaagaaacactgacaaaacgttataaagctgcattacgtcgccaaacacaaagccaaagtgaagacgtattccaaattatcatgacggcttttgcgcgtgaaattgatccccataccagttatttatcaccaagaaatacggaagcctttgattcagaaatgagcctttcattagaagggattggtgccgtattacaaatggatgatgattatccaatgattaattccatggtaacgggcggaccggctgctaaaagtaaagcgctaaaagtaggtgataaaattatcgctgtcggtcaacataataaacccatggttgatgtggttggttggcgcttagatgacgttgtcgcgctaatcaaaggccctaaaggtagccaagttaaactagaagttatctctgatgaaaaaggggcgaagccaagaactatcactttaacaagagaacagatccgcctagaagatagagcggtcaagttaaccgaaaaagtgattaatggtgataaaatcgctattttagatattcctagtttctatgtcggcttaactaatgatgtgaaaacccaactacaaaaagtggctaaagacaatgtatctgctttagttattgatttacgtggaaatgggggcggtgcattaacggaagctattgcattatcgggtttatttattccaagtggtcccgtcgttcaagtccgtgataataatggtcgagtacgccaagattatgatcgtgatgatgttgtctattataaagggccactagtggttatcgttaaccgctttagtgcttctgcttctgaaatttttgctgctgcaatgcaagattatgggcgcgcattaattgttggtgagcaaacctttggtaaaggaacggtgcaacaatatcgttcattgacacgagtttatgatcagatgttaagtcctgattggcctagtttaggttcagttcagtacactatccaaaaattctatcgtattaatggtggaagtacccaattaaaaggggtgacaccagacttgttattaccaagctttgataattcagaaatgggggaaagcaatgaagataatgctttaccttgggacagtattccaccggctaattataagctgtctgagtattcagagaaaataaaacaagcactacctacattggcggatcaacatgctaaacgtatcgcgaatgatagagagttttcatatatctttgacgacatcaagcgctacaatgaagctaaagccaaaggtgaagataagtttattattcttaattttgcagagcgcgaaaaagagaataaagagctagaagccataaaattacagcgtattaaccaacgtcttaagttagagggtaagccaccactaaaatcacttgatgatttgccgaaggattatgaaggccctgatccttacttagatgaaacggctaatattgcggatgatcttgcaaaggtattaaaacctaagaagttattaaattaa

SEQ ID NO: 3595 - DNA, 327 bp, Proteus mirabilis
ataggtgatactatgattaagcttgaaatcaataatacggaatatattgctcagttagaagaagctcgtttatctgtagataaccctcgtggctatctgtttatggatattgtcttttctgatccaaggtttgataagaatacgtttgaaatgaagaatgttcgtagggaaccgatgaggacgtatatgacggaggctgtggcgagggatttgtttgagaagttggggaggtatttcaatcataaaaatatggtactaacatcaaaaaacataaaaaacttatgtagtttgagtaatttaaaaccatctttctcgcttgttacttag

SEQ ID NO: 3596 - DNA, 966 bp, Proteus mirabilis
aaaatcgccactatgaaatcatttaatcaagttcagttcgtcaccattgatggcgatgaggcaggccagcgtattgataattttttactggcacgcttaaaaggtgtaccgaaaagtatgatttaccgaattatccgcaaaggtgaagttcgggttaataaagggcgcattaagcctgaatataaattagctgcaggggatagcattcgtattcctcctgtccgggtagcagaaaaagaagaacatgcggtatcgcctaagttagaaaaagtatcagcacttgctgagtgtattttatatgaagatgaacatgtgatgctgattaataagccatcagggacggcagtacatggtggtagcggactcagttttggtgtgattgaaggtttaagggcattgcgcccagaagcgagatttctagaattagtgcatcgccttgatagagatacctcaggggtattgttgattgctaaaaagcgctcagccctgcgttcactacacgaacagctaagattaaaacagatgcaaaaagattatttagccttagtacgtggtcaatggcaatctcatacaaaagtagtacaagcccctttattgaaaaatatcctacaaagtggtgagcgggtggttaaagtaagtagtgaaggtaaaccatcagaaacacgctttaaggtagaagagcgctttgaatttgcgaccttagttaaagcaagtcctgtcacgggacgaactcatcaaattcgtgtccatacattacatgccggccatcctattgcttttgatgatcgctatggtgatcgtgattttgatacacaattagcttcaaccaagcttaatcgtctctttttacatgcgagttcattaacctttattcatccctcaacaggggaaaaaatgcgtattgaagcgccgatggataaaacgttacgttactgtttacaagtattacgcaatcaaaaatcttaa

SEQ ID NO: 3597 - DNA, 684 bp, Proteus mirabilis
agccgtcgcacaataccgacgcttacaacaaagataattatgaaaaacagcaaatttattgttattgaaggattagaaggggctggcaaaaccagtgctattcaaacggttgttgatacattaaaacaacaagggatcaccgatttggcctttacgcgcgagccggggggaactccgcttgcagaaaaattacgggaattgattaaacaaggtattgaaggcgaaaaagttaccgataaagctgaattgctaatgttatatgctgcacgagtgcaactggttgaaaatgtgataaaaccagctttagcccaaggtaagtgggtgataggggatagacacgatctctcttcacaagcatatcaaggtggtggtagaggaatagacaaagccctgatgaagtcactacgtgatacggtattagcagattttaaacctgatcttaccctttatcttgatttagatccggccgttggtctagccagagcacgagcaagaggtgaattggacagaatagaaaaagagtctatggactttttttaccgcactcgtgaacgttatcaagcattagcaaaagaagacgcctcgattattaccattgatgcatcacaagatattgataaagtacaagcggatattcgcgatgtactcaatcagtggctgactcaggaaaatagcgcattatga

SEQ ID NO: 3598 - DNA, 267 bp, Proteus mirabilis
ttaaacaggttttctagtatggatccatcacatcaaaaatactattctttacttatttctacccaatttacgtttattggcgctatagctagttgtatcactcttattaaagattattgccaaaatctagatgtcctaacgtataagcttacctttctaaaaaaattaaaaagcaaattaaatcagttagatagtaatattatatcaataatattactaggtttaataatgttcacactctcttttataacaattaaaggaaattaa

SEQ ID NO: 3599 - DNA, 891 bp, Proteus mirabilis
gtgtttttaaccccaaggagtggatgtatgtcaacgaaatatcctatcgttttagttcatggtttagctggttttaatgaaattgttggttttccctacttttatggtattgcagatgccttaaggcaagatgggcatcaagtttttaccgcttctctttctgcctttaattcaaatgaagtgcgtggcaagcagttgtggcaatttgtccagactctcttacaagagacacaagcgaaaaaagtgaattttataggtcatagccaagggccattagcttgtcgttacgttgcggctaattatcctgatagtgttgcttcggtaacttcaattaatggtgtaaatcatggttcagaaatagccgacttatatcgacgcattatgcgtaaagacagtatcccagaatatattgtcgaaaaagtattaaatgcatttggtactattatctcaacattttctggtcatagaggcgatcctcaagatgctattgccgcattagagtctttaacaacagagcaagtcacagaatttaataacaaatacccacaggcattacctaaaacccctggtggtgaaggtgatgaaatcgtcaatggggttcattactactgttttggtagctatattcagggattaattgctggggaaaaggggaatctactggatcctactcatgcggcaatgcgtgtgttaaatacattctttactgaaaaacaaaatgacggcttagttggtcgctcgagtatgcgattaggtaaattgataaaagatgattatgcgcaagatcatattgatatggttaaccaagttgcagggttagtgggttataatgaagatatcgttgctatttatactcagcacgctaaatacttagcgagtaagcaactttaa

SEQ ID NO: 3600 - DNA, 1317 bp, Proteus mirabilis
atagagttaacgttaacattctggtcgcaaaatgactttataaggcgcttaacaatgaataaagatgctaaaaaatactatgtgatcttaagtgcgttgctatttttcttcttttttacatggtcttcatcgttttcattaatctctatttggttacatcaatatgttggacttaaagcaacagatactggtttgatattctcggctatatcattgattgctttatgtgcccagccactctatggctttattcaagataaactgggtttacgcaaaaatttactgctggttatcgcggtattgcttattttatcggggcctttttttcttagctttgcggcaatattacgctggaatatttttattggctctattctcggagggctctatgtaggaatgacttttaatgccgggatcggcgttttagaatcttatactgagcgtgttagccgtattcgtggttttgagtatggcagggcgaggatgtggggctctttgggatgggcatcggcaacctttattgctgggcataatatcaatatcgatcctaactataacttttttatggcatcgatagcgggggtgatcttcttaattctgttggcgttactaaaaacagataaaccagatgcttttaatcaattagagcatggtaaaccttctgcactcaccatcaatgatgcattaaacttactgtcattaccgcgcttttgggcattaatattatttgtggtcggaacctgtatttatagcgtctacgatcaacagttcccggttttcttctcttcacaatttgcatcattacagcaaggtaatgagatgtacgggtatcttaattccttacaggttttcttagaagcgggaggaatgtttgttgcgcctttcttagtgaacaaaataggggcgaaaaacggtttattattggcgagtagtgtgatggctgcgcgtattattggttctggattagttgaagggccgataatgatctcttgtatgaagttattacatgccgttgagcttcctatcctgttaatttctatttttaaatataacagccaacattttgataagcgtttatcttctacattgtatttagtcggtttccaatgtgtcagttccattgtggcaacattgttatccccattagcgggttatggctatgatcattacggttttgcccctacgtatatggtgatgggatgtatggtagtcggtactacgttactttctgctgtgttgttacgtgctgactcgaaagcattaccacaacatgatatgactgatctcgatagtaacaataaagctcaaccgatttaa

SEQ ID NO: 3601 - DNA, 273 bp, Proteus mirabilis
gtagaaataactttgtataaagcaccaataaatatatttattggtgctttgttagtaatatcaacgaccatagaaataatttatttatatggcttacttccgtttcttactaaattagtattaatttattatttttcagtaagaaaaattcatattgatgacatcctatgttttatcttaaaaaaactaaaaaacagcttatttttagctccatattatcttactaaaatcatacacctaaatttatttatcattcaaaaaaataataaataa

SEQ ID NO: 3602 - DNA, 2124 bp, Proteus mirabilis
aatatagggtttattacagataaaaaagagtttaacgacagactatttgttatttattgtaggaattacagaatggaactgaaatcaaccccaatgggacaacgtttagctcagcatccttataacagggtaaaattgttaaatgcgggtattgaggtcagtggtgaaaagcatcaatatttaattccttttaatgaattgatcgacattttttgtaaaaaaggcattgtgtggggagagttagagtttttactgcccgacaataaagtggttcgtttgcatggaacggactgggaagaaacgcaacaattttaccgctatctttatcaaacttggcaaatatggagccaagagatgagtgagataacggctcaagtacttgaaaagcaactctcttctatccaagatataattcaaagcgataaatggataaagcaaaaccagttagccggtattcaacaggcaatccaagaaagtttttctgctattcctcttcctctggaacgacttgctcaatttgataactgtaaggtgcattatcaacgctgtttacagtggttacagcaaggtaaggcattaattgcgcaagaaaatgagcaatggatcacccgtatattgacagagcatgcggagttttttactaccattgaaacatcgcctttaaatgaatcgcaatgtaaagccgttatcaacggtgaagataatatattggtattagcgggtgctggtagtggtaaaacgtcggtactagtggcaagagcagggtggttgttacgtcgtaaactagcaacctctgaacaaattctactattggcttttggacgtaaagccgctgaagagatgaaccaacgtttatctgagcgcttaaacgctgatattacggcgaaaacctttcatgcattggcattatttattatccaacagtcaactaaaaaacaacccaagatcagcgaattagaaatcaatagtgaaaagagaagaacacttttgctaacgcagtggcgtgagcagtgtcagcagaaaaaagcacaagcgaaaggctggcgtgagtggttatctgaagaactagcatgggatatccctgatggggagttttggtatgataaaaaattagaaaatcaagttgccgtaaggttagagcggtggatcagtttattaagaatgcaaggtggtagccaaaaaacaatgattgattctgtgcctgcagaatatacggatgcatttaaaaagtatttaaaactattagcaccactgttaaaggcatggaaaaccgcattaaaagaagagaatgccattgatttttcagggctattacatcaagccattaatctgatagaaaaagggcgtttcgtcagtccttggaaacatattctggtggatgaattccaagatatttcaccactaagagcagcactattaaatgcgttaaaacaacaaaatacacaaacttcattatttgcagttggtgatgactggcaagctatttatcgctttagtggggctgaattattactaacaacagcgtttcatcaatcttttggtgatggtgctgagtgtgcattagataccacttatcgttttaattcgactataggtgacgttgccaatacatttattcaacaaaatcctaatcaattagctaagcctttaaatagcttaacaaaaggtaataaaaaagccgttgtattattgccggatgatcaattagaaagtttattaaataaaatgagtggttatgtcagtgacgatgaaacgatccttttattagcgcgttatcattacttacaacctgatttattgaaaaaggcgaaaacgcgctggcccaaattaaaattacagtttatgacttttcatgcttcaaaaggtcaacaagctgattatgtgattatattaggtttacaatcgggtaaagacggatttccagctccggcaagagagtcgattatagaaaccgctttattaccccctgttgaagactatcctgatgctgaagagcgccgattaatgtatgtggcattaacaagagcaaaaaaacaagtatggttattatttaataaacaacaaccatcttgttttgtgtcagagttaaaatctcaaggtgtccctacgcaaaaaaaaccataa

SEQ ID NO: 3603 - DNA, 189 bp, Proteus mirabilis
ccgaataaaacggctgctgttgtgggtgttgcctattttgctgatcattatttaattcagtatagtgatgatatgcacaatactcatgtaaaaatgctgtttgttgtgcgctgtttaactgatttgcggcaaaaaatgtcattaatgaatctgccgtatcaatatcagcggcatattcccaatcaataa

SEQ ID NO: 3604 - DNA, 183 bp, Proteus mirabilis
gctagtaaaactaatctagactattatacagtgggaaataattgcttagaaaatcgcttatttctttatattacccctataattaaatacggagatatcttattttttattttaaaaaagctatctaacctaattggactaaccatagttactttaattattttaggagatgtaaatgcgtaa

SEQ ID NO: 3605 - DNA, 336 bp, Proteus mirabilis
aaattcaagacgcaggtatcattttttttattaattacaaaatataggatatttatgaaaaatattattttagcactaggtttattatcattatcttctgttgctgtttcggctgaattaacaaaatcttgcgaagattattttaaagaaactgatgcctatgtcgcattaatggaacaaaatgatgcaactaaagcacaagcagaaacaatgaaagcacaatatgctcaatcaaaagaacaatttgctgcattacctaaagatgttcaagaaagcacctgtaaacaagctttagattctttagagcaaatgaaaaaaatgtctgctggtcaataa

SEQ ID NO: 3606 - DNA, 705 bp, Proteus mirabilis
cgtgtgaagaccaacataatatttcctttggcaattttactgctggcagggtgtgcagatcccaatcaccaaacggcgaaaaaagagacaccgcgatttttaaatagccagcctgtagagcacagagttaataatgcctcaatttctactgctcaatggaaaaacaccccttttgatgagcatattaaacaagcttcagcccgttatggggttgatgaaaccttaattaaagccattattcaggtagaatctaattttaggccagaagtgataagtaaatcgaatgcggttggattaatgcaaataaaggcatccacagcggggagagatatttatcaaaatagaggaaaagcagggcaaccaaccaccgctcagctaaaagatccggctactaatattgatttaggaactgcttatattcaattattaagagagcgccatttatctgggatctccaatcctgaaacactctattacgcgactattttggcttatgtgaatggggcgggtgcattactcagaacttttgataaaaatagagatgcggcgattgccaaaattaatgccatgagcgcggatgatttttatcgttacgttgaaaaaaatcatccagcatctcaagcaccacgctatttagcgaaggtcaaagcagcctatcatttagcggataacttttctgataagctggcagcagccgctgattga

SEQ ID NO: 3607 - DNA, 369 bp, Proteus mirabilis
gatgaccggacaatgaatagaaaagagcttatcgagtatatacagaaaacatatgccgtaatccccgaatatttatggagtaagtaccctaattatgcggttttcagacatcataatcattctaaatggttcgccgtcatcatggatgtcgctgaaaacaagctatttgatacgggtaaaaataataaagtcgatgtgattaacttaaaagtaccggtgcctttagtgggtgctttacgcttaaaaaaagcagtttatcccgcttatcatatgaacaaagagcattggatttctattcgcttagacacagattttgatgatgctgagctaaaatcattaatttctgaaagttacgaactgacgcagtga

SEQ ID NO: 3608 - DNA, 1305 bp, Proteus mirabilis
atgagaggtgccgttgtgtgttcgggtcaacattcttgtcatgaagaacaacatgagcaaatattgtgccctcagtgcgatctggtagtgagtgttcctgaattagcccaaggaaccaaggcgacctgtccacgttgtcacactttgctaacagcacgttggcgacaacctttttatcagcctgtagccttggcgattagtgcattatttatgttgttaatggcttgccaatttacttttgtcagtatggaagtggcaggaattaccaataacattactttaatgcagatcccaactgtgatgtttagcgaaaattatgttgagctaggcgctttctttttactctttgtacaagtggttcctgctttctgcatgatagcgattttactgctttgtacacccattaagctgccaagaaaattacaaatttggctatcacgaattcttttccaattaaaatcgtggtgtatggcagagatttttttagccggtattttagtcagttttgtcaagctaatggcgtatggtgatatcggcttagggttaagcttcctaccttatgtactttactgcttattacaaattcgtgcatttcaatgtttagatcgccatacattatgggaaaaactagaatcgcgacccgcttatcctaaaattgaatcaggtaaaacaggtttaaagcaaggggtaagattatgtcgttcttgcactgctattttaccggctgatcaatatgaatgtagtcgttgtgaagtaaaagggtatgcgagaaaacctcatagtttgcaatggacgctctctttcttaattacttctttaattctttatattccggctaacctattgccgattatggtgacggagtcgctgggtaataatctttactcaaccataatggctggggttatcttactttgggaagatggctcatatcctgtggcaatggttatttttattgccagtattatggtacctagtttaaaaatggtggctatcggttggttatgttgggatgcacataaagccaaaggaaaacgtgatccggcgagaatgcactttctctatgaagtggtcgaatatgtagggcgttggtcaatgattgacgtttttgttatcgctgttttagcttcattagtcagaatgggacgtctgatgagtatctatcccgattttggtgtagtgctatttgcattggttgtcgtattaacgatgttctctgcaatgatgtttgatcctcggttaacatgggataaatgtactgccgatgatgataaacccatgattaaggagcctaagggtgactga

SEQ ID NO: 3609 - DNA, 321 bp, Proteus mirabilis
atgatgatcgccagcaaatttggaataggccagcaggttagacataaactactcggttatttaggcgtagttgttgatgtggatgctgaatattcccttgatcaacctaacgaggatgatattgcatctaatatgaccttgcgatcagcgccttggtatcatgttgtcatggaagatgatgaaggacaaccggttcatacctatttagctgaagctcaaataacttatgaactctcagatgagcatttagataatgactcaatggatgagttgtcacaatcaatccgcaaccaattacaggccccgcgattaagaaactaa

SEQ ID NO: 3610 - DNA, 411 bp, Proteus mirabilis
atgtcatattttattgctatgataaaagtatgtcgagtaggcgtgatcctcatacctactgcgcaaacaagaagtgaggtcgttatgaaaaaatatctgaccattttatgcagtcttctcgtttccagttcgatatcatttgcttgggcgtcaacagcacagcaaaccacaggacagatttatgtacgaggagcaattgttgatccagcttgtgaaattaatttcacactcgatcaagctgagtaccaatgttacaaaaataacaaagtctttacatcaacccagtctattttccctacctcttttgaacaatcatcatcaattatactgcctcaaaatatggggaaagctgaaatccgttggatggatggcgctgaaaaaaatggattgattaatgtgcaatatttttaa

SEQ ID NO: 3611 - DNA, 519 bp, Proteus mirabilis
ttcgttttagcatgggaaatattaccttggataatctattaccgggtcaatggaaggagattaattttgtttaaaccacatgtcactgttgcttgtattgttcatgcaaacaataaatttttagttgttgaagaaacggtaaatggcaaagccacatggaatcaacccgcaggacatttagaagcaaatgaaaccctgatccaagcggcacaacgagagttatgggaagaaaccggtttaaccttgccggtacaatattttttgaaattacatcagtgggtggcaccggacaatacgccatttttgcgttttttatttttgatagaagcaccagaacaattagccacacaaccacatgacgatgatattaatggctgctactgggtgaccgcgcaagagataatcaatagccaacaattacgttcaccgctggtaaaagaaagtattctttgttatcaacaaaatgaacgttatccactctctttactggatagctttggttcaacatttgcctcttaa

SEQ ID NO: 3612 - DNA, 423 bp, Proteus mirabilis
tcttatttagcgataaagcgtattatgaataaattagcatcaattttggcagctttaatccttacggcatcggtagtaggttgctctgatgagaaagcacctgacaattcagccgtaaaagcagacaacagtagtaatgttgcccaaaatactgatcccaaaaaagaagatgaaagtgcatcttcatttaaaaagaactttattagtagttgcatactcggttctggtgtgactgatgatgcactaataccacaaattaccgaagtttgtagctgtacttacgataacatcatcaaagattatggtatgaccgaatttattcgcgttgatatggaaatgagaaaagacggctccaaatcgcttccgaaagagtggaatatcgataaaattgttgagcaatgtatatcaaccatcaccaaataa

SEQ ID NO: 3613 - DNA, 2964 bp, Proteus mirabilis
tataaattagctctcaattttttagagattatggcttattttatgaaaaatatcgtaatacctacctcgttaagctgcttttttttacttttttcccattcaacatggtctgaaaccaatatttcacaaaccaaacaacgaattatcgaccaacgtaattattggttagatgagatcaaaaatggtgttatcacaactagccctcaaaaaggatcgagaaccgccgaattagatagaataatcagtaataattatcaagccattaccggcaaacgtagagaacttgccgaagcggataaatcacagtctcatacttatgtgttgaatacctatgctaatattttatttggtgataaggctaaatcgatcaactttagcgatattcaagcttatcaagatctcaataaattacatagcacaggcacctatgcttatgatacaaacaaaaaaagagtacgctcgatagattttatcttaaaagaactttttttacgtggccgaccttatcaagtacttgataaagaaggtcattatcttgataactacaccactataacaggctcatcttatcccagtggtcatacgtggaacggatacaaacaagctgcagtgttatccatcttattccctgaaaagggcagtgaaatgtttgccagagcaatagaatatggtgaaagtcgagttattgtcggggcacacttcgcaacagataccattgcatccagaataggcaattattacctgctgtcacaaatgcttgcagatgatgacaccacccgcacttttgtagagcttgccaaagaagtccgccaaaatgttgctagccaatgcaaaaatcaacattgcttaacgacctcgacaacaatcactaacgatgaaacaggttattacgcaaccaaagatccagagcctgcaccacgcattacccctaatgaaataccaacatctgccaacgctttactgcgtttacgctttgcctatttaaccaaagagcaacgacaatctatcttagcgagtaccacctacccgagtaattcattggctggctgggctgcaaacaaagatgatccaaacgccaattggggattaattaatctcccgaaagcctataatggccctagttatttctacaatcattttattgttaatcaaataactaatgaatttgactttgctgaatttggtcaacttgatgaatggaaaaatgatattagtgggcctggcaaattaatcaaacaaggtaatggcaccttgatcttatcaggcaataaccattttgctggcattgaagttaatcagggtcatttactgctcactggtgaaaaccactatgcaaaaaattcttccattaatggtggtacattgcttcttgaaggaacactaaacactttactagatgtcaacaaaggagcattgctattaaatggtgggagcgttgattctcaagtcaatatcaataacaaagggatactttctggtaaaggaaaaattaataagctggccgtttattcaggaggcatcgtatcaccgggtcattcaataggtacaattaatatagatgatactgttatttttaattctggtagcaactaccatgttgaaataaattcacaaggtgatagcgataaaataatcagtttgggtaccgcgacactgaatggtggaatggttaatgtatcgcttgaaaatagccaaaatctgctaacaaaagatgatgttcaaagtttatataacacaaaatataccattttaacggcagatcacggtgttaatggtcaatttactgatgtaaatccaaactatctttttttaggtaccacactgtcctacgataaaaattcagtaatactaaatgtcggaagaaataacaccgccttttcaagtgtggctaaaacaaaaaaccaactatcaatcgccaatgcgatagacgcattacccttgggacatcctatttatgaaagcattataagaatggatacagggaatgatgcccgctctgcctataatcaattaacaggtcaaattcatgcggatatcttatctaaccaactcaacaatagccggcaaataaaagaaacactcctctctcagattaaaaatgcagaaataattaatagagagaaagaaagtgcaggtaacaaaggtcatgtttgggctaaaattctctctaattgggaaaagacttccaatgatggcaatgcaaatagctatgatgcttccacctatggcgtactattaggtgcagatcagcgggttagtcacgataaaatgctgcttggtattgcaacagggatcaccaaaacctcactatctggtgataacagtcacgcaaatagcgaaaattaccacttatcactctatggtggctatgattttgacacaatcgcgttacgtgctggtgcatctaatacctttcatcgtatccatacaacaaaatcggtcaactatggtgtacagtcagataaaaataaggcgaattacaatgggaacactagccaaatttttattgaagcagcttatcccatcaccctctcagatacacaattagagccttttgttaatcttgaatatgccaaaacgaaaaacgccaccattaacgagcaagggggacgagcagccttacaagcccattcgcaaactctagagtcaaccacctctactacagggctacgtttaaataaccaatggaaatttaacagtaaatcaacgggttctctctatggtgagctaggctggcgacaccaatataacgatgtagaacgagggatccatttacgtttcacacaaacccagcctacatttatagcaaatagtgttgatgctgctcgagatgcactggtggtaaaagctggaacaactatccaaatcaatgagacatcaaaagtctcaattggatacagcggactagtggcaagaaatcagcacgataatggtattgatatgaaactctctatcgcgttctaa

SEQ ID NO: 3614 - DNA, 1836 bp, Proteus mirabilis
ctgtcaatagctgtcttattgcaggatagataccagctattaacgctttatgttaacttccatgttcactactcaataataaaaacggtaaccttgaaaaacaacgaattagaatggcaggcgttacgcccagattacgcctcctaccagactttctttcaaacagcatcgcaattgcctgcatcttcacttcgtgaggttcaacctcgcttgtatgaaagcttacagtggctaaataatgcagaagcaggccaatttatgctgttaaaagcagaagattctactgcttatttcgaaacactcgctgatacattacaacaagcagagataaaaacttatcctgttgtaggtgcctatcaagctgaatctaaccaaatttattggcaagaaaatgtagaaggctcattttcatcatcagaatctattgcttgttgccaatggatagagccagaacaactttttggttcattttattatcataaagataagctcctcgttaacccaggactgttgcataaagtcaatggtggtattttagtcttatccattaaaacgctcttagcacaacctttaatgtggttccgactgaaaaagatggttgaagagcaacactttgaatggttagtgtggaatgaccatcaagcacttcctttgcctattgaagccatgccccttcacttgcgtgttattttagtgggcgatcgcctaagcttagaagagcttgagtttatggagcctaatatcagcagtacggcgctatatggcgaatatgaatacgatatgtatttagaagatgaaaccgccctgagccaatggtgtggttttgttaatggactttgccaaaaatatcgtcttccttcattatctgctgatgcttggcaagtattactgactcagggcgcaagagagcatgaagatcagcttatcttatctctcgatcttgaattcctattacgccaattgcgttatgccatgcgttttaatcatgacgcttatcttggtgctgaggcgcttaaaaaagcgcaagaaaatcgtttatggcgacatagctacttattagaacgaagccgtgatgaaatattacaaggccaagtcactattcacactgaaggtgaaatggtaggccaaataaacggtctttctgtcttagattatcccggttatcccgatctaattggcgagccaactcgtattacctgtgtggctcatattggtgatggcgaactggtcgatattgaacgaaaagcagaattaggtggcaatatccatgcaaaaggcatgatgattatgcaagcctacttaaattctgaattacgattagatcagccacaaccttttagtgcttccgtcgtttttgaacaatcttacggtgaagtagatggtgatagtgcctcactagcagaattatgtgcgttaattagtacattgtcacaacacccaattgatcaacaaatcgccgtaaccggtgccgtagatcaatttggtcaggtacaacctattggtggtgttaatcaaaaaattgaaggcttttttgatatctgtcagcaaagaggattaacaggctcacaaggggttattataccgctggcgaacgtgcgacatcttgttttaaacgatagcgtgatacaagctgtcaaagaaaataagttccatatttggccggttgtccatgttgcagaagcaattactttgctaacacatcagccttattacgaagaacaatgtgaaaatccacaatcaaatgaacacttgttagctgttattcatgatcgaataacacaagctaataatcaggataggcctaagttaccttggttcctgcgcttattcagataa

SEQ ID NO: 3615 - DNA, 642 bp, Proteus mirabilis
caaaaaatagctatggcaaatcaatttaacaatagatcgaaactacgcaaatctcacgcactagcaggacaaaaaaaaccttctcgccctagaggtgagcgtaaagtgattatctttaataaaccctttgatgttcttgtgcaatttaccgatgacagcggtagaaaaacactaaaagattttatccctatccctgatatttatgcggcaggacggttagatagagatagtgaaggtctgttagtattaacaaatgatggcaaattacaggccaaattaactcaaccaaataaaaaaacagggaaagtctactatgctcaagtagaaggcattcccacagagatagcgttacaacaatttcgtgaaggacttaacctaaaggatgggaaaacactacctgcaaaaattgaaagggtagaacagccaacgtgggtttggacgcgatttccacctattagagagcgtcaatctattccgactagctggttaaaaatcactttatttgaaggaaaaaaccgccaagttagacgtatgactgcccatattggttatcccacattacgcttaattcgttttagcatgggaaatattaccttggataatctattaccgggtcaatggaaggagattaattttgtttaa

SEQ ID NO: 3616 - DNA, 570 bp, Proteus mirabilis
ggaatgacagccgaaggacatttacttttttctgttgcaacactcgtcttagcacagaaattagaaataacccccgttcttgctcaaggtgattggtttcacatgatccctgctgtcttattaggttcactactaccagatttagatcatccaggctctatattaggacgcctctttcggataatctcattaccgctatcaaaactctgtggtcatcgtggcttcacacatagcctactcgccttttgtggtttagccattttatgggaaacacaagttgcgccttatatcacgatttcggctgatttttttcacgcccttttgctaggttacttaagtcacctactggcagatatgctaacaccatcaggtgtaccttttttatggccactaaaaatgcgttttgccttaccgattttagcgaaaaaaaatagcaaaaaaggagaacgatttatttctgtcatcatcttagttggtgcactatttctgcccccacacctaactttttctcttcccacacaaataaatcactggttacaaatgtaccacgataaacgtacacctttttaa

SEQ ID NO: 3617 - DNA, 792 bp, Proteus mirabilis
aaaaaaaaggctattgtgtcagttgttatagtatgccagaaaaaggggagctttatgtatccagttgatttacatgcacataccattgcgagtacacatgcttatagtacggttagcgaatattttcaacaagctaaaaagaaagggattaagctatttgcgattacagatcatggtcccgatatggatgacgctcctcatgaatggcatttttcaaatttgccggtgatccccagaatggtcgatggtgttggtattctttatggcatcgaagcaaatatcaaaaatataaaaggtgaaatcgactgtactgagaagatgagtaaaaaattagatattgtactcgctggttttcatgatcctgttatgggatcactaggtatggttgataatactaaagcgcttattgcaacaataagtagtggtttagtacaggtgatcacccatccgggaaaccctaaatatcctatagatattaaggaagtcgcaaaggttgctgctgagttcaatgttgcattagaaatgaataattcttcttttatacattctcgagtaggaagtgagaaaaactgcattgaaatagcgaaagcggtgcttgatgccggaggtttaattgcgctaggctccgattcacatattgcatcatctttggggaattttgagcgagtattagaagtattggcggagatccaatttccacaacagaagatattgaatacatcaccaagaaaggtgcttgattttttacaagctcatggcaaaaaagagatcacagagtttcaacatttttga

SEQ ID NO: 3618 - DNA, 189 bp, Proteus mirabilis
tttaatcatttcttaagctttgctgattattattttgtctattttctgttctttctattctctagtttgagtcgtcgatttatagcctattttagtttggcttttagattatttggttatgtattgaactgtgtagtgtgtcaattaaagtattatatttttgttaagtgtaaaaagggtgatatttga

SEQ ID NO: 3619 - DNA, 1266 bp, Proteus mirabilis
gtcattttttatataggacatgttatgtcagaagtcacatccattgctaaacgcccatctatactcggtggtgcgatgattattgccggtacggcggtaggcgccggtatgttctccatccctattgtgacttccggtgtgtggtttaccggctctatctttttactcatttatacttggttttgcctatttatgtctggcttaatgatcttagaagttaatcttcactaccccctaggatcaagctttcatactattaccaaagatttattaggtaagggatggagtaccattaatggtctttctattgcttttgttctctatattttaacttatgcctatatttctgcaggtagctccatcattgtgcaaaattttgctaatgtggttagcttgccacaagccgttgcaggcttagtatttgcccttgttgttgctttcttcgtttggttatcaacccgagccgttgatcgcttaagtaccatattaattggcggtatgattgtggcttttgtatttgctatcggtggattatttaccgaagtgaaaatgccagtattatttaatacaacagaaagccatgccagttatttaccttatgcactagccgcattaccttatttattaacctcctttggttatcacggcaatattcctggattagtcacctactaccgtaaagacggtaaagccgtgatgaaaagtctattaattggtaccttgatttcgctggctatctacattttatggcagtttgttgtacaaggtaatattcctcgtgaaggctttaaacaagtcattgctgaaggcggaaatattggtaacttactggcacaaatgcgtatcaatacagcaaatacttccgtttcattcttattagacttgttctcatatatggcattagcgagttcatttttaggcgtgtctttagggttatttgattatttagctgatttctttaaattctcaaatacagggacaggacgtttaaaatcggccatcgtaacttttgtaccacctactattttagcgattatttttcctgatggcttcttgtatgctattggctttgcaggacttgcagccacaatttgggcggcgataattccagcattaatggcaaaagccagtcgtcaacgtcatcagcaacaaagctttaaagcacctggtggcacctttatgattatctttgtgatcttatttggtgcaattaatgcgattgcacacatattagcaaactttaatctcctacctatttaccgctga

SEQ ID NO: 3620 - DNA, 705 bp, Proteus mirabilis
tcaggaaatttcatggaaaatcaacctaagttgaacagtagtaaagaaatcatcgcttttttagcggaacgtttccctaagtgttttatcgctgagggtgaagcacgccctttgaaagtcggtatttttcaagatctcgttgagcatctaaaagatgaaactcagctgagtaagacacagttacgttctgccttacgcttgtatacctcaagttggcgctacctttatggtgtaaaagaaggggctaaacgtgtcgacttgaatggtaacgactgcggagagctggaagcagagcatattgcacatgctcgtacacaattagccgaagcgaaagcgcgcgttcaagctcaacgagctgagcaacgtgctaaaaagcgcgaagctgaaggtgataaggagaccagtaaacgtccggcagcgaaaaagccaaatcctcgtcgtcaagcacctaaagatggtgaaaaacgacagcctcgccctcaaaagcaagctaatcaagcgcctcgcaaagcgccacgccaaaatactgaaaagttaaccccagtcaaagacatctcagtgcttactgtaggtcaatcgctgaaagttaacgttggaagtagcgtgatggatgcgacagtgctagaaatagcgaaagagggtgtacgtgtacaattgcctaacggtttggcaatgaatgtacgcacggaacatttaaagttctga

SEQ ID NO: 3621 - DNA, 267 bp, Proteus mirabilis
  unsure (77),(89): Identity of nucleotide at the above locations are unknown.
atattttcttacttggctaggcggtttaattctttttttattagtacaattaccttacacgtggcttttattcttangaaaacatttangattactatcgcgtttttttatttaaaggagagtttcgattataaagaaaaattaaagttttgttttccgaataaaagtaaaaaagatatcgataagctagttatggaaaatttatcaccattaggtatgctctattcgaaactggcatggcatggttttggagcgataacagactga

SEQ ID NO: 3622 - DNA, 774 bp, Proteus mirabilis
tttcactattatcgactttatacccgtcttggcgggccgcaactattcagccagcagaggcgctacgttatgagtaatacccctttattacaatgtcatgcactttgtaagcagtatcaagatggtgctatttcaacacaagtcttaaaatccgtctctttcgcgatcaatcaaggtgattttatggcgattgtcggtagctcaggttcaggtaaaagtaccctattacatttattgggtggtttagactctccaacctcaggtgaagtgatatttaaagggcaatcgctcaataaattaacttcaacggcaaaagcggatttacgtaatactcaattgggttttatctaccaattccaccatttgttacctgattttactgcattagaaaatgttgcaatgcctttaatgattggtggaatgagtgcagtaaaggctaaacagaaagcgatgtctttacttgatgccgtaggattaactgctcgtgcacatcatcgtccttctgagttatctgggggagaaagacaacgtgttgctattgctagagccttagtaaacgatccggcgttagttttagccgatgagccgacaggtaatcttgaccaaaaaaatgcggaaggtattttcgaattactcatgaaattaaataaagaaaagaaaactgcctttttggttgttactcatgatttatctctcgcggcacgctttcaacgtcaacttgaaatgaaagatggtcaattagagtctcaagaagcgatttcaggagtggaataa

SEQ ID NO: 3623 - DNA, 984 bp, Proteus mirabilis
atacagtattacccaagagtgattgatagtatgtatacaaaaatcttaggtactggtagttacttgcctgtacaagtgcgaactaatgccgatttagaaaaaatggttgatacatcagacgagtggattgtcaccagaacaggtattcatgaacgtcgtatcgcaacagaagaagaaactgttgccaaaatgggtgcgagtgccgctgagaatgcattagaaatggctgatattgatagacaagaaattggcttaattatcgttgccacaacatcaggctctcatgcgtttccgagtgcggcatgtcaaattcaacacgccctcggtattgctgattgtattgcgtttgatgttgcagccgcgtgctcaggattcgtttacgcgttaagtatcgctgatcaatttattaaggctggcacggtgaaacaagctttagtgattggtgctgatcgcttatcacatgcgttagatcctaacgatcgcggtacaattattcttttcggtgatgctgctggtgccgtcgttgtcggtgcttctgaagagtcaggtattatttctacacatttacattctgatgggcgttttggtgagctgttagctctgccttatcaggatagagaaaatcaagacttacctgcttatgtcaccatggcagggaatgaagtctttaaagtcgcagttcgtgaacttgcccacattgtggatgaaacattagaagcgaatcatattgataaatcggaactcgactggcttgtgcctcatcaagcaaatttaagaattatttcagcaacagccaaaaagctggatatgacaatggataaagtcgtggtgacattagatcgccacggtaatacgtcagcagcatccgttcctacagcattagatgaagctgtaagagacaatcgcattcaacgtgggcagttaattctgttagaagcgtttggtggcggctttacttggggctctgcacttatccgtttttaa

SEQ ID NO: 3624 - DNA, 327 bp, Proteus mirabilis
ctaattaattatgcaaagccactttcaattgctagaatccgtactctcttatataaatccgacgaaaagggtactgacatgtttagttttgataaaatgataaccccgtctataatcactattgtttatagaatattcatatcacttagcattttaggcggtcttgtcactattttttcaggtgggatatctctttggcaattgtttataaccttgttaggtgttgtagttagtattttatttataagaattacatttgagatgattatagttatattcgatatattaaaaacgttaaaagaaataaataacaagctagacaagtaa

SEQ ID NO: 3625 - DNA, 219 bp, Proteus mirabilis
aaatataattattcttatttattactatacatgttgataattttgtatataaaattatcaacaatccatgctttttataaaccggagaaatcaagtgcggtatatattattattatttatctctttgttttttattgtaatttttctattaaaaacacagggcagtaccaaaagcgatgttatcaaccaacccacagaaatagaaagaaaattaaataa

SEQ ID NO: 3626 - DNA, 237 bp, Proteus mirabilis
tatataaattattatttacaacccatgagccccaggcttccattagttttgatattttttgcatataaacatcctgtttatctttctaaaatacactatatgatcacactgtttttttatacagtccttgtagtatataaatatagttatttatctaaaaaatacaatagaaataataaaattaaatatcaatatataaatagaaaaatagctaaaaataatatttctagctattaa

SEQ ID NO: 3627 - DNA, 471 bp, Proteus mirabilis
aggaggaattatatgcctaatattaaacctttttcattattcccaactttatctgacaatctactttcaaaccgttttgatcagatagatcgcctgtttagtcagttaacaggcagtaaaccaatttcatcaccgactcagacttataatctgaaacagattgatgataaccattatgaactaacagtgagtgtgcctggatatcaagaagatgacttatcggtttcattgaaaggaagtcgcttattgattgaagggaaaaaagaagaaaaattagaagaagacaatgataaatggatccaccgaggtatatctcaagggcagtttacattgcagtttgacctcggtaaaaatgtcaaaatagaaaaagccgatttatcaagtggacttctgaccattgctattgagtatgagttacctgaagaagaaaaacggcaaacaatagcgatagaaaataaagataaaagctaa

SEQ ID NO: 3628 - DNA, 894 bp, Proteus mirabilis
gtgctatgttatcaaaacacaagtgatacattaaggagttatcttatgattgcaattactggtgcaacaggcctattaggtcaacatgtgattgaaaaccttcttcaaaccgttcctgctaatcaaattgtggcatttgctcgtgatgtaaaaaaaggatcgtctttaagtcagaaaggcgttttagtacgtcaggcggattacaatgataaagcttcattaataacagctttacagggtgtcgataaattacttttaatttcctcaagtgaagttggcaaacgtaccattcaacatcgtaatgtcattgaggcagcaaaatcagcagatgtacaatttattgcttacactagcatattacatgctgatcgctctccattaagcttgcatgtggaacatgtagaaacagaaaaaatgctagctgattctgggatctcttacactttattacgaaatggctggtatacagaaaattatctggcaagtgtccctgcagcacttgagcatggcgtttttctgggggcggctggtgatggcaaaatagcttcagctactcgggccgattatgcattggctgctgctcgggtaattagtgaagaaggacatataggtaaagtgtatgagcttgctggtgatgaagcttggacattagagcaattggctaaggaattgactaaacaaagcgggaagcaagtgatatataacaatttaagtcaggccgattttgtcgctgcgttaaaaacggcaggcttacccgataaattatcaaatatgctggctgattctgatatcggcgcatccaaaggtggattatttgatgatagtcataccctaagtaaattaattggccgacgtacaacaacacttgcggagagtatcaaagcaatattgtaa

SEQ ID NO: 3629 - DNA, 747 bp, Proteus mirabilis
tcaacgaattttttaattatccttatgaaactttctactgctaaacaaaaattgtctcttatcttgctgttaaatttggttggattgactctttttttatcttggtatcttcccgcacaacatggcttttggctttcaatagatacacatatcttttatttttttaatcggcaactattgccagactcttcttttgctatgtttgtggcttatgtcaataatcgagcattcgatgtgattattctgctggcgatgggagggttgtattaccatacctttcgtcagaaagattatcagggcaaacgccatctcattattgtgggaatagtcatggtgctaagtgcaatcgtaattaatcagattggacaaaatattcctatcgaaagacctagcccaacacttcattttcacgatgtgcaccgtgtaggtgtagtgacaggaataccgactaaagatgcatcaggtgatagctttcctggcgatcatggtttgatgctactgatcttttgtagctttatattacgttatctttcatttcgctcttttttatgcgctcttttaattacggtaattttttcattacctcgtgttatggctggcgcacattgggcttctgatatcttagttggttctatctcgctcactttagtcacaacaagctggttattaataacccctgcatccgatatcatcattcattggctagatgaacatctcccttttaaaggcaaaaaagcatttagctaa

SEQ ID NO: 3630 - DNA, 1701 bp, Proteus mirabilis
gaactttactatcatttagtagattattatttcagattttctggagattatatgacaaacacagttattaagtacgttttagaccgattatatgatttaggtatcaaagatatttttggtgttgctggtgattacgccttccctattgaagacactgtttgcaacaaccaacaacaacgttggattggtaactgtaatgaattaaatgcggcatatgctgcagatggctatgcccgaattaaaggtatggcagcattatccactacctttggcgtaggtgaattaagtgcgattaacgctattgccggtgcctatgctgaaaatttaccgattttccatttagttggcatgccagcaagtggcgtacaaaaaagtaaacgccttgtgcatcatactttaggtaatggtgattttgatgttttttatcagattgctcagcgccttgcttgcgctcatactattttaacacccgaaaattgtgtggaagaaatggagcgcgtaatagatgtggcattaaaagagcgtcgtcctgtttatattggtataccttcagattatgctaatagccaagtagtagagccgttatctgttaccgcaccacaaaagccaacaagtgataaagcaacattagaaaaagcagtatcagcaatcattgagaaactcacccacagcaataatgtctgtgtattaccaggctttttatctgcacgtttagggttaacagataaaatccagcattttattgataaaacaggtttaccttatgccactatgtttatggataaaagcatattaagtgaatctaacgcgcaatatgttggtatgtatgacggacaattaatgacaccagaggtcagagaatttgtcgaaagtagtgaatatatattagggatcggtacattaatgactgactttaatacaggcagtttcactgctaatatgaaatcagaacaattaatcagtattatgccagattatgttgaaattgattctgtgatctactcctgcgtttatatgacagatattctttctgaattaacccaacgactaccaaataaaacttatcataaaataacagcgaaaggattaggtgaagcggttgcatctgataatgataaaattacagcacaatatctctatcctcgtttagaaaaattctttaagcctaatgatattattattgcagaaacaggaacctcatccatgggattaggcttcgctttattacctgaaggtgcacaatttcataaccaaacactatggggctctattggttgggcaacaccggctgcattaggcgctgcgttagcggcaccagaaaaacgcattattttaattaccggtgaaggctctcatcaattaacagtacaagaaattagtcaatttgttcgtttcggtttaaaacctattattctagtattaaataacgatggttatttaatagagagattattatgtgattaccccgaagcttattataatgatttagctcagtggaactatcatcagttaccgcaagcctttggtgcaacagattggtatagtgaaaaagtaactacagcaagtggactagataatgcgttaaataaagccgcactaacaaatagcgcatcttatattgagatagtcacagagcgatatgaggcctctgaattagcgcaaaaattaaaagaatcaaaaagttcattatattcattctaa

SEQ ID NO: 3631 - DNA, 840 bp, Proteus mirabilis
ttcccctactattattaccattttcaggagagatgtatgagtgttcccgttttaggtcttggtacttttcgtttaaaagacgatgcggttataaattctgtaaaaactgcactagaactaggttatcgtgctattgatacagcacaaatttatgaaaatgaagctgctataggacaagctatttcagaaagtggtatatctcgcgatgcgctttacatcacaacaaaaatttgggtagaaaatttaagtaaagataaattaattcctagcttgaaacaaagcttaagtgatttacaaacagattatgttgacttaactctagtacattggccatcaccaaatgatgcagtttctgttaaagaatttatgcaagagttattagctgcgaaacagatgggattaacgcgagaaattggtatttcaaattttaccattccattaatggaacaagctattgctgccgttggtgttgaaaatatcgcaacaaaccaaatcgaattatcaccttatttacaaaatcataaagtggtaaattgggctaaacagcatggcattcatattacatcttatatgactctagcttacggcaaagcattaaaagatgaaacaatacaaaccattgctaaaaaacacaatgcaacaccagcacaaatcattttagcttgggctatgaatgaaggttattctgttattccatcttcaacaaaacgtgaaaatttagccagtaatttactcagcgtaaatatcaaattggatagtgaagataaacaagcgattgcaaagttagattgtcatgatcgtttagttagcccagaaggtttagcgcctcattgggattaa

SEQ ID NO: 3632 - DNA, 234 bp, Proteus mirabilis
aataaatactacaacaaaatcgctgtgagcgttaaaagaaaaggacaattagctatagatcatgctaaacgagccccatcaggcacaggtaaattaaattctgcgagaacgatagcaccgttttcatcagcagccccggtaatcaacacctcagacttgatccctgcaatccgcttaataggaaaattgcaaacacataaaactcggcgaccaattagctcttcaggagtataa

SEQ ID NO: 3633 - DNA, 579 bp, Proteus mirabilis
atggaaaactatattatgattaataaagtctattatttaaaatcagatttggaaaactatagttcttttattcaaaattatcctgatggagaagaaagtataatagggagagcgatggatcagcgatggtctaaatttactgatgactatactgcaatttcattagagttaaattccaatgattttggaagaaagaattataaatttgattttagtagttttttgtcgccatttatggtttttagtgaagatgcattggtgtctttatctgatattttgagttcaagaggacaagtattacccgttaagactgagagcaaacggaagaaatttgttggttattatccaactaattcactttcaggatgttttgacagaaaaaattctgtttatcgggaataccccaatggattaatgattgaaaagccagttctcataaaaaataacatcactgatgagtatttatttactattgacgaatatattagtcgaatctttgttacggataaatttaaacaaagagtagaagatgcaggtttaacggctttcgatttttcagtggaaatagaattatcgtaa

SEQ ID NO: 3634 - DNA, 258 bp, Proteus mirabilis
ccttggagctatagcatgaataaaacaaccttaaaaattgcttgttatgaaattgaagatgttactttgaaacactcttccgataaccaactcacttatgttcatattccatgtgattatgataaagagttttgtatgcaattagatggatgggatgaaaacaccagcattcctgcgcaactgaaagataaaaatattctgctttatcgtcatgcctatgacaaagaaaaccaccattggattttaaaagtagcctaa

SEQ ID NO: 3635 - DNA, 630 bp, Proteus mirabilis
ataggaatatatattatgtatgaaattactcaatttatcgtaagtgataacaaaaatgtagattcaggcttgattataggaggtaataaagcatatgtgtctaaatggcctattaatccaaaaggaaaggagctattgcatcttttctctatagattgtgagaaagtaactcctcagatcgctgatggcattttgcccaaaactggttatttatctatattttcaacatatgatagtaatgattattttcttgatgaaataacttattttggtgatgagaacgagttaggcctgattaaatcaggctttacttttgtatcttattcattaactggtagtttaagtaaaacaaatgaagactttatacctgaaactaaaattgatttattaaatacaaaaattaatagtgaagattatccaatgatatcatttttttcaaaagatattccaaatggattaactggtgtggatgagattttgaaaaattatcattttgtctgtcaggtatattctgcagatttccctctcccttttaaagacgtattgggattgtccgatgccatcggatacttatttattaaaaatgaaggaaataatatagagggccttttcttcgtgcaaacagcataa

SEQ ID NO: 3636 - DNA, 522 bp, Proteus mirabilis
gcaatcaaatattttgtgtgtatggtgtgtattttattgtctataataaaggatttgccatgtagccgtttaaaagaaaaaattgcagagcagatttcaccgccacagaggtcagcattcacagctgacttatatcctgcgctggcgcgagaacaaggctttgatgggattgatttaccccagcccacaattgcaggtgttgcgatggatagcattgatagctatgtgccctcatttaaaggggaacaagtttacggtgtgccagagtcacaggcctcatggtatgcctcacaaatgtttatcggcaacaatatgtgtgcggttatcgctaaacactggctggtggataaagcctgtaatatgcccgcgcgtgatgcgatacgtcagggttacgatattgattgtgataacgacgatgatcgtgctatcagtaaaaagcatcgcaaacgagataaaaataccgcattacacatcagcttaaagagcaggttcactttgggcatgtatacggtgatcgtttag

SEQ ID NO: 3637 - DNA, 648 bp, Proteus mirabilis
gataaaaaatattttttgtggtttggagaactgatgtcaattttacctgagcaaaggaaggctcatttattatcgcgcgtagcggaatatggaaagttaagtaagaagtctcaattcggcggttatagcttaatggttgatgaggttatctttgcgattactgctgataatgaattttatttaaaagggagtggttttgttgaaacactctataaagcaaacaacatggatgcatacgtctatctaaaaaaaggtatccccattacattgcgctattatcgtattacgcaagcaatatggcataatagcgctaagctcaatcaatatatcgattttgcatatcactatagtactcaggagtttttagggcagcaaaagcagcctcgtcgtatcaaagatttacccaatttgggcatagcattagagaaaaagctgaatcaagttgggattaaccgtatcgaggaattacgtacgatcggtgcgaaggcatgttatttaaaactgattgcgcaacctaagcaaggaaatagcgacttattgcttgcgttagccggtgctattgttggctgtcatcgctctgtgttacctagtcaattaaaaatggaattgttaaattggtataaagagttatccgttaaatcctattaa

SEQ ID NO: 3638 - DNA, 321 bp, Proteus mirabilis
caaatgaaatattatattgatgaacatggttattcatgtgccgaagttgaaactgaacatcacctaatagcttggtttttaaaagatgatattcaaggtagtttaaatggtgtaaatgaatatcttgaattatgtgaattggttaagaatggtgagttaccagaatgggaaggtacaggtaatgcccatactgtcaccattaaaccgggtggtgtcgagatttttaacgaatatactgaagagagcgtaacaatctcaacgatagaagagttcaaaggttatctggaaaagtggaaagaattacttttgagtagagaataa

SEQ ID NO: 3639 - DNA, 1515 bp, Proteus mirabilis
gaatatgaatataaccgtggaatgataatgtcagaacaacaaacagataccgcaaaatcgggtgcggtacgcactttgcgtcgagaattaaaggcgcgacatttagcgatgatcgctattggtggttcaattggtacagggctttttgtcgcatcaggtgcaactgttgctcaagcagggccagggggcgcattactctcttacgcattaataggacttatggtctatttccttatgaccagccttggagagttagcggcatttatgcctgtttccggatctttttcaacctatggctctaaatatgttgatgaagggtttggtttcgcactaggctggaactactggtacaactgggctgtgacgattgcagttgacttagtcgccgcgcagctcgtgatgctgtattggttccctgatgtggatggttggatttggagtgcgttatttttagccgttattttcttgcttaactatatttctgtaaagggatttggtgaagctgaatattggttttcattaataaaagtatcgaccgtgattatttttattgcggtgggtattgcgatgatcaccggtattatgaaaggcgctgaaaatgcaggttggcacaactgggaaatcggcgatgcgccttttgctggtggttttgccgccatgataggggtagcgatgattgttgggttctctttccaaggaactgaacttatcggtatcgcagcgggggagtcgaaagatcctgcgaaaaatattcctaaagcagtacgtaaagttttttggcgtattttactgttttatatcctagctatcttaattatcagtttaatcattccttataccgatcctaacttgctacgtaatgatgtgggtgacatcagtgtgagcccgtttacactggtatttaaaaatgcagggttactttccgctgccgctatcatgaacgcagttattttaacggcggttctttcggcagggaactccggtatgtatgcatctacgcgtatgttatttaccttagcaagagaaggtaaagcgccgaaattttttggtaaattatccaaaaatggtgttccacgtaatgcactttatgcaacaacagtggttgcgggtttatgctttttaagctcaatgtatggtaaccaaacggtttatttatggttattaaatacatcaggtatgacaggatttattgcttggttaggtattgcaatcagtcattaccgttttcgtcggggttatgtagcacaaggtcgtgatctgaatgaattgccatatcgttcgggcttcttccctgtaggacctatttttgcctttattctctgtttaattattacattaggtcaaaactatcaggcatttttagaagatactattgactggtatggtgttgtggcaacctatattgggatcccattattcctgctgatttggtttacctataaaatagtgaagaaaacacgttttattcgctacagtgaaatgcagtttcctgagcatattgaaaacaaaaaatag

SEQ ID NO: 3640 - DNA, 1257 bp, Proteus mirabilis
atgagcgatttagtcaccaaagaaagcaaatcaatacattgtcaggagtgtgaccacctcgtatcacttcctacagacctcaagcgcggcgaagacgcctattgcccacaatgtcaagccaagttagcgacctatcgtgattggtcattaacccgactattaattctttctatcaccatgctgatattcgcgtctatcgcttttactcaacctcttatcaagatccatttattagggaccatgatatcagccaatgttcttgacggtattcgcttaatgtcacaacaaggctctccattaacggcaacaatggttgccttttgtgccgttgccgctcctcttagtctacccattgccattttatatctccatttaggggctcgtttacatctaaatttacgtcccgtgctattaatgttaggtaagctaaaagaatgggtaatgctggatgtttatttaattggccttggtgttgccaccataaaactaggcgattatgccacaatctatattggtcatggcttagttgctttttcagctttaatggttttaagtctattaatgcttattaacattaatatggatcaactatggcaacagttttatccgcaaaaagagataaaaacgagtccagcaacctgtcatgcatgtcattaccattttaaaaagccaccttcgagccattgcccaagatgtaaatcttgctatagtgctcgtcaaccaatgagtttgcaaaaaacctgggcagcactcatcacagcgatgatcttgctattaccggcaaatttattacctatctcaatcttttatttaaatggccagcgtaatgaagacactattttttctggtgttctctctttaattaattcaggtaatacacctattgcaattattgtgtttattgccagtatctttgtgcctttctttaagataatcattatgctggggttactattgagcattcattttaactcacgtattcaccctctattgcgcatgaaactttatcgatttgtctcttggatcggccgatggtcaatgctcgacctgtttgtgattgcgctgatgatgtcattaattaatcgagatcagttaatgacattcactatgggacctgcagctttttattttggtacagctgtcattctcactatccttgccgttgaatggtttgatagtcgtttattatgggatacttatgcaacaagaagaaaacaacacacaggcaacccaagccgaaatacgtcgcaaacgtaa

SEQ ID NO: 3641 - DNA, 453 bp, Proteus mirabilis
tccacttggtattatccgtacattttgtacggggaatttatgataaccaaggagatatttgtggatattcatgttcgctttacacaaggtcaaagcatccaaaaaattgcccgtgaactgggtatttcccgcaatactgttaaacaccatttacagcaggaaccgatgccaacgtatactcgacgcgcacccaaacagaccaaattagtgccatttgagccgtacttaatccaacacatccaactggctaaacccgactggatccctgcaactatcttgtttgatgaactttgtcaaaggggatatcaaggtgcaggattgcgcaattgcgtcgtttcgtttaccagtttaaacccattattgcacctgagccgattgtgcgttttgaaacgcctctcggtcagcagatgcagattgatttcaccactattcgccgaagtaaacagaagctaa

SEQ ID NO: 3642 - DNA, 927 bp, Proteus mirabilis
gttattattcactcgtttctaaggtcaataatgaaagccacctcagaagaagtccaagtttttattgcagtggttgaaagtggtagttttacacgtgctgcagaaaaattagcattagccaattctgctgttagtcgtacagtaaaaaaacttgagtcaaagctaggcgttaatttattaaatcggactacgcgacaattgagtttaacggaagagggggagcattactttcatcgtatgcaagttatcttacaagatatgaaattagctgaagatgaattaattaatacacaaaaaacaccacagggtctattacgtattgatgccgcaacgccggttgttttgcatctactggtgccttttattaaacaatttcagcaaaaatatcctcaaataaccctctctttagtttcatctgaaacatttatcaatcttattgaacgtaaagtagatatcgcgattagagtcggtaatttaacggattccagtttacgggcaaaaccactattgaatagttatcggaaaatcgttgcgaccccggactatctcgcccgttatggacagcctaaaatcgcagaagatctgcttgaccatacttgtctaacttttactgaaccagtatcactaaacacatggcctattgagcgagagaatggacaattattagaagctcctatgggaatatcgtcgaatagtggagaaacgataagacaattgtgtctcgaaggtaatggtattgcttgcctttccgattttatggtggttaatgatatcgaaaatggtcgatttatcgaattattccccgataagctgcaacctatagctatgccttttaatgccgtttattatagtgaaaaagtggttagccaacgcatccgtgtatttattgattctctgagtgagtatattgctaaaaaagtaggttaa

SEQ ID NO: 3643 - DNA, 507 bp, Proteus mirabilis
ggaataactcacatgaaaatacccactttattaaagcatggcttaatagctactttgacctttatggtttctttgaattccttcgccgatcccggaaatggtaaaggtaatggaaacggtaatccccatagtcatcaaaatcaaagaggtaacaacggttttaataaaggacaccagaacgtaaaccaacaagatggattttcttcgcaactgcgtattgatagtcgaggagggctctctgtctcaatcacttatgatgatgcaagagcattagcaataaagaacaatctaactggatataaaggtcttcctccgggaatagcaaagaatttaacaagaggtaagccattacctccaggtattgcgaaaaaagccgtacccagcattatgctaagtcagttaccgcattacgatggatatgaatggcagatagtgggtaatgatttggtgttaatcgcaataaccacatcaattattgcctctgttattaataatgtttttgattaa

SEQ ID NO: 3644 - DNA, 456 bp, Proteus mirabilis
gaatgcgctcatatagggcgcgctctttatggagatgaaattatgttatatccagcctttattgaaattgatgaagatggtagcgcaagtggctggttccctgatattgatggttgcatctttgcgggggacagtattgaagaagctcacgcagatgcgaggagcgctattgatgcccattttgaattgttaagcgagaagggtttagatatcccctctccaaaatctcaacaagagcatttaattaattctagtggtgattacaataatggaatatggcttttagttgatgttgatatggataaatacgacggacgagcagagcgtattaatatcacattgccacatcgattattgagtcgcatcgatactatcgtaaaaacaaatcctgaatatgggagtcgtagcggatttattgccacagcaacccgtaaagaactccaaaagaatatttaa

SEQ ID NO: 3645 - DNA, 378 bp, Proteus mirabilis
ggaaattatcaactagcgggcaattatgcgctagtaggtgcttcgtatactaaggctgagtctgacggtaaatatcagcctaaagggaattatgtcccagtaggcagtagttatactaaaaatgaatctgataatcgatataaaaaactaggtaatttaaaacagtttaaaaaaactgcgtcaacagttaatgcagataaaacaatagttaaattcgaatcaaatatgattggtaaacagctttttgctactgctagcgataatagagcatatcctgtcactgtgttaccacctccttatcaatctctcattttatggtatggtggcaatcagttctgggggacaacagtcactactctagtgacggtaaaacattaa

SEQ ID NO: 3646 - DNA, 747 bp, Proteus mirabilis
ctgagggatctcatgggatttgacggaaaaatagcgctagttactggtgcaagccgtggtattggccgtgcgattgcagaaaagctaatagcatgtggtgctaccgtaattggtacagcaacgagtgaaaacggtgctaaagcgatcagcgaatatttaggcaatagaggtaaaggttttgtgttaaacgtcacagaaactgactctattgaaaaatttttagctgatgtgcgcgcggaatttggcgaaattgatattttggtcaataatgcaggtattactcgtgataacctgttgatgcgcatgaaagatgatgagtggcaagatatcattgacactaatctttcatcagtcttccgtctgtctaaagcagttatgcgtgctatgatgaaaaaacgttatggtcgcataattactattggttcagtagttggaaccatgggtaatgctggacaggcaaactacgcggcagcaaaagcgggtgtgattggttttagtaaatcattagcacgcgaagttgcttcccgtggcattacggtaaatgttgttgctcctggctttatcgaaactgatatgaccagagcgttaacagaagaccaaagagccggtattttatctcaagtgccagctaaccgtttaggtaatgccaaagagattgccagtgctgtagctttcttagcttctgatgaagcaggctatatcacgggtgaaacattgcatgtcaatggcggcatgtacatggtctaa

SEQ ID NO: 3647 - DNA, 3537 bp, Proteus mirabilis
cgagtaagtcacaatatgaaaagaatgttaattaacgcgactcaacaggaagagttgcgtgttgcccttgttgatgggcaacgtttgtatgatctggatatcgaaagccccggacatgagcaaaaaaaagccaatatctataaaggtaaaatcacccgaattgaacccagtctagaagccgcttttgttgattatggtgcggaacgccacggtttccttcctatcaaagaaattgcccgcgaatattttcctagtaattatcactcacatggtcgtcctaacatcaaagatgttttaaaagaaggtcaagaggtaatcgtacaggtagataaagaagagcgcggaaataaaggtgctgctttaaccacctttattagccttgcaggtagctatttggtattaatgccaaataatcctcgtgctggcggtatttctcgtcgtattgaaggggaagatcgcactgaattaaaggaagcgttatctagccttgatattcctgatggaatggggttaattgttcgtactgcaggtgtgggtaaatccgcagaagcattacaacaagatttaagctaccgtttaagacattgggatgctatcaaaaaagcagcggaaagccgcccagctccttttctgatccaccaagaaagtaacgtgattgtacgtgctttccgtgattatttacgaccagatattggtgagatcttaattgataacgctaaagtagttgaaatggctcgtagccatattgaagccattggtcgtggtgactttgctagcaaaattcgccactacacaggggctgtaccactatttagtcactaccaaattgaatctcaaattgaatcagccttccaacgtgaagtccgtttaccttcgggtggcgctctggttattgatacaacagaagcattaaccgctatcgatattaactcatctcgttcaacacgaggtggcgatattgaagagacagcctttaacactaacttagaagctgctgatgaaattgcgcgccaactccgtctacgtgaccttggtggtttgattgttatcgactttatcgatatgacccctgttcgtcatcagcgtgaagtagaaaatagaatgcgtgaggctgtgcgccaagatcgcgcacgtattcaaataggtcgcatttcgcgtttcggcttattagagatgtcacgtcagcgtttaagtccttcattaggtgaatcaagccatcatgtttgtccgcgttgtttaggcacagggactatccgtgataatgagtcactttctctttctgtattgcgtcttatcgaagaagaagcattaaaagaaaatactcatgaagtacacgctattgtgcccgtacaaattgcctcttacttgctcaatgaaaaacgtaaggccgtcaccgatattgagttgcgccaagccaatgtcaaagtagtgattgttcctaatgatcaaatgcaaacaccgcatttctcagttattcgtgtgcgcaagggcgaagagatctcttcattaagctacaatttagcgcaatatcacgaaactcagttaaatgaagcagaagatgaagccgtacctgagcgtaaagcgccagagcaaccggcgatatccgcttttgcattacaagataatagcgctgacaccaccaataagaaaaaatctgcaccaactccagctaaacaggtgaagaaaagcgaaacaacagagaatggtggattctttagtgctattacaaaattcttctctaacttatttgcgagtcagccagagcctgtcgttgaagaaaaaccgcaagaaagcaaaaaagagaataatgaaaaccgtcgtgagcgccgaaataataacaatcgtcgcaataataaccgccgtgaacgcgataatgatcgcaatcgtgaccacgagcgcaatcgcgataacgtaacgagcgaagaaaatcgtaagaaccgtaatcagaaagcgcaaaatgccaatactgaagtcagtaatgagcaagaaatcgctgaacgtgaagcccgtcgtcaacaacgccgtgaacaacgtgcagaacaacgtcgtcgtcaggaagaaaaacgtcagcaacaacaagaagctgcgaaagccgcacaaaatacagcggaaaatgacaatgcagcaaaacaggctgagaagaaagaagaacctcgtcgccctgttatgcctcgtcgtgctcgccgtcaattaacgcaatctgttcgtgttactgatgctgccgcaacacccgttattgatgttgctgtgagcgactcaccggtttctgagccaccagcgacagtggttagtcaattaccatcatcagaaaaacaacaagttgcgaaaccagtagcgacggttaaagatgagcaagaacaagtttctgctaatgcgttaactgatactgtaaaagcacaagaagaagtgaaaaaagaagagaatgcgggccaacaagaaaatgtgatgccacgtcgctctcgccgttcacctcgtcatttacgtgttagtgggcaacgtcgtcgccgttatcgtgatgaacgtacattagtctcccctatgccgctaacgatggccgtagcttctccagagcttgcgtcaggtaaagtatgtattcattaccctgtcacaccaattagtgatgcaccatttgttgacaataatgttgaaaatagcactgacaatacagttgctaaaaacttcattactcataaagatccacaaatggttgctattgcaccagaagtatcagaaaccattgctgcagatgttgctcaggctcaaacagcaaatactgaagcaactgaagcgacttattcggtcacagttagtactgaatcaaccactgaagctgtagctgaaattgtcgcgattgcaccgcaagaaacgactgctgatgttaatgagtcaactgccgatcatgtagaagaaaacgctgttaacaacgttattgctgacgttaatacccaagagcatgttactcgtaaagagaatatctctgcggtattaaatacaacggaagcttatctacatgaagtgactgagcaagcagatgttgccgaagagaaaacagaaaccgctcataataaagtcatagctaatgctgatcatgaaaccgctagtgaagacacccatagtgacatgacaacgcaagcgcctgtacctgagatgccagcaacaacccaagcatcaactgaatgtgcggctgagcagcatgtagagcaaactgcttctcaatctacacctgtagaaacacagcctgaagtgaccgagcctgttgctgaaactaaaacggaaaccgaagtcgcatcagttgaagttaagcagccagctaaagtgaccgttattcgtcaagagccaacagtacgccagttacatgctagctcgccaatgacgaaagctccggcatctacagatgcgcctgtagcaattgaaatcaaagcatgggatgcacgtccagcctttgataagcaaggccgtagcggtgcgggtggtcattgttcaactaatcatgcttcatctgaaatgactaaagcgtcaacgcatagtgagtcataa

SEQ ID NO: 3648 - DNA, 348 bp, Proteus mirabilis
tttcccggccatgaggatagttttccgcgatctaaatcaataatgcgggttgccatattacgaataaatgatcggtcatgggaaataaagacaatgctaccttggaaatcctttaagaatttctctaaccataagatagtttctatatctagatggttggtgggctcatccaaaaagagcactttcggtgcgctcactaatgcgcgccctaatgcggcttttcttaaccatcctccagaaagtgaggaaagctcagcttcgccatttaaccctaatttttccaatacttcagcaatacggctatctaataaccagagattacggttatcgagcacttcttgtaactga

SEQ ID NO: 3649 - DNA, 750 bp, Proteus mirabilis
gagcctttacactctatgtactctgtttaccagttttttcaggctatcggtcttggtcttattttacttctaccgctaactaacccactcaccacggtcgcactttggcttggtctgtcggggaatatgaccaaggaacagcgtaatcaacaatcctttatggcatgtgtctatatttttattattatgaccatcgctttttatgcgggtcgtgtaataatgacgacctttggtatctctattccaggccttcgtattgctggggggatgatcgttgcttttattggttttagtatgttatttccccatactcccaatgtggacgatccgctttcagaagaaaaaaatccgcatcgaaatcctcaggcgcccaatattgcttttgtgcccttagccatgccaagtaccgcagggccggggacaattgcgatgatcatcagtacagcagcatcaattccttcacgtacagatattgcgcaatgggtattgtacgttgcacctattaccactttctttttaattagcctgattgtttggctttcactgcgcggttcaaccggtattatgcgctatctcggccacagtggtatcgatgctatttctcgtgttatgggatttttattaatttgcatgggagttcagtttatgattaatggtgtacttgaaatcattgctgatctccccgctttattacaacaagctcaatcagcggctgctgccagcttatcagaaaagttatccgctaaatga

SEQ ID NO: 3650 - DNA, 507 bp, Proteus mirabilis
aatatgttacatcaagatatgatcaataaactcaatgaacagctgaatcttgagttttattcagctaacctttacctgcagatgagcgcttggtgcgatgataaaggatttgatggcgctgccaaatttttaaaagcacattcccgtgaagaaatggagcatatgcaacgcttatttgattatttaagtgatacaggtgctatgcctttgctagggactattgaagcaccacccgctgaatttttatctttatctgatttatttactaaaacttatgagcacgagaagtttattacagctgaaattaataaactagctcacttagcaatgacaacacaagattactcaacatttaacttcttacaatggtatgttgctgaacaacatgaagaagagaagttatttaaatctattctggataaacttgctatggtcggtgatggtggtaaggcattgttcttgttagataaagacttaagtgctctttctacatccgcacatatttaa

SEQ ID NO: 3651 - DNA, 309 bp, Proteus mirabilis
ataatggcacaattaacaacaatatttactatgactgagctttgtcatcatactggtgtttccaaagaggaacttcaagaaattgttgaattaggggttattgagcctgtagaaattaccacacaggagtggtttttcaatgatgatgcagttgttgttgtacatcgggcgttaaaacttcatcgagagttagcattggattggcatggtattgcaatcgccttgacattgttggatgaaaatgaacgattaaagcaagataataaacaacttcgacaacagcttatgcgctttattaataatgaataa

SEQ ID NO: 3652 - DNA, 483 bp, Proteus mirabilis
ccattgggtcttaactggaatttaaaggcttgtagacgtttcatattgcctattatactttggtgtatgaaaaatgaaactaatattcgccgtggcagacattgtgtattcctgatgcacgtccatttggtctttgtcacaaaatatcggcgaaaaatatttgatcaggatgcaattgaaaaattgcgaggctactttgccagtgtttgtgctgattttgatgttgaactggttgaaatggatggggaacgggatcacgttcatttactgattaattacccgccaaaactggcgatatctaatctggttaacagccttaaaggggtatctagtcgattacttcgacgtgatcgtcctgatattgcccaacattattactacaagggggttctttggtcgccgagttatttcgcggggagttgtggtggcgcaccaatatccattatccgccagtacattgagcaacaggaaacacctagttag

SEQ ID NO: 3653 - DNA, 255 bp, Proteus mirabilis
aattatcaacaatccatgctttttataaaccggagaaatcaagtgcggtatatattattattatttatctctttgttttttattgtaatttttctattaaaaacacagggcagtaccaaaagcgatgttatcaaccaacccacagaaatagaaagaaaattaaataaaaaagtcgaaagatgtatgtttcactcaaaaataaaaactaaacgtttgccttggataatgttaacacgtaaacgttcatgctcttag

SEQ ID NO: 3654 - DNA, 405 bp, Proteus mirabilis
aaagataaacaggatgtttatatgcaaaaaatatcaaaactaatggaagcctggggctcatgggttgtaaataataatttatatatcaatacattaacaataaataaacgtgaaaatgtgccaatacgtgttaaattaagaaaagcctgtactgatcgccaaggcatcatagtctcggtatgtatgagtaaactactaaaaaatcataaaaaagattatgaattactagtcgattactatgtatttggacaaacatttattcaattagcacaagcgcatcgatgctctgatacttatatcggaaaaaaactcaaaaaagcagaaggcattgtggaagggatgttaattatggccgaattaatatttattattgagaaaaatgaaaatagtactttacgatcgtaa

SEQ ID NO: 3655 - DNA, 462 bp, Proteus mirabilis
caaatggaacaaattgaccgcacactcgccacagaaaaaaatattgcgttagttgcacatgatcactgtaaaagctcattgcttgaatgggttaaaaacaacagtgaacagctttctcaccataagttatttgccacaggaacaacaggaaatctggttaatcaccatacaggattagaggtcactcagatgttaagtggccccatgggcggtgatcaacaaattggtgcaatgattgcagaaaagaaaattgatattcttattttcttttgggatccactcaatgccgttcctcatgatccagatgtgaaagcgctgttacgcctagcaacagtttggaatattcccgtagcaaccaatcgtgcgacggctaattttcttatttcgtcccctcttttttcacaagagtcaaaaattaaaattcccgactatgaaggttatttaaaagaacgtttaaaataa

SEQ ID NO: 3656 - DNA, 579 bp, Proteus mirabilis
taccctatgcaattttattttgattatgagctaacaatgagttctataaaatcacctataattatctctatcacctcaattgcaggtggcggcaaaacagcactttctcattatataagagaaaagcttccatcaagcaaatgccttcattttgatgatttcgactgccctacagcacctgaagatctcgatgagtggatagaacaaggtggtaattatagcgaatgggatataaagccatttgttgaacaagttaatcagacgatagaagagtctcaatatactcatatcattttggattatccttttgccagatctcacccagcgctacaacagatgatcgactatgctttttttattgatacaccactagatatcgcattagcaagaagaatattgcgtgattataaagagaaaagtggaaatgatattattcattatttagaagagtacttaatctactcacggccctcatatacggcaatgacagaaagagaaaagctgagtgctgacattattattgatggtaacgcatctgtgtctttaattgcacagaatatcctaaagtatattgtttaa

SEQ ID NO: 3657 - DNA, 192 bp, Proteus mirabilis
tatataccgcacttgatttctccggtttataaaaagcatggattgttgataattttatatacaaaattatcaacatgtatagtaataaataagaataattatatttttataaataatcttaaagttatcttaataactttttttgtatcacagtataatattaacaacggtgttattttaagtatcgattaa

SEQ ID NO: 3658 - DNA, 375 bp, Proteus mirabilis
gataaaaagcaacaaaatactggcaataataagggagaagcaatgaaacgtatcattattcccacaaactatattcatatacgaacaacgcctttttggacaagggagacagcccctaaatcaatctgggagagacatttagacaaaggcacccagcaaggggtataccctagattatccgtgatgcaaggcactattatttattatgcctatgccgatcaatatagcccaaagcctaccgaaaccttagtgattaaggagggtgagtttggtgtatttccaccagaaacttggcacagaattgaagcacaaactgaagacaccgtgtttaatatcgacttttatgttgaccccaaaatacttgctgaaggttaa

SEQ ID NO: 3659 - DNA, 198 bp, Proteus mirabilis
tcagtagagcagatcatgcaaaataaaaagaagataaggacagtttaccttctttttatttgtgataaagataagcgttattttttattaagtgaaagttttacattgcctttaggaacacaactacatgcgagtattctgccagaacgttttatggcacctgcttttaatgcattgacatcaccttcatctaattga

SEQ ID NO: 3660 - DNA, 876 bp, Proteus mirabilis
tctatgtggcagaatattggtcgtttgcttgaatcaaatttaggattttcagcaaagatcagcgaaaaacaccacctttcaagcggtgatatacaccacacttggaaaattcaatatggtgagatccctgtctttgtaaaatctaacctacgggaatttttgcccacctttaaaaatgaagcagaacagcttgaaatgttggcaaaaagccaaacgatccgtattcctcgcgtattaggcattggcaatagtaaagatactagcttcttactgttagaatttctgcctgtgcaaccttttacacctcacagcgcgtattgttttggtcaacagttagctaaattgcatcaatgggaagaacaaccccgttatggttttgatttcgatacccatatagataccacacctcaagcaaatggttgggagaagcgctggaattacttctattcggaaaagcgtatcggtatccagttgcaactcgcttcagagaaagggatggttttcggtgatatagaagaaatcattcaaatcattaatcaccgtttagccgatcatcatccacaaccctcactattacatggcaacttatggcctaaaaattgtgctgctataggtcaatctgaaggaacgatgttcgatcctgcttgttattggggtgatcgcgaatgtgatattgccatgttaccgctatgctcttctgtgccagccaatatttttgatggttaccaaagcatctggcctttatctgaaaaattcctatcacgccagcctatctaccaactctactatttccttaatcgctgtcatttattcggtgaagaaaaagattacctagcagccagaaaaatcattgatgatttgctcggcacacactaa

SEQ ID NO: 3661 - DNA, 639 bp, Proteus mirabilis
aatgtcgggcatcattttgctacggattttataaaaaatatgttgccactagttcttgcgtcgacttcgcccttccgagctcagcttctgaaaaagcttggaatgccctttatacaggcctccccaaacattgacgaaacccctttgcccacagagtgtgcacaagcgttagtcactcgtttatcctatgaaaaagcgcgtgctttagaggtacaatacccaaatcacttaattattggttcagatcaggtttgtgtactcaataaaaaaattacgggtaagcctcttaattttgaaaacgcttttgcacaattaaaacaagcatccggtcaatgtgtatcattttatactggattaactttatataatagctcaacattagcctatgaaagtcattgtgaattatttcaagttcactttcggcatttaaccgatgatgaaattatcggctatttaaataaagaaacgccgttttattgcgcaggaagtttcaagtctgaggggttaggaattactctgttcgataaattaagcggtgatgacccaaattctttaatcggattaccacttatccgattgaataaaatgttactctcacaaagaattaacccattactttccacagataatcaggaatag

SEQ ID NO: 3662 - DNA, 243 bp, Proteus mirabilis
tttcattttaaattcaacctggttaataactatttaaatttatttatattcaataagttaaacaaagtactatttttatatttagctaaaagtaacgctcgcttaaattgtataaatttaagccaaatcgctatttttttagcatcaataatgctaggtagtcatctcaccacattgttatttacttttttgagcaataaaatacttaagcaaattataaataacttaccttctagtcattaa

SEQ ID NO: 3663 - DNA, 204 bp, Proteus mirabilis
  unsure (166),(178): Identity of nucleotide at the above locations are unknown.
cttaagcttaaaagaagtcttttaagtgacgaaaggacaaatcttgtgtacgctaaaaaatctttttcactacatctgttacaccctaaatattttcttacttggctaggcggtttaattctttttttattagtacaattaccttacacgtggcttttattcttangaaaacatttangattactatcgcgtttttttatttaa

SEQ ID NO: 3664 - DNA, 1380 bp, Proteus mirabilis
atagttattaaccaggttgaatttaaaatgaaactaaaaagaatggtgttgtttatgttttccccttgttttttagctgtgagcgctgctaatgctgggaattgggaaaatacaattaaagaaagctcatttatttctgattctgaacttgagctgactaccattaatatgtggaaatacctaaaaacagaaaaccgttttgataaacaagagcaacgttatagaaaacaagttgctaatgcttggggtcaaaacttccaagctgatttcagatctggctatttaggtggcattcttggattcgatgtttcttattatggtggtattaaattaggagcaagtaaagacttcgcttctcgtgccatattatataatgatgatggcgaagcaaaaggctataacaaaattggtcaacgttttgcaaaagtgagattcgatttagatcctgttttaattaatggtaaagcgggttggtttaccttgaagaatacaggtatttttactaactcacagcgcttatcattaaacagttataacggttattacactaatacggcgatgggtgattggagtttagatttgctgtatctcgacggaaaagttatgcgtcgtgatagcccaaatatcgatagaatgtatttcagtgatggtaatggtgttagacataatattgaccatgttattactggtggagttaactataattccaaaccattaaaagtctattatttctatggtcaggcggatgatgtattccgtcaacacggtttagaaacaaaatataagttaacatcagacgttactctaggtggtgttgtttattaccacgattatggcagtgaaggaaaacgcacattaaccaatgctaatgcaggtaaacgtaactttgataaggatgcatggcactttgctggtactatggaatggcgtattcctgaatcagcgtggaccattcgtacgggtgtgacttataccgatgcgaaaaaagccaatggtgttggtcaatttgcgcgtaacccaattgggaatactcgtggacgctttaactcaccagcttatgcagatattgactatgtgcgtgatggtgaagtgatgggtgcattagaagctgcatacaaagttaacaatgagttgtctgttggtgcacggactaactatagtgaatttagttactccggcgaaagattaaaacaagggcagtttggcttatttagctactggaagccaacggctaatctttctatttctttaagtggcggtattggttggcaccatcaacaagaaaatgattacaccacaccaaaactgtatgatggtcactcacgacgtgctcactcattatcaggctctatgacaacgacatatcgttttaaaatgtaa

SEQ ID NO: 3665 - DNA, 1173 bp, Proteus mirabilis
aaaaataataaaacctttttgggagcactgatgatcaacgtatcacgcctttatatacaccctgtaaaatcaatgaaagggactcgtctttctcaagcctttgcccgtgaaagcggcttcacgtttgatcgtgattttatgataacgacccctgaggggacatttatcaccgcacgtaaataccctttgttgctgtgttttattcccactgtaatgacaaatggtatttatattcaagcacccgatggtgaaggaattgccattacttatcaggattttcaatcttcattacaaccaactgaagtgtggggaaatcattttaccgcttatgttgccccagatgaaataaatcaatggttcagccgctatttaggcatggatgtacaacttcgctggacgggtgaaaaatcaacacgtcgagtaaaaaaatctcctgaaaccgcggtttcgttcgctgacggttacccttatctattgattaatgaagcctcatttcagtctctgcaacagcgttgcccagcttcaatcaatattgagcaatttcgcggtaatatcatcatcacaggtgcaaaaccttttgcagaagatagctggcaaacaatccgtattggctctgtcgtcatggacttagtcaagccttgcagtcgctgtattatgaccactatcagtatcgataaaggcattaagcatcctaccacagaaccgttagcaacactgcaaacattccgtacagatgaaaaaggcgatgtggattttggtcaaaatattatcattcgccaatcaggtattattcgtgttggggataaagttgaaatattagcttataaagaagcgaaatcttatttacaaacaacagagcaaacaaccgaaccggcaactgacaatgcggttacagcagcctccgctcaagagccaaaacaagctgtcactattgaatttaatggcatcagctttgctgggaataatcaagaggtattgttagagcaactggaaaatcacggttatgctattccctatagttgtcgtgcggggatttgtggctcatgtgttattcaattagatgaaggtgatgtcaatgcattaaaagcaggtgccataaaacgttctggcagaatactcgcatgtagttgtgttcctaaaggcaatgtaaaactttcacttaataaaaaataa

SEQ ID NO: 3666 - DNA, 1077 bp, Proteus mirabilis
attataaataacaagcaaatgaggcattatatgtttttatttaaaaaagctgttatcgctttgtcaattaatatcgcattagtttcttcggctctggcctgcacaacgttattagcagggagtgaagcaactaatgatggctctttgattgtagctcgtagcgcagatagtgatgctttaaaagcacaacattttgttattcatccagccaaaaataatcagactggcatttatagcactcaagcccatcatggcgctaataactttacttatccactacctaaacactcattacgttataccactgtacctaattggaaaactcaattgcatggtgcaacgggttttaatgagctaggcgttggggtgagtggtacagaatccatttttgcctcacctaaagcattggcgttcgatccttatgttgaagatacggggatcactgaagatgatattccagatattttactctcaagggcaaaaactgcccgtgaagcaattgaattactggggaacatcatcgaaacacaaggtgcgggagaaggatttggggttgccgtcgttgataaaaatgaggtgtggtacctagaaactggtacaggtcatcaatggatggcgcaaaaactaccaaaagataaatattttgcgacgggtaatcaagggcgtttacaggcctaccatatagatagtaatgatactttaggctctaaaaacttagttgagtttgcaatagaaaaaggactttatgatcctgccactgatggcgaatttaatttttctaaagcctatacgcgtgatgatgaacgtgatctcacttataattatccgagggtttgggttatccagcaacaatttaacccttctctgaaacagaatgtggcagatggtcgtcaatttgcgcctatgctgacaccggagaaaaaagtatcagtagaagacgccaaagcgatgttacgcaaccattttgacggtacagaacatgatccttataccaatggattgaatggcaatgaaccatggcgaccaataagtgtgtttcgtacttatgaatctcatgtgatgcaagtaagaccttga

SEQ ID NO: 3667 - DNA, 312 bp, Proteus mirabilis
aaacgcgataatttttctggtgtaaattgtgtaggcagtccaatacgatggcaatactcttctgtcacaaaaacggttgatttaatcggtgttgctgaaaccacatgggcaaattgtggccgtggaaatatccacttccaagcgacaaataaaagaatagctaatacaaggattagtcctattagtgtgaactttttgctatcaacactcactttttcccctttttatgcgtttatccctattttactatttttttgttataagcggatttcactcttttatcaccacgttgtaattcaatatgttgaatga

SEQ ID NO: 3668 - DNA, 342 bp, Proteus mirabilis
gaaatggataacgcaagcaagccgtctttccaaaacgtactggagtttgtgcgtatgtatcgtcgtaaaaacaaaatccgtcgtgagatcactgacaatgagaaaaagatccgtgataaccaaaaacgtgttcttttattagacaacttaagtgaatacattaagcctggtatgtcaattgaagatgtactcggtattatcgctaatatgcgtagtgactatgaagatcgtgtagatgattacatcataaaaaatgccgatctctctaaagagcgtcgtgaattgtcaaaacaattaaaagcgatgggtgaaattaaaaatattcctaatattaaaaattaa

SEQ ID NO: 3669 - DNA, 243 bp, Proteus mirabilis
gggctttacaatataagcgtggatgtttatattgctccccattgcggaggggtggccgagcggctgaaggcagcggtcttgaaaaccgccgatgggaaaccatccgagagttcgaatctctcctcctccgccatttcaacatatcctagcgtctccttaacttcctttgatccactaaaaaatttcctagttaatagttttattcataattattcaaatttctgtttgtataaagagtattga

SEQ ID NO: 3670 - DNA, 2181 bp, Proteus mirabilis
ctttatgacaacgtaatacaattagctataatgcccaacaattttattttaggtggtaacaatattatgcgctctctgtttgccagcacaggccgaggtctggaagaattattaaaaactgaacttgaacaccttggtgcccagtcttgccagattacgcaaggtggtgtctatttccgtgctgatgataaaaccatgtatcagtctttgctctggagccgtttagcttctcgcatcatgcttccgctaaatgaatttaatgtctacagtgatctagatttataccttggtgtgcaagcaattgattggagcgaagtatttacagttaatcatacttttgctattcactttaatggcactaatgatgtgatccgtaatagccaatatggtgcattaaaagcgaaagatgctatcgtcgattcattccaacgtaaaatagggcaacgaccggatgttgctaagcaatcaccagatattcgtttaactatacatctacataaagaaaaagcgtcattatctttagatctcagtggcgatggattacatcaacgtggttatcgtgacttaacagggcaagcaccgctaaaagagaatctagccgcagcgattattatgcgttcaggttggagaaccgatacaccattaattgatcctatgtgtggctcaggtactttacttattgaagcagcaatgatggcgacggattgtgctcccgctttaaatcgagtccattggggttttcgtcattggttaggacataatgaagcgctatggaaagaagtcactcatgaagcatttgcccgcttccgtgaaggtaaaaagaatactcaagcgcgtttttatggtttcgatgtggataaacgcgtattagatatggcaagagctaacgcacgccgtgcggatgtggccgatttaattacttttacccaaggtgatgcagcaaaactgactaacccagtatccacgggtgttaaagggacgattattagtaacccgccttatggtgaacgtttagaaagtgaacccgcactcattgctttgcatagccagttaggacgtgcggtaaaagcccatttcccaggatggcgattatcactttttagtgcttctcctgaattgttaagctgtattcagttacgtgctgagcgtgaatttaaagctaaaaatggtccgttagattgtgtacaaaaaaactatttattatcagaaacaccttcgacgattaatacacgactggcggaagattttgctaaccgtttacgtaaaaatgagaaaaaactcgcaaaatgggcaaaacaacagcaaattgagtgttatcgcttatatgatgctgatttaccagaatataatgttgcggtagatcgctatggcgaaaaagtggtgatccaagagtatgcacctccaaaaaccattaatgaacataaagcacgtcagcgtttatttgatgtgattagtgccaccatggaggttttggcattacgctctgatcaactaattttaaaaactcgtcaacgccaaaaaggtaaacaacaatatgaaaaaatggcagagaagggggatttctttttagttgatgagtttggtgccaaattctgggtgaatttaaccgactacctcgatactggactgtttttagatcaccgcattgcacgcaaaatgttaggtgaaatgagcaaaggaaaagactttttaaatctctttgcttataccggtagcgcgtcagtccatgctgggttggggggagctaaaagtaccacaacagtagatatgtcacggacttatcttgaatgggctgagaaaaactttcaagcaaatggattatcaggtagacaacatcgtttaatgcaggcggattgcttacagtggctaagccaaagtaatgaacagtttgatgtgatttttatcgatcctccgacgttctctaattcaaaacgcatggaaaatacctttgatgtacaacgtgatcatattgaattaatgaaacatctaaagcgtttgttaagaaaaggcggaacaattatgttctcaaataataaacgtggtttcaaaatggatcatgaagcattagcgaatattgggttaacagcaaaagagataacacaaaaaacattatcgcaagattttgcacgtaaccgccaaatccacaattgctggctattaaatcatgctggtgaggaataa

SEQ ID NO: 3671 - DNA, 264 bp, Proteus mirabilis
cctttatgttttaggaagactatgcgcccaatttttttgttaataccatttatgtttttaattggctgtaccgagcaaatgagtgtcggaattggcacttctagaacgcataatataggatatccggtttgttcaacattagtttgtggaaagaatacgcgaacagttgaagaacaaaaggcaattaatgaagcggtgcatgaacagcaaagagctattatgcgaggagaaaaaccagatttaaaaattattgcctcatattaa

SEQ ID NO: 3672 - DNA, 384 bp, Proteus mirabilis
agacatagcaataaaataataggtagcaagatgacagacaccaccaacaccaacaccatcgaatgggatgactttttacgggtagaaatgcgggttggcacaattataagtgctgaaataaataaaaaagcgaagaaacccgcttatgtaatggaagtcagcttgggagagctggggactaaacgctctagtgcgcaaatcaccgtgaattatactcctgaagagctaattggtcgccgagttttatgtgtttgcaattttcctattaagcggattgcagggatcaagtctgaggtgttgattaccggggctgctgatgaaaacggtgctatcgttctcgcagaatttaatttacctgtgcctgatggggctcgtttagcatga

SEQ ID NO: 3673 - DNA, 1254 bp, Proteus mirabilis
atggaaagcaaagtagttgttccggctaatggtgctaaaattacattagatgctaaaggtaagcttgttgttccaaataatccggttatcccttatatcgaaggggatggtatcggtatcgatgtcacgccagcaatgttaaaagttgttgatgcagcggttgaaaaagcttacggcaatgaacgtaagattgagtggatggaagtctacaccggtgaaaaatcaacacaaatttatggtaaagatgtttggctgccagaagaaaccttagatcttattcgtgaatatcgtgtttctattaaaggtcctcttactacaccagtaggtggtggtatccgttcattaaatgtggcactacgccaacaactcgacctttacgtttgcctgcgcccagtgcgttattacaaaggcactccaagcccagtaaaacacccagaactgacggatatggttatcttccgtgaaaactcagaagatatctatgccggtattgagtggaaagccggctcagcagaagctgataaagtgattaagttcctgcaagatgaaatgggtgtaaccaaaattcgcttcccacaagattgtggtatcggtattaagccatgttcagaagaggggactaaacgtttagttcgcgcagcgattgaatatgcaattgataacgatcgcgactccgttacattggtgcataaaggtaatattatgaaatttaccgaaggtgcctttaaagattggggttacgaattagcccgtgaagaatttggtggtgagctgttagatggtggtccttgggttaaaattaagaaccctaaatcaggcaaagatattattgttaaagatgttatcgcagatgcattcttacaacaaatcctgttacgcccagccgagtatgatgttatcgcttgtatgaacctaaatggcgactatatttctgatgcattagcagcacaagttggtggtattgggattgctcctggcgctaatattggtgatgagtgtgcattatttgaagcgactcacggaacagcaccaaaatatgccggacaagataaagttaacccaggctctattattctctccgcggagatgatgctacgccatatgggttggacagaagccgctgatttaatcattaaaggtatggaaggcgcaatcgaagcgaagaccgttacttatgatttcgaacgtctaatggacggtgctaaattgctgaaatgtagcgagttcggtgatgcgattatcaaacatatgtaa

SEQ ID NO: 3674 - DNA, 579 bp, Proteus mirabilis
gtgaaaggcaaaagagttgttattgttcatggctatactgcatctcccaaggataattggtttccatggttgaaagaagagcttggatcattaggatatgatgtcagtatacctatgatgcctgagcctaatcatcctaaccctaatgagtggcaacaaaaacttgccgatgaaaacataatacttgataaagatactattcttgttgggcatagtctgggatgtataactttattacgttttctttctgaacaggcttgtgaagatataacaataggcgggtatattttagtcgctggttttaatagtgaacaaaaaactttacctgagttgaactctcatatttataataacctgaattatagtaagttaattaaaatatcggataaaagggtatcattaatatcatccaatgattggattgtgagtcctgattcatccaaaaaattagctagtcaattacaaactcaagttgttattgaagaagatgcgggacattttcttgataaagaaggctatattaaattgccagtcatgcttgatatttttaaatatatgctgaatcaatataagctataa

SEQ ID NO: 3675 - DNA, 798 bp, Proteus mirabilis
gtaaatataaaggagattaatatggataaaattacgattaaaacccctgaggaaattgaattaatgcgtgaatcaggtcgtttattagcccaagtttttacaatgcttgatgattttattgtgccaggtgtttctacattagaaattaacgataaagtagacgattttattactcatgatctgcaatcgagacctgcaagcaaaggacaatatggttatgagtatgtacttaatacttcaattaatgaggtagtatgccatggtgttcctaaagccgatgagctattaaaaagtaaagatattattaatgttgatattacactagaaaaaaatggttttattgctgattctagcaagatgtatgtcatgccagatgcctcacccatagcaagaagattagtcaaaacaacttaccaagcgatgtgggaaggtatcaaagaagttaaacctggtgcaacactcggtgatatcggtcatgcaatccaaagctttgcacaaagtcatgggtatagtgttgtaagagagtattgtggacacgggattggtcgagaaatgcacgaagcccctcaagtattacattatggtattcgaggacaaggtgttgtactaaaagaagggatgacctttaccattgaaccgatgattaaccaaggtggacacaaaataaaaaccaaaaaagatggttggactgtagtcacccgtgataaaaaattatcggcacaatcagaacatactattttagttactgctgatgggtatgaagtactcactttgcgtccagaagaaacacttccataa

SEQ ID NO: 3676 - DNA, 657 bp, Proteus mirabilis
atttacataaattttgagagcaactttcaaaaaattgatcttgatttaagtgaaactcaggtatactgtatatacatacagtacatcttgaacgaggtaaatatgaaactctcaacatcatctttggcaagacaaaatggccttttccaagagatctctactgaggtattacctctttttatggcttccgatgcaattacaacaacaatgcccgataatagacaaggcatggtaagtgaactgctttaccaaaatcccttgatgattaaccacatcttactacctctgttaaaacagtatagccatgaatcacgttggttactgtggttaagtccacaacaaaaattaaatcgtagttggttaaaagaaaccggcttacccctgaataaaatcattcaactcaatcatgttgattcaattaatactgtggaattaatggagaaagcgctactaagtggaaactacagtgtagtattgggttggttaccagaaatatcgtcagaagagatgaaaagattagaatatgctgccagcatcggtaaagcgttaggttttatcatgcgacaacaaaacagtaatcatatccaaatagaaaacaataattcctctaaacgacatttaaactcgataaaaattcattcaaatcactaccattag

SEQ ID NO: 3677 - DNA, 1818 bp, Proteus mirabilis
actgtgataaatagaaaaatcagacaagacaggaataggatagggacaatgaatgagagtagcagctccacaaaccagcattttattcgtaagttagaaggtattgtcggtaaaaaacatgtattaacccaagagcataaaacagagcgatatcgtaaagggtttcgttccggacagggaaaagcgctggcagtggtattccccggctctttattagaacagtggcgtatttttaaaacctgtgttgaagccgataaaattattattatgcaagcggcaaatactgggttaacagaaggttcaacccccagtggtgatgactatgatcgtgatattgttatcatcagtaccttgcgccaagataaaatacaagttctttctgaatataaccaagttattgcctttcctggcagtacattatggcacttagaaaaagtattaaagccattaggaagagagccacattcagtgataggttcttcttgtattggtgcttcggtgattggaggcatttgtaataactcagggggggcattagtgcgccgcggtcctgcttatactgagttatcactttacgcccgtgttaatgaacaaggtgaagcagagcttatcaaccatttgggaattgatttaggtgacactccggaagagatattaaccaatctggataatcgacattatcatgcgaaacaaattcatgcgacggataaactggcatctgatcatgaatatagtgagcgagtacgtgatattgatgctgatacaccatctcgatttaataatgacgaaagacgtctctttgaagcggcgggaagcgcaggtaagctctctgtttttgccgtgagattagatacttttcctgctgatcatcgcactcaagttttctatattgggaccaatgatcctgatgagttagaagatatccgtcgccatattctcagtcaatttaaggtattacccgttgcgggtgagtatatgcatcgaagttactacaagatggcagaagtttatggcaaagatacctttttaattattgataagttaggtacagataagatgccagccttatttgctattaaagggcgtgttgatgctgttcttaataaagtgccatttttacctaagaatctaactgatagaacaatgcaattgatgagtaagttatggcctgctcatttacctgctcgtatgacagaatatcgcgataaatatgagcatcatttaatgctaagaatggcggatagtggtatagaagaagcctcaacttatttaaaagaatattttaaacatgccacgggggattatttcgaatgtacagaagaagaaggtaataaagcctttttacatcgttttgccgccgcgggtgccgcggtgcgttatcatgccgttcatattaacgatgtggaagatgtgctacctttggatattgcattgcgtcgtaatgatcgagattggtttgaaaaactgcctcctgaaatagaaaatcaattactctataaattgtactgtggtcactttatgtgtcacgttatgcatcaagattatattattaaaaaaggtgttgacgctaaggcgcttaaagcacagatgttagccttactagacaaacgtggtgcggaatatccagcagagcataatgtaggacatctctattatgcaaaaccgcaattaaaagcgttttataaacataacgatccgacaaatagcatgaacccaggcattggtaaaacctccaaattaaaatattggggagaagagtgtggttgcgggcataatcataatcaagctgaagttaatcatatagaaaacaaagaataa

SEQ ID NO: 3678 - DNA, 1023 bp, Proteus mirabilis
atgaagataaaaaaattagtttggatagccttttttgcattattgattagcgctggcgcagccacattatatattatgcaaagccttcgtgggttagagaacaatgttgtggtaaagcaagatgaaatgctgcttactgttccggcaggaacagggcgtattgcgatggaacaattgcttattaagaataatctccttaaacaaggagattattttcaaattttattaaaagtaaaaccagaactcagtcaatttaaagcagggacttatcgtttaacaaaaggtatgacactgcgagatgttttgctgttaataaaaagtggcaaagaggcgcagtttacgattcgatttatcgagggtagccgtttaagtgattggcaagctatttttgataaagcccctgagttaaagattgtcgcaaatggtatggaaagcgataagttacgccaagagataggaatgaagcctgaaattacccatcttgagggttggtttgctcctgatacttaccattacactgcaggtacgacggatattgccattttaaaacgtgcttatcagcaaatggaaaaaacattagaagaagagtggctaaaacgcgatagtgatttaccctataaatctgcctatgaaatgttgattatggcatcgattattgaaaaagagactggcattgatgcagaaagaactaaagtggcctcggtgtttgttaatcgtttaaaacgtaatatgcgcttacaaactgatcccactgtgatttatgggctaggtgataaatatcgcggtacaatttatcgcagtgatcttaatggctatacgccttacaatacctaccaaattgatgggctaccgccaacaccgattgctatgccaagtgttgcttccattaaagccgcagcacatcctgcggatacgcgttatctctattttgtcgcagatggcactgggggacataagttttctacaacgttggcggagcataataaagccgtcgcacaataccgacgcttacaacaaagataa

SEQ ID NO: 3679 - DNA, 207 bp, Proteus mirabilis
tcaatatccctactattgttatctcttctactactaaggagaaatatcatggttaaaccaacaatgtcattacgctctcaacatgttaagaatttagcaaaaaagataaaaaaaatgcgtgccatagaaaaggcgattaattgtaataaagaagcagatctacttgttattattaataaaaacccaacacttgtttttataaaatag

SEQ ID NO: 3680 - DNA, 609 bp, Proteus mirabilis
actttgtcaaaggggatatcaaggtgcaggattgcgcaattgcgtcgtttcgtttaccagtttaaacccattattgcacctgagccgattgtgcgttttgaaacgcctctcggtcagcagatgcagattgatttcaccactattcgccgaagtaaacagaagctaaaagcgttcgtggcgacactgggctattcccgagcttgttacgtcaagttctttgataatgaacgagccagcacttggcaacaggggttaaaagaagcgttcgattactttgggggcgtgcttcaacaagtactttgtgataacgccaaagccctcattgtcaagcgagacgcttatgctaaaggtgaacataaactgcatgttgaaatgcttcagatgtcaaaaaattatagttttaagttgaccgcttgccagccttatcgggccaaaacgaaagacaaagtagagcgttttaaccattacctaaaaaatagctttatcgtgccatttaaggcggaacttcgcgctcaaaaccttgaattggatgttgagatagcgaacgcaaaaattggtccatggctacagcgaaaatggggtgttggtaagaatgtattattgaagtga

SEQ ID NO: 3681 - DNA, 420 bp, Proteus mirabilis
cgagagaaaaatctcatgctggaattgataaaaaagaaataccctacagcgatttgttggtctttcggggataatccgcagcttgctgatgaacttgcacaacttgtcgttgaaagaaaaaaaacagcaacatgtagctcattaagtggtttttttagtgatccagtcacgccaacaattggtggttacaatattattttaaatagccatggggttcctatttgtgttatcagaacacgctctttaacattggtacgtttttctgaagtcacagaacagttagcgcgtaaagaaggtgagggtgatctaagcttgtcatattggcaacaaggacataaagaattctttatgcgagaaggcacctactctccagatatggaattaatatttgaagaatttgagttaatagaggttttttag

SEQ ID NO: 3682 - DNA, 606 bp, Proteus mirabilis
tcgttggaaaaaagcgaatcaaatgctgacccaattacaggagcaatggcaggagcgcgcatgattatatatttacatggctttgattccaccagtccgggaaatcatgagaaggtattacagctacagtttattgatcctgatgtccgttttctcagttacagtacgttgcatccacgtcacgatatgcaacatctactcaaagagacggataaactgattaaatcgacaaaacagccggtgctgatttgtggtgtaggattaggtggctactgggcagagcgtatcggttttttatctaatattcgccaagtaatgattaaccccaatctttttccatatgaaaatatgactgataagattgatagacctgaagagtatttagatattgccactaagtgtattcaagattttcgctctaaaaatagagacaatgcattagtgattttatcccgtcatgatgagattttagataaccagcgttctgctgatgagttatcaccttattattcgattatttgggatgaaacgcagacacataagttcaaaagcttgtcagaacatctttttaaaattaaagcatttaatagcaaaatccccgcttaa

SEQ ID NO: 3683 - DNA, 351 bp, Proteus mirabilis
tttgtggaaaatgttcaactttcggtggttcataagctgccgctgagttatcggtggctagcaggctttacaggaacaagggtagaaattctacctgagaatgatgctagtagacaaaataccttgattggcttaaaactgctaagtcatgatggtatgactttagatgaggcaatacagaacttacaaaagtatctgaataatctcaatattgaaaatgtgattattgagtgggatggcgtaccttgtttatttttacatagtgatgatgagtgcgcagcactttgttgcttaaaaaatgctggggttgcaattgctgagccatttccaacagactactcttatctgtag

SEQ ID NO: 3684 - DNA, 513 bp, Proteus mirabilis
aaaggggaaaaagtgagtgttgatagcaaaaagttcacactaataggactaatccttgtattagctattcttttatttgtcgcttggaagtggatatttccacggccacaatttgcccatgtggtttcagcaacaccgattaaatcaaccgtttttgtgacagaagagtattgccatcgtattggactgcctacacaatttacaccagaaaaattatcgcgttttcatcccgcagagcaagagtgccgtgttttctatatgatagaagcgctaaacaataaaagtattgctcacttcccttatgctcaatttagagaatgtattcccatttaccgccaagaaaggcgagttatcggttatgatgtgctttacacaattgatggtacaccgggtaaagtgagaacgacatttaaaccgggcgatatcatcgcgctagatagcgatggccgacttgttttggagcaagagccatattgttctatgaatgaaaatattccttgccgtaaagagtaa

SEQ ID NO: 3685 - DNA, 228 bp, Proteus mirabilis
attaaaggaaattctatgtctaattcaatgactggtacagtaaaatggttcgatgaaggtaaaggttttggttttattactccagcagatggcagcaaagatgtattcgtgcatttctctgcaatccaaagtgataacttcaaaacattagctgaaggccaacaagtttcatttaccatggaaaatggtatgaaaggcccagcagcaggcaacgtggtggctctctaa

SEQ ID NO: 3686 - DNA, 840 bp, Proteus mirabilis
ataaggtgtttgatgtattgggtaaatggacaacagcaacaaagcatcaatgtgagtgatcgcgcggtacaatttggtgatggctgttttacaacacttgctgttgaacaaggtaaacctattctattatctgctcaccttaagcgtttacaacgcggttgtgatgcactgtttttgccctcaccagactggcaatggttagccagccatcttctacaaatagcgtccacaatcactgaaaaaagtgttattaaggtgattattagccgcggaagcggtgggcgaggctattcatcgaaaggctttgacacacccacagtgatcacatcctgctcaacttacccgttttattatcataacttacaaaagcaaggggtttctttagctattagcccagtgagattgggacaaaatagtttattagccggtatcaagcatcttaatcgcttagagcaagtgctgattaaacaccatttagaaacaaccccatttgatgacatgttagtgtgtgacaatgaaggatatttagttgaagcgaatgccgcaaatcttttctggcgtaaaggaaatcaattatttaccccggatattagtctttcgggtgtgaatgggatcatgcgccagcaggtattagattttgcgcaacaattggactgggatattcacattgtgcgagaaaaaccgcaaacgctctatcaagcagatgaaatttggttaaccaatgcactgatgcccattattcccgtaaaacagatctatttttcagatgataagcactatcaatatcgcgatagagacgcttaccatgttgttttacaacactgtttgtcactgacttaa

SEQ ID NO: 3687 - DNA, 222 bp, Proteus mirabilis
agaataaccctaaaaaagccggaaaatccttatggtcttccggttttgttcttgtttggagccgctcagtttctatttttagtggctgttgtaatcgacaaacagttaccgcattctcagcttaattttactaagctggtcttattggcgctggtactgttgcttgatggttctggtgtcatcagtatcaggatgatacgagtatactggtctgcattataa

SEQ ID NO: 3688 - DNA, 993 bp, Proteus mirabilis
cgcattatgaattggtatccttggttaaatcaggcatatcgacaactggtaagtatgtaccaagaagggcgtggtcatcatgcgattttgttgcatgcatctcaaggaatgggggctgatgcactttcttatggattaagtcgttggttaatgtgtcagaataagcagggttcaaaaagctgtaatgagtgtcatagttgccgtttgatgttggcagaaacacatccagattggcatatcttgcaaaatgaaaagggaaagtcatcaatagggatcgaagcggttagaaaagtcaccgaaaagcttgagcaccatgcacaacaaggtggctcacgagtggtatggataaaagaggttgaggcattaacagaagcggcagccaatgcgttattaaagaccttagaagagccaccagttaattgctattttttattgaattgtcaacaacctgaaatattgctagcaacactacgtagtcgctgtttctattaccatttagcaccgcctgagatgaattatgcgatacattggctacaacaacagctacctaatatggcttatgccgatggtgtcacagcattaaacctatctcaaggtgcgcccgttttagcgttatcattactaaaacaagaatggcaagaaagggaagccttctgccaagcgttatatgttagcttacaacaacgaaatttatatgggttgttagctcagttcaatcaagataatgctgaacgtaagatctattggttattatcattactgttggatgctttaaaacgacaaactcatgctgaagtgtattgtgtcaaccaagataagcagccattaattatggcgttatcacagttgccttctgcaatgttgctagcggtgagcgaaagctggaaacagtgtcgtcatcaattagttaccattccagcaatcaataaagagctattgttggcagaacagttacttgattgggaagcccagctagttgctctagggaaataa

SEQ ID NO: 3689 - DNA, 579 bp, Proteus mirabilis
aaaataatgaaatatattattgggatcgcggtattgatgctgacggcttgttcaagtgtgcctgataaagcttattatcaattacctgatgtttatcaaggtgcaaataataaggttgttacaaccactgagagcgcaaagcaagatcagatttggattcagcctatccgtttatctgatatgttagttaacacgggcattgtctatcaaaccagtgatatcaattataccgttgctaaccaacatttgtggataaacccgcttgatcaacagctacagcaaaatctggttgtgggattagcaaaagaattccctaatcgagtggtctcgacacaacctattgaagataaacttgctaaattgactgtcaatgttaattattttcaaggtcgatatgacggcaaagtgattattgctggtgattggatatacactcaaggcaataaagtgattagtcagcctttttctgtcgcgttaacacaaacggaagatggctatccggctctggtacgtacgctaggggaaggatggcagaatgtcgtcgctgagatcgcaaaaacaattaaatcacaatattaa

SEQ ID NO: 3690 - DNA, 654 bp, Proteus mirabilis
caaggtgtgaatatgaccattgaaactataatttctgttttaaaagagtacctagcaaaactaaatgatgaacaaaaaattgaagctctcaataaaataaaaatatcgcttcatcaaataagcccatttaaaaatgaacctactgactgtgttctttggataaagcaacaacaagttatcgctaatgactataatcccaatgtcatgtctccgacagaaaagagattactagaaacgtctctggtaaaagacggttatactcagcctgttgttgtcttacctattcaacaatccaaaaataaaccatcacaatggcaagtcgttgatggttaccatcgttatttattgagtaaaaaaaatagcttaaacaagcgaattaacggctatttacctattactatacttgatgttgaaagtcatactatggctgaccaaatggcagcgactattcgccataatcgggctagagggcaacatcaagtggcagcaatgtcggatatagttagagatttatcaagattaggttggaatgaccaaaagattggtgatgaattaggtatgtcacaagatgaagtactacgtttaaaacagattagtggcttagctgaattattttcagagcacgacttctcagaagcttggacggttaagtag

SEQ ID NO: 3691 - DNA, 192 bp, Proteus mirabilis
aaacgagtgaataataacctaataacgaatcactcttattatataatatatacgctaattgctttaaaatattatttctatatttttatagttagtttttctcaagcaattagcgatatattatctgacactttattcattattaataaagcgcataagctgttgtcgaagttgtttattatcttgctttaa

SEQ ID NO: 3692 - DNA, 1215 bp, Proteus mirabilis
cataccaagaacaattgtgaaaatatacctatattagttttagtggttattattataaaaataatgaatttaataaataatagtatctgttatatgcttatgcaaaatttacataagcaaggtttttctatgtcagagcaaagtcaaacaaccacattggctaaaaaatgttttattcctgtttatcgctggctccccggcttgctgctaacaggtatattaaccgccctcgctatttacgtaggtgatattccatggttttccagtatggggttaggtgctcttacactggctatcttatttggcattattgcgggtaatacggtttatcccatcgctaaaccttatagtgatgaaggcgttaagtttgccaaacactatttactacgtgcggggatcatcctatacggatttagactcacttttcagcaaattgcagatgtaggtgcaacaggattaattattgacgctattatgttgacctcaacgtttctcattgcaatgtgggtggggaaaaaatattttggtcttgatgatcaaaccgtcatgttaattggtgcgggtagtagtatttgtggtgcggctgcggtcatggcaacagagcctgttgtcaaagctcaggcgagccaagttgcggtggctgtatccactgtcgtaatttttggaactatcggtattttcctctacccatggtttttccatcttaacgcttttgcaggttggttaccttttagtgaagaaacttttggtatcttcgctggttcaaccatacatgaagtcgctcaagttgttgcggtgggtcattcaattagtccagatgcagaaaatgcagccgtaattagtaaaatgatccgcgtgatgatgctggcacctttcttaattatcctttctacttatattagtaaaaagggccgtaaaacagtaggtgcgacaacagaaaaaagtccgataactattccttggtttgctgtgttctttatcttaatggctggttttaattcatttaatttaattcctgccgctattgtgagctatatcgttactattgatactattttattggcaatggcgatggtagcactaggtttaacaacgcatattagtgcgatacgtcaagcgggtgtaaaaccactactgctagctttatttctctttttctggctaacgttaggtggtgctgctattaatatttttatccaatctgtgttgatgtga

SEQ ID NO: 3693 - DNA, 186 bp, Proteus mirabilis
tggctctggaagaagaattcgatatcgaaatcccagacgaagaagcagaaaaaattactacagttcaagctgctattgattacgttgaaaacgcaggtaaataagcttgctaatctaggcggtcactcgaccgcctatattcttaatcctaaactttttccctccttggaggataagcgtgtctaa

SEQ ID NO: 3694 - DNA, 675 bp, Proteus mirabilis
cgtttgaggaatggtaggatgaaagagatagaacaattttatcgtgaattagaatcagctattaattttattttagaagataaagagtattatgattttatagataatgctttagtcgattatatagaaaatgctactaataagtttatttatgaatggaatgatgatttttttgaaaaaaaatgtaaaataacacttaatattaatgcattactaaatgaaaaaagtagcacaatcgtgcttttattaagagatttcttaatggaggaaaaagataattatattgagttgatcaattatttttatttttctgtattggagtgttattgtgaagaatactttggcaacaaaatagaaaaaaatttaaatgaactaattgctgtatattttatcacattgtcttatttttctctagatgatcaaatagttgtttttaaaagtctaattaaaaatattaaagctaataatgaatttattgatgatgagttgtcagagactttaataccacttgttttttatctttccaaggaaaaattaaactcagttaatgataacttgaataatgatattgagtggggaataaaagaatttgattttaatttaaaatataaaaaatttgttgatggttttttccataaagaagatataagatcattattaaatgagtttttgtaa

SEQ ID NO: 3695 - DNA, 537 bp, Proteus mirabilis
agaaactaccttttttcttctgatataaatcgcgtaatgcttgcgtcatggccagaaaacgggaatgtggtaatatcttctttattatggccattgattgtatgttttttaattttttattttagaaagcatctattaaagctaatagatactttctttgatggcaagttaaatataaaaatttcaggatttgaactaaatttgaaagaaaattcaatacaacaaggtcacattattctagatctacaatctaaacttgttgaaatgggaaagaaaatacacacattacatcctaattcagaaaaaattttactgcctaatattccaatgaaaaaaaaggtcttatgggttgatgataacccttcaaataatagctatttgattgaaacactaaaaataaatcatatagatgtagatacttcactttcaacaagtgatgccattgaaaaaataaaaagcaataactttgatgttataatatcagatatggggagacccgaagacgatcgagctggcataactcttacaaaaaaataa

SEQ ID NO: 3696 - DNA, 969 bp, Proteus mirabilis
  unsure (623),(631): Identity of nucleotide at the above locations are unknown.
aatgatattgataatcattatcagttagagaattccacgaaaattataaggctatataatatggatatgttccgctctgtaaataaaatttcgcttacggcattatgcttagttgcctcaatcttctttataacccctgcacaggcaaaagataagctaaaagttgtcacgacttttactattatccaagatatcgcacaaaatgttgctggcgatgctgccgttgttgaatctatcaccaaacccggtgcagaaattcatgattatcaaccaacgccaaaagatattgtcaaagcgcaaaaagctgatcttattttatggaatgggttaaatcttgagcgttggttcgaacgttttttcaatgaattacgtaatgtgcctgcggtcgttgtcactgaaggtattacccctatgcctattcgtgaaggagcttacaaaaacaacccaaacccacatgcatggatgtcgcctaataatgcattaatttatatcgaaaatattcgtaaagcgctcgttgaacacgatccagataatgccgcaatttataaccaaaatgccgcgcgttacgctgaacaaattaaacaacttgatgcaccattaagagcaagattagcgcgtattcntgaagaanaacgctggttagtaacgagtgaaggtgcctttagctatttaaccaatgattatggttttaaagaagtgtatttatggccaattaatgcagaagagcaaggcacccctcaacaagtaaaatacgtgattgataccgtaagagaacaccatattcctgtcgtgtttagtgaaagtacgatttccgataaacctgctaaacaagtgagtaaagagactggtgcaaaatatggtggcgttctttatgtagactcactttctgccccgggtggagaagtccctacttatattgatctacttaatattactgtcgataccattgcgaaaggatttggacaatga

SEQ ID NO: 3697 - DNA, 522 bp, Proteus mirabilis
acaatggttgatagacgcgaatcttattctaaagaagacctcattgcttcaggccgtggtgaattatttggccaagatggcccaccactgccttcaggtaatatgctaatgatggatcgcatcattaaaatgactgaagatggcggctcccataataaaggctttatcgaagcagaattcgatatcaagccagacttatggttttttgattgccactttgtcaatgatcctgttatgccgggttgtttagggcttgatgcaatgtggcaactggtaggtttctacctaggttggttaggcggtgaaggtaaaggccgagctttgggtgtgggtgaagtgaagttcactggacaaattctaccaacagccaaaaaagtcacctataaaattgatttcaaacgtgttatcaatcgtaagcttattatgggtattgctgacggtgaagtttatgtcgatggtaaactgatttatgaagccaaagatttaaaagtcggcttatttaaagatacctccgcattctaa

SEQ ID NO: 3698 - DNA, 2691 bp, Proteus mirabilis
ctaaaccgttttttgacgagtaagctttggttatataaccgtaaaatagtcgtgttaactaaaaggcttttttctatgacacaacaaagaattgctaaatatcgtaaagattaccgcgccccagattacaccatcactgatttgcatcttgattttatcttagataaagaaaaaacacaggttactgctattagccaatgcaagcgcttagcgacaacggtaacgccgttggtgttagatggggacgatttaacattaaaatctatttttgttaatgatgttgcttggacacactataaagaagaaaacggcaaactcatcattgaccaattgcctgaacaatttacgttaaaaattgttaatgagattaacccatcagctaataccgcgttagaagggttatatgtttctggcgatgcgctatgtacacagtgtgaagcggaaggtttccgtcatattacttattacttagatagaccggatgttttagcgcgctataccaccacgatcactgcagataaaaaacagtatccttatctattatctaatggtaaccgtgttgcacaaggtgatcttgaagatggtcgtcattgggtgacttgggaagatccgcatcctaaaccaagttatctctttgcattagtggcgggagactttgatgtattacgcgatacatttaacactaaaagtggtcgtgaagttgctttagagttatttgtcgataaaggtaatcttgatcgtgctgattgggcgatgacatcactaaaaaatgccatgaaatgggatgagtcacgctttaatttagaatacgatctcgatatctatatgatagtcgccgttgatttctttaatatgggagcaatggagaataaagggcttaatgtctttaactctaaatatgttcttgctaaaagcgaaacagcaacagacaaagattatttagggattgaatctgttattggccatgaatatttccataactggacaggtaaccgtattacttgccgtgactggttccaattaagcttaaaagagggactaacggttttccgtgatcaagaatttagctctgatttaggctctcgctcagttaatcgtatcaataacgtgcgtgttatgcgtacagcacagtttgccgaagatgcaagcccaatggctcatccaattcgtccagatagtgtgattgaaatgaataacttctataccttaacggtatatgaaaaaggggcggaagtgatccgtatgatccacacgctactcggtgaagagaaattccaagcgggtatgcagatgtatattcatcgtcacgatggtagtgctgcgacctgtgatgattttgtacaagcgatggaagatgcctcgaatgttgacctgactttattccgtcgttggtatagccaatcaggtacaccggtattgactgtacgtgatagctatgacgcacaaaaacagcaatatacattaaccgtcagtcaaatgacgccaccaacggcagatcaggcggaaaaacaagttctacatattccgttagatattgaattatataatcaacaaggggaggttatccctttacgttcacaaggtcagccggtttctaatgtattaaatgtggtgagagaagagcagcagtttatttttgatgatgttgctcaacagccaattccttcattattgcgagaattctctgcgccagtaaaacttgattatccttttacggatgagcaactctcattcttaatgaaacatgcacgtaatgctttttctcgttgggatgcggcgcaatctttattaggtcgttatattaaagaaaacgtttcgcgtgttcaaaaagggcaaccattaattttacctgaaatggtaattgatgctttccgtgctgtattgcttgataaagatatcgatcctgccttggcggcacttattctgacattacctaccgatgttgaagcgggcgaagcttttgctattatcgatcctattgctattcatcaggtcttaggttttattcgtaaaactttagccactgaaatggctgatgagttctctgcggtttatcactcaatgcatatcggtgcttaccgtgtcgatcatggtgatattgctaaacgtgatttacgcaatgtctgcttgggttatttagccgttgaaaaccagcaaacgggtaatcaattggttgaagcgcaatatcacaatagcgacaatatgaccgatgcactcgcggccttaaatgccgcagtaatggcacaattaccttgtaaagaggcactattacaagagtttgatgataaatggcatcaagatggcttggtaatggataagtggtttagcttacaagcaatgagtccggcaactgatgtattacaaacagtacgcagtttgctatcacatcgctcttttactttagctaacccaaatcgtactcgtgctttaatcggtgcgtttgtgaataataaccctgtggctttccatgcagaagatggctcaggttatttattattgacagaaattctgactgacttaaatagccgaaatccacaggttgcatctcgtcttattgagccgtttattcgtttgaaacgctatgatgctaatcgccaagagaaaatgcgtgccgagttattaaagctaaaagcccttgataacttatcaggtgatttatatgagaaaatcactaaagcattagcggattaa

SEQ ID NO: 3699 - DNA, 189 bp, Proteus mirabilis
aaagaggctgatatgtctacaatgaaaactgaagtcgttgttattcgtttaaccaaacaagagcgagctgcattagattcaataaaaacgatgccattacttgcagattggctaaaggagctagccctttccaagtggaaggagcaggcattacaattagaacaatctaaaaatgggcatagtaattaa

SEQ ID NO: 3700 - DNA, 234 bp, Proteus mirabilis
tggttgtatgaaaaacaatcattatctttccgcttaaacttagaacgtgagggttgtctaaatatgaaaagacagaaacgagatcgtttagctagagcattatcgaaaggttaccaagccggtatgcaaggtcgttcaaaagagcagtgtccctattttgccattgatgcacgttcacattggctaggaggttggcgacaggccatggaagatcgccctgggcttgcaaaataa

SEQ ID NO: 3701 - DNA, 522 bp, Proteus mirabilis
agcaaaaatgaagtaatgaccttaccttctaaagagttgataggtatggctcatcaatacaataaaaatatttcagcattggaatttgataagaaaaaatttagaaaagaattctggaagaagtttttaaaagaaatacataccatccctacagaaatgtatgccacacatcgtgcttctgcaggctcgctagatgatacgacttatatttatacaacagcagtaagtaaagaacaattaacaagctctgctaatatttccactatgtctaaagtagaattacccaatgggaaatatttagttattacttttgagatggataatattttagattccctcaccgggtatgatgatattatttatactgtatataccaaagtattaccaaagatgaatttgctacgtcgatctggtccagatattgagcgctataccttaaaacaatcggttagctatgataagttaatcggccatagtgagcagcatctacaagaaattagttactatattcctgttctttag

SEQ ID NO: 3702 - DNA, 1359 bp, Proteus mirabilis
tctattgatgaggggtttaatttattttctatctttatttttaattatcttaaaataatgaaatggctgatgcaatcatatttaaaagtgatattattattttataatcatttatatatttacattatttttattttaatgctggagatacacgtgaataaaagagcactttcgacaaagtatcgaaattcgatgtatccatcaatgataaaaaaaatagggggatacggtttatcgttattcttgataccaataatattctttcattccgctaatgcgttagagttatccgttcctattggctcaacaggttatttaggggaggtcactccgccagttggttcaacaacgaaaaattatgggatggtaagttcagtgcttcaggcgaatagatcttatataagttttcggtgggagcctagtcaatttgtgataagtgacctgcctttttaccccgaaatcggtcgagtgggtgtggctatctacaataaaagcaatcctaaaggggcctttattgttttagcacccagtggatatggtttgttgcgttataaacgggctaacgatacatatgagaatgcttcattttcatttagtcgttccaaaaccaccgctatgacaaatatgtataataattttccctctaattctgatgaattaagttggggtcttttgcccagacaaggcaatagtaattttttctcagcacgatacgtagatggtagtgataaagttcattcgttaacattaacaatatccagttattccgcgtatgccatcgggccattagaggccggtgaatatgccatgcgtgatgattcaaaattttatgccgtcattcgcactagttcaggttcttttgcaagatctaaaacattattaagttcaatggataatgtgaatattaaagcacttaaagcctgtgacgttatcccccaaacgtctaccaatattcagtttccgactcaaatcgcgaaaaattatgcaacacccactaaattagcagataatttagctagtatcagtgtcaattgtccttatgctaataaaaatatctatctcactctgagcccttttaataatttagtctcaggcagtgaaacagggatggagctatccaccagtagcactgaaaatatcaccacactgccttatgtggtggcttctttaaaatctgcacaatcaaatatttgtcaagccaatgcacaagatgccttgcgactcgtcggtagtaataaactagcacaacaaaatatgaagagttttacgcaaaatatactttttaacctttgtgctaatggcaatatcaaagccaataaatatgcaggggcaattaatgtagcaattttaattgaatag

SEQ ID NO: 3703 - DNA, 204 bp, Proteus mirabilis
agagtggatgatgacgctttacatacatcagatctattttctataaccaataacactgtcgtcacattattatgcaataaactgtttgctaacaataaagcaaataagaatacttatcaatgcgattgcgaatataaattagaattttctcttatttgtgtaattattagtcatagaatagaaaaagagccggctaaattgtga

SEQ ID NO: 3704 - DNA, 336 bp, Proteus mirabilis
atgactgacgagttgggcaaaactagagatagttttatagtcaaggcttggaatttagttatttcttttattgttggtctttctgctttttttattcttagattgataatcttaattacattaaatttaatagcaacttctaataatgtggcaacaatacaaacaataggtgggataatggttgtgctatctattggtattgctgctatctatactaaaattcttaactcaagtggaacgcttgaaagccgaaaacgaaaaaagatcattacggttattgtagggggagtttccttgtacatttctactgtacttctgcatattcctgttttttag

SEQ ID NO: 3705 - DNA, 546 bp, Proteus mirabilis
tatgcgcgccttatgcaaaaggtaaaattacccctgaccattgatgcgctgcgagcagcacagaagaatttagactatgacggtcaatattcctctgagcaagttagccgcttagctgaatcggtggtcagtgtggacagtaatattgatgtggctttatcatttgatattgaccatcaacgtttggcagtcatcaaggggcattccgatgtggatgtcactttagagtgtcagcgttgcgggggccattttccctatcatgttcacacaacatattgttttagccctgttgttagtgatgaacgggctgaagcattaccggaagaatatgagccaatcgacgtagacgattttggtgaaatagatttgctggcgatgattgaagatgaaataatcctcaacttgccggtggttccggtacatgattttgaacactgtgaagtgtccgacgcggaacaagtgttcggtgaactccctgaagaattatcagagaagccgaatccatttgccgtattagccagtttaaagaaaagtactaaggagtaa

SEQ ID NO: 3706 - DNA, 1668 bp, Proteus mirabilis
ttaaggagcctaagggtgactgaaaagaacgatactgctttaacacaagcaaaaattaataaactgaaaagctggtctccagtttggataatacctcttgttacgttattgataggagcttggatactttattatcatttcagtcatcaaggtcctgaagtcacattaataacctataatgctgatggtattgaagcaggtaaaactaaaataaagagccgtagtgttgatattggcctagtcgaaagtgtgacattagatagtaattttagtcgagtgatcatcaaagctcgtctcgataatgaaatgaaagagctactgcgtgctgataccgctttttgggtggttaaaccacaagtgggaaaagaaggtgtcactggtttaggtactctactctcaggtgcttatattgagctacaacccggtttaacaggcaaagagcaggatgaatttaatttattggactctccgccactggcctctccggatgcaaaggggatacgcattaatttagtcagtgaaagagcaggccagcttaatgcaggtgatccggtattatttaggggttatcaagtcggctcggttgagacgagtgaatttaatattgaaagccgagatatgcactaccagctttttatcaaagcaccttatgacaaaatggtcacgtcgaatgttcgtttctggaaagattcaggcattgcatttgatatgtcatcatcaggggttcgtgttgaaatggcttcgctttccacactgtttagcggtggggtgagttttgatgtgcctacggggtggttacctggtgaagctatagcccctaaaacagaatttaaactttatgataacgaaaagagtattcaaaattcgttatataccgattaccgtagctatattatgtttttctctgattctataagaggattacaagccggagcgccagttgagttccgtggtattagaatgggtacggttgttcaagtaccctattacacccaagaaatgcaacaatcgttagataaagatttccgtattcctgtgcttatccatgttgagccggaacgttttgcgaatgatgtaggtgaaagttttgatttcgtaaaagagctttcttctgctgctgaaaatggattaagagcatcgttaaaatcaggcaatctattaacaggtgcgctgtatattgatctggacttttatcaagatgttgaaccttggaaagggccacaaactgttgcaggattaccacaaatacccacagtcagttctggtttaacgcaaattcagcaaaaagtgatgacttcattggataagatcaacaatcttcctgttgagccaatgttgaaagagatgactgcgacattaaccgaaagtcaaaaagcggttgctgaagcgaaggaaactctgaaatcattaaatgctatgattggtagtgatgacttccaaaaactgcctaatgatattcaacagtcattaaaagagatcaatcgcagtatgcaaggtttccaacctggctcaccggcatacagtaaaatggttgataatatgcaacgcttagatcaagtgctcagagagatgcaaccgctattgaagaccttaaacaataagagcaacgcattaatttttgaagcacaacaaggtaaagatcctgaaccaaagagggctgaaaaataa

SEQ ID NO: 3707 - DNA, 1062 bp, Proteus mirabilis
atcgtcgtagacatatcattcctaatacccgatattctcaatggagatcgtatgtattattccttagtaaggaaggcattgtttcggctagatcctgaacgtgcccatgattttacctttcgtcagttaaaacgcttatctcattccccatttcaatttcttattcaacaatcacttcctgccaaacccgtttcttgtatgggactttcatttaaaaatcctctcggtcttgccgccggccttgataaaaatggtgattgcattgatgcattaggggcaatgggttttggctttattgaagtgggtactgttacaccacgagcacaagtaggtaatgacaaaccgcgtctctttcgcttagtagaagctgaaggcttaattaatcgaatggggtttaataatttaggggttgataacctaatagagaatgtaaaacaatctcaatatggtggtgtgctgggtattaatatcggtaaaaataaagatacccccgtagagcaaggaaaagatgattacttaatctgtatggaaaaagtttacccttatgcaggttatattgcgattaacatctcttcacctaacacccccggcttacggacactccaatatggtgaagcattagacgatttattatctgcgattaaaaataaacaacttgagttacaagggaaatatcaaaaatatgtgcctgtggccgttaaaattgcccctgatcttactcatgaagaattaatccaagttgcagatagcttagtgcgtcaccatattgatggcgtaattgcgaccaatacaacattagacaaatcattagtgagtggattagatcactgcaatgaagctggtggattaagcggtcgtccggttcaatcaaaaagtacacaaatcattcgacaactaaatgaagagttaaaaggcgctttacctattattggggtaggggggattgattcattgactgctgcacgcgaaaaaatggatgcaggtgcttctttaatacaagtctattcaggattcatttatcatggtcctgcacttataaaatctataattaatcatatttaa

SEQ ID NO: 3708 - DNA, 237 bp, Proteus mirabilis
tggaaggtagataatatgtttccagaatatcgtgatttaattgctaagcttcgtcaaactgatccccatttccgagccctgtttgaacaacataatgaacttgaccataaaattgtacgcttagaacaccgagataggcgaggatatggagaagaagttgttgaattaaaaaaacaaaaattacgtctaaaagaagaaatacatcagatcttaaaaaatcccccagaagatgagtag

SEQ ID NO: 3709 - DNA, 453 bp, Proteus mirabilis
ttaccgcaagagattggtgaagtgactttatgttgggtttgggaatgggctgatctaaccgcttttgtttcttattacagtggattaaaagcatatccacaacactatgctattggaacagataaagcagataatgactctatctattggaaatatcgtaagttacaaacattagtaatgacagattatcctcaatttgctcctattgttaaaaaagcataccaagaatgggaagctaaaacagcattagaacaaaaagaaatggaggctaactatttgtcaatgagtaaaaagaataaagcagcagcggataacatgctgaatgaatttaatttacgtgtaatggctgatgcagagcaattaactgaaaacctaactaatcaactctttactcttaaaactaaaaatatacaagatgagatcttttttgctaatcaatctaaaaaagattaa

SEQ ID NO: 3710 - DNA, 237 bp, Proteus mirabilis
ttgtcgaaagagacaacaagctcagataaagttaaaaaatctgatatggatgaagcaccacaagcttgtgctatctcttgtgttgttggaatttgccgccaatatggttctccgataagaataagcccacctgttttaatactttttgctagtagctcgatagtttcaattacaccaccagcaatccaagttgctcctatgcatgctgctatatcacattttttatcactaatataa

SEQ ID NO: 3711 - DNA, 198 bp, Proteus mirabilis
tttactgaagataaatcaacttttttatggaaaatcccactttttttatgcagaaaaataattcgtttatttgtaggtatgatcaaccaaatattagattttacgattccgctattaacacataaaactgtttcatcattatttaataattcaggtaatctagtaaatatatcaaaaacacccattgttgatttataa

SEQ ID NO: 3712 - DNA, 963 bp, Proteus mirabilis
cataatcgagatatcactatggaattaaaggattattacgccattatgggggtaaaacccactgatgacatgaaaacaattaaaactgcttatcgccgtttagcgaaaaaatatcacccagatgtaagtaaagagccagatgctgaggagcgttttaaagaaatagcgcaagcttgggaaattcttggtgatgaacagcgcagagctgaatatgacgaactttgggctcaccgcaatgatccgaaatttaaacaatttacacagcacaacaattcacattcaaaccaacaaagttttagtcaggaagattttgacgatctttatgcttctttctttggtcaaggttcaccttttgaagggcgccattcacgtcaagcacctagacaacgtggacaagatctagaaattgaattaccggtttttcttgaagaagcacaagaagagcataagcgtaccattagctatcatttaccggtttataatgtctttggcatgatagagaaagaaattcctaagaccttgaatgtcaaaattcctgccggtgttgttgatggacaacgtattcgtttaaaaggccaaggtactgctggggagaatggcggagaaaatggtgatttatggctaactatccgtattgcacctcatccattatttgatgtaaaagggcatgatcttgaaattgtggttcctattgcaccttgggaagccgcattaggtactaaaattgctattcctacacttaaagataaaattttacttactattcctcccgctagtcaggcaggtcaacgcctgagaattaaaggaaaaggcttagtaagcaagcaaaaaagtggtgatctctatgccattttgaaagtcgtcatgccacctaaagtggatgaaaaaacacattcattatggcaacaactcgccgaagcccaagccgattataatccacgtaaaaactgggagaataaataa

SEQ ID NO: 3713 - DNA, 339 bp, Proteus mirabilis
ataaaaagagagattataatggacttaaaacaatgcgataaaaaacaattaaaagaagagtttaatcgacttacagcattaacaagttataaatcaacaatgggtgtttttgatatatttactagattacctgaattattaaataatgatgaaacagttttatgtgttaatagcggaatcgtaaaatctaatatttggttgatcatacctacaaataaacgaattatttttctgcataaaaaaagtgggattttccataaaaaagttgatttatcttcagtaaactatgatgcaattacttctattgactcatcttccggattgacaggagtaaaataa

SEQ ID NO: 3714 - DNA, 1419 bp, Proteus mirabilis
acgaagagagatttatttatgatcgttgcgcctgtagtcgacgtactgcaaggccgtatcgcggttggcgaagacgtcaccgttcgcggttgggtacgtacaagaagagattcaaaagctggtatctcattccttaccgtctatgacggttcctgctttaatccagtacaggccatcattaataataatttaccgaattatcaagatgaagtgctgcacttaaccacaggttgctctgtggaagtcaccggtaaaattgttgaatctccgggtcaaggtcagaactttgaaattcatgcgaccaaagttgtggtagtaggaatggttgatgatccggaaacttatccgatggccgctaaacgtcacagcgttgagtatctgcgtgaagttgctcatcttcgtccacgcacaaacttaattggtgctgttgcacgtgttcgccataccttggcacaagcactacatcgtttcttcgatgaacaaggctttttctgggtttctacgccattaattacggcggcggataccgaaggtgcgggtgaaatgttccgtgtctctaccttagatatgaacaacctgccacgtactgataaaggtgaagttgattttagcgaagacttttttggtcgcgaagctttcttaaccgtatcaggacaattaaacggcgaaacttatgcctctgcattaagtaaagtctatactttcggcccaactttccgcgctgagaattcaaatactagtcgtcacttagctgaattctggatggttgaacctgaagtggcttttgctgatctgaatgatatcgccggattagcagaaaaaatgctgaaatatgccttttctgccgtgttagctgagcgcagagatgatatggagttttttgctcaacgcgttgataaagaagccattacacgtttagagcactttatcgcttctgatttcgcacaaattgactacacagatgcgattactgtgttagaaaattgcggccagaaatttgaaaacccagtttattggggtgttgacctctcctccgagcatgagcgctatcttgctgagaaacactttaaagcccctgtggttgtgaagaactacccgaaagatatcaaagcattctatatgcgtatgaatgaagacggtaaaacagttgcggcaatggatgtgttagcaccgggtattggtgaaatcattggtggttctcaacgtgaagaacgtttagagatgtttgataaacgtttagctgagatgggtatgaataaagaagactactggtggtatcgtgatttacgccgttatggcacagtaccacactctggttttggtctcggctttgaacgcttagttgcttatgtgactggtgtcacaaatattcgtgaagtgatcccattcccacgtacaccaagaaatgtcgatttctaa

SEQ ID NO: 3715 - DNA, 765 bp, Proteus mirabilis
caattaaaggaaattaaaatggatattcctcgtattttcactattagcgaaagtgagcatcgtattcataaccctttcacaccagagaaatatgccaccttaggtcgagtattacgaatgaaagaaaactggcaaattcttgatctcggaagtggctctggtgaaatgctatgtacttgggctcacgattacaatattacaggtattggcatcgatataagcccgctgtttactttacaagcaaaatctagagcagaagagttaggcgtcagccatcgagtacattttatccatcatgatgcctcagattatattagtgataaaaaatgtgatatagcagcatgcataggagcaacttggattgctggtggtgtaattgaaactatcgagctactagcaaaaagtattaaaacaggtgggcttattcttatcggagaaccatattggcggcaaattccaacaacacaagagatagcacaagcttgtggtgcttcatccatatcagattttttaactttatctgagcttgttgtctctttcgacaatcaaggatacgatctagtcgaaatggtactggcagatcaagagggttgggatagatatgaagctgctaaatggatgactatgcgccgttggcttgacaaaaatagtgccgataattttgctcaagaaattcgaacagaattgaccatagcccctaaacgtcatgttagttttacacgagaatatttaggctggggggtatttgcattaattgctcgataa

SEQ ID NO: 3716 - DNA, 207 bp, Proteus mirabilis
gatgcttgggaaatagatgtgcttgaagatttattaagtggggcagttgttgaattagctaagcgtgaagacgcgttttgtgaactacaggctgataacgtagctacgacaataaacgccggtatgagcttaagcattctcataaacggtttatttctcattgtgacagatttcccttacatccttatgtgccagatgagcacatga

SEQ ID NO: 3717 - DNA, 426 bp, Proteus mirabilis
gtgcttgcactattgtcgcaaaagagagcgatactgctgagaaagcatttagccaagccaaagcgattattcgcgcaaacttactctaatccaccggcacatggggcatctgtggggaccactattttatctaacccagagttaaaagaagagtggattgaagagctcaccacaatgcgtgagcgcattcagcgtatgcgtcaattgctggtgacaaccttacaagaaaaaggcgcaaaacaagatttcagctttattattgaccaaaatggtatgttctcatttagtggccttaataaagagcaagttgaacgtctacgtgctgaatatggtatttatattgtcggctctggtcgtattaatgtcgcaggcttaacactggaaaatatggttccattgtgtgaagccattgtcgctgtactttaa

SEQ ID NO: 3718 - DNA, 294 bp, Proteus mirabilis
tttaacgcactaaagttaacgttaacatataagttatgtgcgatagatcgctatttgtatatccccattaaacgaggttctccctatactcaacgctatgctccttttatttcttattcattagatatttcacgttttagtcaatatggtttaccataccttttatcgcagttaagcattgttaacaatttgatatttgtgacactatcatcaatcaaactttgtcgttatatccattgtttaaacccgatgcaactcaatagtgcaaggtttaatgctttaaaactcatttaa

SEQ ID NO: 3719 - DNA, 417 bp, Proteus mirabilis
gatatgaattggtcttttattctaattttagctctatttgtagttgttggttgtgttgataaagagaggaatacatctggctctatagaaaaggtggcaacagagatagcgactcttactgttcaatatcaccacgatgaaagtcgttatcccacatttatgttatcaaaacaatctcgttttgaaatgcaagccaaggaggaaaaacagaaattcaatcaattatttaaatttggatttgaagagccaaccacacccactaatagcgaatattcctataaaaaggaacaacgtataagaaagaatgatcagtcaatgattattctgccagaagcgatacctgtatggaataaagataaacaagaagttgaagttaagtggagctacagaccaaaatatgtttttgatgcatattaa

SEQ ID NO: 3720 - DNA, 219 bp, Proteus mirabilis
atacgttgttgggttttttattgttttattcgtgctgtgggaaaaaaccatactgaatttgttttgaaagccgttcgacgttcagctgaagaaacactgaaagatctgcgagtcataaatgttaatcccgaagtttatcaggaatttatcaacccgcttgatgcaacacttgtaagcaacgagacattacgaaaaacagtgatgtctaaatccccttaa

SEQ ID NO: 3721 - DNA, 207 bp, Proteus mirabilis
accgcctgttgcatgtggagcttgtatgcatcggtatccaacagtgatgtaataatcggtgtagcgtctaaaatcatagcgcgtcaagcatcctcacggagcgtttttatgtcagctaaatcgttaaggttggagagtatacccgaatatgatgataatgcgtcactattcgttaatatttctctgcgacataaaaacaagctgtaa

SEQ ID NO: 3722 - DNA, 1413 bp, Proteus mirabilis
aaatctcgttggagagttaagatgaattttccgttaattattaacgtactcgtctttgttgtgctattactcatcttggctaaattaagccaacgtcagtggagcctgtcaaagaaagttcttgtcggtttggtctttggggtggtgtttgggctggcgttacatgcattctatgacgcacacgatcctattattaaagaatctatcctttggtttaacatcgttggtaacggttacgtgcaactgttacaaatgattattatgccattggtatttgcttctattttaagtgcagtatcacgtttacaccaagcatcatcattgggaaaaattagtgcactaaccattggtacacttctatttacaacggcaattgctgctcttattggtattgttatagccaatatctttggtttaacagcggaaggtcttgttcaaggggaacaggaagcgcagcgtttagccgctattcaacataattatataggtaaagtgtctgacttaactgtacctcaattaattttatcttttattcctaaaaatccatttgccgatttaactggtgcaagctcaacctcgattattagtgtagttatctttgcggtattcctaggaatggctgcaataaaactgcttaaagaagataaacctcgcggtgaaaaagtattagcagcgattgatagcttacaagcgtggatcatgaagttagtccgtatcgttatggcattaacaccttacggtgtaatggcactgatgactaaagttgtggcaagctccaatctgcatgacattattcaactcggtagcttcgttgttgcctcttatgttgcgctgggcttaatgtttgtcgttcatggtttattagttggatttactggcttaagcccaattaaattcttcaaaaaagcaggaccattattagcatttgcatttacaagtcgttcgagtgcagccagtattccattaaatatcgaaacacaaactcgtcgcattggtgttcctgaatcgattgccagtttctcatcgtcttttggtgcgacaattggtcagaatggttgtgccggtatttatcctgctatgttagccgttatggtggcaccaacagtcggtattaatcctttcgatcctctttggattgccactttggtgggtatcgtaaccattagctcagcaggtgttgccggtgtcggtggtggtgcaacctttgcagccctgatcgttttaccagcaatgggattacccgttacactggttgccctactaatttctgtggagccccttatcgatatgggtcgtactgcattaaatgttagtggctctatgaccgcaggtactattactagccaaatgatgcgccaaacagataaagagatctttaatcaggaagaagaagctgaacttaatgtgaagtaa

SEQ ID NO: 3723 - DNA, 1239 bp, Proteus mirabilis
ctacgcagttgtcagtatattactcgttattactcacattgcaccaaggaatgtttagcaggaagttgtaattcattatatgatatttttaggcttcccaaattcaggaaatacacaatggactataaacttaatttagattggcaatcatttttagaaagccattggcaaaaacgtcctttattaatcaaaaacggcttctctggttttgttgatcctttatctcctgatgaacttgcaggtcttgcaatggaagatgaagtggatagccgtcttgtgagttgtcaagatgggcagtggggagttaaacatgggccttttgagcactttgaaggtttgggtgataaagattggtcgttattagttcaagcggtcgatcactggcattttccaagtgcggcattgatgaaaccttttcgtgtgttgcccgattggcgtattgatgatttgatgatctcttactctgttcccggaggcggtgtgggccctcatcttgatcaatatgacgtatttattattcaagggcaaggtcgtcgtcgttggcgtgtgggtgagaaaatcccaatgaaacagcactgccctcacccggatttacttcaagttgatccttttgacgccattatcgatgaagaattagagccgggtgatattctgtatattccacctggatttcctcatgaaggctacgccattgaagaatcactaaactattctgttggctttagagcacctaatgcacgagagctatttagcggttttgctgactatgttttagcaaatgacttaggaagctaccgttacagtgatcctgatcttactcctcgagataatccggcattagtccagcatcaagaattaaataagttgcatgatatgatggaagacttacttgcccaacccgaagtcttccgtcattggtttggggagtttatttctcaatctcgccatgaacttgacttggccattcctgaacctttatatgaaaatgctgagatccacgatttactgcaacaaggtgaacaacttcatcgtttaaacggtattcgcgcactgcgtgttggtgatagttgctttgttaatggtgaattaatggatactcatcatattgaagctgcagatgccctttgccaatatgattgtattgataaacaacatttaggtgatgctttagcagatccaaaatttatacgcttattgacgcatcttgttaaccaaggctattggtattttgaagattaa

SEQ ID NO: 3724 - DNA, 675 bp, Proteus mirabilis
accttcttctgccaaaaaaatattgcgaaatacttgccaagtttcagtactacgagtaattttgtcgccattatcgtcaatgctatttatagaaggttacctatggcaaaagctaatgaaattaagcgcggtatggctatcagttataacaataaattattattggtaaaagatatcgacatccaagcgccaagtgctcgcggtgcaagtactttgtataaaatgcgctttactgatattcgtacaggccaaaaagtagaagaacgttttaaaggggatgatatcctcgatactatcaacttaacacgccgtgcagtcagtttctcgtatatcgatggtgatgaatatgtctttatggacaatgaagattatacaccttacaccttcaaaaaagatcagattgaagaagagctgctgtttattccagaagaaggcttagctggaatgcaggtcttaactatggatggacaagttttagctttagagttaccgcaaactgttgatatggaaattatcgaaacagtaccgggcattaaaggcgcgtcagcgagcgctcgtactaagcctgcgactctacctactggattagtcattcaagtccctgaatatctttctacaggggataaaatccgtattcatattgctgaacgtcgctatatggggcgtgctgattaa

SEQ ID NO: 3725 - DNA, 750 bp, Proteus mirabilis
atggttacctgtttaactattcgttatttccagttattcgtggtttgtataaatcatagaataatcattttacgactaggattttgtatgacactagacactcacaatggagttaaagtatatacccccacagcattaaaactttatgactggtgggtattaaatatttctaaccgttatgcatggcgttgtgatacagataaatatttgctacctcattttaaaaataatcttggtgagaaccatatggatattggtgtaggaacaggattttacttaaaaagagctttagctaatataaataaaatagcattaacagatcttaatattaatagcttagattatgctaaaaaaaatattgttgatgataaattaacttattgcttacagcatgatatctatcataaatttcctaatgaattcaattcatcgtttgactctatttctttattttatctattacactgcttacctggcacaatggaaggtaaaaagaaagtgatagaaaatataagtaaaatattaacggaaaagggtgttttatatggtgctactatcttgggggctgatgttgaacacaatttttttggtaataaattgatgtctgtttataacaaaaaaggtatttttagtaactattctgactcggcagatgctttagaaaaagtattatcttgttttttttacgatgtatctattcatattcaaggagttgtcgcgttatttaccgcgagaaataaaaaattataa

SEQ ID NO: 3726 - DNA, 1395 bp, Proteus mirabilis
aattcaacctgggagttgccaacaatggaattatcttcgctgacagcgatttcaccgattgacggtcgttacggtagtaaaacctcgtcgttacggactatttttagtgaattcggtcttttgaaattccgtgtacaggtagaagttcgctggctacaaaagctagcatcttgcaccgacattaaagaagttcccgcctttgaacaaaacgcaatcgattaccttgatgcaattgttgctaacttcaatgaagatgatgctgctcgtatcaaaactatcgagcgcaccaccaatcatgatgtgaaagcggttgaatatttcttaaaagaaaaagtggcagctatccctgcactacagcaagtttctgagtttattcacttcgcttgtacttctgaagatattaataatttatcccatgccatcatgttagaaacagcacgccaagaagtgctactaccagcatggcgcgagcttattgatactatcagtaaaatggcgcaagcatatcgtgatttacccctgctctctcgtactcacggacaaccggcaacaccttcaacggtaggaaaagagtttgcaaacgttgcataccgtatggagcgtcaatatcgccaacttactcaagtagaaattttaggtaaaattaatggtgcagtaggtaactataatgctcacctagctgcctatcctgaagttgattggcaccaatttagtgaagaatttgttacttcattggggatcacatggaacccatatactacgcaaattgagccacacgactatattgccgagctttttgattgcatcagccgctttaatacaattttaattgattttgaccgtgatatttggggttatatcgctcttaatcacttcaaacagaagaccattgctggtgagattggctcatcaacaatgcctcataaagtgaatcctatcgattttgaaaattctgaaggtaatttaggtttagctaatgccgttatggggcatctttccagcaaattaccagtttcgcgttggcaacgtgatttaactgactcaaccgtactacgtaacctaggtgtcggtatcggttatgcattaatcgcttaccaatcaaccatgaaaggcttaaataaattagaagttaatgaaagtcatcttcgtgaagagttagatagcaactgggaagttcttgctgaaccaatccaaacggttatgcgtcgctatggtattgaaaagccttatgaaaaacttaaagagttaactcgtggtaaacggatcacggcacaagatatggttgtgtttattgacggtttagcgctaccagaacaagaaaaagcacgcttaaaagcgatgacacctgaaagctatattggttttgccagtcaacttgttgataaattagattaa

SEQ ID NO: 3727 - DNA, 690 bp, Proteus mirabilis
accttattatggagagtaaacatgtcttttaaattgcccatcgaagccgctatttttgatatggatggtttgctaatcgactcagagccgttttgggcacaagcagaacatgaggtctttgcacaattaggtgtcgatttatcacttgctgacagcatgcccgacaccgtcggcttaagaatagatcaagttatcgaactttggtatcaagtatcaccttggcaaggcgtaacacaacaagaagctaaagaaagaatgattgctcgcgttgtacaacttattgaagataaaaaaccgctgctccctggtgttgaacatgccctatctttatgtcaatcattaggtttaaagatagccttagcctcagcatcaccgcattttatgctagagcgtgtacttgagttatttaatattcgtcattacttctctgctgttgtctctgcagctgatttagcgcacagtaaacctcacccagaagtctatctcaatgctgctaaggctcttaatgtcgcacccattaattgtgtctctttagaggactcacgcaatggtatgattgcttgcaaagctgcaagaatgcgctcaattgttgtgcctgcagcggagcagtttaatgacaaatgttggggattagccgatgttaaaattgcctctctcaacgaattaaccaaatctcaattattaggctaa

SEQ ID NO: 3728 - DNA, 2418 bp, Proteus mirabilis
cattcactatgggacctgcagctttttattttggtacagctgtcattctcactatccttgccgttgaatggtttgatagtcgtttattatgggatacttatgcaacaagaagaaaacaacacacaggcaacccaagccgaaatacgtcgcaaacgtaaaatttcgactttttggttactccctgttatcgctatttttattgcgagttggttgcttttccaacactggcaagaaaaaggcgtacaaatcaccatcgattttcaatcagcctctggtattgtttcagggagaacacctatccgttaccaaggtgttgatgtaggtattgtacaggacgtgacgctcagtaatgatttacgccgagtcattgttaccgctgatattcgaaaaaaccttgctaatgcattacgtaaaaatacgcaattttggcttgttaccccaaaagccagtctttctggtgtttcgggattagatgccttagtgggaggcaactatatcagtatgcttcctggagatggggaaaagcagtttcaatttgttgctcaagaggttcgtcctaaagccaacattgataaaaaccaacaaattatcaccttaacggcggataatttaggctctcttaatgtcgactctcaagtttattatcgcaaagttccggtcggtaaagtttacagctatgccatacgtccagataatcaaggtatttttatcgagctgagtattgataaacaatatgctcatctgatccgccaagatagtcatttttggaatgtatccggctttcagggcaactttaatctaaagagtggtgcttctattaaaatggaaagtgtttctgctttaattaatggtgctattgcctttgattctccggaaaatagtcccccagcccaagaaaatcaacaatttgtgctacagtctgccacttccgtggatgcaggcaaagccttatatggtgaagatggattaattatctcattaaccagtgaagagagctggggtgtagatgccgggcaacctattctatttagaggcattacgataggacaaattattcagcgcaacatcagtgatgatggggttattttcgatgccatcattgcacctgaatataaacactatatttacgaaaacagcaaatttgtcgctaatagccgaattaacgtcaatatgggcttaaatggtattgagatccaaggagccacacctcaagagtggcttgaaggcggtatccaccttattccgggtagccaaggcgcccctaaagaacaatatcgcctttatcgcaatgatttttatgctaaagcaagtattgagggcaatgagttacctgtcactttgacacttaaagcagctagtctaccgggtattcaaaaaggttccgtggtgctttaccaccaattccaagttggagaaatcgtcgatgtacggcctttaatggatgaatttgatattgatgtccatatttctaaacaatatcgtcacctgcttactgaaaagagtgtgttctggactgaaggtgctgcgaaggtttcattaaatggtgcgggattaacggtagaagcaacgccgctaaaccgtgccttaaaaggcgcgataagctttgataactttgaaaatattaataacaatgtttcaagatataaactttatcctagcgaaacgagtgctagagccattggtgctcaaattactttaaaaacctacgatgccagtaaactttctgaaggaatgcctattcgttatctaggtattgatatcggtcaggtggaaacgctaaccctttctgcagataaaaaagcggtgagtgtatcagcggtactctaccctgaatatgtgaaaacttttgcacgctcaggaagccgatttgcggtagtcacccctgagttaaccgcttcaggcctcgataatttagattctcttattcagccttatatcaaggcagagccaggcaatggtggcgtataccgcatatttgaattacaaacggcaaatattaccgactctcggtatctagacggccttaaccttgtattgaatgcgactgaagcaggatctgtacaaattggcacacctatctattatcgtggtttagaagtgggtgcggtaaccggactagaattaggtaatatgtctgacagagtattgatccacattagaattagtcagaaatatcaatatctggtacgtaataacacagagttttggctttcatcaggttataacttctcatttggtttaactggtggagtattccgcagcggtacatttaagcagtttatacgtggtggcattacatttgctacaccgccatcaaccccactccaggctaaagcaaaacaagagcagaatttcattctcaatgctaaagagccaaaagagtggaatgaatggggtactgcgatacctaagccataa

SEQ ID NO: 3729 - DNA, 1299 bp, Proteus mirabilis
aatgaaagatggtcaattagagtctcaagaagcgatttcaggagtggaataatggcgcagttgccacttgctttagttaccgcattacgtttttcaaaaggacgaaaacgtgctggtatggtgtcattaatttcgattatctcaacgctgggcattatgttgggtgtggcggtattgattatcggattaagtgccatgaacggttttgaacgtgaattaaaaaaccgcattctttctgtggttccccatggacaaatttattcggtagaacaaccctttatatcttggcaaccggcactatcgcggattgaaaatactgagggggttgttgccgctgcaccctatattttattgaccggattacttgaaaaaggaaccgaattaaaagcggtacaagtgatgggggttgaaccgaataaacaaagtgatatcagtttattaccgagctatgtgcaaaataatgcatggcaacattttcaagcgggtcaacaacaaatcattattggccaaggtgttgccgatgccttaaaaatcaaacaaggtgattggttaactattctgatccctaacaatgatgatccgaaaaagctattacaacctaaacgcattcgtttacaagtcagtggcatatttaaactcagtggtatgctcgatcaccaattagcgttaattccattggcagatgcgcaacagtatcttgattacggcaaaggaattacgggtattgaagtgaaaacaagcgatccatttctagctaatgaaattattcataatgcaggcttaaatagccaagcctatgtttatgctaaaagctggatcagcgattatggttatatgtatagcgatattcagatgatccgcagcattatgtatctctcaatgattttagtgattggggttgcttgttttaatattgtctcgacgctgattatggcggtaagagataagagcggagatattgctattttacgaacgttaggtgcaagagatagccatattcgcaatattttcttatggtacggactgttgtcaggcatgatcggatgcgtggccggtgttattatgggggtagttgtctcactaaatttaacccctattgtctcggtaattgaatccatgacaggacatagtgtgttatcaggagatgtctattttgtcgatttcttaccttcagaaatacatgcaattgatgttttctccgtatttttgacgacggttattttgagtttgattgccagttggtatcctgctcgtcgagcaactaaactcgatcctgctagaattttaagtggacagtaa

SEQ ID NO: 3730 - DNA, 1302 bp, Proteus mirabilis
gcggtcactcgaccgcctatattcttaatcctaaactttttccctccttggaggataagcgtgtctaagcgtcgtgtagttgtgaccggactaggcatgttatctcctgtcggtaataacgcagaagcttcttggaaagctgtgtgtgccggacagagtggtatcggccttatcgaagaatttgacaccagtcatcatgcgactaaattcgcaggattggtaaaagatttcaatcatgaagattacaatctttcgcgtaaagatgcgcgcaagatggatctctttattcaatatggtattgcagcaggtgttcaagccattgcggattcaggtcttgaagtaacagaagccaatgcaagtcgtatcggagctgctattggttctggtattggtggcttaggccttatcgaggaaaatcattcatcattaatcaatggtggccctcgtaaaattagcccattctttgttccttcaaccatcattaatatggttgctggccatttaagcattatttatggcttacgtggaccgaccatttctatcgcaactgcatgtacatcaggtgtgcataatatcgggcatgccgctcgtattatcgcttatggtgatgctgatgtgatgttagcgggcggtgctgaaaaagcaacaacaccattaggtgttggtggttttggtgcagtacgtgcattatcaacacgtaatgatgatcctcaagcggcaagtcgcccatgggataaagatcgtgatggtttcgtgttaggtgatggtgcaggtgtgttagtcctcgaagagtatgaacatgctaaagcacgtggcgctaaaatttatgcagaagttgttggttttggtatgagtagtgatgcttaccatatgacctctcctgcagaaaatggcgcgggtggtgcacttgcaatggaaaacgcattgaaagatgcgggtattaccgctgctgatgtcggttatatcaatgcgcatggtacttctactaatgcgggtgatattgcagaagcgcaagctgttgaaacggtatttggcaaagggactgatgtattagttagctcaacaaaatcgatgacgggtcacttattaggtgctgccggggcgattgagtctatctttactattttgtctttacgtgaccaaattgtaccgccaacaatcaatcttgataatcaagatgaacattgtcaccttgatttcgtaccacacaaagcgcgtaaagttgagaatatggactatgcactatgtaactcatttggctttggtggtaccaacggttcgattctctttaagcgtgtgtaa

SEQ ID NO: 3731 - DNA, 249 bp, Proteus mirabilis
ataacttatcgtaaaattaactcaactgaagactataatcatgtaatttacaaattaataccttgtgaagtaatagtgttacttagaatgagagagttaaataaattacctattaataatattgatcatcaactaataaatagatttaagatgtttttaaataaagatatacctttaagtaattttaatcgttcattaagaaaatctattttacataaagcatcacataaaattagtcagaatcactga

SEQ ID NO: 3732 - DNA, 924 bp, Proteus mirabilis
tattactgtcgataccattgcgaaaggatttggacaatgaatgataaaaaaataaatcctactcttactgttgataatgcaacggtaacctataacaacggtcacactgctatttatgatgcaagtttctctatcactggtggcacaatttgtgccctagtgggcatcaacggtagtggtaaatccacactttttaaaaccattatgggattagtcaaaccttcaaaaggtaccgtaacattaaataatcaacctattcagcaagcacttaaacagaatatgattgcttatgtgccacaaacagaggaagttgactggaactttcctgtactggtttctgatgtggtgatgatgggacgttatggaaaaatgggtttttttcgtattccatcgaaacaagatcatgaagtggttgaagcttgtttagagcgtgtcggcttatcaggccttggacatcgccaaattggtgagctatctggtgggcagaaaaaacgggtattcttagcacgagcaatggcacaagaaggcaccgtactgttattagatgaaccttttactggcgtggacgtaaaaacagaaaatgccattattgaattattacgtaacttgcgtaaagaaggtcacctagtattagtatcaactcataacttaggtagtgtacccgaattttgtgatcacgttattttaattaatagaacagtgcttgatagcgggccaacagaaaccacctttacccaaaagaatttagagcatgcttttggtggcgtattgcgtcatatcagcttatcaggccctgatcttcacgacgacgacgatccacgttcacttaccgttattaccgatgatgaacgcgctgccgttttctatggtcaccatgaacaacatactcccgctcatcaaagtaagcgtaaacaaggagattag

SEQ ID NO: 3733 - DNA, 261 bp, Proteus mirabilis
ctcatcttccggattgacaggagtaaaataaaaataaatactcctggtactatttatgaaattggtacactacaaaaaaactcagtacaaccactagttgatattatcctatctaaaaaaaataactcttcatcgcaatcttcaaataacagtggtgatgacttgctatcaaaattagaaaaattaggaaaactaaaagaaagtggcgtactgacagaagaagagttccaagaacaaaaaagtaaattacttaatttataa

SEQ ID NO: 3734 - DNA, 558 bp, Proteus mirabilis
atatatttacgactggggacactcaatatgatgatttattgttatgatgacaaaataagtgaaattaaaatagaacaactcaccaaattgttatatagatgtgtccttggtggggcaagtgttgggtatactgacgcagaaactcaagtagatgatatgagaaattattggcttagtgttaatcactcattatcaacaaatacgtttaaattaattactgcagtgattgacggacaaatagtcggtgttgttggtcttgaattatgcactaaaccaaacggcaaacatcgtggggagatttgcaaactattagtatcccctgatcataggcataaaggaatagcacagcaattgatgcaaaaggctgaacaaatagcatgggagagagggataacacttttaactttagataccattacaaaaggtatgacggtgagtctatatcgctttcttggttggcaagttagtggtgaaattcctgagtttgctcaagcagttgatggtaagtttgaggctacaaccattatgtttaaacttaagcctgagagtaatagttaa

SEQ ID NO: 3735 - DNA, 429 bp, Proteus mirabilis
tttaaggaacgcattggggcatttatgacgaatgatgaattaattgataaactaaacaatttttttcctgtgtttcgagaaatacatggcgagcatgatggtatttatctaatatttggaggttttggtacgttttttgctgatctgataaatctatatggctctggtaaagtagatgagaaaagctatttttctcaaaatatcgcatctatttacaaggataaagatatattaataaaagaaataaagaacatatttagttttgtcgatgacttatttctttatcaaggtgatgacgtaaaagacatattaaatacgtgtatctttgaagcaataatgggaagtgattatagttataatttggctagaaaatatcttagcaaagaaacttataatcactatttggaaataactaaaagagttatttag

SEQ ID NO: 3736 - DNA, 957 bp, Proteus mirabilis
tgtcggttgcgagcggagaaatactctggagcgggcgccataaggttgagtaagtcttatcaacaacagttattgagcctattgcgggaatggtttcccgcaatacccttatcacagtggcaaataaccgccttagcgggattagggggcggcacttttcgtttgcaaagtaatgggatagattgggttgctcgttattatggcactgaaaaaacggcactttttgtcagggctaaaaaagagtcttcgattttaaaacagttattaaatactcagcttgcaccaaatattattaaacgccatggtgcatggttttttttccagtggctagagggtgagcatcttactcatcagcagttatttggctcccatctcaaatcattagctcatcaaattgctaagttacatcagcaaaaaccttttgggtttcctcttgatttgtggcatgaactttcagtctattggtatcatattgacagaaaacgattatcaccaaagtggttacgtttacatcacgattttttatgtcaacctcgacgtacactcataaaatacgcgccagctcacatggatcttcatcctgagaatattcttctgagcgattcaggtataaaatttattgattgggaatatgccgctgatattgatacggcagattcattaatgacattttttgccgcaaatcagttaaacagcgcacaacaaacagcatttttacatgagtattgtgcatatcatcactatactgaattaaataatgatcagcaaaataggcaacacccacaacagcagccgttttattcggttaacgtattaaagcagcgtattttattaagagaaccctttatcttgtatatgatgctgatgtggtatgaggttcgttggcaacaaaccaaagataacgcgtttttggctatgtctgaacctttacgtcgctattttagtctgatgaattga

SEQ ID NO: 3737 - DNA, 294 bp, Proteus mirabilis
atcccgaagcggttgtcaccagtaacctttcaggatcttctgcggaagctgtcatcacaaaacttgatgcaagagcagcaacaacgccaagcgcaattttatttttctttaacactaccattcccgattctccaagaatatatattctttaagttttatatagatggacagatcgacagttgctcaacaatgaaggtaattaatttaattacccttagttattttgatattatttttatatccctattgactaaattcctatacttctgctgttattgttttatgcttctataa

SEQ ID NO: 3738 - DNA, 855 bp, Proteus mirabilis
tttatcgagcgcagtgtcagttatggtcaaacgggcgaggtttttaccgccggacattggtactaccacagttatcagtacgacccgctgggacaattgacagcgcatttagggtcggtgcaaaccgaacactttctgtatgatgcggcggccaatttactgccccgtccgcacagcgaagcaccgcataaccaagtacaaggcagtgataagtatgattatcgctacgacggttttggtcgcatggtctcccgctatgaaaaaggcagtagctcgggacaacgctatcactatgacagtgaccaccgcattatcgcggtggatatcgaccaagggcccttagggtatcagcgagcggaatactgctacgatatcttagggcgccggattgaaaaacggttatggaaagccagtgcgattgccaatacggtgacctatcaccaacatgagccggatgaagtgtacacctttggctggatagggatgcgactggtgtctgagcacagcagcgcagcgccccataccacggtttatcatgcttacaatgaccaaagttatacgcctctagcccgcattgaatgtacggataacccgcttaatccacaacgggcgatttattatacgcacagcagtttaagtggcttaccggaagcgttgaccaacagtgagggtgaaatagtttggcaagggcaatacagtgcttggggacatttacagcgtcaaacccgccccacaagcacgtttaatcgtgaacagaacctgcgttttcaagggcagtatttcgacaaagacaaatttgtcgggaacaaatttgaacagcgcttgcgctggcccgtagggcgagtatcaggatga

SEQ ID NO: 3739 - DNA, 1329 bp, Proteus mirabilis
tcaaatatttttcgccgatattttgtgacaaagaccaaatggacgtgcatcaggaatacacaatgtctgccacggcgaatattagtttcatttttcatacaccaaagtataataggcaatatgaaacgtctacaagcctttaaattccagttaagacccaatggtcagcaagagcgtgagatgagacgctttgcaggggcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaagcgtaccgcgtttcctcgattcaagaaacgcggtaaaaatgaggcttttcgctacccgcagggcgtgaagctcgatcaatccaatagtcgtatatcattgccaaagttgggatggatgcgctaccgcaacagtcgtgaagtcgtcggagaagtaagaaacgtcacggtcagtcagtcatgcggtaaatggtacgtcagcattcagactgagtatgaagcgacagaaccacaacatgaatcaacctcaatagtcgggcttgatgcaggcgttacaaaactggccacgctttcagacggtacggtatacccgcccgtcagcagttttaaagtaaaccagcgaaagctggcaaggcttcaacggaaattaagccgtaaaatccaattcagtgccaactggcaaaaacaaaagcgcaaaattcaacgtctgcattctcatattgccaatatcaggaaagactcccttcacaaagtcaccagagaaatcagcaaaaaccacgcaatgattgtcattgaggacttaaaggtcagtaacatgtctaaatcggcaaaaggtacgacagaacggcatggacggaacgtaaaagctaaatctggtttaaaccgctcaatactggagcagggctggtatgaaatgcgccgtcagcttgagtacaagcagctctggcgaggaggtcaggtactggcaataccacccgcctacaccagtcagaagtgcgcttgctgtggtcatacagcaaaggaaaaccggcagtcacaaagtcaattcgagtgccttgaatgtggatatacagcgaatgctgatatcaacggggcacgtaacattttagcggcaggacatgccgtgcttgcctgtggagggagggtgcagtcagaccgcccgtcgaagcaggaactcgccgaggtgattcagacatcagtctga

SEQ ID NO: 3740 - DNA, 198 bp, Proteus mirabilis
attattgttaggaattcgatgctttcatcaaatgatgatccccaaaaacgggatttaaagcataaccttaacgatataaagtctacaatgaacttaaaaagttacaagtatccctttaaaattcgacttaaaattttaaaaagatcggccgttattcacaataagaattattctatatttttgttaaatttcttgtaa

SEQ ID NO: 3741 - DNA, 438 bp, Proteus mirabilis
tgtgataatagatcatcatggcaacaaggtagcagcatgataaaacaagctaaaagggtttattcattacttatagtattgttgatgacaacgttattggctggatgttttgcgtctcattcagacaataaactctattttaatcgtcaacaatctattgtgatggagccgtcggttttagctgtaggtattgtggcaggcaaaccattattgacgcgttatgaacaggggagtcgcgccacggtgacgttatcgaatacgcgatcttatcctgtctctattcgttatcgtttttattggtataacgagcaaggactggaaatttctccggcaggccgcgtaaatgatgtgatgattttgggcgatggtgatactgagatcagtgctgatatacccaataaaacagtaagttatgtcagagtctatctctttacttag

SEQ ID NO: 3742 - DNA, 897 bp, Proteus mirabilis
aataggaacagtatcaatatgatgaggattgccttattcctgttaacaaacttagctgtcatgtttgtgttcgggatcatcttatctttaacaggtattcaaggccgcagtgttcagggtttaatgatcatggctggcctatttggttttggtggtgcatttgtttctttacttatgtcaaaatggatggcattacgatccgttggtggtcaagtgattgaaaatccaacctctgaagtagaacgttggttacttgatactgtaagacgtcagtctgagcaagtggggattaaaatgcctcaagttgcaatctacgatgcaccagatattaatgcgtttgcaacaggagctcgtcgtgatgcttcgctggtggcggtgagtaccggattattagccagtatgagccgtgacgaagcggaagctgttattgcacacgaaattagccatgttgccaacggtgatatggtaacgatgaccttgttacaaggtgttgtgaatactttcgtgatctttatctcccgtatcattgctcaatttgtggcgaattttatttcgagcgatgaagagagtgaaaacagtaacggaaacccatgggtatacatgggcgtttctatggtgcttgaaattgtctttggcattttggcaagtatcattacgatgtggttctctcgctaccgtgaattccatgcggatgcaggctctgcaaaactggttggccgtgagaagatgatagcggcattacaacgcttaaaaaccagctatgagccacaagaagagagcagtatgatggctttctgtattaatggccgtaataagtcatttagtgaattatttttatcacacccgccattagataagcgtattgaagcactacgtagtggcgaatatctcaagtaa

SEQ ID NO: 3743 - DNA, 981 bp, Proteus mirabilis
aaaagggaaagaaagataatggagtatataactaataaacattgggccaaatatatcaagggatatatttttactggttgtgcaatccgagataaaaatattgtgtacttttgtttgcgcaaagatattccatacgaaaaggctcgaaatttatggaacagcgaaatcccctcacagttattatgtatttatttagacacaccagatgacccgattgattatattagaattgaagggttcgataatcctaaagtaggtatttgtttaaaaccgaaagaacaagggatgcttgcatctagaggcgatggtgggtttgtcaagtgtatgggcagtggatctaaatttccgctagaaaaagttatggatggtgactatgcaaatcctaaaaatattaaatgtgttggtggatatgcttattatgttggtacttcgcgcgaaatttataaacgagtggatattggaaaatggcagagaattcaacatgggataccaggaggagaaaccaatacagatatgggattcactgatctcgatggtttctctgagcaggatatgtatgccgttggcggtgcaggtgatgtttggcattataatggcgaaatctggatcccttgtggttttccctctaatgagcaattaagtgcagtattgtgtgcccctgatggttatgtgtatatcggcggtgaagggggcagtttatggcgagggcgtgaataccaatgggaaaaactttatcacggcagttcggctattttactgaatcagttacgctggtttgaagataaagtgtgggcatgtgatgactatcgcttacagtgttggaatggtaaagaaatggtccgtcccaaggatggtgatagaaatgttatcgcctcaggtcatatggatgtccgcgatgggattttagttgtagctgatgattataatgttgatctgtatgatggaaccgcttggcataagatagtgagaccttataaataa

SEQ ID NO: 3744 - DNA, 192 bp, Proteus mirabilis
atagataagagcctattctcttcgatgagattaggctttttcttttatggtgtatctcagataagagtacttggcaagttttcgccctaccgtactttacaacataaaaaggcctaccgcggtagacctttttatttccaattcacaattgttatttatattcaaattgtcctatgttcaagttattcatag

SEQ ID NO: 3745 - DNA, 333 bp, Proteus mirabilis
ataaatgagaggaggtttattttgaaaaagataccgatagttttagcatgtctaggtctattattaacggcacctagtttagcacgtgaaagtaaagtgttaggttcaacaacaattacttttgttggtgctattgtcgaaggcggatgttatgcatcatcagaagaaaatactgttaaaacaagttgttggaatggtaaggagatgaaagacttccaatataaactagatgctaatcagcaatttaactcgcaattaattaataataaaggttttatggatatcgaatggattaacgatcatctagcagtaatgaatattgtttataattag

SEQ ID NO: 3746 - DNA, 879 bp, Proteus mirabilis
attaattttggatacagtctaatgaaagttacaagtgccgaaaaacatgcattgttattaccagataatcgaacgttaacttggtatgaatctggcccatcagatggtcaaccggtattattctgcacaggtgcagggatgagtgggctattaagtatggatgctgatctgttaactaagttaaatattcgacttattacaccgactcgtcctggtttaggtgaatcaacttttgatcctaaaaagacattaaaatcgttttctagcgatgtattattcttattagcatatcttaatattaagaatatcagtgtgataggatcctctcaaggtgctgtttttgcaatggccatttgttactatggtaaagtggataagctggcaattgttgctggtcaagatcaactagattatcctgaaataaaaaaactgttgtccagtgatgtggttaatatgcaacaacaggcattattcgatcctgatggattaaagacctggatcattgaaaatatcaccgctgactggttaatggattttattttgaattatagtgctgatgttgatttggctctttatcaagaaaataaattttttcctgtttatcaagcttgtatgaaagaagcatttaaatatggaaataagggctatgctcaagatttattaatcacgatgcaaccttggggatttactccagaaatgattagcacacctacaacattatggtatggactaaaggatacgagtactgttcactcgcctgattttggcaagttattgtctcaacgttttccccatgcacaacgttatgtctatgataatgaaggtggctctttgttgtggactaaaacatcacagattttaactaatcttattagttaa

SEQ ID NO: 3747 - DNA, 285 bp, Proteus mirabilis
atgaaggttggtagagaatatattattcaaggtcgtgtacaaggtgtcggtttccgctttcatacttatcaatggatgaaaaagcagcctattacgggttatgtgtggaatcgtgatgatggcagtgtggggatcagagcttttgctgaagagcaggtactgagaaaaatagaagattggttggctgctggaggaccaatagggagtaagattgtattctggtcggcaacaccatgccaatatgaagaaatggcagacttttcaatccgccattatgcatcttag

SEQ ID NO: 3748 - DNA, 696 bp, Proteus mirabilis
gctagttatggaaaatttatcaccattaggtatgctctattcgaaactggcatggcatggttttggagcgataacagactgaaaaatatctatcaagtcgatggaataacaaattttactgaggctaatcgaaagcataccggtattttgttgattggtattcactccatgtcgttggagcttggagggcgtattatggggttgtgcttccctgtaaacgcaatgtatcggcctcataataataaagcgatggagtttattcaaactagggcaagatgccgttctaataaaggtatgattgatagacgtaatttaaagtttatggtcactgaattaaaaaaagggaaggccatttggtttgcaccagatcaagattttggcttaaaaggaaccaccttttcaccatttttttcggtgaaggaaacgtctacttcaaaaggcgctgttatattagcaaagttatcaggagctccttctttaacggtaacattggtacgtaatcatggtcatgataataaaaaatatagcttaattataggtaaagagcttcataattatccaacagaaaatattcaaaatgatacagatagaatgaatcatctgattgaaattgagattatgcgagcgccagagcaatacttatgggctcatagacgctttaagaccagacccaaaggtgaagccagtttttattaa

SEQ ID NO: 3749 - DNA, 1263 bp, Proteus mirabilis
agagatttagggggcaaaatggataaattattagaacggttttttgaatacattagttttgatacacaatcgaaaccatcatcgaaaatgtcaccaagtagcgatggtcagctaaaattagcgaaggcactggtacaagaattaaaaaaactgggtttttctgatgtgacactcagtgataaaggatgcgttatggcgagtttgccctctaacgtatcttggcctgtacctgttattggctttatttcccatcttgatacttcacctgatttttcaggtaaacatgtaaaacctcaagtgcttgaagattaccgtggtggtgatatcgcgctaggtattggtgatgaagtattatcaccggttatgtttccaattttacactcaatgattggtaaaacattaattacaacggatggtaaaactctattaggtgctgatgataaagccggtatcgcagagatagtcactgcgatggtacgtttaaaagcacaaaatcgacctcatggtgatatccgtattgcatttacgccggatgaagagatagggcgtggtgcacattatgtcgacctaaaagcatttggtgctaactgggcatataccgttgatggtggtggtgtgggcgaattggaatatgaaaatttcaatgccgcttctgtgagtattaaaatcgttggtaataatgttcatcccggtagtgccaaaggcgtgatggtaaatgcgttaggactcgcttcgcgtattcaccaagaattacctgttgaagagacccctgaaaacacagaaggctatgaaggtttttatcacctacaaagtattaaaggtacggtggaaagagccgaaatgcactatattattcgtgattttgatcgcaatcagtttgaaaagcgtaaacaaaacatgatcacgattgctgaaaaagtaggtaaaggtctacatcctgattgctatattgaactaactattgatgatagctactacaatatgcatgataaagtggttcagtatccacatgttattgatattgcaaaacaagcaatgattgattgtgatattgaacctgatattaagcctattcgtggtggtacagacggtgctcagctctcttaccgtggattaccttgcccaaatatctttacgggtggttataattttcatggcaaacatgaatttatctctttagaaggtatggaagccgcagtaagtgttattatgcgaattgctgaaattactgccgaaagagaaaaagcaaaagttatttgttaa

SEQ ID NO: 3750 - DNA, 1155 bp, Proteus mirabilis
tttaaccaagggcaaataataaggcttaaagccaaatgcctaacttggatgataacgaggcgtaaaatgaaaaagacagctatcgcattagcagtggcagtggcagctttcgcaactgcagcgcaagcagctccaaaagacaatacttggtataccggtggtaaattaggttggtctcagtatcaaagtactggtaacaattgggacggcgtgaatatcggtaacggtagcacacacaaagaccaaattggtgctggtgcatttgctggttatcagtacaaccaatacttaggttttgaactgggttatgactggttaggtcgtatggcttataaaggttcatacaacaacggtgcattcaaagctcaaggtatccaattaaccactaaattaagctatccagtaatggatgacttagacgtttatacacgtttaggtggtatggtatggcgtgcagattcaactgcaactattaatgcaacttcagcaggaactcaaaaacgtttctctgaaaatgatactggcgtttctccagtattcgcattaggtactgaatacgcgatcactcctaacattgctactcgtcttgagtatcagtggatcaacaacatcggtgataaaggtactctgaacgctcgtccagacaatggtatgctgagtgttggtgttgcttaccgtttcaaccaagaaactccagctccagttgttgagccagctccagtagttgctccagctccagttgttgagaacaaaacctttactctgcgttcagacgttctgttcaactacaacaaatcttctctgaaagctgaaggtcaagaagcactgaatggtctgtacaatgaattagctaacatcgacccaactcaaggtcgtgtcgtagttatcggttacactgaccgtatcggttctcaaaactacaacctgcctctgtcagaaaaacgtgctcaatctgtagttgattacctggtatctaaaggtattcctgcaaacagcatctctgcagaaggtcgtggtaaagaaaacccagtaactggcaacacttgtgacaacatcaaagctcgtgcagctctgatcgattgcttagcgccagaccgtcgtgtagaaatcgaaatccaaggtacaactgaagttgttgttcaacctggtcaataa

SEQ ID NO: 3751 - DNA, 264 bp, Proteus mirabilis
ggtattaaaggcggaaaaagaattcaatcaacgcgtcagaatcgtatcaatggtgagattcgcgctcatgaagttcgtttaacaggtttagacggcgaacagattggagttgttagtctgaaagaggctcttgagaaagccgaggaagcaggtgctgatttagttgaaatcagtcctaatgccgagccgccagtttgtcgtattatggactacggcaaattcctctatgagaaaagtaagactctcaaagaacagaaagtcttc

SEQ ID NO: 3752 - DNA, 912 bp, Proteus mirabilis
cagctaaaaggtgggatggacatgcgtattacattgcgacaactggaagtatttactgaagtacttaaaagtggttctacaacacaggcttcacaacagttggcattatctcaatccgctgtgagtgcttctttaactgatctagaaaatcagttaggagtacaacttttcgatagagtggggaagcgcttagtgactaatgaacacgggcgattattatatccaagggcactctctttacttgagcgtgctactgaagtagagcagttatttcaagccggaaatggtgctttacgtattgctgcaagcaccactattggtaattatattttgccacaaatgttgggtaattttcatcgtaactaccccgatattccacttgaaatgagtattggcaatacggaagaagtcgtcaaatcagtcagtgagttccgtgttgatttaggccttattgaaggggcttgccaaagctctgaattgatcagccaaaaatggctactggatgaaatggtcatattttgttcccctgaacatcctttagctaaggcgaaaacagtgacattagccgatcttcaatccgcgccgtggatcctacgtgaaaacggttctgggacgcgagatgtactcaatcatctgctgtttgcttcattacccggatatcgaatcgaaatggaattaggtaattcagaagcgataaaacatgctgtaatgtatgaaatggggattagttgtttatctcgccgagtgatccaagatcaaatagagagtggctctttaaaagagataaaggtcgaaggtctaaaattacaacgtactttatatttggtctatcatcgccaaaaacatgtctctgatgccctcaaaaaattactttcatattgtaatgctgaacatttaatcgacaacgcttga

SEQ ID NO: 3753 - DNA, 201 bp, Proteus mirabilis
cggaatggagggagtttgaaaagttcggaactgattaagttgttagaaaaaaacggatggatacttgatagaataaaaggaagtcatcatcaatttactcaccctgatttttcttttgttgtaacagtaccgcatccaagaaaagatttaaaaaaaggaacattaaatcaaattattaaaagtgccaaactgaaaaattaa

SEQ ID NO: 3754 - DNA, 903 bp, Proteus mirabilis
aaattatttatggatattcgtgttttacgctattttattgaagttgttcaattaaatggatttagccgagccgctgatgctttatttattacacaaccagccattagtcgtagcattaaaaaattagaggatgaattaggcactgttttattaataagagaagtggatggggtaaaattaactgatgacggtgctattttatatgagcatgcaaagcagatcctcgctcaatttaatagtatgaataaagcattaaatgataaagatgaacctttaacaggcgccttaaatgtcggattacctcctgttatagcctcaacctattttgctgatattatcatggcgtttagctctcgccatcccaatgttgaacttaaaatttttgagctgggcaccaaacagatggaagatgcgatgttagaaggcacggtagaaactgcggcagtgatgttaccttttaatgataaagattttgaattaaccattttttcagaagatcacttgatgttattagtagcacaatcccatcctttggctaaagataagaaggttaattttaaacagcttattacagagcggtttatctttttttcagaagattttcgtattaatgatttggtacgtagtgcttgtgggatttataacactgaaccacaaattgtggggagaagtaatcatttagatttaattattgcaatggttaaagccggtgtcgggatcacactgttgcctaatagcatgtgtaataaatatcctatcgatgatttagtggttattcccattacttcccctaggttatcttatcaattagctttagccaccaatcaaaatagttaccaaagccgtagttgccaagcatggaataaattagcaatagagaaattaatgaaagagaatatttaa

SEQ ID NO: 3755 - DNA, 402 bp, Proteus mirabilis
gaggttattatgtcattaaacacacttaagacatcatggggcaaattatccgccatcgctgttttatttttaggcatgtcatgccaacaagccttagcacacgcacatctaaaatcacaattacctgcagagggtgcggctattgaacaagcgcaagcaccaaaagtgattacactcgatttctctgaagggattgagttggcctttagtaaagtaaaagtcactgataaagagggtaaagaaattactgtcggtaaattaagtcttgatcccgttaacaatacaaaattgttattgccattagaaggtgaattagcagaagggaactactctgtagattggagtgttgtttctgtcgatgggcacaaaacaaaaggttcttatcaatttagtgtaaaataa

SEQ ID NO: 3756 - DNA, 795 bp, Proteus mirabilis
gagtacattatgtttttagttgattcacactgccatcttgacagcttagattatgaaaaactgcacaaaaatattgatgatgttgtagaaaaagcacaacagcgtgatgtcaaatatatgttagctgtcgcaacaacattacccggctttaaaaatatgcgcgaactgatcggcaagcgtgataatgtggctttttcttgtggtattcacccattaaaccttgatgagggacacgatgtcgctgagcttgcgcgccttgcagctgaggccgatgttgttgcattaggcgaaacaggtttagactactattatcaacaagaaaatgcgtcacttcagcgtgaaattttccgtgaacatattcgcattgggcgccaagttaataaacctgttattgtacatacgcgtagcgctcgtgaagatacgctaactattttaaaagaagaaaaggttcaagactgtggcggtgtattgcactgttttacggaagataaagaaacagcaatggcgctacttgatcttggtatgtacatctctttttcaggcattgtgacatttagaaatgccgagcaaattagagaagctgcacgtatcgtaccacttgatcgtattctggttgaaacggattcgccatatttagcgccagtgcctcatcgtggtaaagagaatcaacccgcttatgtacgtgatgttgctgagtatatggccgtattaaaaggggtgagcatagaagagcttgctcagcaaaccacccgtaattttgcaacactttttcaaataccaaacctcgcagactaa

SEQ ID NO: 3757 - DNA, 1224 bp, Proteus mirabilis
ataataattatattttgtcgttttttggagtttaactgcgtgcaagagcaacgtccgtcgtactttagcctcattttaatattggggcttatttccatgcttatgccactggctatcgatatgtatctgccaagtttacctactatagcacgggattttggcgtgcctggtggccaagttcagatgacattaagtagctatatctttggttttgctattggacaaatggtctatgggccgatggcagatagtctagggcgtaaaccggttattctaggtggtgtgattgtttttgcattagcatcgagcgcttgtgcattatctgactcgatcgatatgctaattggtatgcgttttctacatggatttgctgccgccgctgcaagtgttgtcattaatgctttaatgcgggatatgttttcaagagatgagttctcaagaagcatgtcatttgttgcattagtcatgacgattgctccattattagcgccattacttggtgcttgggtgatgaactggttctcatggcatgctattttttggagtattgctattgcggcgatcattgctgctgcattaattgcgctctatataccggaaactttgcccaaacagcaccgccaacgctttagcctacgagtgacatttagtcaatttattagcttatttagagcacgtcgagtactttgctatattctggcatcgggattttcttttgcagggatgttttcatttttaagtgcagggccttttgtttatatcgaactacatggtattccattcgaccaatttggcttgtactttggttttaatattattttcttgattgtcatgaccagtatcaatgggcgctatgtgcgccgatttggtgcactgaatatgttacgttttgggttaactgtgcagtttttaatgggcatattcttaatattggtggtcgcccttaatttacatttttacttccttgttgtgggagtggctatgtatgttggtgggatagccatgataacctcaaatgcgatggccgttattcttgaagactatccacatatggcgggtacggtatcttctttagccggtactatccgttttggtgtgagggctttagttggaaccgctattgcaatgttacccgctaaaactgagtggccgatggtgagttcgatggcattttgtgttatctgtgccatgagtttcttgttacttgctcgtcgttataaataa

SEQ ID NO: 3758 - DNA, 1929 bp, Proteus mirabilis
atgccaattattactcttcctgacgggagccaacgtcaatttgaaaatgcagtctctgtcatggatgtcgctgcagatatcggtcctggacttgccaaagcctgcattgcagggcgcgttaatggtgagctggtggacgcttgcgaattaatcgagcaagattcacaactggcgattattaccgcaaaagacgatgaaggtcttgaaattattcgtcactcttgtgcccacttattaggacacgcaattaaacagttatggccacaaaccaaaatggcgattggtcctgttatcgaaaatggtttctactatgatgtggatttagatcattctctgacgcaggaagatttagaaacgttagaaaaacgtatgctagagttggcgaaaacagattacgatgttattaaaaaacgcgtaacttgggcacaagcacgggaaacttttgttgctcgtggtgaagattataaagtcgctatccttgatgaaaatatcagtcaagatgcacacccagcactttatcatcatcaagaatatattgatatgtgccgtggcccccatgtgccaaacatgcgtttttgccatcactttaaattacagaaaatcgcaggtgcatactggcgcggtaatagcgataacaaaatgctacaacgcatttacggtaccgcttgggctgataagaaacagttaaaagcttatttagaacgtttagaagaagccgctaaacgtgatcaccgtaaaataggtaaacaacttgatttatatcatatgcaagaagaagcgccgggtatggctttctggcataatgatggttggactattttccgtgagttagaaacatttgtacgttgcaaattaaaagaatatgattatcaggaagtaaaaggtccatttatgatggatcgtgttctttgggaaaaaacaggtcactgggaaaactacaaagagaatatgttcactacttcttcggaaaaccgtgaatattgtatcaaacctatgaactgcccaggccacgtgcagatttttaaacaaggtctacgttcttaccgtgatttaccattacgtatggctgaatttggtagctgtcatcgtaatgaaccctctggtgcattacacggtttaatgcgtgttcgtggctttacacaagatgacgcacatatcttctgtacagaagaacaaattttaagtgaagtaaataactgcatcaaattgatttatgatgtatattctactttcggatttgaaaaaatcgttgttaagctgtctactcgtccagaaaaacgcatcggtgaagatgctttatgggatattgcagaaacagacttagcaaaagccttgactgataacaatattgaatttgaatatcagccgggtgaaggggcgttttatggccctaaaattgaatttacactttacgactgtttagatcgtgcatggcagtgtggtacagtacagctggacttctcattgccaggtcgattaggcgcttcttatgttgctgaaaataatgagcgtaaagtacctgttatgcttcaccgagcggtgttaggatcattagaacgttttatcggtattctaactgaagaatacgcaggattcttcccgacttggttagcaccacagcaggttgtcgtgatgaatatcacggatggacaggctgattatgtacaaaaactcgtcaaagaattgcaagatgccggaattcgtgcaaaagcagacttgagaaatgagaagattggctttaaaattcgtgaacatactttacgtcgtgttccgtacatgcttgtttgcggtgataaagaagtcgaatcaggcaaagtagcggttcgtactcgtcgaggtaaagaccttggcagtatcgacgttaacgattttaaagaaaaacttctgcaagaaatcagaagcagaagtcttcatcagttggaggaataa

SEQ ID NO: 3759 - DNA, 1773 bp, Proteus mirabilis
tgtatggttatggcttttacacttagaccttatcagcttgacgcggttaacgcgacaatcacttattttcgccaacataaaacaccagcacttattgtattacctaccggtgctggaaaaagcttagtcattgccgaacttgctaaaagagcacgtgggcgggtattggttctagcacatgtaaaggaattagtagagcagaaccatagcaaatatgaagcctatggtctatctgcggatatttatgccgccggattacagcaaaaagagagtcgaggcaaggttgttttcggcagtgtacaatcggtagcacgtaacttatcgcagtttgagcatgctttttctctattaattattgatgaatgtcaccgtattagtctgtctgaagatagccaataccaacaagtgatcaaacaacttcaaaccattaacccccaactacgcatcttaggattaacggctactccttatcgtttaccgactggttggatttaccaatatcactatcacggtatggtaaaaggagatgacaattgtttttttcgtgactgtatttatgaattacctttacgctacatgataagtcaccatttcttagtcccaccaacacgtttagatatgcctattttgcaatatgactttagccaagttagaacgagccaaaatggtatttttaatcaagaagatctcaatcgcgaaataaaaaaacaacagcgtattacaccccatattgtgtcacagataattgaatacggtgaacaacgccgtggtgtgatgatatttgcggcaacagtcgaacatgcgacagaaatcttcacattattaccccaagggcaagccgcgttagtcagtgctgaaaccccctcttctgagcgtgacgcattaatttcacagtttaaacagcaacagctacgttatatggttaatgttgctgtattaaccacaggctttgatgcaccccatgttgatttaattgctattttacgtccaacggagtccgtcagtttatatcaacagatagtaggacgaggattaaggttatttgcaggaaaaacagaatgtttaatcttagattatgcaggtaaccctcacgacctttatcttcctgaagtgggtagtaaaaaacccaatccaaatagcaaaccggtacaagtgttttgtcctctctgtcaattcgctaacactttctggggcatagttgatgcagatggcgatattattgagcactatgggcgacgttgccaaggttgggagcttgatgagcaaggacaaaaaaaacagtgtgattatcgctttcgttttaaattatgcccacactgtaatgaagaaaatgatatcgccgcacggcgttgtgtgcactgtaatgaaatcctagttgatcctgatgatatgctcaaagctgctttaaagctaaaaggtgcccttatccttcgctgtggaggaatgcaattactcagtggtcaagatgaaaaaggtgagtggcttaaaatcaactattatgatgaagaaggtacttctgtttcagaacgatttcgtttaaaaacgcctgcccaacgtaaagtatttgaactcaagtttttacgcgaacaccagcgcgcccctggcgttcctttggtatggcataacgctcaagatattattaatcagtttgatttattacgttatcctgactttattgtggcacaaaaaaataaaaaagatggcttttggcaaattcgtaataagttatttgactatcatggacgctttcgtaaagcagataccttatattaa

SEQ ID NO: 3760 - DNA, 570 bp, Proteus mirabilis
ggaattactatgtcccaaaaaccttgccgtattattttaaccggaggtccaggctctggtaaaagcactattatcaataagttaagaagaaatggctactcttgctcaatagaagcaggtagagccattattcaagatcaaagtcatattggtggttcagcccttccttggattgatccgctcgcttttgctgagttaatgttaagctgggagctacgatcatggcataatgcatccaatatagatgataacagcaaaccttatttttatgaccgaggcataccggatatagcaggttatttacacttttgtgagcgccctattccccaacatcttgaaaacgcaataaggctatatagatattctacaaccgtgtttattgctccaccatggaaagaaatttacttacaagataaagagcgccaacagacatttgatgaagccgtagcaacttatcaagcgatgctggcgatatatagacagtataattataccttaattgaattacccaaagccgatgttaaccaaagagtaaaatttattataaacaacataacatcgctatcttag

SEQ ID NO: 3761 - DNA, 270 bp, Proteus mirabilis
tctgttactattaccttagtatgtcagaatgatacaaaattttatgatctgtatgctatcgtaattttatgtcaactagagcgatcattgtcacaacatgttacatttattgcaataagtaaaccattaaatgtgaatttaatcacatttaataaggcatttatttttttatcttatttaatagatgaaaatctagtttttatttaccttataaaagattttttatctaaacccccttgtattccatttatttatatttttcaaagctag

SEQ ID NO: 3762 - DNA, 444 bp, Proteus mirabilis
ggagccactatgacaaaaactgtattagttcccatcgattttactgagcttggtttattggataaagttgtcactcatctcaaagcattagcgatggccgataaactaaatatccactttttatctgttattcctagctatgagtcctttgtcggatttgcttttggcagccaagaccgtcttgccaatgataagcaacgtattgaaattgcattatctacgttaaatgatagtttatctcatattgaaattcccaatagcacatcccaatcttatatttccgtaggtaacccacgcgaccgtattttagagaccgcaaaaaaaatccaagctgatctgattgtgataggctcacgtaaccctggaatgaaaacctacttactaggctcgacagcttcttccgttgttagctatgcagaatcttctgttttagttgttcgataa

SEQ ID NO: 3763 - DNA, 858 bp, Proteus mirabilis
aggagaactatgatgaaatttgttggcgcacatgtcagtgctgcaggtggtgttgatcaggctgtattacgagctcatgagatcaaagcaacggcatttgctctttttactaaaaatcagcgccaatggaaagcagcccctttatcaactgaatcgattgataaatttaaaaaaaattgtgaaatctatggctatggtccagcacaaattttaccacacgacagctatctgattaatttagggcatccagaagaagaagcccttgaaaaatcaagagccgcttttctcgatgagatgcaacgctgtgagcaattaggcattgaattacttaattttcacccaggtagccatttaaaaaaaatcgatgttgataaatgtctgcaacgcatcgctgaatcaattaatatcaccttagataaaacccaaaatgtgaccgcagtgattgaaaataccgctggacaaggcactaacttaggctatcgttttgaacatctcgccgccattatcgatggtgtagaagataaatctcgagtgggcgtttgtattgatacttgtcacacttttgctgcaggttatgatctacgtactgttgaagactgcgaaaagacctttgctgaatttgataatattgtcggctttcaatatttaaaagccatgcacttaaatgatgctaaaagcgaattggctagtcgtgtcgatcgccatcatagtttaggccaaggcaatattggcaaagtaccctttacttatattatgcaagatacccgttttgatgggatcccacttatcttagaaacaattaatcctgatatttggccagaagaaatagcttggttaaaatcacaacaaactcaataa

SEQ ID NO: 3764 - DNA, 2034 bp, Proteus mirabilis
agaatatatattcttggagaatcgggaatggtagtgttaaagaaaaataaaattgcgcttggcgttgttgctgctcttgcatcaagttttgtgatgacagcttccgcagaagatcctgaaaggttactggtgacaaccgcttcgggatttaaacagactgttgaagatgctccagcttctgtttcagttgtaactcgtgaacaattagaaacaaaatcatatcgtgatgtgactgatgcgctaaaagatgttccgggggtgctagtgacggggggcggtagcagctctgatattagtattcgtggtatggatcctaagtataccatgatcttagtcgatggtaagcgtgttgcatctcgtgaaacgcgtcctaatagtgataactcaggtattgaacaaggttggttacctcctttacccgcgattgagcgtattgaggtagtaagaggcccaatgtcttctttatatggctctgatgccatgggaggcgttatcaatattattacgcgtaaagcgcaaaaagaatggaactttagtttacgtggtgacacaacgttgactgagcgtaaaaatgaaggaaatacaggacaaggtagtttctatgctgcaggtccattgattgataatgtgttaggtctaaagctgcaagggcaatattctcaccgtggtgaagatagacgtgttgatggctataaccgtcagatcacggcaagtggtggcggtacattaagctggacaccagatgagaaaaataccgttgaatttgaatttaaaaaagataatcaacatcgtgattcacgtgttggctattcaaaatcagctgaacttgttaaaggaaaggcaccacaaagtagctttactgattatgagctaacgcattatgctttaacccatgatggtatttatgattttggtactatgaatacctatgttcagcgcgatgaaagccgcaatccatcacgtaaaatggattatgatgatacaactgttcgtaaccaaaccgtctttatgtttggtgatcatatgttaagtgtcggcggtcaatatcgctatgaagagctgaaagatgaaggcaataagcttaaaggtaataataagctagatcgctatagttgggcgctgtttgctgaagatgagtggacattgacaaacgacttcgctttaaccgccggtttacggatggataaagatgaaaactttggtactcactggacaccgcgagtttatggtgtttggcatttagctgatgaatggacattaaaaggtggggtatctactggatatcgttcaccggatttacgtcaagcgacagctacttggggacaagggactggcggtggtcgttatgatgcagttatttacggtaatcctgacttaaaaccagaaaaatcggtgacagaggaaattggtattatttgggataatcgtgataacttaacggcaagtttaacgatttataatactgattttaaagataaaataacagaagttcgtcgttgcgatagtcgttcagacaaagcaccgagtatgcttgattgtacattagctgatggtgttggtaatagtggcgacccttatgattttgtaagtgatagaactaacgttgataaagccaatatgcgcggtgttgaagttactgctaactggattatttccccagaatggaatttagcagcaaactacacgttcacagatacggaacaaaagagtggcgatttcaaaggtaagcctctgaataagcaaccgcgccatatggcgaatgcgaccttaaattgggaaaccacccctgaaatggaaacttgggcacgcattaatttccgtggtaagacatcagactatttatcacgtacttcaatgtctaagagcacaccttcatacgcctttgttgatgtaggtactagctatagtctaacgaagcaactaaatctgatcggtggcgtctataatgtttttgatcgtcgcatcgaaagagataattacggttcaaccttagaaggccgtcgttataacatcggattaaactacaacttctag

SEQ ID NO: 3765 - DNA, 591 bp, Proteus mirabilis
ggtagtcatatgaaaaaaatgctatttgtggtggcagcggtatttttactggcaggttgtccatcgatgttaccacaacaacccccagcacctgtagagcctgttactcccacagagccaacagagccacctaaacctatcgagccacccatagaggttgtaccaacaccgccaaaaataaccagtattaattggaacgcggccattcagccattaattagagagatgtctgtcacggatgatttagcaactggcaaattattagtggttgataatgtaaaaaataattcgggcggaaacatccaagcggttaatgctactaacacaattatcgactcggtaaatagtattagtgcattacaaacggttccttatgcacaaatgatgtcagcaagaaaagcattaggactatccggtgaagatagcttaggattgcgcagtgcggcaattggtttagcgcgttatttgcaagcagactatattttgttttctactgtcgatggtaagaaagataatcgtgtgatcagcatgcaattaatgtcggttgcgagcggagaaatactctggagcgggcgccataaggttgagtaa

SEQ ID NO: 3766 - DNA, 1473 bp, Proteus mirabilis
aagcttaatatgcataaaaaacaacgttcgcccttctctttacgaacaagatttttacttgccaccagcgccattattttagcactgacactctcttatggtttagttgccatagtcggctctattgtcagttttgataaaacgacttttatgctaatgcgcagccaaagtaatctctactatagcttagcgcaatggaaagatgggcaattgcagattgaatttccgactaacctcaataacaacaacacatcgctggtggttattttcgacgagaaaggcaatgtgctatggacgccaacggatttacctcaggtgatcccaaacagtatcgcgccaaaatggcgcaataaagaaggcttatttgaaattagtgtgaatgttaaaacgacacgttttatgttacagcaactgcctcaatatcgtgcctatctaaaaaaactcaacgaatattcaagtaatgataccttaacgcattccgtggttattaatcactatcctgcggcggataatatgccttatctatccattgcggttatcgatcctattcctcaaagtctgcaaaatgtaagtagagtctgggattggtttctctatatattactagctaattttcttttggtgatcccattaatttggttagcagcccattggagtttaaggccgattaaatccattattgagcagatcagcgcgttggaaaaaggcactcgcgataatttagatgaaaatcctcctaaagagctcaaaggattagtttataatctcaacattttattgcgtaatgaacgcaaccgttatagtaaataccgtaccagtttatctgatctgacccatagcttaaaaaccccccttgctgttttacaatcaacattacgtgctctacgtgctggcaaacaaatgtctatagaacaagctgagccaattatgcaaagtcaaattgaacgaatttcacagcaagttggttattatttacatcgagcttctcttcacggcgatcacgatataacaacacgcaagctccactctttatcaggcttacttgacaatctttgtagtgcacttaataaggtctatcaatccaaaggcgttgatataacgttaaatgtttcccctgaaatgatgtggttaggtgaaaagaatgattttatggaagtcatggggaatgtacttgataatgcttgtaagtactgcttagagtttgtcgagatcaatgtaagtcatgatgacaattgtgtgattatcaccgtagatgatgatggcccaggagtcagcccagaaaaaagggagcttatttttcagcgtggtacacgtgcagatacattgcgcccaggacaaggcttaggattatcaattgctgttgatattattgagcaatataacggtgatatcaccattaccgatagtccattagggggggcaagactcatcgtcacctttgctgagcaacaactcactactgaaatagagtaa

SEQ ID NO: 3767 - DNA, 312 bp, Proteus mirabilis
tataaggatatttgcgtaatggctgtactctccaaaataataataaaacaaacaagatcagaatgtctgtgtaaaaaaataccgataaccagtgataatacttttagtaaacaagagtataaagcatcgtttattatcgttttcagctattttttaattacccatcttattatattttctttatatttatcaaatgataagcatacctggttacttttagggctacagagtgcgttctttatcattttgccatggttattttatggcacaagaacgttactaaaagaggcaatatattatttaataagataa

SEQ ID NO: 3768 - DNA, 1113 bp, Proteus mirabilis
gatccattcatgtcagataacagccaaaaaaaagtcatcgttggaatgtccggtggcgtagattcatccgtctcagcctatcttcttaaggaacagggatatcaggtcgttggtctgtttatgaagaactgggaagaagatgacgatacagaatattgctcagcttctgccgaccttgccgacgcgcaagccgtgtgcgataagcttggcatagaacttcacactatcaattttgccgctgaatattgggataatgtatttgaacactttttatctgaatataaagctggccgcacccctaatcccgatattctatgtaataaagagataaaatttaaagcatttttagaatatgcagccgaagatttaggggccgactatattgcaacggggcactatgttcgtcgccgtgatattgatggtaaaagccaattactgcgcggtgttgataacaacaaagatcaaagctacttcttatatacattaagtcatcagcaaatcgcccaaagccttttccctgtcggtgaaatggaaaaacctgaggtgagaaaaattgccgagaagcttgatttagccaccgccaagaaaaaagactctacggggatctgttttatcggtgaacgcaagtttactgatttcttatcgcgctatttacctgccaaaccgggtcctatcgtcaccgtagatggcgaaaccattggtgaacatcaagggttgatgtaccacaccttaggtcaacgtaaaggtctgggtatcggtggcacaaaagaaggtagcgaagatccttggtatgtagtcgataaagatgttgcaaataacatattaattgtcgcacaaggtcatgaacaccctcgattaatgtccgtaggcttaattgctcaacaacttcattgggtcgcaagagagcctattaccgaagcttttcgttgcacggtgaaaacacgatatcgccaagctgatattccgtgtacagtaacaccattagatgaagataaaattgaagtccgttttgactatcctgttgctgctgttacaccggggcaatcggccgttttctatcaagacgaagtctgtttaggtggcggtattattgaaacacgtattcaggagtag

SEQ ID NO: 3769 - DNA, 378 bp, Proteus mirabilis
aaataccgcattacacatcagcttaaagagcaggttcactttgggcatgtatacggtgatcgtttagcattattcgttgtggagacatcaaatccgaaagagtggtatgaaaacccgtttaatatcgatggtgtgaccaaaggcatgtacaaggggattaaacagattgatccacaatgggtaacacctgatttaacggacgccaatgttcaagatcctgccagcatggatttctacgaaccaacctattatgtgattggtgggcgcaagtatcacaaatctcactttattaagtttgtaccgtttcctgtgccgaatgtcttgaaaccaatgtacaactactttggtgtttctgttcctgagcgcatttatgagtga

SEQ ID NO: 3770 - DNA, 1239 bp, Proteus mirabilis
acacttagcattagcaacaggaacagcacagttttcatgtacaattctgtctcattttttataggactccgttatatgcggggtcgcgcagtcgacaaatttggtcgattcgtctcatggctatccgctttagggattatgctgggtgttgcggcattgatcacagtgacttctgtgatgaatggctttgaacgctcattacaaaacagcattttggcctatattccacaagctgttatcacaacacccaatgggcagctacccaaacaagatagtactgcacaaatgttattaaaacgagaagatgttatcaatgtcgttcctttagttgaaggggatgtggtattacaaagtaaagataatatcggtgttggcgtgatgttagggattgataaagcacacgatgaacccctaacacagtttattcgctatggcgatttctcgttattaaaaccgggagaatatggtgtgatcctcggtagtggtttagctaaacagctaaaaaccaaagaaggggatagcattcgccttattgttcccggcgtaagccaactcaccccaatgggccgagtgcctagccaacgactgtttactgtcaaaggtattttccaaagtggtggtgatgctgatgcttctcaacttctggtcaatcaacaagatgcggcgcgtttgatgcgctatcaacccggcaatattaccggatggcgtctattcttctcaaccccccttaatattgaaaaatacagtgctgaacctttgccagcaggtttaagttggaaagattggcgtgaacgaaagggcgagtttttccaagcagtgaaaatggaaaaaaatatgatgggcttattattaagcctaattattgcggtcgccgcgtttaatattattacttcgctttcattactggtgatggaaaaacaaggtgaagtggcaatattacaaaccatgggcttaaagcgttcgcagataatgtctatctttatgctacaaggggcaggggccggtattttaggtgctattgctggaggtttgttaggggcgttactatcaagccaactaaatgtgattatgcctgcggtagggcttattcctcatggggtagaattacccgcgactttagagtggagccgagtctttatgattggttttgccgctattgtgatttcactattatcgactttatacccgtcttggcgggccgcaactattcagccagcagaggcgctacgttatgagtaa

SEQ ID NO: 3771 - DNA, 249 bp, Proteus mirabilis
ccttatggcataactaaatttattaaaggaaattctatgtctaatacaatgactggtacagtaaaatggtttaacgacgataaaggctttggctttatcacacctaaagatggtagcaaagatgtatttgttcacttttcagcaattcaaagcgatagctttaaatcactgaaagaaggccaagaagtatcattttctattgaaaatggtgcaaaaggtccagcagctgctaatgttatcggtctgtaa

SEQ ID NO: 3772 - DNA, 807 bp, Proteus mirabilis
ttttttgtttttaataagatacataaaaattggtacagactaagggatattatgcagagttatcactctctatcggctcaagtttatcaattggataaaccgataggatgcagtttcggcgatgttgaatactatcaacagcgattaaaagatgttaaaggtaaaattttagagccggcagtaggaacaggacgcatccttattcctttattgcaatcaggttttaatattgagggatttgatctttccgaagagatgcttgaattttgtaagaaaaatctaatcgagcatgggtttacaaccaactacgtaactcaaaataatttagtcacttttgaagttaatacccctgtcgaggctattattattcctacagggacattcctcttattaaatacgcaacagcaggcgatccaagccttaaaacagtgttatcaagcgcttgagtttggtgggcgcttattggttgatattagtcttgcccatcattttgttaaaggtgaatgtactagtcgccaatttaatacaccagaaggcgatctaattaccttacagataattaatgctgaaattgattatataaatcagttaactacttcacaccatcgttatgataaatggcgagatggcaagatcattgaaagtgaatgggaagttttcagcttaaaatggtttggtgtgtctgaatttgaacaaatactacgcttgattggttttaaacagatcacaatatcagccgattaccagtatctgcaaacccccagtaatatgacagaaattatgacttttgaagcgtataaaaaatag

SEQ ID NO: 3773 - DNA, 630 bp, Proteus mirabilis
aactatttaatacaccgacttagagaatcgcctatgagaaagataacagactggactaccttagaaggtaatttagtacgtttagtaccattaagcatggagcatgcatcaccattacgtgaactgattgttaaagataggcctgatgaactttggtttaccacagttccttctgtcactacattaaaacaagatattgagcataaaagacaattacaaaaacaaggagtaatgcttccttttgccgttattgataaacgccgtgagcgtgtggtgggagtgacgacctatatgaacgtagataaccatacacctcgagtagagattggttcaacatggtatgcaaaagaggtacaaagaacgggtattaataccgaggcgaaatatctattacttaaatatgcattagaagatctacaatgtattgctgttgaattccgcactcatatcttaaatcaaaccagtcgtagagcgattgagcgtttaggtgcaaaactcgatggcatattacgtaatcatcgtttaaccaccaacggtcaacgcagagatacctgtatctatagtattaccgattatgattggcaagcggtgaaaacacatcttgagtggttaatgaaaaaatacccataa

SEQ ID NO: 3774 - DNA, 912 bp, Proteus mirabilis
atgaatttaataataaaggggcttctttatcctttttttgttttcttttcagcatatgcattatcttttgggtgcagtgttgataatggatatgatattgagtctggtaattataatatttatgtgcaattagaggctgaagtgcaaccttatcagaatttaattgttgatctctctaggcatttaaaatgttggaatagttatggtggatggcaagatgttgaccatatcaatttagaaccagggacgggcttatctgggccactatttaattttagtggttcagtatattggtatggaaatacatattcattgcctttaaatagtgcgactaaagttttacatatcggtgatcttacccctatgccgatgccaatgatgttgtatttaacgcctataaataactcacctgcaggaggagtactcattagatcgggtgaaactattgcaactattaatatgtataaaatagcggattgggatggtggtaatcctaaatattttacgtgggaaatagtgtctaaatatgatgttacaatgccaattagtggatgcgacgttagtagccgaaatgtcaatgttaatttacctccttacccaggcgaagctccggtcaatttaaatatccactgcgcgcaaccacaaaatatatcattttatctttccggacaaaccactaatgatgatacaacctttattaatttagcaggctctgcaggggaagtctctaaaggtatgggagttcaattaatgcgtaatggatatgtaatccctgctaataaagcaatatctttaggtagagttaattcgtcgacttcattaggtttaaaggcaaggtatggtatgactggcgagcgtgtaactgctggaaaagtaaaatcaattatagatgttaactttatatatgagtga

SEQ ID NO: 3775 - DNA, 909 bp, Proteus mirabilis
tgtaaaataatgactcctgaagacgtttatattttatgccgaatttttcattttgtggcagtcatgttcatgttcggactgagctgttcggctgccattctcgctaaagaaaagtttgttcctcttattcaagtacgcttacgcccagcattggcgattagcactatcactgtatttgtttccacttatttatggatgatagtgcaatcaggcattatgggagatggctggcaagatgcttggtcgctaacgatatggcaagctgtattgggaacctcttttggccaaatttggcaatggcaattagttttatcctctctcgcattaatcgctctctttattcatcaacgtagtattagaaatattagtctgttacttatctcaacattgatgcttgtgctgcatgcttttattggccatagtgccatgtttacaggtagtgaagccgtaatttataaactaaatcagagtatccatcttattagtggagcgtattggtttggtggtttatggccttttgttgtgtgcttacagtttttgcgtaataaagatgaattagctgatggcatgatcaagcctattattgccaccatgaaacgcttttcattattcggtcacttcgctgttttattggttatagctagtgggattgtgagtgccattatgttactccccggttggcctgcgacaacacaactttcctcagagtaccaaagtatgttatggctaaaaatagcctttgttgccttgatgttaggattggcattagtgaataggtatgtattagtgcctcatatccgtaagaagaataactttcaatggttgcttattaatagttggtttgagttattacttggtactatggttattttgacagtggccatttttgcgattaactcacctgtatag

SEQ ID NO: 3776 - DNA, 555 bp, Proteus mirabilis
ttagtgataataaaacccgatgatcgctggcgttggtattttgatgacgagcaacaaaagttgatgctcgatttagctaatggaatgatttttcgtagtcgttttccaagtaaaatgctaagtgcaactgctcatcaatcatcaccttttactgttgatgatgctgctctttattatggatatgatgagcaaatccgccagattgatatgccttctgagtcgcgagcagaattagcgttaaacgcattaatagcccatcgttttttaaagccattaatgcctaagagctggtattttgaagtgagtcattcatcaacccgcccttatttagctcaagtggtggaaaccgcattgaaagatagcaatgaaaaagtgctttttttagtggcggaagtgggagagcaagcctgtttatgcttattagcccagcctcagttagcattatttgatagaacactaacgttttgtgatccactaaaaatcatgaatgatcggttaagtgaatatcataaacagtctgagccaagatcgtttttgtacgaaaaagtcatctaa

SEQ ID NO: 3777 - DNA, 285 bp, Proteus mirabilis
ccttactccttagtacttttctttaaactggctaatacggcaaatggattcggcttctctgataattcttcagggagttcaccgaacacttgttccgcgtcggacacttcacagtgttcaaaatcatgtaccggaaccaccggcaagttgaggattatttcatcttcaatcatcgccagcaaatctatttcaccaaaatcgtctacgtcgattggctcatattcttccggtaatgcttcagcccgttcatcactaacaacagggctaaaacaatatgttgtgtga

SEQ ID NO: 3778 - DNA, 462 bp, Proteus mirabilis
gataactccttaatgtatcacttgtgttttgataacatagcacctaaacttactaaaagtaagtacatacaaaaaggtaagtatacaatgacaatatccacactctcgcagcaattacgtgaaggaaatttattttctaaacagtgcccatccagagagatcctcaaacatgttacaagtcgttggggcatactcattttaatagccctacgagatggaacacatcgttttagtgatttacgacgtaaaattggcggagtaagtgagaaaatgctgtctcaatcgttacaagtattggagcaagatggttttattaaccgagtgtcatatcctgttgttccaccccatgtagagtactctttgacagatcttggtgagcaaataagtgagaaactcacgcttcttgcggattggatagaaataaatttacctaatatcttgtcacgacaagaagtggagtag

SEQ ID NO: 3779 - DNA, 312 bp, Proteus mirabilis
ttacgagtaataaccttattagcaaggcaagagttttttattgcagcaggaaatccaaaggcaatacttatctttacggcctttcttccgcaattcgttagcccacaattaccggctagttcccagtttctaatacttggttctttattcttgttactcgagtttattgcaataatgctctacgcttggttaggcttacacatgaaaaagttgcaaaaaaaaccacatgctaaaaaagtgttcaatcgtatgtgctcaagtttattagctagtgcagggattgggcttttagtttcacagaaaagccattaa

SEQ ID NO: 3780 - DNA, 1158 bp, Proteus mirabilis
ataacaccaatgagggtaataataatgatgaagcgcaatattcttgcagtggtaatcccagctttaatgtttgctggtgcagcaaacgcagctgaaatgtacaacaaagacggcaacaaagtagatatctacggtaaagttgacgttcgtcattacttcgctgacaaagattctggtgaagacggtgatgcatctcgtgcacgtatcggtttcaaaggcgaaactcaaatcaataaagacttagttggttttggtcgtttcgagtacgaagttaaaactaataatactgaaggaagcgaaggtaacaacaaaactcgtctagcttttgctggtctgaaatttgctgacttcggttctttagactacggccgtaactacggtgtaatttatgacaccaacgcatggactgacgttctgcctttatggggcggtgactccatggcgcaaactgacgtttatatgactggtcgtactactggcgtattaacttaccgtaacactgatatgttcggttatgttgatggtttaagctttgctctgcaatatcaaggcaaaaataacgaaaacaccaacaatactcgtggtacatatgatccaaaagatccagcgtcaaataaagcagatgctaaatcaaatggcgacggttttggtttctctaccgcttataacttaggctggggcgtaacactgggtggtggttactcaagttctgctcgtacagcaccacaacaacacgcaagcttagctggtggtgaacgtgctgaagcatggaacgttggtggtaaattcgaagctaacaatgtttacttagcagcaatgtacggtgaaacccgtaacatgacttatttcggtaaatataaagatattgctaacaaaactcaaaatatcgagttaactgcacagtatgattttgctgatttaggtatcaaaccatctttagcctatgttcaatctaaaggtaaagacttaggtgttgctcaaggtaacgaccaagatttagttaaatatatctctgtaggttctttctacaaatttaacaaaaacatgactgcagttgttgattataaaatcaacctgttagatgacaatgacttcactaaaacttacggcgttgcaactgacaacgtagttggtttaggtctgacttatcagttctaa

SEQ ID NO: 3781 - DNA, 213 bp, Proteus mirabilis
atagcagcaataccaatagatagcacaaccattatcccacctattgtttgtattgttgccacattattagaagttgctattaaatttaatgtaattaagattatcaatctaagaataaaaaaagcagaaagaccaacaataaaagaaataactaaattccaagccttgactataaaactatctctagttttgcccaactcgtcagtcatctaa

SEQ ID NO: 3782 - DNA, 696 bp, Proteus mirabilis
ggggatgttttgttattacctgaattacatttgcgatgttatacacaagatacggtatcacatcagcatgagaatatctggcagatcatctttggcttaaccggaacgatggaagttaatttcaatcggcaagattttcttatttctcaacaaaactatttaattatcccacctaccatcgatcatgcttttgctggtcatctcaataataaaaatcttattttagaacttcctgtcacatcacagtggcgactgaatgaaagagggggaatatttgccttatcacccgcagcaataggattattagcgtgggtacatcaataccctcaagcgccagaacatcattccactctcgcacgtctgctattagcccaaatgaaagtacaaccaagctggggggataaattagatctctggctagaagataaactgcatatgccattaacagcttctgatattgctggtgcattaaacatatcaatcagtacgctacagcgcaaagtaaaagcggaattaggcatatctattatgcagtatgtgatgcaaaagcgactcgctaaatccgcagagttgctcaaatacacatcattaacgattgaaaatattgctttagcggtagggtatgattcacattcggcttttagccaagcttttcgtcaatactttcataaaacccccagtgaatatcgacagtaa

SEQ ID NO: 3783 - DNA, 354 bp, Proteus mirabilis
aggttaaaaatgactatgaaaaatgataataaaggttatttattgacacttatttgtgataacagtaatgataaagtagagaaaatcttccttaatcctaagatactttatattcctgatgttgccgctaaagaaattttgttattaactaacgaattaaagggcaaaatagatctctcagcccaagcgctgactttaacgctcaccaataaaaataatggtgtttcagtggataaagaatgcgagataaaagatttacttgatcctgatatggcgagtctaatggttaaagatttaatcaatatcgtccgtggttatgatatggatgaagaagccaatgtttgtggttggtaa

SEQ ID NO: 3784 - DNA, 285 bp, Proteus mirabilis
actaagaaaatcatcgcgcaagcgagttttgataggaaatttaatagtatgagcactatcgacgaacgcgttaagaaaatcattgttgaacaactgggtgttaaagaggaagaagttgtgaattcagcttcatttgttgatgacttaggcgctgattctcttgacacagttgagctggtaatggctctggaagaagaattcgatatcgaaatcccagacgaagaagcagaaaaaattactacagttcaagctgctattgattacgttgaaaacgcaggtaaataa

SEQ ID NO: 3785 - DNA, 1140 bp, Proteus mirabilis
tataaggaaatatttatggaacactttactaaaaaatcgttatttacctgcgataaaactaatgaaaatctccctaataaaccgggtgtaataacacattgccaagagctagcgtctgacttagggttaagcgaagcttttgcgcaatacacaatatcttatacttcttgtgacagtgttcatggagaaattatccgtgaagatactggtgctgtttttattccgaaaagtcaggcacctaaagatggttggcctgtcattgtatggaatcatggtacggtagggatagcgccaacttgtgctccctcattaacgcctaaaaatagtcgcgtatcgcaatatttaaatacttggctatcccttgggtttgcgattgttgcaccagattatccaggtttaggctcatcagggttgcatcattatatggatgaaagagcaacagcatggagcgctttggatagtgcaaaagctgtcttgaaaggtgggttttcgctaagtaatcgctttatctttatggggcaatctcaaggggctcatgctgcatttgcctctgtcggctatcagcctgaatatgcaccagaattaaatatcttaggtgcgatagtgacagggacgccttattttagtgataatctacttgaaaactttattagtgatggtgttcaagatgaaggtgatagaaagctaccttacgcgatgtacttatatctttctgctgctgataaaaatccaaacttaaaagtggaagattatttccaagaattagcaataccttatgttgaaaaagcgaaaacgctttgtatcagtccattaagtcaattagtaatggataataaattaaacgcatcaaatagcttaaaacctaagttttacgagctattagagcaagaagcgtcaagtttaaattatagaaaacttcttgttgataagcccgtatttatagggattggtttagaagatattcatgtgttaactcgttggcaacaagagtttgcaagagatgtattggaagcaggcacaaatgcatatgtatatgaatatccgaatattggtcatttagatgtatacaatgtctctttgcgaaattcagtgccttttgtatttgaactgatgaaaaatgagcatagcaaaatagactaa

SEQ ID NO: 3786 - DNA, 234 bp, Proteus mirabilis
ccattgagaattaatcaactaaaatttacaattaattgtaaattagatattaatactaagttattttacttattgggagcgctaaaaatatgtacaatactaaaaattatttataaaataatttatgtattgataataaaaataagtggcaataataataacaatatagtcgggttctctctacatttagcattattaaataacaaatgtataataaattatttaacaggctga

SEQ ID NO: 3787 - DNA, 387 bp, Proteus mirabilis
tggctaggaattaaaataaataataaggtgataaaaatggcagaagagacaatttttagtaaaattattcgtggtgaaattcctgcagatatcgtttttcaagatgatactgtcactgcatttcgtgatatttcaccccaagcgcctactcatattttaattatccccaataaacttattccaacggtaaacgatgttactgcacaagatgaacaagttttaggtcatctatttgttgtggcagctaaaattgctcagcaagaaggtattgcagaagagggatatcgtttagtaatgaattgtaataaacatggtgggcaagaagttttccatattcatatgcatcttttaggtggaaaaccattagggccattattaagcaaataa

SEQ ID NO: 3788 - DNA, 507 bp, Proteus mirabilis
gatcttctgatgccacaattaaatttttatcaggaactcactgataatttgtcagccttgttgtctggtgaaaatgactttatcgcatcacttgctaataccagtgcattgatttacgagaagttagacaagataaattgggtcggattttatcttaatgatggtaactcattagttcttggtcctttccaaggtaaagtggcttgtgtcaggattggttttggaaaaggagtctgcggaacggcattctcagaaaacaaaattctaagagttaatgatgtgcaccaatttagtggacacattgcatgtgatagtgcaagtcagtctgaaattgttctacctttagaggtaaatggacaaattatcggcgttctcgatatcgatagccctatttttggtcgttttgataaaaaagatgaaaatgggcttaaagcgttgtgtgacgtgctctgcgagcatttaaaaacgtgtcataccgcaaaatattgtgaattttgtgtaagataa

SEQ ID NO: 3789 - DNA, 702 bp, Proteus mirabilis
tttttactgatgtacacaaggtggaatatgcggatcttaattattgaagataatatcttacttcgccatcatttatctgtgcagtttcgcgatgcaggacatcaagttgatgcagcacaagatgcgaaagaagccgatcactttatcgcagaaagtacacctgatgtcgccattgttgatttaggtcttcctgatgaagatggtatcagccttattcgtcgatggcgggaaaataatattactattcccattatggtattaacggctcgagaaagctggcaggaaaaagtgaccgcattaaatgccggtgctgatgattatgtgacaaagccttttcattttgaagagatcgtggcacgcgttcaggcattaatgcgaagaaacatgggcattgcatcacaaatactgactattgccccttttgagttggatttatcacgtaaagagttcatgatcttaggtgagcaaatcaagctcactgcattcgaatatactattttagaaacattaatgcgtaatcaaaacaaagtggtgagcaaagatgtgctaatgcgccaactttatcctgatgcagagcagcgagaaagtcataccattgatgtgcttatggggcgtctgcgcaaaaaaattctccaaaaatatgataatgatgtcattgtaactgtacgtgggcaaggttatcgttttgatatgaaagcttaa

SEQ ID NO: 3790 - DNA, 1221 bp, Proteus mirabilis
cgcgctatgattttagacgctacaccgattattacatcactgttggataccgatgcatacaagctccacatgcaacaggcggtttaccatcattatagtgatattcctgtcgttgctgaattccgctgccggagtgatgaacgtctaggtgaatatgcaacaaccttacgccatcaagtggatatgatggcagacttgtcattaactaatgaagagtttggctatcttcaaagcctgcctttctttaaaaatgactatctgcaatggtttaaacattttcgctttaaacccgagcaagtgcatatcgcgaccactgctgacaatcaattgacgattaagataactggcccttggcgtgaagttattttatgggaagttcctttgttagcattggtgagtgaaattgtccaccgtgctcgttcgccacaaattaccgctgatgacgctgttattcaattacgcaaacttatcgatattttctatcgtgatgcggctgaacaacagattgatttagcggatttcaaattgatggattttggtactcgtcgtcgcttttcttatgatgtgcaacgtgccattgtcgatgaattaaaaaatcatttcccttatcttatcggcaccagtaactatcattttgctgaacgtatgcaactggcccccgtaggcacacaagcccatgaatggttccaagcacatcagcaaattagtcctgagcttgccaatagtcaacgggctgcattgcaatcatggctagatgaatacccagatcaactcggtattgcactcactgattgtatcactatggatgcattcttacgtgactttgatatgccattcgccagccgttatcaagggttacgtcatgactcaggtgatccgattgaatggggtgaaaaagccattgctcattatgaaaagctcggcatcgatccgatgagtaaagtattggtattctctgatagcctcgactttcagaaagccttagcactttataagcatttccataagcgtatccgcttaatttttggtatcggcaccagattgacttgtaatatcccgaatattacacctcttaatattgtgattaagctggtggagtgtaatggtaaacctgttgctaaattatcggatagtccaggtaaaaccatttgtgaagatgatgagtttgtcgacaagctacgtaaagcctttgatgttcctcttgttaggcaagcttgttaa

SEQ ID NO: 3791 - DNA, 315 bp, Proteus mirabilis
atgaccatgataaactccactattgcacacaaaataaaacaaagaagaaaagagttaagactaacaggcatagaaatgggaaatcgattagggataagccagcaacattattctcgaatagaaaatggtaacataaaaatcacggtagaacttttgttttctattgcatttattctcaatatgacgccacaaagtttattacctaattataatttattggataaaaaaatcattaatctttcagatgagaaaaatatcatcaaagcaaaacaggctttatctgcagaatttattataccaataaaagaaaaataa

SEQ ID NO: 3792 - DNA, 444 bp, Proteus mirabilis
aaatgcgtttttttattactacaattaaatgaccctctaacaggaattatgatgaataaagaatattctgccaaatgggaagagcgttttgatttcttcgaaaaatatggttctcctaaatctccagaatacaaggctgcatataaagcactgactttcggtaagcgtattctaattgggatgaatatctgggctttcttctttggctttatttattttcttatccttggtttatggcgtaaagcattaactttattcgggattaatgttgctattatcattgtggtaagttttatcgtggaaggactttccctaagcccttcaattctcaatgtagtcagtattgtgctcaacttcttatgggcggcgacagctaattatgcttactacttaaaagaaaagaaaaatgatcaaggttggaacccgttcaccggtgtattctaa

SEQ ID NO: 3793 - DNA, 3522 bp, Proteus mirabilis
gctttggcgatgtcgctaaagatgtgttgggagttaactacaaccaagagttcacattacacgcttatgtcctcagaatatcgttatcaacttcctgtaaaacaaggggatactcgccagctgggtcagctgacaggtgccgcttgcgccctagaatgtgcagaaatcatcaaacgtcatgctggattagtcgttcttgtcactcgtgatatgcaaaatgcactgcgtttacaagatgaaatccgtcagttttgtgattatcctgtagagacattatctgattgggaaacattgccttacgacagtttttctccccatcaagaaataatctctaaccgcctttctacgctataccgtattccatcacttctcaagggaattttaatcttacccgtcaatacgttaatgcaaaaagtctgcccaacagattatctcgcaagtcatgcattaataatgagtaaaggagagcaactttctcgcgacaatttacgcaaaacatttgatgaggcgggttatcgtcatgtagaacaagtgttagagcatggcgagtatgcaacacgcggagcattacttgacctattcccgatgggcagtgaatttccttatcgaattgacttttttgatgatgagatagatagcctaagaacttttgatgttgatacgcaacgcaccttaacagaagtcgagcagatcaaactattaccggctcatgagtttccaactgatcctaatgcgattgaactctttcgtagccaatggcgtgaacgttttgaagtaagacgtgatcctgaacatatctatcaacaagtaagtaaacaagtattacccgcagggattgaatactggcaaccgctcttttttagtcagccattatccaatttatttgcttatttcccacaaaacaccttaattgtgacgcaagatctgcaagattgcgctgataaattttggcaagatatcaaccaacgttatgaaagccgtcgtgttgatcccatgcggccattactgccaccagatgatatttggcttaatgtcgaaacgctcaatcaacagttaaaacagtggccacgtattcaacttaaaacgcaagcactgccggaaaaagcgggttataccaatttaggttatcaaccactacctgatttatcagtcaatgcacaaagtaaatcaccgcttgataatctacgccgtttccaagagcaattttctggcagtattgttttttcggttgaaagtgaaggccggcgggaaaccgttcaagagctcttatctagaattaaaattgcccccaaacaaattattgaattagcggatgctaaagagaaagggtgttattttattattggctctgcagagcatggctttattgacaattatcgtcagttagcgctgatctgcgaaagtgatatgttaggtgagcgagtccaccgtcgccgtcaagataatcgtcgcaccatcaataccgatacactgatccgcaatctggcagaattaagtcccggacaacctgttgtccatcttcagcatggggtgggtcgttatcaaggtatgactaccttagaagcgggtggcgtaaaagcagagtacttgatcctctcgtatgcgggagatgacaaactctatgttcctgtttcgtcactgcatttgatcagtcgctactctggtggggcggatgaaaatgcacctcttcataaattagggggtgatgcttggactcgtgcgcgccaaaaagcagctgaaaaagtgcgtgatgtggcggcggaattattagatgtctacgctcaacgagccgttaaatctggttttgcgtttaaattagataaagaacaatatcacactttccgccaaagcttcccctttgaaaccacacccgatcaagagatggcgattaatgccgtattaagtgatatgtgccaagccattgccatggataggctagtatgtggtgatgttggttttggtaagacagaagttgctatgcgtgcggcatttcttgcaataagcaacaataagcaagtggctattttggtgcctactaccctactggctcaacaacactttgaaaactttcgtgatcgctttgctaattggccggtcaatattgagatgatctcacgttttcgtagtgccaaagagcaacagcagatcaccgaaaaattagcagaaggcaccattgatatcgttattggtacacataaattattacaaccgggcattcaatggaaagacttagggttattaattgttgatgaggagcatcgcttcggtgtacgtcataaagagcgtattaaagcaatgcgtgccaatgtcgatatattaaccttaacggccacccctattcctcgtacgctaaatatggcgatgagtggtatgcgtgatctgtcaattattgccaccccacccgctcgccgtttatccgttaaaacatttgtccgcgaatatgatgatctggttgttagagaggctatcttgcgtgaaacattacgtggcgggcaagtgtactatttatataacgatgttgaaaatatagagaaagcgcgtgataggctagcacagttagtacctgaagctcgtattggtattggccatgggcaaatgcgtgaacgtgagcttgaacgtgtgatgaacgattttcaccatcaacgatttaatgtattgctctgcaccaccattatagaaacgggtattgatattccgagtgccaataccattattattgaacgtgctgatcactttggtttagcgcagctacaccaattacgtggacgcgttggtcgctctcaccatcaagcctatgcttatctattaacccctcatcccaaagcaatgactaaagatgcccataaacgcttagaagcgattgcctccctagaagatctcggcgcaggttttgctttagccacacatgatctagaaattcgtggtgcgggagagttattaggtgaagagcaaagcggtcaaatgaataccgttggcttctctttatatatggagttactagaaagtgcagttgaagcattaaaagagggtcgagagccatcattagaagatctgaccaatcagcaaaccgaaattgaattaagaatgccggtgctattgcccgatgactatattcctgatgtcaatgtaagactctctttctataaacgtattgccagtgccaaagacttaaatgaacttaatgatctaagggcagagcttattgatagattcggcaccttacctgatgcaggacgcaacttattacgtaatgcggctattcgattaagcgccatgagtttaggtatatctcgcattgaagcccatgacaaaggtggctttattgagtttggtgaaaaaaataatgtcgacccgacttatttaatcggtttattgcaagagcaaccgagcgtcttccgtttagatggccctaccaaattgaaatttatgataagcctaaccgatcgagaaaaacgactcacttttatcgacgatatgctcaccgcttttagtgaacacaaaataaacgcattgtctgtttag

SEQ ID NO: 3794 - DNA, 558 bp, Proteus mirabilis
ggaaaagagatgtctgaacactttcaaggtaaatttgaagcagaattgaaatatcacttaaaacgacctcaagattttattgatgcattacaactcgctggagcaactttatttatatcgaaaaatgatgaaacagattggtatttagaacatccaaatacgcctttccctgctccctctataagtttatgcgtaagaaaaatggtcccctctggtatcaatttattaattgtaaaaggcccagaacaagcccaatgtgaagcagtaaaaatagaagatgcagaaaaaacggtttcgatgtttaaaacattaggttatcactgtattttaaactatacaaaatcccgtcaaatctactttctagaccaatttcatatcactatcgataaattagacaatcttggctactttgctgaatttgctattatgactgatgatgagagtaaacttgctgactataaattacagttacataacttagcatatcaatttggctttaatgatagtgagcaagagcatcataactataaaacaatacttttaagcaagttagcttaa

SEQ ID NO: 3795 - DNA, 873 bp, Proteus mirabilis
aaaccaaggattgccatgatgaaacttaaacttcgtcatcgtcggcttaggaagtttcgtaagataaaaagtttacgtagacaacactcacgttgtcgttattttcatttaacccataaaacggaacatgaaatgaatttacccaaagtagtggtgctaaccggggcgggcatttcggctgaatcaggtataaaaacctttcgatcagaagatggattgtgggaagagcatcgcgttgaagatgtggcaacgccagagggatatcaccgcaaccctaagctggttcagcagttttacaatgagcgccgtcgtcaattacaacaaccctcaattcaacctaatgaagcacattatgcattagcaaaacttgagcaatatcttggaaaggacaatttcctgctggtcacgcagaatattgataacttacatgaaaaagcagggagtaaacatattctccatatgcatggtgagttattgaaagtccgctgtccgcaatcaggtcaagtttttgaatggaaaggggatttatcaacgacagattattgccattgttgccaatttccctctcctctacgtccacatattgtttggtttggcgaaatgccaatcggcatggatgaaatttatcacgctttagcacaggcagatctctttatcgctattggcacttcggggaatgtctatcctgctgctgggtttgtccatgaagcacggttaacaggggctcacacggttgagcttaaccttgaacctagcttagtggagagtgagtttgaagaaaaacattatggccccgcaagccaagtggttgatgcatatgtccataaattgtttgatttaattaatgatcctaaagctgatttgacgcaataa

SEQ ID NO: 3796 - DNA, 2184 bp, Proteus mirabilis
gggctttttgtgttcaatttgtttaatggcgcccgccgatttatctataatagccactttttatattatattcgcataataatcgcacttacgggaacgactttatttccatgggctttaggacaagaaccaaaatatactatacctcttacattaggtgttgtcgcagccgcattaactgacttagatgataggcttgtgggccgcttaagaaaccttgtgatcaccttatgttgtttcttattagcatcaacatccatcggattactctacccttaccctattttattcttttgtggtcttgctatctccacttgggggtttattttattaggcgccttgggtcagcgttatgctaccatcgcctttggtgcgctattaatcgctatttataccatgttaggtatgccgattttcccagaatggcatgaacaacctatttggctccttttaggcgcgatttggtataatttgcttaccttaattggtcacctacttttccctattcgtcccgttcaagatagccttacgcgttattatcagcagctttccgcttatctagaagccaaggccgcattatttgatcccgatattgaaggtgatcaacagcaattactgtataacttggcattggctaataatcagttaattgaggcaatgagccaaactaaactaacattactaagccgtttaaaaggtgataggggccagcgtagcagtcgtttcacattgcattattactttgtggctcaagatattcatgaacgggccagctcttctcatattcaatatcgattactgagtgatagattacgccacagtgatgtccttttccgctttcagcgcttactgtcaatgcaagcaagagcctgcgaacaagtcgctcaatctattctttggcataaaaagtaccaacataatcctcattttgaacgtgcaatcactcatttagaaaatgcacttaataatgtaaaaaacagtacttctgatccacaaattattgcgccactctataatttattacaaaacttacagggcatcgatgctttattaaaaagtattagtacagagcaatatcaaatctctcatgaccaaaaagaagaaactcagttatctgatgaagggcttactgggtggcgagatatcgtgctaagaataaaaggtcacttaacaccaaaatcagctctatttagacatgcagtacgaatgtcacttgtcttatgtataggttatgtgatcatccagttttttgatttgcatcgagggtactggattttattaaccagtttgtttgtctgtcagcctaactataatgcgacacgtagacgattaacattacgggtcagtggcactattattggtattttaattggtttccctattctctattttgtgccttccatcgaaggtcaattagtgcttattgttgtgacaggtacgctcttttttgctttccgaaccgtacaatacgctcatgccactttgtttattaccctactcgttttattaagttttaatttattaggtgaaggctatgatgtcgcactaccgcggatcattgatacgttaattggatgtgccattgcctggtttgcagtcagttttatttggccggattggaagttccgtcagttgccattgctcatccaaaaaaccatgaccaataactgctactatcttgatgcgatcctcattcagtattatcaaggaagagataatagcgttaattatcgtattgcacgccgtaatgcacatagcagtgatggtgagttagcatctttaatttctaatatgtcatcagagcctaaaagctttcaaacctctcaagaagaagcatttaaattactgtgtttaaatcatactttactgagctatatttcagcgttaggtgttcatcgttgcaaaattgaagatgaagcggtactcaccctgcttaatgatactgtctgttatattgattcagcgttgagacgtaaaaaaccacaagataatgattttatacaatctcacgatcaacttatcgcacgtgttaatgcacaaccaagttcagataacgcccgtattcaattagtgttaacgcaaatacgcttgttactggatttattgccacaaattgtcaattgcattgagctaattgagcaaacagaatggcaaaacgataaagataaattagctacagcttga

SEQ ID NO: 3797 - DNA, 384 bp, Proteus mirabilis
tatatacttgtattaatctatttttttaagtggaagataaccatgaaacgttttttatttgcgggcatattgatgcttttttcttttcaaactttcagtgcaccaatatcaacagtcagtaagcttcagtttggtgatgcttggccattcacccgtgaagaagtcatgctaaattgtcgtgcagatggtgcttggtttgtgattaatcccgcaactttagctcaatatccacttaataatattgccatggaacaaatgaaaagtggcaaagttaatgctcaactgattgatagtattctacttcctgatcccaatacacctgataagaaaaaatcactggaagctatagaaagtgcatttttgtctctttgtgaaaaaaactaa

SEQ ID NO: 3798 - DNA, 630 bp, Proteus mirabilis
gggaaatctgtcacaatgagaaataaaccgtttatgagaatgcttaagctcataccggcgtttattgtcgtagctacgttatcagcctgtagttcacaaaacgcgtcttcacgcttagctaattcaacaactgccccacttaataaatcttcaagcacatctatttcccaagcatctcaagatgaatttgaatcattggtgaagaatctcgatataaaatctaagatacttgaccaatatgcagactggaaaggtgttgcataccgcttaggtggcaatacaaaaagtggtattgattgttccgcttttgtccaaagaacttttcgtgatcaatttggtgtcgaattacctcgttcaacctccgatcagcaatttgctggtaccaaagttaatcgttcaaccttaaaagcgggtgacttagtactgtttaagactggtcgcactatgcgccatattggtatttatatcggtaatgataagtttgttcacgcgtcaaccagcagtggtgttatcgtttctgaaatgtccaatgtctattggaaaaaccgtttctatacagcgcgtcggatcattgataataatacaacaacaagtcttgctgataactattctcaagcgtcattaagataa

SEQ ID NO: 3799 - DNA, 474 bp, Proteus mirabilis
ataggaactgttatgaaaaagccactttctttatggataactcaatttttgattgtctgctgtattatactgatattatatttttttataaccaatgcatcactgttattaaatttgtatagttttgatatgcccgctgagataaagatagaaatttatttatggagttttattcgtttgttagttttaattatacaaatatcagcgctttacttttcctttaggtgcgataaaagggcgcgggtattgactatcttagcttggctaccaatcattatcgtcatgttatggagcaatttccatgaagggttaacttctttgaacgaaagtggtataagctatgataatgatgctcaaagatctggagggattataggtaaacttattctggctggattatccctttggttgacatctattatattattttcaaaaaaattaaagcgttattttctatttgagaaaagtgaatga

SEQ ID NO: 3800 - DNA, 963 bp, Proteus mirabilis
acatggcatgttggcagcccgtcgccgcgcacgtcaaagttcacaagcacttatttcacaatcccagcatccaaaagacgttactcaacaagaagaggtgcaactatgaatgaattaatggaatttttcattgaaccttttcaatatccttttatgcaacgtgcaattattgccgcggttatcattggtatcgcctgcgctattttatcttgctatatggtgttaaaaggttggtcactaatgggagatgctatttctcacgctgttttacctggcgtggtattagcttatgtcactgcaattcctttaacgataggggcttttctttcgggcctattttgctcatttgcaacaggttatttaaaagagcatagccgaataaaagaagatacggtaatgggaattgtcttttctggtatgttcgctgtcggtttggtgatcttcgctagtgtagatactgaccaacatttaatgcatatattatttggtaatatcttaggtatcaccccagatgtgcttatacagattagtgctatttgtttaattactattactattatgctggttaaacaaaaagactttatgttgtattgtttcgaccctaatcaagcaagaattgtcggtctcccggtcgctttattacattatggcttactctctattttggcgttaacgattgtcgcctcgatgcaagccgttgggattattttagtggtcgccatgctgatttctccggggatcaccgcttatctattaacgcgaagcttctctcgaatgatcacactcgctatccttttttctgttatatcgagtgttattggtacatttatcagttttcatattgacggtgccacaggcccttctattgtactcacgcaagcggtgttctttattattgcattactctgtaatcagattaaattggcaaaaataaaacggcaaactaaacccgccaatgcctaa

SEQ ID NO: 3801 - DNA, 207 bp, Proteus mirabilis
gggttaaatgtgggtattgtaaaaatttctgatgagctacatgagtatctccgtaaagcaagtaatgtgatgtctcgatcagttaatgcacaagcagagttttggataaaaattggtattcaagcagaattaaatccagaaaaaacgtttccaatgattattaatgaaatgttagaaaaagaagcaataaaacaagagcataagtaa

SEQ ID NO: 3802 - DNA, 453 bp, Proteus mirabilis
agagagaatgtgatgcttagtcgaatcaccatgttaacaacaagttttcttttatctgggtgcatgtcttcgagtgttgttcctagcaaacaacttgaacgtcctcaaccacaagtaaatataccaacaaaagtgttaacgattaaactagatattgggaaaactactcaaaaagaaaccatagcactattaggaactcctacagatatttcgtcttacgatgctaacttatatggtgaaaacatgaatgtacttgagagccatataggtaaaggatacgaatataattcttgtgatatgggccgagcagagaaagctaaagttgtaataaaaacacttgtggtggataaaaatgcaccagatttagaatatattgtcgaatgtaatacgacaagaaaaacattatcactatctttttttgatgggaaattgagtcaatattcatattattga

SEQ ID NO: 3803 - DNA, 279 bp, Proteus mirabilis
gctttttgtgtcaaaaaaagtcgtgatttaaaaattatcgttactagtcaatatttagcaggtaatggttatgaaagtctgtgtctgtatttcgctttaccattatcagacaatgaacctgagtggcgagtggttgagcactggcttaaagacggtaaacgctgtttagagcataccgaactgacctatgatttagcccaacgaacccttattacagcaaaacgaggtgcgaaaaaccttccgttatgtcaatgcattgaattaaacttgattttttga

SEQ ID NO: 3804 - DNA, 213 bp, Proteus mirabilis
cgcatctgtgtctttaattgcacagaatatcctaaagtatattgtttaaccttaaagctgtgccgtattaaatcaatagcacccaccaattttactattacatacggtgatcttctggtgctgtctaatcgtattgattacgctgtcagaatatggatctggcttcatcgcatctttactcgattgctcatatttatcaatatcagactgtga

SEQ ID NO: 3805 - DNA, 702 bp, Proteus mirabilis
ttcggcttcgttttgagcttagggaataattacactatgtttgagaaaatcattgctgcaccagccgatcctattctgggtttagctgatagtttccgttctgatactcgtgaaaacaaaattaacttagggattggtgtttataaggatgaaacaggtaaaacacctgtactcaccaccgttaaaaaagcagaaaaatatttattagaaaacgaatccactaaaaattatcttcctattagcggtattcctgagtttggtgcggtcactcaagcactgttgtttggtgaacaacaccctatcatcacagaaaaacgtgcacgtacagcacaagctccgggtggtactggggcattacgtattgctgcggactttattgctcagcaaactaatgctaaacgtgtatggataagtaacccgacttggccaaaccataataatatttttcagactgcaggcttagagatttgccaatatgattattatgatgccgaaagccacggtttagattttgaaggtatgctagctagcctacaaaatgcacaagcaggtgatgttgtgctgttccacggatgttgccataacccaagtggtattgacccaacgttagagcaatggcgtcaattggctgccttatccgcagagaaaggttggttaccagtatttgactttgcttaccaaggttttgctaatggcctttga

SEQ ID NO: 3806 - DNA, 219 bp, Proteus mirabilis
aagttatttttaatattaaatggatgtattaaattaattcaggttcgtgatgattgttcagttatagttaaaattgattctatgcaactgaataatgctaataaattccctgagtttaagtatattatttcaggccaattaaaaatgaaggagatttcacatactggaaaaattattcctttttgtcacattaaaaatatgaaacactcagtaaaatga

SEQ ID NO: 3807 - DNA, 234 bp, Proteus mirabilis
agtgaaatagtgggaagatcaatgcttcaagaaaatgtagttaaagatatcattgtttggatcgagcaaaacttagattcacgtttatcattagatattattgctgaaaaatcaggctataccaagtggcacttccagcgcttatttaaagcatatacaggaatatctttaggcaaatatgtcctagcacgccgtttatcttgtgggcgcttatgcgttgaggatcactcgtag

SEQ ID NO: 3808 - DNA, 1422 bp, Proteus mirabilis
gtttatcaagtactcagttcgaagttatgggagggttcgctcatgtcagataatgtcatctcctctatcggcaccaatcaaactggtgttaataaccgtgttcaattacgcaaaacattgacgctaatgcaagtcgtcatgatggggttggcatttttacaacctatgacgatttttgatactttcggtattgtatcaggcataaccaatggtcatgtggcaacatcatatgctattgcgttaaccgctattttatttaccgcagtgagctacgggaaattagtcaagcgtttcccttcagcaggctctgcttatacttatgcacaaaaatccatgagtccacatgttggttttatggttgggtggtcttcattattagactacttatttatgccaatgataaatatcttattggctaaaatttatttacaagccatattcccaggcgttgatccgtggatctttgttgttgcgttagtcgcgttaatgacattttttaatctacgcggaattaacgttgtggctaacttaaataccgttattgttgttattcaagtagctgtaatggtggtatttgttggtttattaattcatggcgtatataacggcgaaggtacaggggagttatggactttccgcccatttgcgtcagtagatgctgaattaatcccaatgataaccggcgcgacaattttgtgcttctcgttcttagggtttgatggcattagtaccttatctgaagaaacacccaatgccggtaatgtgataccaaaagcgattttcttaactgcgttaatcggtggtttaatttttatcgctgtttcttattttttacaattatatttcccagatatttcacgttttaaaaatccagaagagtcacaacctgagattatgctgtatgtagcaggagccttgttccagtctattatcttagtgttttcttgtgtgacggtattagcatcgggtatggcggctcacgcaggtgttgcgcgtctgctgtatgtgatgggacgtgatggtgtattccctgaaaaagcgtttggttatgttcatcccaaatggcgtacaccggcatttaacgtactattagttggctttttagcgctaggggcgatcttttttgatttagtcactgctacagcgttaattaactttggtgcgttagtggcatttacctttgtcaatttatctgttatttcgcagttctacattcgtgagcgtcgtaataaagggttaatggatcatattaactatcttatattaccgattattggtgccgcgacaatgggggtactgtgggtaaaccttgaaccaggctctatggaattaggactgatttggggggcaattggtatactttatatggtgtggatcactcgtcgattccgtcgacctatgcctcaaatgccagagaaataa

SEQ ID NO: 3809 - DNA, 765 bp, Proteus mirabilis
tattcatttttaatagatgcctcatatcagatggtactcttccatttttcagagaaattcatgcgattagataaatttttatcccagcaattggggattagccgtaatttagtagctcgtgaacttagagcagggcttgtgactatagatggtgaaatggtaaaaacaggtgcgactaaaatcacacctgaacaagaaattgcttatgatggcaatgtgttgacacaaattttaggcccgcgttattttatgttgaacaaacctattggttatgtgtgttcaacggatgatcctgttaaccccaccattctttattttattgatgagccactagcacataaattacatgctgcggggcgtttagatatagatactacagggttagtgttattaaccgataatggtcaatggtctcatcgtataacggcacctaaacatcactgtgaaaaaacgtatgtcgtaacgttggaacagcctattgctacggatgtcgctgagaaatttaaaacaggtgtccagttaaatggcgaaaaagaattgactaagcctgcgacattggaagtaataacaccgactgaggtaaaactgaccatcagtgaagggaagtaccatcaagttaaacgtatgtttgctgcggtgggtaatcatgttgtcgcgttacatcgagagcgtatcggtgatatcacattagatgatgctttagcgccaggagaataccgaccgctaacagaagaagaaatcaatagcattcatctacctaaataa

SEQ ID NO: 3810 - DNA, 1245 bp, Proteus mirabilis
tctattttggtgatagttatgtctttgaaacgtaaaattgcgctggggaaaaatgtattagaagctgctcaagagagagtccagtggatatttgatacttttgaacaaatcactctctccttttcgggagggaaagattctactgcgctttttcatcttgttgccgcacaagcgcgaaaacaacatagaaaatttaatgtgatgtttcttgattgggaagttcaatattctgcgactatagatcatattataaaaatgaaatctatctaccaagattgtattgaacggttttactggatagcactccctatcaccactgaaagtggcatttctcaatatgaacctacatggacagcatgggagtctggtaaaaaatgggtaagacaaccgccagaagatgcgataactgaccctcactttttccctttttatcacccaaatatgctttttgaagattttacccctgcatttaaccagtggatcacaggtaatcatcgcagttcgattatcctgctaggcataagagcggatgaatctttaaaccgatttattgccattagtaataatcgaaagttacgttatgccgatgatattccttggacaacggcatcagcagaaggcttttattatatggcctaccctatttatgattggcatgttaaagatatctggacttatatagcgcgtttcaatttaccctataaccctatttatgatctgatgcaccaagcgggcgttagtttaagtcaaatgcgtatttgtgaaccttttgggccagagcaacgcaagggactatggttatatcatgtgctagagcctgaaacatggagtcttgcttgtgaacgagtgagtggagctgatgccggaatgttatatacgaatcctcgtaataaatcaggtttctatgggcgacatcaaattagcaaaccttcccatcatacgtggaaatcttatgctcactttttattagccagtttaccagagaaaacagcagaacattatcgtaataaaatagcggtctatcttcgctggtatgccgaacgagattacccaaatggcatacctgatgcacaagaaggtgatactagcactaaacagataccttcttggcgacgaatttgtaagaccatcttgcgtaacgatttttggtgtagaacattagcatttagtcctactaaatcacactgttatgatcgatatttcaaacggatacaaggaaaacgaaaagactggcaacttatttag

SEQ ID NO: 3811 - DNA, 1002 bp, Proteus mirabilis
aagcgtttggtggcggctttacttggggctctgcacttatccgtttttaatattatcaggaaaataaacatgactgattttgcaatggttttccctggacagggatcacaagcgattggaatgcttgcagaacttgccgagcattatccaatagtgacagaaacatttgctcaagcatctgatgtattgggttattctctttgggatttagtgcaaaatggtcctgaagaagagttaaacaaaacatggaaaacacagccggcattattagcagcatccgttgctatttggcgagtatggcaagaaaagcaaggcaaaatgccacaaatgatggcaggtcacagtcttggtgagtattctgctttagtctgtgctggcgtaattgattttgctgcggcgattaaactagtagaattgcgcggtcaattaatgcaagaggctgtacctgcaggtactggcgccatgtatgcaattatcggattagataatgatgctattgcaaaagcttgtgaagatgcggctcaaggacaagttgtctcacctgtgaactttaactcacccggtcaagtggtgattgcgggtaataaagaagccgtagagcgtgcaggggcattatgtaaagaagctggagcaaaacgtgcgttacctttagcggtaagtgtgccttctcactgtgctttaatgaagcctgctgcagataagttagctgttgcattacaagaaattgaatttaaacaacctgaaattcaagttgttaataatgttgatgtgaaaacacaaaccgatgctaatgctattcgagatgcattagttcgtcagctttataacccagtccgctggactgaaacggttgaatttattgctggcaagggcatcacacaattattagaaataggacccggtaaagtattaactggtttaacgaaacgtatttctaaagagatgaacgctgcggcagttaatgatattgcatcattagacgctgcattaggaaatgactga

SEQ ID NO: 3812 - DNA, 549 bp, Proteus mirabilis
gcaaaaatattcggtttaaggcagttttttggcaaaattgttgatatgctagtatatagttacgttgtcacggtgatttgtatgaaatatcaacagttagaaaatctagaatgtggctggaagtgggcttatttggtaaaaaaacatcgcgaaggtgaattaatcacccgttatgtcgaaaagagcgccgccgatgaagtggttgagcaactattacgtcttgagtctcaaccattaaaagtccttgaatggatcaatttacatatgaaccctgagttatcgaatagaatgaagcaaactattcgtgctcgaagaaagcgttattttaatgctgaacatcagcatacgcgtaaaaaatctatcgatttaacttttaaagtttggcaacgcctatcagcactatctcagcgccgaggtttgacattatcagaaacgattgtccagcttatcgaagatgcggagcgaaaagagcaatatgcactaaaagtacataacctaaaagatggcctaattgagttactagaacgagacaaacagaaaaaagagtag

SEQ ID NO: 3813 - DNA, 588 bp, Proteus mirabilis
attaggatatttaggtgcatattgccgaattctatgagtgaggacaaaatgagttatcaacatgcaggaatatatgccattgtaaaacgtgttattggttggcttatttttattcctgcctttatttcaacgacagtttcgttgattgagttagctgcgatgccaagagcaaatggcgagggtgttaatgctgtaattaatgatttttttcgagtattagcagaaatggtacaatttaacaccccgtggctagactttttttggcgtcattctccagtacctaacactcaaataggttttagccaacagaatattatcttctttgtgatcttctttttaatgtttattggcttagcactgagtgcatcagggttaagaatgtatcgccaagtgaaatatttaaaggaaaatattcaagatcaactaattattgaacgagcactaaaaagtggtattacagcgcaagagctagagcagaatataaaattgccaagacatacactatttactcaagtcatggtgctgtatatttcacctattattgtgatcgcaattggttattttctgctgaaatttttaggctggtag

SEQ ID NO: 3814 - DNA, 333 bp, Proteus mirabilis
atgcgtaaattactttctatctctgcaattgctttattaacttcaattattgcaacgcctgcattagctgctaaaacagaaacttacgactgtgaagggcaaaaaatcagagtttctttccctaatgatgatttggccgtaatggattataatgatgaattaatcgtgttaaaatctgcagtcgctgcaagtggtgcgcgttatgttggagaaagtttccaactgtggggtaaaggtagtgaagagttcaatttagcgacgatgtcagaagatgaaatagttaatgatcgtattgctgaagatacagggcgtacttgtaaaatagtaaaataa

SEQ ID NO: 3815 - DNA, 456 bp, Proteus mirabilis
attttaaaattaattaggcaatttatgttcaattatccagcaacatcccattttgacgaagaaagtgaaacttacgagattacttatcgtgattttgacaatatacatgcagtggcatatacagaagatgatattgaactagaagcctcagatattttacatgtaggacttgaagagtttatttcgagtaaaatgccgatccctatgccttctgagcctcaatcaggggattttattgtgtatcttccccctattagttgcttaaaaatcgcattacataatgccatgttaacaacaaaaactaaaaaggcagatctggcaagaaaaatgaatctaaatagcgcccaaattgagcgtttactcgatatcaatcaaacttcaaaaatcgatagcctagagcaagcgctttacctattgggttatcacattgctatatctgtgcataaacagcgctag

SEQ ID NO: 3816 - DNA, 402 bp, Proteus mirabilis
agtgctttttcgttaaaatgcgccccgctttatctgtttttagataaaccaaatctcgagcttgttgctgggtcgcctgtaacaagtatgtattttctttttcataagagaaaaaagatgttaactattaatgcaacagtacgtaaagagcagggtaagggtgcgagccgccgcctgcgtgtggctaaccgttttccagctatcgtttatggcggaaatgaagagccaatcgctatcgatttagatcacaacgaagttatcaaccaagaacacaaatctgagttctacgctgatttcgttaacctcgttatcgatggtaaagcaactaaagttaaagttaaagcagtgcaacgtcacgagtataagccaaaaattactcatattgacttcctgcgcgcttaa

SEQ ID NO: 3817 - DNA, 1023 bp, Proteus mirabilis
gtgattgtttcatatgaggtcatagccatgcccaaaactcttatgagtcttaaacaaaatgattttacgcataaaaaaattatcgtaggtattagttcatgcttattaggggataaagtgaggtttgatggtgggcataaatgttgtcatcttgctgctgatgaattatctgagttctttgaatatcaatctacttgcccagaaatggctattggtttaccgacacccagaccagcattacgattagttcagtctaagactggtgaagttaggttaaaatttagtaatggaagtgaaggtgacttaacccaattgatgaatgattactctatcgaatatttgaggaggtttaatcaatttagcggttatatcgtgtgtgcgaaatcacccagttgtggattagaacgtgtccgggtttatgatccaataggcaacggcaataaaaaatcgggtacaggcatttttactgaaaatctgaaaagaataatgccgtggttacctatagaagaagatgggcggttaaacgatccctatattagagaaaattttattacacgggtgtttgcgcttaatgagctaaatcaattgaaaataaataactttactcgccaggcattaattgattttcatacaagatacaaactattgttattagctcattcacaaccgctttatcggcaactagggcgctttgttgctaacaataaagattgggattcattagagactttctttgttgaataccgtaatcgatttatggctctattacaacatcaagccactcgtcgtaatcacactaatgttcttatgcatgtgcaaggatattttaagcaagatttaacttctaagcagcgacaagcattaagtcaattgatcttagagtatcgtcaaggaatacaacctttattggcaccattaacattaattaatcattacttatcagaatacccagataattatctgagtaaacaaaaatacttttatccttatcctcaatctttaagattacgttatggtttatga

SEQ ID NO: 3818 - DNA, 216 bp, Proteus mirabilis
atctgtgtttccttaaagtcattgatagcgtcagctggagtaaagatgaacaaagtggtttataaagtgagtggactatggaacgaaacgtcctttgtaaatctatttattgcaacgaatgaaaaagaagtattatctgcaattatactatgggctcagtttagtggtgcaaaagtggatgatttatctattgagtattatagttccgtgcattaa

SEQ ID NO: 3819 - DNA, 1071 bp, Proteus mirabilis
tctgatgaattgaaaagattttattattgcaataacaaagagaggaatgttatgggtcctgtaatgcttgatgttgaaggatatgagctcgataacgaggagcgtgaaattttaaagcatccccttgttggtggtttgatcctctttacccgcaacttccacgacgctgagcagttaaatgaattagtgcgccaaatccgtgatgcttcccatgagcgtttagtgattgccgttgaccaagaaggagggcgagtacagcgctttcgtgatggttttactcgcttacctgctgcgcaatcttatgctgcgcttaatgagcgctatcaagctagtcgcttagcacaagaggctggttggttaatggcatcagaaatgatcgcaatggatattgatattagctttgctcctgtcctagatcttggtcatgactgtattgctatcggtgagcgctctttccatgagtgtccagaaatcgctatggatatggcggaaagctttattaaaggaatgcgctctgcaggtatgaaatcaacaggtaagcatttccctggtcatggtgccgtcagagccgattcccataaagaaacgccacgtgatgagcgctctttaaacgatattcgtcaacgtgatatggctatctttaaagattttatccaacgtcaattattagatgccattatgccagctcatgttatttattctcagattgatgagcgtccagcaagtggctctccttattggttgaaatcaattttacgtgaacaactcggtttccaaggcgttattttctctgatgatttatctatggaaggtgccgctattatgggaagttatgcgcagagagcgcaacgttcattagatgcgggttgtgatatgcttttagtgtgtaataaccgtaaaggggcggtaagtgtgttagataacctgtcctttgtcaaagcagaacgcatttcggcgttgtaccatcaccgaggtcgttacacattaagtgaactgcaagcatctgatcgttggaaaaaagcgaatcaaatgctgacccaattacaggagcaatggcaggagcgcgcatga

SEQ ID NO: 3820 - DNA, 1773 bp, Proteus mirabilis
aggcaatattcactaataaacacagaaatatttatagacatggtaacgagaaatcagtcctatcgtgaaaaagtatcccaaatgatcagttggggtcactggtttgcgctgtttaatattattctaagtcttttgcttggaagccgttacctgtttattgctgattggccaagtacctttgcaggtcgtctttacgctattgtcagttggatgggccattttagttttatcgtgtttgctatttatatccttattcttttcccgttgacctttgtggtagtttcgcaacgattacttagggtgatatcctgcaccttagctagcgcaggattgacattacttatttttgatatagctgtttaccagcaatttcaacttcatttgacccagttggtttgggatttggttatcaatccagatgaaggtgaaatggcgcgagaatggcaacttatctttattggcatccccattatctttcttatcgaaatgctatttgctacatggagttggcaaaagctgcgcagcttaaaccgccagcgatggggaaaaccattagcctgtgtatttattagttgctttattttatcccactctatgtctatttgggcagatgctaatttttatcgccctattactatgcaacgtgcaaacttaccgctgtcttatccaatgactgcacgtaaattccttgaacggcatggttttattaatcaatctgagtatgagcagcgcttaatgagcgagggtaatcctgcggcacagagtatcacctacccgcttacacctcttgattattctaaagatgaaagctcatataacttacttatgattgtggttgatggattaggtaatgaagacgttgccaaactaccgagcttgcaacaatttgctgataataacctctctttctctcagcactattcagcaggcataaataacgaaacggcgctgtttggattattttatggcatttcaccgtcttacttggatagtgtgttaagtagccgcaaaaactcagcgctctttgacgctttaaattatcgtcactatcaattagcactattttcaactaacggatttaaatcgccattatttacacaagcggtgctggctgattactcactacctacttcacgtagtgaggataacgacacaacgattaatagttggcgttcatggttgttaaaaaataaacaaagcacaccttggttctctttcttacaaatcaacggtgataagcatacatcagcttctcaagcacagttaaatagtcaattagagaccatttttactactttaaaagaaagcaacatacttgataataccgttgtggtcgtaacgtcaaattatcatcagaacaatgataaacaagatagccaatggcttgttagcaaagacacttttaatttaagtcaatcgcaggttccactggtaatacattggcctaatgttacaccacaaaaactagataaactaaccagccaccaagatataatgacaacgctaatgcaacatgtattaggtgttattagccctgcagataactattctcaaggcgaagatctatttgctaatacgcgtaatcacccttggatttttactggtgataatgaaactctagtggtctttttacaagataatacgttaatgatagataaacatggcagatatgctttgtttgataaatcaggcaaagagatccaatccgccaaacctgatttacgcctattattgcaagtacttgctgagcaaaaacgatttattgagcgttag

SEQ ID NO: 3821 - DNA, 651 bp, Proteus mirabilis
aacacgtattcaggagtagatgtggctaaagattttcgtgatattacccttgcactggcaggtatctgccaggcaagtcgtcttgttcagcaaattgcttatcaagggaatgcagacgagaaagatgttgaagtcatggttaacagcatttttaatatcaacccaacttcaaccttggatgtttatggtaatcaaataagtcatttgaaattaggttttcaaactataaaagctatccatcaagcggtaagaagagaaaaactcacgtttgagttgatgacttatcaacaaggcctgattaaccttgaacgtatcataaacaaaaataacgattatagttcgcatttatcacaaaaaatatctcaacttgaacgacaaaaaaattattttgaaccgctttctgacggattatttaatgctctcgctggcgtttatagtgatgcggtcagccctgtagggccaaaaattcaagttaatggttcgattgagttgcttaaaaaccctattattcaagccaaagttcgtggattacttctgacaggtcttcgtagtgccgtactttggcgtcaagtaggtggtcgccgttttgattttttactccatcaaaaaaccatcttacgacaaactgatgattttctcgctcaatgttaa

SEQ ID NO: 3822 - DNA, 219 bp, Proteus mirabilis
tatcagcattcgctgtatatccacattcaaggcactcgaattgactttgtgactgccggttttcctttgctgtatgaccacagcaagcgcacttctgactggtgtaggcgggtggtattgccagtacctgacctcctcgccagagctgcttgtactcaagctgacggcgcatttcataccagccctgctccagtattgagcggtttaaaccagatttag

SEQ ID NO: 3823 - DNA, 414 bp, Proteus mirabilis
atggttgattcagagatttatgacattctaagaagtgtcaaaacaattgcactggttggtgcaagtcataaagaagatcgccctagttataaagtcatgaaattcttattagagcaaggctatgaggtgatccccgttaatccgggtatggcaggggaaacaatattaggccagcaatgttatggtcatttgcaagatattcctgtggcgattgatatggtagatgtatttcgtcaatcatcagtagcgctcgagattgccaaagaagcgattaaaattaatgctaaagttttatggttacagataggtgtgatcaatgaagaagcaaaagcattagctgaacaatcggggttgcgggtggttatggatcgctgtcctaaaaaagagatagaagcccacggattgccttggtaa

SEQ ID NO: 3824 - DNA, 609 bp, Proteus mirabilis
gtaatggcctcagaaattgaaatttgcaatattgcattaagtcgcattggtaatagtcgttcaattaatagcatgactgaagccagcaaagaagccgttcaatgtaaccttcattatgcgcaatgccgtgatagtgtgctggccgattttccttggaactttgcgactaaaaaggtggcattagccaatacaaataatcccccgcctaattgggcgtatgcctatcgctatcctaatgattgtctaaaagccattggtattgtcgaacctcatcaaaagtaccgtagaccagatacagcaatccattttcatgttggttcagatgaaaacggtactggtcgtttaatttttactgatcaccctagtgcatggcttgaatatgttgcacgtattactgacgtcaatatgtttgatgcgttatttaaagatgcgcttgcatggcgtttagcggctgaattggctcgtccattggcatcaaatgcgggtattggtggtgaagcattacaaatttatcaaggtgttattaaaagcgcagccgcacattcattaagtgagtcagcagagccaactgattatatggatgaattcacacaagcgaggttgtcataa

SEQ ID NO: 3825 - DNA, 1539 bp, Proteus mirabilis
tcaatgcctttattacaagatgactcttcttcaccacgtcctttagaaattgcggctatagaccttggttctaatagttttcatatgatcatagcccgtgttgtcaatggtgccttacaggtattaagtcgtttaaaacaacgggtatatcttgccgatggtcttgatgataatgataaactcagtgaagaagcaatgttgcgggggctttctgcactttccctttttgctgaaaggttacagggatttccagcagaaaatgtcactgtggtcggtacacatacgttacgggttgctagcaatgccaaagtctttttgcaacgcgcaaaagaggtgatgccctatcctattgaaattatttctggtcacgaagaagcacgcctgatctttatgggcgttgagcatacgcaatctgaaaaagggcgtaagctagtgattgatattggtggaggctctaccgaattagtgatcggagaaaattttgaacccatcttgatcgaaagccagcgtatggggtgtgtcagctttagccgtcaatttttcccgaaccaaaaaattagcgaatccgcttttcgtaaagcacgcgaaaaagcagcacgtaaaatggaaaaaattgcttggcaatataaaatgaccggctgggatgtcgcattaggcgcatcgggtactatcaaagctgcacatgaaattttggttgaatttggtgaaaaagatggtgtgatcacccctgaacgcctattaatgttgaccaaacaggtactacggtttaaaaaatttaaggatatcaccctaccggggttatccgatgagcgtaaacacagttttgtacctggtttagccattttatgcggtattttcgacactttaggcttaaaggcactccatttatctgatggtgcattacgtgaaggtgtattgtatgaaatggaaggccgttttcgtcatcaagatattcgccagcgtaccgccaaaagtcttgctgaacactataatatcgatcgtgaacaagctaagcgcgtcctcaccacaatgcaatcactgtatgctcagtgggcggaacaaaatcctaaactggttcgtcctgatctagaagcgattttagtatgggcggtgatgttgcatgaagtgggattaagtatcaatttaagtggtttgcatcgtcattctgcttatattctttcgaatacagatctacccggttttaatcaagaacaacaacaattattaactacattagttcgttatcatcgcaaagtaattaagtttgatgagttacctaaatttaatctatataaaaagaaacagtattatccattagtacaaatacttaggttagcaacactacttaataatcagcgtcaatcaaccactaaaccggtttctttacgtttagtgaccgatgataatcactggacactctattttcctaaaaattatcttgccgataacacattgatggaattggatttagaaaaagaacaggagcattggcaggccgttccgggctggaaactggatataaaagaggaatctgcttaa

SEQ ID NO: 3826 - DNA, 870 bp, Proteus mirabilis
acatgccgattatttgtggataacccctgcagcccatccttgattattgatgatacgcatatgttgatctcttcttccgttaaccaaatggcgcaattacagccttgtcgatattcaggctttattttatcaatagtatttcattttactttagttattagttatttctatatcacgcaacaacgcccggtgataatccatcaacctgcaccggctgttatgcttagcttaagtgaaaacgtccaagcggtgaataaagaaaaacagattgtcggtgttgatcagcaaatggctgtcgccagccaaaaaaaacagcagcaagagattgcggagaaacaacccaatcttattattaatgaaaatgcagatattttgcttgaaaagccgaaaaaagtgctacaaaaccagacctcagttaaggttgccccttcaattgcaccaaccaaaccttcacctattgtcagtgaaaatgtatcgagtttatccgcgccctcaacaagccattctgttgcgaaacaacaggctaacgatgtttctgcaaattatgatagtgatgcaaataaagaagcagatgccttggcattatggcaagctaaggccaaaggtcatttaaatcgttataaagcttatcctgaagaagcgaaaagaaaagggcgtacgggagcacctaaagtgcgttttattgttgatggacaaggttatgtcatagcctgcgaattgattaatagcagtggtgtgcgctcactagataaagaggcacaaagtgttattaagcgtgctcagccattaccaaagcccccagaagaactgctttttaatggtcaaataacaattgaaatggcaattgaattttccacattgactttataa

SEQ ID NO: 3827 - DNA, 705 bp, Proteus mirabilis
tcgcatctatcagcggatcatggagcagattattttatgataacccctttaatgttaacgggtcgttctacggatcatttagtgactttatcagagcgacatcatttacagtttaatgcgacaaaagcctttttagcgttacaacaacaagcggccaaagcgggatttaaattaatgcctgccagttcatttagaagttttgaacgtcagttagcgatatggaatggcaaatttgaaggcactcgccctgtattagatgctgaaagtcaacctattgatattcagacattatcagaaggccaacgctgcgaggcgattttaaaatggtctgcattacccggagcaagtcgccatcattggggcacagaaattgatttttacgatcctttccgtttacctaatgggcaatcattgcaattagaaccttgggagtatgaacaagggggctattttgcacaacttaatgactggctgactgaaaatatgtcagcttacgatttttatcgtccttttaccgataaagagagttatattgcctatgagccttggcatatcagttatttacctctctcttatgaagcttcgcaggcctatactatcgatatccttcgcgctgttttagaagaagagccgattttaggtaaacaatggctattagataacttagaaacggtttatcaacgctatattgtgctaccagaataa

SEQ ID NO: 3828 - DNA, 672 bp, Proteus mirabilis
ggattgatatcgttgataaatactctagtaatcagtcaagttgaaatatttagtttaggtatagaaaaattactttgccagattaaaaaaattaatattcgtaagattatgaatgatgaaagtgaagcttttcgttattgcagacaatattctgtcaatcttattattttttattctttacctactgtctctttaatagatgtaataaaaagaattaaacgtttttctcccattataaaaatagtggttatttcgcctaaaatagactcaatactttccgtcacattgctacagttaggcatagaagggtttatcgttatagattcctctgctgcgaatgtgcttcaggctattcgacaagtctgtattggccaacgttatattagcccagaaattgctatggatatcgcattaacgaaagttcaagcagatttaaatccgctacatcatctttctgaaagagagttacagataatgtcgatgattataagagggaaaaaaatagcacaaattgcacaagagctgaatatcagcactaaaacagtaaatagctatcgttatcgaatgtttagtaaacttaaaatctcaggtgatgtagaattaactcatatagcagttcgttatgggttaatcgagatagagagttacttacaaagtggaaaacatatttga

SEQ ID NO: 3829 - DNA, 774 bp, Proteus mirabilis
cgcaggaaatcatctgttatggatcatgtgatttataccgcgatgggcggtgccagacactcaatggaaaaccaagctgtcgtggcgaacaatttagcaaatgcatcaacaccagggtttaaagcgcaacttagtgcgatgcgagccgtacctatcaatggcgaaaccttaccgacgcgtacacttaccgtcgcgtcaacgcccggtagtgatcagcgtcagggaacgatgaattacaccggcagaccgatggacattgctttaagtgataatggctatttggctgttcaacttgaagatggtacgcaagcatatacccgaaacggcaatattgagcgtaacgctgatggcatgttgatggtacaaggccgtcttttgatgggcgataatggcgcaattgaagtgccaccacaagcggaaattagcattgctaataacggcattgtcacggctcatgtccctaccgatccaccaaaaatgctagggcaaattggtcgcctaaaaatggtgaagccagaacaaaatgatttggtacgaggcgatgatggtctatttcacctatcacctcaaggtacagcacgagtgggtgaaacgttacctgcggacgataacgtcaaagtccttgctggtgtattagaaggtagcaacgtcaatcctgctgaagccatggtcgatatgattgccaatgcccgccgtttcgaaatgcaaatgaaggtgatccacagtgcagatgataatgcgcagcgcgctaaccaattgctatcaatgagttaa

SEQ ID NO: 3830 - DNA, 1248 bp, Proteus mirabilis
ttggctttttttactattttcgcgacgcgaaaacacataaataccttcgatttaatgacgatagtgtttaggcaacgttattacaggagtgtaataacaaacctattaattaaaaattttcaaataaaattgaaggaatattgtatggcacaagttattaatactaattatctgtctttagtcactcaaaataatctaaatcgttcacaaagcgcacttggtaatgcaattgaacgtttatcttcaggtatgcgtattaacagcgcgaaagacgatgcggcaggtcaagctattgctaaccgtttcacttcaaatattaacggtttaactcaagcatctcgtaatgcgaatgatggtatttcagtgtctcaaaccactgaaggtgcattgaacgaaatcaacaataacttacaacgtattcgtgaattaactgttcaagcgaaaaacgggactaactctaactcagatatcacttctatccaaaatgaagttaatcaacgtttagatgaaatcaatcgtgtttcagaacaaactcagtttaacggtgtgaaagtactgagtggtgaaaagtcaaaaatgaccattcaagtcggtactaatgacaatgaagtgattgaattcaatttagataaaattgataacgacacattaggtgttgctagtgataacctgtttgatgctaaaacagagaaaaaaggggttaaagcaacaggtgatgctatcgatgcaaacgctctgggcatttcgggcggtacaaaatacgcgactggtgtttcagtaaaagagtataaagtagatggtaaggtttctgctaataaagttgtcttaaaggatggtagcgacgagtacgtagtaagtaaatcagactttacattaaaatcaggtactactactggtgaaattgagttcactggtagtaaaaccattaaatttaaggcagatgcaggtaaagatgttaaagttttaaatgttaaggatgacgctttagcaactttagataacgcaattagtaaggttgatgaaagccgctctaaattaggtgcgattcaaaaccgtttccaatctactatcaataacttaaataacactgttaataacttatctgcttcacgtagccgtatcttagatgctgactatgcgacagaagtgtccaatatgagtaaaaatcaaatcttgcaacaagcaggtactgctgtactggctcaagcaaaccaagtaccacaaactgttctgtctctgttacgttaa

SEQ ID NO: 3831 - DNA, 333 bp, Proteus mirabilis
gtaacacgatccatttcagaaaccgcaagacccacttgtgaaattcctcgactttgttcatccgatgccgaggcaatttcccccataatatcggtaacacgtgtcacagattcgacaatacgagtcatggtttcccctgcactttcaactaataccgatccggtttcagtgcgactaacagagtcttcaatcaacgtttttatttctttagcagcttctgcacttctctgtgcaagattacggacttcgccggcaactaccgcaaatccgcgaccatgctcaccggctctcgcagcttcaacagccgcattcaacgctaaaatattggtttga

SEQ ID NO: 3832 - DNA, 1050 bp, Proteus mirabilis
catgttatgtctgaagcaattcgtttaacacaatacagtcatggtgccggatgtggctgcaaaatttcaccaaaagttttggaaacgattttacatagtgaacaggctaagtttcacgatccccatttattggttggtaatgaaacgaaagatgatgccgctgtttatgatttaggtaatggcactggaattatcagtaccactgatttttttatgccaattgttgataacccctatgactttgggcgtattgcggcgactaatgcgattagtgatattttcgctatggggggtaaacctattatggcaatagcaattttaggttggccaattgataaacttgcgcctgaaattgctcgtgaagttatcgaaggtgggcgagccgcctgtcaagaagcggggatttcccttgctggtgggcattcgattgatgctcctgaacctatttttggtttagcggtaacgggcgttgtaccggtgagtaaaattaagaaaaacagtgcagctaaagcaggatgccaactttttttaactaaacctttaggtattggggtattaactaccgcagagaaaaaaggcttattaaaacctgagcatcagggcctagctactgaaattatgtgccgtatgaataaagcgggtactgatttttctgatattgaaggggtcacggcaatgaccgatgtgacaggttttggtctattaggtcaccttagcgagatttgtgaaggctctggattacaagccactattcacttttcacaagtaccacgattacctgaagtagaagcgtatatagagcaaggatgtgtaccgggcggtactggacgtaattttgaaagttatggccatttgattggtaatatcagcgaaatgcaacgtaaattattatgtgatccgcaaacttcaggtggcttattactggcagtacagccagaagccgttgagcaagtaaaagaagttgctaaacgctttaatattgatttgacctcgatcggtgaattaacagagccgaaagcaggaagagcgttaattgaagtgacaaactaa

SEQ ID NO: 3833 - DNA, 489 bp, Proteus mirabilis
ctgtccatgtctaattacagcaatgaacgtaaaagctatagcttaattctgatcatcctattattggtgatcgccattattgcagcggcattcggtggatatagttggtgggcattgaagcatgctaaatcaggtactacgggcactagtcagcaaaaagttataccggcccccgtttttatgtcattagagccttttaccatcaatctgattgatgaagaagaacatttagatcgcgtactctacatagggatcacgttacgcttacatgatgagaatacacgtaagcgcttacatgattatttacccgaagttcgtagtcgcttgctactacttctttctcgtcaacacgctaataaaattgcaacagatgcggggaaacaacaactcatgacagaaataaaagaaacgctgagaccgactcttgtaccgggtgaatctgaacagatcctctccgatgtactgtttaccacgtttattctgcgataa

SEQ ID NO: 3834 - DNA, 1407 bp, Proteus mirabilis
attgtgtcgtcttgctgcaccggaggcgttgtaatgaccgcaagattggggcgttggttagaaaaactcgctgatgcagaatctcgtttaaataaaattccgcgcatacgccaatatggtcgcttaacccgtgctacaggcttagtcatggaagctaaggggctagttatgccccttggctctacctgcttaatagaacgtaccattggtaaaacggttgaagaagttgaaagtgaagtcgtcggatttaacggtagccaaatgttactcatgccactacaagaagtggaaggattaaccccaggtgctcgagtctacgctcaatcgatccccggtcgtgaaggcgaaggccgacaattaccccttggtgatgccttattaggccgcgtacttgatggctcaggagatccgctagatggtttaccgccgccagataccagttatcgtgcaccactgattacaccacctatcaacccattacaacgtacccccattacagatgtacttgatgtgggtgtacgtgccatcaatgcactgcttacggtcggtcgtggccaacgtatgggactctttgccggctcgggtgtcgggaaaagtgttctattaggtatgatggcgcgttttactcaagccgacgtcattgtcgtagggcttattggtgaacgtggtcgtgaagttaaagactttattgagaatatcctaggtaaagaaggattagcacgctcggtggtagtagcagcacctgctgatgtttcaccactcttacgaatgcaaggtgcttcttatgcaacccgtattgccgaagattttcgtgatcgcggtaaacatgttttattaattatggattcgttaactcgctatagcatggcgcagcgtgaaattgccttagccgttggtgaaccgccggcgacaaaaggttatcccccttctgtatttgcaaaattacccgcacttgttgagcgtgccggtaatggcgttgatggtggtggctccattactgctttctataccgtgttaacagaaggtgacgatcagcaagatccaatcgctgattctgcccgtgctattttggatggccatatcgtgctttcgcgttcactggcggaatcgggtcactaccctgctattgatattgaagcgtccattagccgtgcgatgacctcactgattgataaaacacattatcgccgagtacaagtatttaagcagctattatccagttatcagcgcaatcgcgacttaattaatgtaggggcttatgccacaggcagtgatcctatgctggataaggcgattgccctttatccatcattagcaaaattcttacaacaagatattcaagagcaatgtagctatcaacatgcttgtgaacaacttaatcaactgatcacactagattcattctga

SEQ ID NO: 3835 - DNA, 618 bp, Proteus mirabilis
gatttaactttaacccatgttggagttcagatgtcccaagaacgactctatattgataaagagatcagctggcttgcgtttaacgagcgagtattgcaagaggcggcagataaacgtaacccgctaatcgaaagggtcaggtttttggggatctattcaaataatcttgatgagttttataaagttcgctttgcggatgtaaaacggcgtattttaattaatgaggagcgcggctcacgctctggctccagtcacgctcgtcatttaattaaaaaaatccaatctaaagttgccaaagccgaccaagaattcgacgcactgtataacgacttgcttttagaaatggcgcgtaatcagatttttttaatcaatgaacggcaaatctcacctaaccaacaaatttggttacgccaatattttcgccaaaacttaagaaaacatatcacgccgatccttatcaaccctgaaactaatttggttgagtttttaaaagatgactacacatatttagccgttgaaattgctcaggggcaaactattcactacgctttgttagagatcccctccgataaagtccctcgttttgttattttgcccacagaaacaaggccgaggtaa

SEQ ID NO: 3836 - DNA, 1557 bp, Proteus mirabilis
  unsure (67): Identity of nucleotide at the above locations are unknown.
agatcccctccgataaagtccctcgttttgttattttgcccacagaaacaaggccgaggtaagaaanagtcaatgatcttgctggataatatcttacgctattgtcttgatgagatttttaaaggcttctttgactatgattctttaaatgcttattccatgaaaatgacacgtgatgctgaatatgatttagccactgaaatggaatccagcttattagaaatgatgtcatctaccttaaaacaacgtcttaccgctgagcctgttcgttttgtctaccaacgtgatatgcccgatgaaatggttgctttactgcgtagcaaattaggtttatctaataatgactcggtcattgctggtgggcgttatcacaactttaaagactttattaattttcctaatgagggtagtaagtttctattaaataaacctattcctcgtttacggcatgtttggtttgataatttccgtaatggctttgatgcgatccgtgaacgtgatgtgttactttattatccttatcatacctttgagcatgtattggaattattacgccaagcgtcttttgatcccagtgttatttcgataaaaatcaatatctatcgcgtagcaaaagactctcggattatcgattcgatgatccacgccgcccacaatggtaagcgtgtcactgtggtcgttgaattacaagctcgctttgatgaagccgcgaatatacattgggctaaacgcttaaccgaagctggcgtccacgttatcttttcagcgcccggcttaaaaattcatgcgaaattatttattatttctcgtttggaagaaggcgaaatcattcgctatgcgcatattggtaccgggaattttaatgaaaaaaccgcacgcctttataccgattattctctgttaaccgcgaatacagaaattaataatgaagtacgtcgagtgttcaattttattgaaaacccttatcgtccggtgacttttgaacatttaatggtatcaccgcaaaactcacgtattttgttaaaccagttgatcacaaatgaaattcacaatgctcaagcagggcaccctgcgggtattaccttaaaagttaacaatttagtcgatgaagagttagttaatcgtctttatgatgcctcacaagcaggtgttaaaatccgcctattagtacgcggtatgtgctctttagtccctaatcagcccgattttagtgaaaatattcaggtcaccagtattgttgaccgctttttagagcatgatcgtgtttatgtctttaccaataaaggggatgagaaaattttcctatcatccgcagactggatgactcgtaaccttgattatcgtattgaagttgccgtaccactactcgaccctcagctaaaacagcgtattttggatattcttgagatccagtttaatgatactgtaaaagcacgatatttagataaagatctaacaaatagctatgttcctcgaggaaataaacgtaagatccgcgcccaacttgctgtatatgaataccttaaatcattagaacaaccaggatcacgagcgtaa

SEQ ID NO: 3837 - DNA, 2313 bp, Proteus mirabilis
tttggtgatcctatgagtaacggcattacattgcgtgtgaaaggaaaggttcaaggtgttggctttcgcccctttgtttggcaattagcacatcattttggtttattagggcaggtgagtaatgatagcttaggagtattgatacacttaacattatcaccgcaaaatcaacactttattaatgcattaacggctcaatgtcctcctcttgcacgcattgaacgtattgaacaaacaccttatcaatgggagcaactccccacgaactttactattgtaaaaagtggtggtggagaaatggatacacaagttgtacctgatgcagcgacttgtcaggcttgtattgatgagttgtttgatccacaaaatcgtcgttatcactatccttttataaactgtactcattgcgggccccgttttactattataaaaaaaatgccttacgacagaccttttacctcaatgtctgcgtttccattttgtccgacttgccaacatgaatatcaagatcccgcagataggcgttttcatgcacaacctaatgcctgtcctgtctgtgggcctcatatttggttggcagatcatcaagggcaacaacttgcaataaaagagcgggcattaacacaagcttgtcaggcgctattagcggggaaaattgttgctgtaaaaggcattggtggctttcatttagtctgtgatgcacgcaatagtgaaagtgttgcgcgtttaagagcgcgtaaacatcgtcctgccaaaccacttgcggtgatgttaaccgggactgagcaactccaaaaaccgggcgataatgccgagttttactcaaaagtgatagaaacattaaccagtaccgcggcacctatcgtgcttattcctaaagaaatcgcccccacttcattaagtgaactgattgctcctggattaacagaagtgggtgttatgttaccagcaaatcctttgcaacatcttctcgcacatgaaacacaaattccattagttatgacctctggtaatgcgacgggacacactcctgcattaaccaatgaagaggcgttaactcagcttggtgatattgcagaattatttctaatgcataatagggagattatacaaagagcggacgattcattagtgcgtattgaagatgatcagtgtgtgatgatccgccgttcacggggttatgtaccagatgctatcgcattgccaaccacttttgatgcacaacctgcaattttggctttaggaggggatctgaaaaatgtgttttgtctcttaaaagagcaccaagctattatggggccgcatttaggtgatttagatgatttaagtgtgaggcaacaattactgaaatcactcacgctgtttcaacagatctatcgttttacgcccaaagcgattgccattgatgctcatcctaattatatcagccatcaaataggtaaacagctagctgaacagcaacagatccctgttatagaagttccccatcaccatgcacatattgtctcttgtttagcagagcatggacatacacagcaacaaggcgcagtaattggtatagcccttgatggtctagggtatggacaagatggctctttatggggaggcgagtgtttgctggtggattataaaaaatctcaacgtattggcgggctacctgcggttgctatgccgggaggaaatttagcttcaatacagccttggcgaaattggttcgcacatttagctacttttacaaaagattggcaaggtagtgttatcacccaagcaattccgctcactgagttacagattttgagtaaggcagtggctcgtggtttaaattcaccgctagcatcatcttgtggacgattatttgacgcagttgcttgctctttgggattatcacctaaacaaataagctgggaaggcgaagcggcatgctacttacaaagcgctgcgttacagtgtcacgtagatcggtatgctgatatcatcaagcaatatggacatttaatgtctgtaaaagataagcatgttgatttgtccattttctggtcacaatgggaaagcatcacattgaataccagtgagaaggcttggttatttcactatttattagccgaaagtttgggtgatattgctctgcaagctgcgcaagaacatcagattgatactattgttttaacaggaggggtattcaataatatcttacttaaggatctgtttaagcaaaaattaaacaataaaaaggtattaacccctatgatattgccatctggtgatggtggaattgcattaggacaagcacttattgccagtcattttatgtaa

SEQ ID NO: 3838 - DNA, 243 bp, Proteus mirabilis
aataatatgttgcctttcataaataatatgatatcttctgcatcaagtcattggggagtagcctgtcttaaaataaatctcattattttaagaagtctgtatcaacatactcgcttatttttatttagcgtggtacagacgccattatttggttggcaagaccatagacacataattgtacttctttggttgggggtcaattgtgtgtatatggaaacaccccaaccgaggctattgttatga

SEQ ID NO: 3839 - DNA, 240 bp, Proteus mirabilis
atttgcccccccatttcttggatatttcgttttacaacatccatacccacaccacgtccagaaacatcggtgacaacctcagcggtagagaaacctggcgcaaatatcaacatcgcaacttcttcattgctcatattttcagaaacagctaagcccgatgatatcgcctttttcaaaatacgctcacgatttaatccagcaccatcatctgtcacttcaatacaaatattgccaccttga

SEQ ID NO: 3840 - DNA, 234 bp, Proteus mirabilis
aaaacacccccggagataaactgcaaaacaccaaacaacagaagaatggataacaacccagtcactattttcattcggctaaacatgagtttccctttttataatagatggtatgaccaagttatcggcagacttaagagaaactttataggttttatcctatatagatactattttctatctacaataaataaattaaatatcaataagttatattttaaattctcattttaa

SEQ ID NO: 3841 - DNA, 201 bp, Proteus mirabilis
ccaccctacccgtttaaccaaaggagaaataccatggctttatgtgacagtccatataaggacagagttttaacagaagaacaaaagcaagattgctcatactgtgattattgtgatgttgaaatactagatgatgatgtcgtgttcgttggtggtgatactgtttattgttgcgagcaatgctttgtcgatagccaataa

SEQ ID NO: 3842 - DNA, 474 bp, Proteus mirabilis
gtaatgaacccattaaaagccggtgataaggcacctcaattcagtctgcctgatcaagatggagaaattattaatctgtctgattttgctggccaacgtgtgctcgtttatttttatccaaaagcgatgacaccaggctgtacaacgcaagcttgtggcttacgtgatgagatggatacactaaaaaaagccaacgtcgaggtattgggaattagtactgataagtcagaaaaactttcccgttttgccgaaaaagagatgttaaacttcaccttactttctgatgaagatcataaagttgcagagcaatttggcatttggggtgaaaaacaatttatggggaaaacttacgatggcattcatcgtacgacgttcctaattgacaaaaacggtgtgattgaacatgtgtttgataattttaaaaccagcaatcaccaccaagtggttatcgattatttagctgcacacccatag

SEQ ID NO: 3843 - DNA, 204 bp, Proteus mirabilis
attccctcgttttcagttattgttttatattctacttttgttgatattatccccactattcttataaaacacattaacaagctctattgctgtggggataacctctatttatactcacaaagtattatattttatatccataaagtattaagcaggatgctcagaagcaattttccaattaattgcactgacacttttttctaa

SEQ ID NO: 3844 - DNA, 585 bp, Proteus mirabilis
agatttccgttggtaaaagaaaatatgaaaagtatttcactgagtcttatattgcttttactctctacttttagctgggctaatgaagatgaagacagcaaaaaggttgatgagtataaaacagccctacaggcattttttaacagtgattatttattgtgtttaggcgaagggaaatggcccgtttacagtaatgaaaatgatgctccatgggttttagagcgaatgaatgcattaatggatgctggtttaattgaacaaactgtcgatggtgacgagtgggtgttctctctaagcgagaaaggacgaaaagcttggcaaccatatcaagatttttgttatggacacctttttattagccaaataaaagagatacaacctatcgattcagataaaagtactatctatttttattatggtgtcaaagatattcctgcttgggctagaaatagtgatgtacagtcagcatttagtgaactggatatagtgattaacggtatcaatcgagagctttatcagttaaaaattgaaaagttacccgataatcacttcaaagtattaagttatcctgtccctattgagtga

SEQ ID NO: 3845 - DNA, 1095 bp, Proteus mirabilis
agtgatccgttcactcaatgcgctaggtgcgaccccaacagatctcatgtcgatattacaagcgatggaaagtgcgggttgtttacgggcgagattggagattatctgatgaaagagttatctctgctttcttcaatgccgaatatttcaacgccggcatatgatagtaacgcattgaataaacttaaatatcaggttggacaaaatgccgatcagcaagggctgcgccaagtggcgcagcaacttgagggggtttttgtgcaaatgatgttaaaaagtatgcgtgaagctattccacaagagagtatgttcaattcagaaagcactaaaatgtacacctctctttatgatcagcaaattgctcaagatttatccaaaaaaggcttggggtttgctgacatgattgaaaaacaactatcagctaaagtaacgatggaaccgagcgaactggccggtaaaacgccgatgccattagacagcagtgatatttttcaatcaatgccaacacaagcattaggccagctctatcgtgcgatgcaaccgttacaaaatgcagttgaaagtacggtaggcaagttaaaaggactgtctgaaagtagcgcttcttttgccgctaaattgttagggcctgctaaacaagcgacacaaggtacaggtattcatcatcttttagttgtagcacaagcggcactagaatctggctggggtaaacgagaaattttaacgggtgatggaaaaccgagctacaacctgtttggtattaaagcggggcgttattggaaagggcctgtcaccaatattatgacaacggaagtgattgacggtaaatcgatcaagatgcgtgataatttccgtgtctacggctcttatgtggaggctatccaagattatctaagattgcttacggaaagcccgcgctatgccaaagtaccgcaagccaaaacaccagaacaggctgcttatcatattcaagaagccggttatgcaaccgatccggggtatgccaaaaaacttgtttctattatagggcaattaaagggacagggtgagcaagttgcgaaaacttatacgcatgatttaagtgaactcttttaa

SEQ ID NO: 3846 - DNA, 189 bp, Proteus mirabilis
aggtatatgccatttgtacatatctcgatgaggtatgtacgtgaaaacctcacatttactcgacaaaaccctgtggcatttatagatagcgaaggtgaagtaattagtgcatccaagaaagagtttgaacagttaactgacggtaatcacataggtttcgatattccgttaattcaacaattcaaataa

SEQ ID NO: 3847 - DNA, 3390 bp, Proteus mirabilis
aaactgatgcctatttacgaacaacaacctgatgatattttatctgcggatattaatgctgttcagcaacctgaacctacttatggtgacaatgtttcacagtcttggtatgaccctattaatccgcttgatgatagacggcaaactaaagaattacgtgatgcagcgttccgtatagataactcagtgggtagcttgattgctactgcaccttttaatcaatttgaagatgtagaaggctataacccatttgaagatgaattaacgctttcaggctatgaagactatgccgatgcctttattcattcaaactctcctcaagaaaccgctgcaataaaacaacgtattgatcgtgagcgtaacgataagcaaatgttagcagatgctggcggtgctggtgttgtgagtagtattgctatgggggttattgatccaattaatgttgctgcaatgatgataccagggggagccattgtaaaaggtggcagtgtgaccacaaccgcaggtaagtttgcattggcaaataccgctggtggtgtagcttctgaaatggcattacatagtacccaagaaacacgaacattaactgagagtgcgattaacgttacgctggatgccatgataggcggaaccttaggttcagccgcacagttagtaaaaaaccgtggtgaattggtaacaaaagtaagaaatgatttaattggagaacaacaatcagggcaacaaaatattccaaataatattcctgataattctagtgttggtgcaatggaagtacctaacaccacattagaacaagaaaccttaaaagggccatcatttattaatcgtacgatgaatgttagccctgttggccgtgttgctcaatccccctctaaaacagcgcgacaaattaaccaacaactcacagaaaataactttacctttgctaaaaatgaagaaggcattgcgacatttaccgctgttgaaacaaaagttagaggttatgaaactctcgtttataagcaagtagaatcaacgaaagaccactttaaacagtatcgtcaatctggtggccgtgatatgagttattaccaatttagtgaagcggttggtgatgctatgcgcaatggtgatactcatgcgataccacaaattgcagaggcggcacgttctattagacctattgtcgaagcaaccaaagatagaatggttgaattagggatcttacgtgaaggtgtaaaggtgacaacagcacaaagctacttccctcgtatttataaattcgacaaaattttaaatgatcgtactgaatttaagaaaatcattgctgactggttagaagagattaatcaaacctcgataaataaagccaaaggtagccttgatcgtgctgaaatcggtattgataaagcacgcaatgcatcaccacaagctgaacgtttagggcttgagattaaagaggctgatagttggtcgggtaaaaagtctttgctgatggatgatattaataaatatcaaaaaatcattaatgaaaagagtgcggtagaagttgagctaaattcactttctaaccttgctaagttaaataaaacacaaacaagaagacaagcaacattacaaagaaaattacagcgtattaatgatgctgagaataaattacctgcattacaacgtagtgttgatattcttgataaccctcgcaagtttagaaatgaacatcgtcgtttaacacgaactgcgaattcattaactcgtcatgacagaattagacaatccgcattaaatcgcatgacacctttagagcgtgaagagttagatgccgcagcagatgatatcgttaataaaattatcggggcaccgtcaggcattgtacccagtgaactgatccccgatggattagttaaacgtgctggttttacaaaagatagaaccctaaacattcctgatgaacgcattaaagactatctcgaatcagatgttaactatgtaatggaaaactatattcgccaagtcgcgcctgaaattgaactcacggctaaatttggtcgtgttgatatggataatcaaatcaaagcgattacagaggaatacaaccagcttattgctgatgcaaccacacctaaagaacgtagtcgattagaagcacgaagagaggcggatttacgtgatattcgtgctatgcgtgaccgtctattaggaacttatggcgcacctaaagatccctctagtttctttgttcgtgctggtcgtgtggctcgtcacgttaacttcttacgtttattaggtggtatgacaatatcatcattacctgatatggctcgtccgattatgcaacacggtttacgtagtgcgttaaaaccattgggtaagatgctaactgatatcggcgctatgcgcattgctaaagctgatttacgcgaaatgggtattggtcttgaatatgtattatcaagtcgttctaaggtgattgctgatcttagcgatccatatagcagacgcagctatttagagcgtggcttacaatggtcatcacagaaatttggcaatcttacattgatgaaccaatacaccgatactatgaaaatgtggtctggtgttattactcaatctaaggtgctgagagcggcaaatactttagatgctggtggttcgttaagtaaacgagaaataaagaaactggctcatattggtattgatgaatcaatgctaaagcgtatagcagatcagtttaagcgacacggtgaagacttagacggcatgttaacagggcacagccatttgtgggatgatcgtgttgtgcgtgaaactttccaagcggcagtattaaaagatgtaagaactacagttataacaccaggtattggtgatacaccattaatgatgagtagcgaactaggtaagattgtaatgcagtttaaaaccttcttctttgctactcacaatagagcgttagtatcaggcatacaatcaggtgatgcatcattttactatggggcattacttcaggtagcacttggatccctagtctatattctcaaggctaaaatggcagggcgtgatattaatactgaaccggctaacttagtaaaggagggtttagactggtcaggaatgatgggctggttgggtgagcctaacaacgtattggaaaaccttagcggtggtacttatggtatgagtgccatgtttggtgggccaccagcatcacgttatcaaagtcgtaatggaattggtgcattattaggccctacgtttgatctcggtggtgatattaaaaatatcacatcaggtgtattaaacggtgagtttgatgatagagaagtacgatctgtacgcaaactattacctttccaaaacttgttttatttgtcaccattattgaatcaggttgaagaacagatgaagtaa

SEQ ID NO: 3848 - DNA, 615 bp, Proteus mirabilis
ggtttgaagtttatctttttgattgccataataaccaaagaggtgatgattatgactatcaaaagaccaagaaagaaacctgcacgacagccaatgcctatcaacgacaagatggaacgtttctgtcaggaatatatcaaatcccccgataatcaaactgatgctgcaatctctgctggatatgcatctggcagtgcttgcaagcgcgcatcacagctaatggctgatccccgtattcaagagcgtatcgcacaacttatgcaacagcgtaataagcgcaccaagatgagtgcagacaatgtacttaagcgtttggttgatatgcttgatgcagatattgccgatattctcaatgacaatggcgatatcaaacctatcaaagattggcctactgtgtggcggaaaagtattgcttcatttgaaattgcggttgttgatgagaatgtgaccgtcaaaaaagtgaagctactggataagctacgcgtattggagctggtaggcaaacacgtcgatgtgaacgctttccgtgaccgcgtacaggtcgatgtaaacgtatcattggctgataagttggcatctgctcgtaaacgtgctcagcaagggagcgttgagtaa

SEQ ID NO: 3849 - DNA, 189 bp, Proteus mirabilis
aggctaattacgccattaaatgaaacgcaaaaggccaataatgagacacctgagagtaggtttatttatttgcgtaaggggagtctgttttgttacgccacgcttttagtattcatcccgaactacaaggcaaggattgtctatgaatgccgaaaaaaccgacgttgtgaaccagaaaaaaggttttaa

SEQ ID NO: 3850 - DNA, 567 bp, Proteus mirabilis
caggagaatacaaaaatggatgcattaacactgcttttaaatcgacgttcagcgtctcgactgactactccagccccaaataaccaacagcttgaagctattttacaagcaggtatgagagcccccgatcatggcgcccttaaaccttggcactttgtcgtgatgaaagaggatggtattgagcgttttagtcaattattacataaagcggcggtggtgagtcaactaggtgctgaggtagaagaaaaagcaaaaaacgcaccttttcgtgcacctttaattattaccgtgattgccaaagttaaagcgcatcctaaagttcctgaatgggagcaaattgttgcggcaggctgttgtgttcaggcgatgcaaatggctgcagtggcacaaggttatagtggtatttggcgttcaggctcttggactcatgatccagtggtaagagcgggattaggttgtggtgaacacgaccatattgttggtttcttatatcttggtactcccgcattgaaagcacctacaacggtttctcctgctgatttaactgattttgtgacttatttttaa

SEQ ID NO: 3851 - DNA, 711 bp, Proteus mirabilis
acaatgaccacgaccacatctacatattcaattttaatcgttgaagatgagccgaaattggcacaattacttattgattatcttcaagcatctgattatcaaacgcagtggctggcagatggtactgaggttatacaacatatcaagcaatctcattacgatttagtcctgcttgatctgatgctaccgggtaaagatggcattaccctatgcaaagagttacgtcagttctccgatattcctattattatggtcaccgcaaaaacagaagaagtagaccgactattagggttggaaattggtgctgatgattatatttgcaaaccttatagccctcgagaagtggttgcccgtgtaaaaacattattgcgtcgctattatcggccacaggatattgtgcaaaatagcgccttagttattattgatgagcaggcttaccaaattcaatatcataataaaattcttgatttaactaccgctgaatttcgtcttattaaagcattagctacacaaccgggcaaagtgttaagccgtgaccagttaatggatcatctgtatgatgattatcgcatcgtaaccgaccgtactattgatagccatataaaaaacttacggcgcaaacttgagcaacttaacgatcaaattgaatttattcgttcaatttatggacaaggctatcgttgggaaaccgcagcctatcgttttcgatga

SEQ ID NO: 3852 - DNA, 702 bp, Proteus mirabilis
cactatgacacaaatttttttaacattaccagaaccaccgcaatgccgtattcggagttatatatgtcatctacctattttcactctagcctattagcagctacactgttttcagttacgttaacagcacctgcttttgcttctgaaaatacgcaaaacacacctcagactattacgacaaaaaaacctcagccagcagagaacactttctcagaaaaaaatgaggaaagctattggggaaaatttaaacgtaatcttacccaaacttgggataatgaccaatataactactatttaccggtatggacttggcataaccgttttacttacgataaagaaaaaaccaatcgttataacgaaacgccttggggatttggtatgggtaaatatcgttatgataatgagggtgattggcatggcttatatgctatggcctttatggattccaataatcgtgtacaacctattatgggctatggttttgaaaaaatgtggtatcccggtggagatagagagggttttcgcatgggggcgggctttaccttaagtgtgactgctcgtcatgagtataactatattcctatgccattacctctaccgctagtgtcagtcggttatggacacttatcattacaggcgacttatgtaccaggaacctataataacggtaatgttttatttgcttggttacgttggcagtga

SEQ ID NO: 3853 - DNA, 189 bp, Proteus mirabilis
gataatagcacttcaatactgtttctcgcaggggcacaaaccgtcactgagccaggccactgctctatcaacattcctgctaacgctgattttcctctgcctcgtggtgccgtgatactccatacgccagattttacctgtaaaagatgcgctaataactgttgctgttgtatggttggcatcccttga

SEQ ID NO: 3854 - DNA, 222 bp, Proteus mirabilis
ctttatgtaactaataacaatatttattacgctaaaactacttttcctataccaaccaccagcgttgtagttagaagaaaaaacggacctaaattaaggtccgtattttatatggtgcccagggcgggacttgaacccgcacagcctaaaggccgagggattttaaatcccttgtgtctaccgatttcaccacctgggctaaattctgtggtgcgtccgtaa

SEQ ID NO: 3855 - DNA, 657 bp, Proteus mirabilis
tcaaaggtaactcctgtgaaaaattcagcgttattattagttgatctacaaaatgatttctgtaccggtggcgcattggctgttaaggaaagtgataccgtcatagatacggcaaatcggcttattgattattttcaacgccatcagcgtcctattattgcgagtaaagattggcatcccgcagatcatctcagctttgcaaaaaattcaggtactgttgttggcgaaattggccaattaaatggccgcccacaagtttggtggccagtgcattgtgtacaaaatagccatggcgctaactttcatcccttattaacagatgatttaattagtcatattatttataaaggccaaaatcgacttatcgatagttatagtgctttttttgataatgaccatgaatatcaaacaggattacatactcttttacaaagcatgcagatcgagcatctcaccattttagggatagcaactgattattgcgttaaatttaccgtgttagatgcattacaattgggttatcaagtatcagtggttatggatggttgtcgaggtgtcaatattcaaccagatgatagccaactcgcatttaatcaaatgcaacaacatggggcagttttagttgattcagtaacagtgcttaaaagtgacaaataa

SEQ ID NO: 3856 - DNA, 243 bp, Proteus mirabilis
gtgacacaaacgatgcgcagaatgttgcagcaaaaaatcatccaagtatgtgatacaaaaatagcgcaaaagggagaaggggtaggcctctctttttatgctttttttgctaataaaaatgatgatcctgaattattaatggaagcggcaacttggtggataatgacgcataaattagatcattttgaaaaagccacaaaaattaagaagatgatacaaactgaaatggacgctaatcgctaa

SEQ ID NO: 3857 - DNA, 237 bp, Proteus mirabilis
gttgtgaaaacaaacagagtcgcaagacgtattttaggtttaccttataatttaagtcgctctaaaaagaaagtgcgtttttccattattacgcctacagaaagtgataatcttcccgcagagttaaaaaatgcaactcggatctgtttaaaacaagatttcagaaaaaatgcgcaaaataagcgtatttatatgaaattaaccgatgcttatccagattatcttctagtaagttaa

SEQ ID NO: 3858 - DNA, 297 bp, Proteus mirabilis
tataccgaaacaaggagggcaacaatgaaatgcgaaacattgctcactattgttaatgccatcatctgtaccgtcatatttctacgtgtgttctattttaaacgtgacggcagacaacactgtaaaaaaggtggatggttagctttcctcattcttgcttactcttcaagcgtacctattcgcgcttacttcgatcctaattatcacgctgatatatacaacatctttgccaatatcctgatctgcacaacgttgctggtcagtaaaggcaatgtaatcaagtttataaaggggtga

SEQ ID NO: 3859 - DNA, 261 bp, Proteus mirabilis
tttgcagaaacatcgttagcctgttgtttcgcaacagaatggcttgttgagggcgcggataaactcgatacattttcactgacaataggtgaaggtttggttggtgcaattgaaggggcaaccttaactgaggtctggttttgtagcacttttttcggcttttcaagcaaaatatctgcattttcattaataataagattgggttgtttctccgcaatctcttgctgctgttttttttggctggcgacagccatttgctga

SEQ ID NO: 3860 - DNA, 657 bp, Proteus mirabilis
cccgcggtgacttttattgtgtcacccttttctctttttattcaatgcattttcaccgaggtgcttatgtccggtggtaagaaagttccacctataaaattacgtcctctcgaaagagaagaccttccttttgtccataaacttgataataatgctagcgttatgcgctactggtttgaagagccttatgaagcttttattgagttaagcgacctatatgaaaaacatattcacgaccaaagcgaacgacgttttattgctgaaagtgaaggcacaaaagtcggtttagttgagctggttgaaattgattatgttcatcgtcgtgctgagtttcaaatcattatcgcccctgctcatcaaggccatggttatgcagcccgcgcggcaaagttagcgatggactacgctttttctgtacttaatttatacaaactctatttaatcgtcgataaagagaatgctaaagcgattcatatttatgaaaagcttggctttaagaaagaaagtgatttaatagatgagttttttgttaatggctcttaccgttctgcgattagaatgtgtacattccaagccccttattttgaacaaaaagccaaagcagcaagaccggaaaattttgttaaaccgggtgcaacgataaaacaatatgtctga

SEQ ID NO: 3861 - DNA, 1161 bp, Proteus mirabilis
atcggacagactgtggctgaagatagcgatctcgaaaagacagaagaacccactccccataaacgggaaaaagcgaaaaaggatgggcaaattgttcgttccaaagagctttcgtccgtattaatgattttagggggcgtcagtctactgtggatgagtgggcgttttatcactcgtgagctttatgccatgttaacggaaggttttacttttaatcaccacataatcggcaacgagaatttattgatcccccgttttgccagtttaatgaaacaggctgtatttgcgttatcgccagtgtttctaggcttggtcttagtggcaattggtggttcagccgtattgggggggattaattttagtagcaagtctatcaagtttgatccgaaaaaatggaaccctatttctggcttaaaacgtattttttcaatgaatgcgttagctgaattatttaaagcgattttaaaatcactctttgtcggcttagccgcaacggttttcttatggcacaactggaacgatattcttcatttgatcacgcttcctcctttaagtgctttagctaatgcgatgcaactgcttatttttgcggtctatattgcggtttttatgcttatcccgatggtggcattcgatattatttttcaaattcgtagccatttgaaaaagttacgcatgactcgccaagaaatcaaagacgaatttaaacaacaagagggtgatccgcaattaaaggcgcgtattcgccaacaacaacacgagatgtcgcgtcggcgaatgatggcagatgtgccaaaagcagatgtcattgtcactaacccaacgcattacgcggttgctttgcaatataacgacaaaatggtagccccaaaagtacttgctaaaggggcgggcgccattgccttaaaaattaaagagattggtgctgaacatcgaattccgcttctagaagcgccaccgcttgctagggcgttatatcgtcacagtgagataggacaggctattcctgcaacactctatgccgctgttgcagaagttttagcttgggtctatcaactgaaacgatggaaaaccgaaggtggtttaaaacctaaacaacctatgaacttgccagtgcctcccgcactggactttgctggagaagataatcgtcatggctaa

SEQ ID NO: 3862 - DNA, 210 bp, Proteus mirabilis
tcagtcgagacgctgaacgtcgatttaaaagcagtgttaatgcatccatttttgtattctcctgtcagtattattgtagcaaaatcccttaagagcagggatagacagttgttatcaattcgcagtataacaaaatgttatattaccaccaccgagaaatttaagcggatatttttagctaaaataggattgtacctaagccaatattga

SEQ ID NO: 3863 - DNA, 372 bp, Proteus mirabilis
aaagcgtggacagcaaatatggatataatggcagcttacgagcaggttttgaaattaagtgagcaaatgttaacgcttgccaaaaatcagcagtgggatcagctgatagaaatggaaatggattatttaaagagtgtagaaattatcactaagatgataaaacccactgagggtgagctgataatacaacagcagctcaccaatatgttaaagaaaatactcgaaaatgaaaatgagacgcgaaatttattacgagcaagattagataagctcgctgttttaataagacagactgaacaagagcagagggtacaaaatagctatggtcagttttcagagcatagttattatcctgatctcaatctaaaataa

SEQ ID NO: 3864 - DNA, 306 bp, Proteus mirabilis
aaattttctgcatatgccaaagggaatagccggagtaagccgctagctcttcaaggtgtattacgcgacctaaatgctcctcaatccatttacttagcgcgcaaactaatgcgagatgattatcttgtggcattacagttccattctatcgatgaagttaaggtaaaaaacaaaattaactccttaatattatacaaaaagtggcaaacagagaaatccatattagttgattgctgtttctatgtgttggcaaaatgtgtaattaaaataaaaatgcctattttgcgtacaattaagaaaaaatag

SEQ ID NO: 3865 - DNA, 834 bp, Proteus mirabilis
tcctcagtcgctgtttacataacgatattgcacatgggaggtagtatgtatcacgatcttcaaggaaaagttgctgtagtaacaggttcgtcacgaggaattggtgcagcagtagtgacgagattagttcaagaaggaatgaacgttgttatcaactatcactctgatgaaaatgaagctcaagcattagccgatagcctaaatagacatggtaaaggtaaagcgattatttttggcggtgacattagtgatgaaaaaattgctcataactttatttataaggcgattgaccactttggtcagctcgatcttctgatcaataatgcgggaattgagacacaaaccccttcccatgcagtgaatttagaagattggcgtaaaattattgatataaatttaaccagttattttctaacggctcgctccgcattgaaatatttcgttgagaataagatcaaaggcaatattattaatatgtcttctgttcatgaagtgatcccatggccgacttttgctagttacgctgccagtaaaggtggcgtgagaatgttaacgcaatcactggctcttgaatatgcacactatggtattcgtattaacgccattggcccaggtgctattaataccccaataaataaagaaaaaatgcaagatgatgcgttacgcaaagaattagaagagatgatcccaatgaaatatgccgcagagcctgaagcagtggctaatgttgctgcttggttagcatcggagcaatctacttatattactggacaaactattttcattgatggcggtatgacactttatccctcatttcaaggtggaaaaggttaa

SEQ ID NO: 3866 - DNA, 660 bp, Proteus mirabilis
aaagattacgcatattattttttagggagaggggttatgcctagctactcaattatgatagtggatgatcaccctatcatgagatatggattacggctattgttagagcaagacaaggaatttattgtagtaagcgaaagtggcaatgctcaagaagcaatcaccacagcaaaacagttaaatcctgatcttattatgatggatttacaccttcaaggacgctctggtattgatattattcgttctctgcgtcgctgtggtttaacatcttatgtattggttttatcaatttcagattctcgcaatgatgtgtatgctgcattagatgctggtgctaacggttatttattgaaagagtgtgaacttgatatgttgctactcagtttacgtaaagcggtggttgggcgccccgtttacagtgaaaaagtttggcaatatatccaattaagacaaaactattctgatccgctatctgcattaacaaaaagagagcttgatgtccttcaagaagtggcggtgggaatgaaaaataaacagattgccgaaaatctgtttatctcagaagaaaccgtcaaagtacatattcgtaatatcttaaagaaactacaagtgacatcacgtttagcggcgagccttatcttaattaagcatcagcactaa

SEQ ID NO: 3867 - DNA, 333 bp, Proteus mirabilis
atgattaacgcagaggtttatatgtcaattccagctattgaaagtgttctggataaaatgcaaattcaaactttacaagcatccaatattgccaaaccccagccagtacaggcaggatttgcaactcagttggttcaagcagtaggtaaaattaacgaaactcgtgttaatgcaaccaacaaagtacaagcatttacgttaggtacgcccggcgttgaattaaatgatgtgatggtggatatgcaaaaatccagtatttcattacaaatgggcgtacaagtgcgtaataagctggtcgccgcttatcaagagattatgtcaatgcaggtgtga

SEQ ID NO: 3868 - DNA, 186 bp, Proteus mirabilis
gtaaaacgcgccatcatacctaatagaacacttttcccgacacccgagccggcaaagagtcccatacgttggccacgaccgaccgtaagcagtgcattgatggcacgtacacccacatcaagtacatctgtaatgggggtacgttgtaatgggttgataggtggtgtaatcagtggtgcacgataa

SEQ ID NO: 3869 - DNA, 1104 bp, Proteus mirabilis
aggaatctagctatggcacaagtcattaataccaactatctatccctggtaactcaaaacaacctgaacaaatctcagggaactttaggaagtgcaatcgagcgtctgtcttctggtctacgtatcaacagtgcaaaagacgatgcagcgggtcaagcaattgctaaccgtttcacttcaaacgtaaatggtttaactcaagcttcacgtaatgcgaacgatggtatctctatcgctcaaacaactgaaggtgcattaaacgaaatcaacaataacttacaacgtatccgtgagttaactgttcaagcgaaaaacggtactaactctaattcagatatcacttctatccaaaacgaagtgaaagaacgtttagacgaaatcaaccgtatttctgaacaaactcagtttaacggcgtgaaagtactgagcggtgagaaatcagaaatggttatccaagttggtactaacgataatgaaactatcaaatttaacttagataaagttgataacgatacattaggtgttgctagcgataaactgtttgatgctaaaacagagaaaaaaggtgttacagaagcaggtgctgcaatcgatgcgaaagatatcggcgttgctggtgcaacttcatacgattcaggtacagtaaaagaatataaagtagatggtgttgtttctgctgataaagtaattttcaatgatggtactaaagattacctcgtaaataaaagcgatttcgcactggaaggtgctgacaaagctaaatttactggtgctaaaacaactgaatttacagcagatgcaggtaaagacgttaaaactttaaacgttaaagatgacgctttagcaactttagacaaagctatcaacaccattgatgaaagccgttctaaattaggtgcgattcaaaaccgttttgaatctactatcaacaacctgaacaacactgttaacaacttatctgcttcacgtagccgtatcttagatgctgactatgcaacagaagtttctaacatgagccgtggtcaaatcttgcaacaagcgggtacttcagtacttgctcaagcaaaccaagtaccacaaactgttctgtctctgttacgttaa

SEQ ID NO: 3870 - DNA, 762 bp, Proteus mirabilis
tttttaaaagcgcatttggtttacaggaagccgcagcaggggcaattggctatggtattagttcaagcgatgacccaaggtattcaacgcggcctattttctaatgaagcatgtatgggatctgcacctaatgccgccgcttctgcaacaccttacccacctcatccagcatcgcaaggttatattcagatgttaggggtatttatggataccttggtgatttgtagtgcgactgcagtgattattttatcttcaggtgtgttagataattatcaagatggtattaatggtattcagttaacccagctagcattatcgtcaactgtcggtggttgggggagtacttttattgctgttgcgatttttttctttgcctttacatcgattattgcaaattatgcctatgctgaaagtaatatgatttttttaggccgcaatcatatgacagggctattcttactcagatcagctgtactggcgatggtgatgtttggcgctttggctgaaatgccgttagtgtggaaaatggctgatctctcgatgggattgatggctgtcactaacttaattgccattattttactttcaggcgtcgctttgaagttaattaaagattataaccaacagcgacaagctggtgtattacccactttcaatattcgccaataccctgaattacaaaatgatatagagcaaggtatttgggataaagagcctttaccgaatgagccgttagtccgctgtgaaaaggtgaggcaataa

SEQ ID NO: 3871 - DNA, 1056 bp, Proteus mirabilis
cacttaaatttgaaaaaagggtatcatcaaaggctactattcaatataacagaccttgcaaagtatattaaccctatgaaattaaatgatgaattaactaattctatcgcatcagtcacagaagccgctgctattgcggctatgccatgggtaggtaaacaagataaaaatgcggcagatgctgccgcagttgccgccatgcgagagcgccttaatagccttaatatcaatggccaaattgttattggtgaaggtgaaattgatgaagcacctatgctctatattggcgaaccagtaggcaacggccaaggtgaaaaaatagaaattgccgttgatcctatcgatggaactcgcatggtcgctaccggtgaaaataattctttggctattttagctgcaggttttgaaggtagttttttacaagcacccgatatgtacatggaaaaactggttgtcggtaaaaaagcagcaggtgtgatcgaccttaaccattgccttgaatataaccttgatgctattgcacaaacattaaataaatcattaagccagttaacactagcgattttagataaaccgcgccatcacgatattatcattgatttgcgtaatagaggtattaatgtcatcactttgccggatggcgatgtgcttgcttctttatatgccacaatgcctaataatcctattgatgttatgtacgggattggtggtgcgccagaaggtgtaattagtgccgctattgctaaagctttaggtggtgatatgcaagcacgccttattacccgcgatattgctaaaggtaataatgcaacaaatagagaaattgcagcacaagaaatctctcgatgccataacatgggaactgatgttaatattacattgccacttgaaatattggtgcgccatcaggatgttatgtttgcagcaaccgcaattactgccggtgacctattatccggtgtcactgaacaaagcgattatttgcgtacacactcgttagtgattaatggctccacacactcattacgttatatcgaaaattatcatttacgctaa

SEQ ID NO: 3872 - DNA, 1452 bp, Proteus mirabilis
ggattattttacgaacacagaaaggagaccagtatggctggtattagtgcactaggaataggcgccaagatgccacttggcgagacattaatgcaattagaggctgcggaaaataagcgccttgaacctttagacaaacagatgaaaagctacgatgcacaaattactgcatatggaaaaattcgtagccaattagataaattacagaaagcatctgaagaattaaaaaaattcgataaaatcgtcgccaccaaagttgatgatgagtttgatgcttttaaagtaaccactgatggtaaagcaagcattggtaattatacggtctcggtaacagagcttgcccatgctcaaacactgaaatcaaaagccgtcagtgatatcaaagatcctattggtgaaacattaggtgaaggcaaaacacggactttagtgatcacccaaaaaggtgaaaaagagcctttaaaaatagagttaacagatagtcaaacttctattattgaattacgtgatgctatcaataaaaaagaaggcaacgtttctgccactattgtaaaagcccaagatggcgttaaccatttagttctgacttctcgtaaagaaggtacagattctcaaatggaaatcactgttgaaggtgatagtaagcttaacgattttattagctactccactaaaacaaacagtggtgcaatgacagagatcgttaaggcaaataatgcaaagttaacgattaatgggattgaaattgaacgtcaaactaatgaaattaaagatgcgcctgaagggatcacgttaaatcttaagaaaaaaaccaatgataataaagatggcgtagataagcctgaaattattacggttgcgcgtgatattgagccaatgaaaaaggccataaaagcctggaccgatgcttataatgaattaaataaaacctataaagatttcaccaagtacacccaagttgaaaaaggtgaagatgcctctaaagacaatggtgtgttattaggtgataccactagccggatgattatgtctgagctaaaaagctttatcactcgttctcaatcttcatctgagattgatacccttaataaaatgggcattaaatttaaagtagatggcacattagaagttgatgataaaaaactcgataaagcattaaaagaaaaacctgctaacgtcaaagagttttttatgggtgatggtaaagaaacaggatttggtactcaaacctataattacctgaaaaaaacgctgcaatccaacgacggcacccttgatattgccactgatggtgttaaaaaacgtaaaaaatcgttagataaccaaattaaaaataccaaacgtactattgaagcgacgatggaacgttataaaaaacagtttcaattattagataaaatggttaatgccatgactaactcaagtgcatcaattgaacgtttattacgctaa

SEQ ID NO: 3873 - DNA, 726 bp, Proteus mirabilis
ctatcattttacaaatccgtgatgttatattataacaaaatatcatgggtggttttgtttatgtggatagctaattttaaaaatttctcttggcgagcagttccgatattgatgtctttctttttattgatgactacaccaaaagttttagcacatcctcatagctttattgatatgcaaacaacttttaatacacaagatgataagttaattggattaactttttcttgggttatggatccgataacctcaatggatattctgtacgatatatataatgcgcaaccagaaagtgatatttggaaaaaacaggcggcgagattaatgagcaatatattatctcagaactatttttccgagttttatatggatgggaaaaaacaaaagtttcgtcgtataccaagccattacactcttataaaagagaagttacaggtgaagtttagctttgatgtgctatttatcaccccattgccattcgctaaacatcattttgaacttttaacttatgatcccactttttatgtcagcatgacctatcgtgacaatacacagatcatatggcctttagaaatgatcgctgattgtaaacacaaactgattgaaccttttgctgatgaaagtttaaaagaatatgcacaatcattagatatcaatggctctactgatagtgatttaaatttagggctctcttttacacaacgagtacaagtattatgccaataa

SEQ ID NO: 3874 - DNA, 684 bp, Proteus mirabilis
cataaactttataaggtgatacaaactatgtctgttagaacgtttatcggtgttatttcttttttctttatagtaaatagcggtatagccaatcccctacccgaagcgctacagcaatttttccaaacgcgccaccacaaagacgataaagtcaccgtaaccgttttaaccccagaggataaatggccacattgccgacaacaagaaatcctacagcatgcaggctctcgcaattggggacgtctttctatccccattcagtgcgataatcaacgtcgttttatacaagtagatgtgagtgtttatggacaatatttagtcgctaaaaaagagattaatcgtgatgatgtaataacaaaatcttcgattaagatcataaaaggagatttagaaaagctaccttatgacgtgttaagagatgctgtttttattaaaaatgccattgctatgcgccatattgcgaccgaaaaaccaataacatcaactatggttcgtcgcccttgggccattttagcggggcagactgtaacggtttttgcacaaggtgatcactttcaaatccgttatgaaggaaaagcgattaacaatgccgttgccaatgaaagtattcgtatacgggtcaaatcagggcaaattattactggtgaagcgctggaaaatggctctgtacgtatccccttgtaa

SEQ ID NO: 3875 - DNA, 2319 bp, Proteus mirabilis
ccaagcccttaccctattgatacaaaggatatgaagatggaagacaaactacaacaaagtgcattggattttcatgaattccctaatcctggcaaaatcacagtgacaccaactaaaccactaataacacaacgtgacttagcattagcttattcaccgggtgttgcggctccttgccttgaaattgcggctaatcctttagctgcgtatcgctttacagcgaaaggtaatttggttgccgttatctctaatggtacggctgttttaggactcggtaatattggcgccttagcaggtaaacctgtgatggaaggtaaaggcgtattatttaaaaaattctccggcattgatgtatttgatattgaagtgaatgaaaccgatcctgataaattggtggatattatcgcttcattagaaccgacttttggtgggatcaatttagaagatattaaagcaccggaatgcttctatattgaacaaaaactgcgtgagagaatgaatatccctgtctttcatgatgatcagcatggtacggcaattatttctacggccgctattatcaacgggttacgtattgttcgtaaaaatattgataaagttcgcttagtggtttcaggtgccggtgctgcttctatcgcgtgtatgaaccttcttgtcgctttagggttaaagcgtgaaaatattgttgtttgtgactcaaaaggggttatttatcaaggccgtgaagccaatatggcagaaactaaagcggcttatgcgattaaagataacggcagccgcacacttgatgatgtgatcaacgatgccgatattttcttagggtgctcagggccgggggtactgacccaagagatggtgaaaaaaatggcacgcgacccgctgatccttgcgctagcaaatccggagccagaaattttaccaccgttagtcaaagcggtacgatcagatgcgattatttgtaccggacgctctgattttcctaatcaggtcaataatgttctctgtttcccgttcattttccgtggtgcgctggatgtgggggcaaccgctatcaatgaagagatgaaacttgcctgtgtacatgcaattgctgaattggcactggcagaacaaaatgaagaggttgctagcgcatatggcgatcaagaactgtcatttggcccagaatacattattccaaaaccttttgatccacgtttaattgttaaaattgcgcctgccgttgcaaaagctgcaatggattcaggtgtggcaacccgtccaattgaagatttcgccgcttatatcgaacacctcaatgaattcgtttataaaacgaatttatttatgaaacctatctttgctcaagcgaaaaaagagaaaaaacgcattgtattggcggaaggggaagataaccgcgttctgcatgcgactcaagaattagtcactttaggacttgctgagccgatcctaattggtcgtcctagtgtgattgaaatgcgtattcagaaattaggcttacatattcaagcgggtagagattttgaagttgtaaacaatgaaaatgatccgcgttttaaagaatattggcaagaatattatcaaataatgaaacgtcgtggtgtttcgcaagaacaagctcgtcgagccgttattggtaatccaacactgattggcgcaattatggtacgtagaggggaagcagacggcttgatctgtggaaccgtgggaagttattcggaacattttgaaatatataaaaatgtttttggtttacgtgaaggatctaatactgcaggggcgatgaatgcactattactgcctagtggtaacacctttattactgatacctatgtaaatgaagatcctaccgctgagcaacttgctgacatcactataatggcggcagatactattcgtcgctttggtattgagccaaaagcagcattagtatcccgctcaagttttggctcttttgacagtccatcatccataaaattaagaaaagcgttagagcttattaaacaacgcgccccagaattagaaattgatggtgaaatgcatgctgatgctgctttagttgagtcaattcgtcgcgatattatgccagacagcccactaaaaggttcagctaatctgttagtgatgccaacaatggaagcggcgcgcattagctataacttattacgtgtcactagctccgatggggtaacggtaggtccagtgttaatgggagttgctaagcctgcccatattttaacgccaattgcatctgttcgtcgcattgttaatatggtggcattagctgtggttgaagcacaaacacaatctcaacgctaa

SEQ ID NO: 3876 - DNA, 576 bp, Proteus mirabilis
gtgaagtttctcccgatgacacttattgatacctttatcaatcgctttcaacttactttacccgagccggtaaatcagcctattgatgctaaaaaatcggcagcagttttactgccgattatcaataagcctaatccaacgatcctcttaacagagcgcgcatcaacgttgcgctctcatgccggacaagttgcgctccccggagggaaacgcgatccacaagataaaagcctcattgaaacggcattacgtgaagcccatgaagaggtcgatattccgcccagtatggtttctgtgatcggccaattagccccattacgcagttcagaaggttatttagtaacccccattgtcggggtgatcccccccaatttatctttacgtcataatcccacagaagtcgcttctgtctttgaaatgccattaagttatgtactcaatactcagcgctatttaccgttagattttcgtcgtgccggtaaaatgcatcgcatctatttttacccttatgaagggcatttggtgtggggactaaccgcagctattttacataacctcgcgttgcatattacttaa

SEQ ID NO: 3877 - DNA, 1848 bp, Proteus mirabilis
agagttacttacaaagtggaaaacatatttgatgctaaagcatttctaagtcgagtaacgagtcaaccgggtgtgtatcgaatgtatgacgcctcaggcaccgttatttatgttggaaaagcaaaagatctgaaaaaacgattatcaagctactttcgtgctcaggtgaatagtcgtaaaacagaagcattagtaaaatgtattgccaatattgatgttaccgtgacacatacggagacagaagcgctacttttagagcatagctatattcagcgttatcagcctcgctataatgtgttactacgagatgataagtcctatccgtatatttatttaagtgcagacaaacacccaagattggcgagttatcgtggtgctaaacatgctaaaggggaatactttggccctttccctaactctttggcggtgagagaaacattagctttgatgcaaaaattatttcctattcgtcaatgtgaagatagtgtttaccgcaatcgctcacgcccttgtttgcaatatcaaataggccgttgtctcgccccttgtgtaaaaggttatgtctctgatgaagagtatgcacagcaagtcaattatgtgcgtctttttttatccggcgatgacagccaagtgattgaaggcttaattaaacgaatggaagaggcaagccaagcgttacgctttgaagaggctgcgcgtattcgtgaccaaattcacgcggtaagacaagtcactgaaaaacagtttgtggctaatattggcgatgatctcgatgtgattagcgtggcatttaatggtgcgattgcttgtgtgtatgtgctctttttccgtcaaggtaaagtgcttggtagtcgtagttattttcctaaagtaccggcaaatacatcattagacgaagtggtacaaacctttattggacaattttatttacaaggcagtgcgatccgcactttacccacagaaattttgctcgattttaatcttgaagataaaacgattttagcggagtcaatttcttcgatagcaggacgtaagatccatatccaaactaaaccccgtggtgatagagcacgctatttaaaactagcacgaactaatgcagctacggcattagccactaagcaagttgaacaatcaaccatttctcaacgttataactcgttaatgtcacttttagagatgaaagagataaaacgaatggaatgttttgatattagtcacactatgggagagcaaactgtggcttcatgtgtcgtatttgacatgaatggcccattaaaatcggaatacaggcgctataatattagtgggatcactccgggggatgattatgccgcgatgaatcaagtattgactcgtcgttatggcaagtcattagaagagagtaaaatacctgatattatttttatcgatggtggtaaagggcaattagcacaagccattgacgtatttcaatcacttgatgttgattgggataaatcacaccctaaattaattggtgtcgcgaaggggagtgatcgtaaagcggggttagagacactattttttaaaccagaaggcgaaggtgtggcacttccttctgattcacccgcgttacatttgatccaacatattcgtgatgagtcgcatcgtcacgcaataacggggcatcgtcagcgtcgtgctaaggttaaaaacaccagttctctagaatcgattgagggggtgggaccaaaacgacgtcaaatgctattgaagtatatgggtggtttacaagctttacgtgatgcaagcgttgaagaaattgcgaaagttcccacaatttcgaccgcgttagcagaaaaaatttttaatgcgttgaaacactaa

SEQ ID NO: 3878 - DNA, 408 bp, Proteus mirabilis
taccaatattacgtattgtcatataaggaaaatatcatgtctactactaacctgacatacacgatgtacggcataaaaaattgcgatacaatcaaaaaagcacgtaaatggctagatgataatcatattccttatgtttttcatgattaccgtaaagacggtttgaaggaagcattattactcacctttacagaaaatttagattggcagacattggtgaacaaaagaggaacaacttggcgtcaattatctgatgaagaaaaaaatgctatcactgatgtgaatgcagccattgcacttatgcttgataaacctgccattattaaacgtccaattttagtctcttctgataatcgttttatggtaggttttaatgctaatgattacctgacttttacaggagcctaa

SEQ ID NO: 3879 - DNA, 384 bp, Proteus mirabilis
tgctcatcctatttacgatgctgtaactcaataaggtgtgacatgtcacgatataaggttttaaaaaaatcatttatcgctgggcgtctacttgaaatcggtgaagaggttgagtacgacggtatagctggcgataacttagcgttaattggtggcgctgatgctcgacttaatactcatagtgtggctgatggggctggtgataatactggtgaaggcataagtaatattgctgttagcggttcaggtgtggcgattgattcaagcctagatgcgcttcgtgagcaatatacccagctatttggtaaagcgcctcatcacaatatgggcgcagataaaatgcgcaccgcaatagatgaaaagcggaaagaacttggggtttga

SEQ ID NO: 3880 - DNA, 408 bp, Proteus mirabilis
tatcatgactattcattaatcactggtactacactcatgcaagaagatgtctacacaaaagctgggatcggcacaactgcttttcttggttacttcgcagggcttccagcagaagttgttatgggttcactattgggagctatcttctttaccactgctgctactgaatatagctttaaacgtagatcggtattagcctttctaagcttcgtttgtggtcttatattctttagcccagcagcaactatctttatttctgttactggtcttttcggtgtgaaacctgagcaatacgaaatcgaacatatcgatgccgtaggtgcttttgtttccgctttgcttgtggttaagttaagcgtaaaagcatatggaagggctgatataccgaaacaaggagggcaacaatga

SEQ ID NO: 3881 - DNA, 612 bp, Proteus mirabilis
tacctctgctacaaagaaacgggcataacaatgagtgagaaaagtatcgtccgagaggcgaaagatattcgcctagcaatggaattaatcaccttaggtgctcgcttacaaatgcttgaaagcgaaacgcaattaagtcgagggcgtttaattaaattatacaaagaattaagaggaagccctcctcctaaaggtatgctacctttttcaacagattggtttatgacatgggaacaaaatatccattcttcaatgttttataatgcttaccgctttttattaaaaagcggggggagcgtaggtgttgaagctgttgtaaaagcctatcgtttatatttagaacaatgtccacccgttaaagatcaagaacctattttagcactaacacgagcatggacattagttcgttttgttgaaagtggtatgttacaactttctgtatgtaccaaatgtaatggttcatttattacacacgcacatcagcctgcaagtaattatgtttgtagtctttgtcagcctccatctcgggcaataaaaaaacgtaaactttccgccaatcctgccgatattaacttacaactgttggatggtcttgaacagtttgcaatgtga

SEQ ID NO: 3882 - DNA, 372 bp, Proteus mirabilis
atgaatagctataataagtacaccgaccttcaaattaatgaattagttgctacaaggttaaagaagaaatgcttattaacggaagaatctgtattagcttatatggatagcggctatcggactttcgatccatgcaacaaccctactgacgcaatgccgattattattgagaataaaattagcttacttgctggtgatggcaatttctggtgcgctagatatggggagtggaatatacttccttgtccatctggtattgagtttatagaaaaagcgcaagttataaacgatagcccatatcgcgcagctatggaattattcttaatgatgaaggatgcggagaatgaaaaaatacgaccttatctattgtga

SEQ ID NO: 3883 - DNA, 516 bp, Proteus mirabilis
cggtgctctctgttattccgcgtattgatgctggtggtttctgatatgaaaaaacatcatgtacaaattattcctgctactcatgaacatattgttcgtttattaccacatgtaagacaagctgatgttgatgagttctacgctatgtcaatgcaaacacctgagcaggtattacgacatggcttatctgtttctactaaagcttatgccggcattattaatgatgaagtcgtgactatttttggtgttgcttctggctcattacttactggcttaggtgttccttggttggtgggttctaacttattagagcaacatcagaaaacctttctacgacgctgtaaacccatcttaaaacagatgttagggcaatactcaatactgatgaattatgtcgatgaacgtaatcatattgctaaggcgtggctccattggttggggtttcagattgaagaagcaaagccagcaggtttacttcagttacctttccatcgttttacattgagggctaaataa

SEQ ID NO: 3884 - DNA, 1083 bp, Proteus mirabilis
acagatcctctccgatgtactgtttaccacgtttattctgcgataatcattatgagcgataatatcctttcacaggcagagatagatgctctgctgaatgatgacacatcaggtgacgacgcccaaaaaagcgcgaacagggaacctgcgatagcgaaggatccgaatgaaccggatattcagccttatgacccgaacacgcaacgtcgtgtcgttcgagaacggttacagtcgttagaaattattaacgaacgttttgcgcgtcaattccgtatggggctgtttaatatgcttcgccgaagccctgatatcacggttggtggcataaaaattcatccttatcatgactttgcccgtaacctacctgtaccaactaacctaaatttggtgcatttaaaaccgttacgcggcacagcgttatttacctttgagccgaatctggtttatatcgcggttgataacctgtttggtggcgatgggcgttttccaattcccgttgaaggacgcgagttcaccaatacagagcagcgtattatcaacaaaatgttaaaactggcacttgatgcctatcgtgatgcttgggactccatcttcaaaattcaagttgaatatgttcgttctgagatgcaggtaaaatttaccaatatcacctcatcaccaaatgacattgtggtgacgacaccttttcaagtagaaattggctctatggttggggaatttagtatctgtattccttttgccatgattgaaccgctacgtgaacggctaatcaatccaccaattgaaaaccttcgccaagaagatagcgtttggttagacagtttagttaaccaagttaagcattcagagcttgagttggttgctaactttactgacattccgctgcgtttatcaaaagtccttaccctgaaaaaaggggatgtgctccctattgataaaccagaaagattgattgcacatgttgatggtgtgccggtattaacaagtcaatacggtacagtccatgggcaatacgcccttcgtgttgaacatttaattaaccctgttttaaacgctctggatgaggaacaaaccaatgagtga

SEQ ID NO: 3885 - DNA, 3993 bp, Proteus mirabilis
gatgcacgatatgaggagcactgcatgagtagcacaacaatgggtgttagacttgatgaagaaacccgtaatagattaaaagatgctgcacaaaaattagatagaacatctcattggctaattaaacaagccatcttcaattatcttgaacaaattgaaaatgatcagctcaccctaacccctatcacacaggctgagcaagatattgaagaaagcacagcccccctaacggcacattatcaaccgtttttagaatttgcagagcagatccacccacaatcggtgttacgctcggcaattacttctgcttatcgtatacctgaaacacaagcagtgcctatgctactacagcaggcaacactacctgagcatgaggctcaagccacgcataaactggcttactccattgcagaaaaattacgcaaacaaaaacagggtgttggacgctcaggtctggtacaaggcttactgcaagagttttctctctcttcccaagagggggttgccttaatgtgtttagccgaagctttattgcgtattcctgataaagcaacccgtgatgccctgatccgagataaaattagccatggcaattggcgctcgcatttagggcaaagccaatctatgtttgtcaatgccgccacttggggtctactgtttacaggcaaactcgtctctacccataacgaagagaaattatctaattctctaaatcgcattttaactaaaagtggtgaacctttagtgcgtaaaggcgttgatatggcgatgcgtttaatgggggaacaatttgtcaccggtgaaactatctcccaagcgttagccaatgcacgcaaacttgaagaaaaaggctttagatattcctatgatatgctaggagaagcggccttaacggaaaaagatgcgcaagactatttagtctcttatcaacaagccatccatgccattggtaaagcctctaatggacgaggtatttatgaaggaccggggatctccattaaactttcagcattacatccccgttatagtcgagctcaatatgatagagtgatgtcggagctttaccctcgcctactctctttaacgctacaagccaagcaatatgatattggtattaatattgatgcagaagaagcggatagactggaaatatccctcgatttattagaaaaactctgcttcgagcctgaattagcgggttggaatggtataggatttgttattcaagcctatcagaaacgctgccctttagtgattgattatattattgatttagctcgccgcagtcgccgccgtttaatgatccgtttagtaaaaggggcttactgggatagtgagattaaacgcgcgcaaatggatggactggaagattaccctgtttatacccgtaaagtatataccgatgtctcttaccttgcgtgtgcgaaaaaactgcttgcttcaccgaattatatttatccgcaatttgccacgcataatgcccatactttatcagccatttatcatctagcaggtcaaaattactatcctggtcaatatgaattccaatgcttacacggtatgggtgaacccctctatgcacaagttgtgggtaaaattgctgatggtaaacttggtcgcccttgtcgtatctatgcgccagtaggtactcatgaaaccctactggcttaccttgtgcgtcgattattagaaaatggtgcaaatacctcgtttgtaaatcgtatcgctgacaccaccatctccttagatgaattagttgccgatccggttaaagagatcaataaaattgcgcaagctgaaggacaaatcggactttcacatcctaaaatcccgctcccaatgcagctttatggtgatgagcgtaaaaattcaccggggattgatatgtctaatgagcatcgtttagcctcattatccagtgcattactgacctctgcgatggaaaaaattcacagccatcctctcattggtggtgagtatcatagtgcagaagaagtgattgcaccacaatctatactcaatccggcaaatcacaccgatgtcgtcggtacagtacgtgaaacaacggccgccgaagctaattttgctttagatattgcccaagaaaatggtgaaatttggtttgcaaccccacctgcggaaagagcggcgtttttagtccgcacagcagaactgatggaacagcaaatgggtccattaatgggtgtcttagtcagagaagcgggcaaaacctatagtaatgctattgcagaagtgcgtgaggcgattgattttctttattattactcagcacaagtggcaaatgattttgataataatacccatcgtcctttaggccctgttgtctgtattagtccttggaacttcccattagccatctttagtggacaaattgcagcagcgttagcggcaggtaataccgtactggccaaacctgcggagcaaacccctctgattgcttttaaagccgtagaactattttatcaagcaggagtacctcgcagtgcattacaactcttaccgggtcaaggggagaccattggtgcacaattagtggcagatgaacgcgtgcgtggtgtgatgtttacaggctctaccgaagttgcccacattctgcaaaaaaccttagcgggtagactcgatagcgaaggtcgccctgttcctttaattgctgaaacaggtggcttaaacgccatgattgtcgactcttctgccttaacggaacaagtggtcactgacgttatggcctctgcttatgatagtgcgggtcaacgttgttctgctttgcgtattctctgtattcaagaagaggtggctgatagcacgattgaaatgttaaaaggcgcaatggcacaagccataataggtgatccaagtctcttatcaacagatattggccctgtaattgataaagaggcaaaagcgggtattgaaaaacatattcaaactatgcgcacagcgggttttgacgtttatcaagcaacctataatcaacttactaaacaggctgaaaataacagtacttttgttcctcctaccttaattgagttagataaaattagctcacttaaaaaagagatttttggccctgtactgcacgtcgtacgttactcaagccaagatctgcctgctttattagctgaaattaatgcgactggatatggattaacaatgggggttcatacccgtattgatgaaactatcgcttatgtagcgactcatgcaaaagtaggaaatttatatgtaaaccgcaatatggtaggtgctgttgtcggggtacaaccttttggtggtgaaggtttatcgggcacggggccaaaagctggaggccctgcttatctgtatcgtttattatcaaaacgtcctgaaaatgccataacacaaaccttagcacgtcaagatgaaacattaccccttgatgcctctatgcgacaaaagttattacaaacctatcatcactatatgacgtggttagcaaataaaacggaacctgcacattatcaggcgctagaagaatacgccaatgcatcacaagccggaacattgcgcgtattgccggggcctactggcgagcgtaatacctatcaattagtcccttgtggcaaggtgctttgtctctcagataatgagcaagatatatttactcagttagcgggagtctttgcatcaggatgccatgctattgtccataatgctgttttctcgcaaaaaacctatcgtgaattgcctgatatgatcagaaaagcaatcactctcacggacaactggcaagatgagtcactaagcattaatgccgttatttatcatggtgatagtgatcagttaaaagagacttgtcagcaaattgcacaacgtaaaggggctattatttcagtacaaggcttctcacgtggtgagacagcattgttattagagcgtttattgcatgaacgagcattaagcgtcaataccgccgctgccggaggcaatgccagcttaatgacaatcagttaa

SEQ ID NO: 3886 - DNA, 801 bp, Proteus mirabilis
tcagtgagatataacgcattgtctatcgccggcaccgatccgagtggtggggcggggatacaggctgatctgaaaacattttccgcactgggtgtatatggcacaacagtcatgactgcactggtagcgcaaaatacctgtggtgtacactctgtctatgatttatcccctgattttgtcgcagcacaattagatgcggtactttctgatgtcagaatagatagcgctaaaattggtatgctttctaatgccagtattattgatgtcgtttgcgataaactgcaacaatatcccattccttttgtcgtacttgatactgttatgcttgccaaaagtggcgatccactgttacaacctgatgctattgataaaatgttcactcagttattaccccgcgttgatttgatcacgccaaatctgcctgaggcggcagcactattaggttgtgatatcgcgacagatgaaacaactatgaaacaacaaggtgaagcattactttatcaaggttgtcaggcggtattgatgaaagggggccatttaagcgagaaagaaagtcctgattggttattgacccaagatgggcaatggcgatttacttcaccgcgcatcaatacaaaaaatactcacggtacgggatgcacactttcagccgctttagctgctattcgtcctcaagtttctgattggcaaagttgtgttaaacaagcaaaagcctatttacagcaagcgttagaacaggcagacagtttagaggtgggtcaaggtttcggccctgtacatcattttcatcgctggtggtga

SEQ ID NO: 3887 - DNA, 327 bp, Proteus mirabilis
gccgagagatatccaatgaaactaaccaatctaaaaaccagcaccgaaacttatgaaaatgccaaaggtgaaaaagaaactcgtgaagaatatccatacgggctacgtatttcacttgaaaacgacacaatagaaaaattaggcgtttctattcctgatgttggtgaaagtattgagctgtctgctgttgccaaaatactgtctaaatccattaatgaacgtgaaggtaagaagtcagtatatgtagagttacaaataaccgatctggctctaggtgcaggcgacacaaaatcaacggcagatgttctttttgatgggggtgagtaa

SEQ ID NO: 3888 - DNA, 909 bp, Proteus mirabilis
ctaaagggatatcgcgtgttagtactcttaggatatatcgtggtgatttgtgctgtcctcggagggtttaccctcgtaggtggacatctaggcgcattatatcaacccgctgaatttttaattatttttggtgccggtatcggtgcttttgttgtaggtaataatggtcgtgcgatcgtatcaacggtaaaaatcctaccgaaattacttcgtaacactaactacaataaagcgatgtatatggatctaatggcattaatgtttcgtttgctgtctaaagcgcgccaaaacggcatgttggcattagagagagatattgaaaatccacaacaaagtgacattttttcccaatatcctcgcattatgaaagacgtttatatgctcagttttattactgattatatgcgtttgatggtgacggggaatatgaatccttatgaaattgaagcactaatggacgaagaaattgccacttttgaagaagaaagtgaagtacctgcggcggggctctctacgatgggcgattcattacccgcatttggtattgtggccgcggttatgggggtggttaatgcgctaggtgctgccgatagacctgctggggaaatgggggcacttattggtcacgcaatggtaggtactttcttaggtattttattagcttatggctttgtttcaccattagcttctcgtatcagacaacgctctagtcaacaaatgaaaatgatggagtgcatcaagaccaccctgttatctagcatgaatggatatgcaccacagatagcggttgagtttggtcgtaagaccctctttctggcagacagaccttcatttattgaattggaagaacatgtacgtcaggtacggacaccgatgcaggcaaatcctgatgcaatgaaagaagagtaa

SEQ ID NO: 3889 - DNA, 405 bp, Proteus mirabilis
gatattatgtatcaacaatcagccagtaaaatgtatgctcaaatcgatgttgaaagtgagattttaaatgcttcaccttaccagctgatccaaatcctatttaatggggcgctaagcgcccttcgccgtgcattaatattaatggaacaaggaaatatcgccggtaaaggagaaaatatttctaaagctattaacattattggcaacggcttaaaacaggggctggataaagaaaaaggggaggagcttgctgaaaatttagcattactttacgactatatgatcactcaactactcgatgccaatttaaaaaataatccagaaaaaattcatgaagtcatcaagttattaactgaaatttctgatgcttggcaacaaattggcacacagattaattcttattaa

SEQ ID NO: 3890 - DNA, 426 bp, Proteus mirabilis
gggttatcgtatatgaaatttatgcaggatttagttgttgatattttacgtgacaataaaaaatcattgtcagttaacgagataacggcaattgcttctgatctcaagggaaagaagaaccgctcaacaaccaattatgcactgattaaattgattgaaagctccgtcgtagaacgcaaagcggtagttggcattgggtatgtctacaaactaacgcctgattacatggagcgcctacgtgaattagatatcaaaaaagaagcatctctaatgaccaagaagccagcaaaacctacggataagcatgttatctgtcagaaaggctcactaacctacgtcagaaagagcctaccgccgttacagcatggaaaaattgctgatattcataaccgtatgaacgcaatgctggtggcggtacgcgcatga

SEQ ID NO: 3891 - DNA, 672 bp, Proteus mirabilis
tctcgcgatttttttgtctggctgcgtcgtacattaggagaaattatgaagatcgttgaggtaaaacacccactcattcaacataaattggggctgatgcgagatcatgatataagcactaaacgctttcgtgaattggcttcagaagtttccagtctactgacgtatgaagctaccgccgatttagaaacagagacggtaacaattgaaggttggtgtggcccggttgagatagaacagattaaaggaaaaaaaattactgttgtacctatcctccgtgccggtcttgggatgatggatggagtattagaaaatattcctagcgcccggatcagtgtagttggtgtttaccgcgatgaagaaaccttaaagcccgtcccttacttccagaaactagcctctcatattgaagaacgtatggcacttgttgttgacccaatgttagcaactggtggctctatgattgccacaattgatttattaaaaaattcaggctgtacttcaattaaagttttagtgttagtggctgcgcctgaggggatcaaagcattagaagaagctcatcctgatgttgagttatatactgcatcgattgataagcatcttaatgagcatgggtacattgtcccaggccttggtgatgcgggtgataagatatttggtacaaaataa

SEQ ID NO: 3892 - DNA, 369 bp, Proteus mirabilis
atgaataagtacagcaacagaaaatctatagtagataaaaaagttacaaaaagagcaatggaactactgcttaaattatttccagattattacagtcaggatgatctttattcagatgatgaatgctgtgaatggcattactgtaaaactgattattatggtgaattcgatgcttatgatgccttttatgagttgcacaaaagcctaattgtccagacaacagattggaatggcgtgaatgcgaccgaggaaaataatgaggataaaactccatattattcaccatggcgtcttagtggcaaaatcgggcgacgggaagttatttctcattgtcataaattagttaaagctggtgtagtttgggggtga

SEQ ID NO: 3893 - DNA, 768 bp, Proteus mirabilis
ataaataatctttttgaaagaggaaaaaaaatgaaaatcttatttattggtgagtcatggcacattcatatgatccactcaaaaggctacgacagtttcacttctagtaaatatgaggaaggtgccacttttttattaaattgtttaagggaaaaaggggtagcagttgattatatgcctgcacataccgttcaggtcgcatttcctcagactgatgaagaattagcaaaatatgatgtcatcgtgatcagtgatattggtgctaatactttcctcttgcaaaacgatactttctacaacatgaaagtacttccaaatgcattagggctaattaaacagtttgttgctaatggtggtggcttattaatgattggcggctatctatcatttatgggtattgaagcgaaagcaaactataaaaataccttattggcacaagtgttacctgttgaaatgttagagggtgacgatcgtgtggaagccccagaaggagtattcgcaactccagttaatgcagagcatgccacgataaaaggttttagtgaatggccgatgttccttggttataacaaagtgttcgctaaacataacactgaaacggttttgaatattggcgaagatccactactggtgtttggtcaatttgaaaaaggaaaaacagcttgttttatgagtgactgttcaccgcattgggggagcaaagagtttttagcatggccacattatgctgatatgtgggtcaatattctaaagcaaatcgcacgttag

SEQ ID NO: 3894 - DNA, 201 bp, Proteus mirabilis
caattttttcattgtattcatcactactcatatttgattgccatggagaagttaagacaaaaggttcttttttttctattgtgttattatcagcgtgctttgttagccattggagacgtgcgtcaatatcttggtagcttattaatgtggcttttttcagttgatggtcaacaattagtgcccaatcataaataccgatag

SEQ ID NO: 3895 - DNA, 990 bp, Proteus mirabilis
tcaataatccaaaaggaacatcttatgagtacaaaaaatttatcaacacccttgctgatggtagcaactgtgttagcagggatgctatcaccaatgcagtctgcggtgaatgggcaactgggacatgtattaaaagacggtaatgctagtgcagttatctcttttgccagtggtttagtggtcatgttttttatcattatgtccaaaaaacaatatcgtcagcaatttgcttctattccgacattaattaaaacacgtaaaattccattatggaactggtttgctggcctctgtggcgcaatggtggttttttctgaaggagcatcagccagtgcattaggaatagctacattccaaacagcattaatttcagcactgttattatcaggtttattatgtgaccgctttggtataggtgtggatgagaagaaatacttcaccccatatcgtgtattaggtgccgtattagctgttgttgctactctttttgtcgtttctccacagtggcattcaacctcttttatttacttagctattctaccttttttagcgggtttattagcgggatggcaaccagcaggtaattcaaaagtggctgaagcaacaggttcgatgatggtttctattacttggaactttattgttggatttactgttttaacgattgcgttagtagtacgtatggcattagggcatataacactggagcttcctgctacatggtggatgtatttaggtgggcctttagggttaatgtctattgcattaatggctattttagtacgaggcttagggttactgatgttaggtgttgcatcaactgcgggccaattactgggttcggtattaattgacctattattaccttcgttagggaatactgtttatttagtcacaatcatcggtacgttatttgctttagtcggcgccattgttactaccattcctgagtttaaagcgactaaatcagtaaaaagagcaggggcataa

SEQ ID NO: 3896 - DNA, 795 bp, Proteus mirabilis
gcagctcgtcttgcttttttaatattgattctgtcattgatagaatttgtgttagaatcacgacgtttattaaactattcaggtgaggtgcttctgaatacgccatcacagctatcattaccactatctctgcccgatgatgagacattcgatagcttttacgcaggggaaaatgcatcactcgttgcagcgatccaaactgctattcaccaatcacatggcagttatatctatttctggtctcgtgatgggggcggaaaaagccacttgttgcatgcagcttgtgcagagctttctttagccggagatgcagttggttatgttcctcttgataaacgggcttatttcgtaccagatgtgcttgaaggtatggagcatctttcattagtttgtatcgataacgttcaatgtattgcgggtgatgaagagtgggaacttgctctgtttaatctgtataatcgcgtattagaacttggtcgcacctgtctattaatcacaggggatagacctccccgtcaaattgatttacaacttcctgatctcgcttctcgcctagattgggggcaaatttatcgcttacaaccgctaagcgatgaagaaaaaattcaagcactacaattaagagcgaaactgcgtggatttgaattacccgaagatgtgggtcgttttgtattaaagcgcttagatagaaaaatgcgcacattatttgaaatgctagatgaactcgatcatgcctctattgtggctcaacgtaagctgaccattcctttcgtaaaagatattcttaagctttaa

SEQ ID NO: 3897 - DNA, 915 bp, Proteus mirabilis
atttatagtctaatgtattcaggatggataatgatctttagtcgctacagtctctttttacttgttactttggggttgctttcaggttgtgttcagcaacctcagcttattgataggggggattattttgcacaagttgttcccaataatcctgggcaagataatcgcgtaaaatttttagttatgcactacaccgccgttgacgataaagaatcgttaaaaacgttaacttcgggaaatgtaagcagtcattatttaattcctaccaaaccaaattatgttgatggtaagccggttgtgtttgctttagtgagtgaagataaaagagcatggcatgcagggctaagtcagtggggaaatagtgcaggtttgaatgatggttcaattggtattgagatagtgaattatggttataacgatcagggtacattaagagagtggttaccttataccgcagaacaactctcaaccattactatgatgatgaaagatattattcaacgctatggtattgaaccacaaaatgtagtcgggcatagtgatattgcaccacaacgcaaagttgatccagggccacttttcccatgggctgaattagcgaaacaaggaataggcgcttggccagatgatgaaacagttactttctatttagcgggaagagctgcatcggagcctgttgatattgctaattttcaaaccttgttagcgaagtatggttatcaaacaccaacaacagggatattagatcctgaaacgcaaaaagtggttagcgcatttcaaatgcattttagaccaagtgatattaaaggtattcctgatgcgcagtcagaagctattttaatggcgttaattgataaatatcgaactaagtggatacagccatcaactgagccaataaaacattcagataattga

SEQ ID NO: 3898 - DNA, 480 bp, Proteus mirabilis
caaatgtcacaaataccctgttttgcttatgctatgcttaatagaaactcgtcctgctttaagggatattttcgggaggttattatgaaattaagcaaattagttggtcaaacagggatacttggtgcaggtttttttcttgcggtttcttttggagcctctgcagaaagtgtcacaaatgtgaataatgataataatgttgtgcgctcagccccttttgctagttgtgttaatcttgataaagaacaacttgccactagagtgaaaaatgattatttactcaatcgattacctcgctggcaggatgataaaaaagcgctaggaccaaaacctgtggcgaatattaatgcgaacgatgttatcaaaagagataatagctatcatgttatcttggatgtaagaggtgctcgtaccgatctacgttacaatgttgaagttaattgtgatgagaataaaattacctatatatcaagtaaatag

SEQ ID NO: 3899 - DNA, 483 bp, Proteus mirabilis
ccattgggtcttaactggaatttaaaggcttgtagacgtttcatattatctattatactttggtccatgaaaaatgaaactaatattcgccgtggcagacattgtgtattcctgatgcacgtccatttggtctttgtcacaaaatacaggcgaaaaatatttgatcaggatgcaattgaaaaattgcgaggctactttgccagtgtttgtgctgattttaatgttgaactggttgaaatggatggggaacgggatcacgttcatttactgattaattacccgccaaaactggcgatatctaatctggttaacagccttaaaggggtatcgagtcgattacttcgacgtgatcgtcctgatattgcccaacgtgattactacaagggggttctttggtcgccgagttatttcgcggggagttgtggtggcgcaccaatatccattatccgccagtacattgagcaacaggaaacacctagttag

SEQ ID NO: 3900 - DNA, 450 bp, Proteus mirabilis
tctatggaacagatcccttccttttccagccaaggtgcggttaatactgccgcacccgccacaacgcaaactatccaaacaccggcgcaacctttacccgttggacaaagccttgtgcaagtcagcaccgcgcttgcgggtattattgtactgattattgttgcaatgtggcttttccgccgttttggctttgctcgcggtacatttaaagctaatcaagcacaactcacggttaaagcgaactgttcattaggtaccaaagagcgtgttgtcgttgttgaaatcgagcaggaatggcttgtattaggggttacggcatcacagattaatctgttacacaccttacctattcctaatcatgcctcgcaggaagcgcctataccaccttcttcaccgttatttattcaattattacaaaaaacgctaaagcgagataaaggcaactcataa

SEQ ID NO: 3901 - DNA, 1656 bp, Proteus mirabilis
aaggatagacaaatgtccaacaatttaattaatacagcgatgagtgggcttaatgcagcacaagctgcgatgagcacaattagtaataatatcgcgaaccaaaaagtaaattggtataaccgtcaaatgaccgtatttaatgaaaacggtggcacgatgaccagtaatggttatattggaaatggtgttaatgtgagtcgtattcatcgcgaatataatgagttccttgcgggacaaatgaatcgtgcggtaacaaaacagagtgctttaaatagctataacaaaaatatctcgcaaataaatgatttattagcggataaaggcaatgatgtttccagtgcaattgatgacttctttaccagcttacctaatgtaacgaacaatgcggaagataacccagcccgtaccaccatactgggtaaagcagaagcaatggtgaacatgtttaacaaagcggatcaatcattacgcgatctcgaaaaagacattaatagccaagtcactaataccactaagaatattaatgaatattccaagcagatagctaaattaaatcaagaaattagccgctcccaaggttttaatggtgccgagcctaatgatctgctcgaccaacgcgaccgcttaattcaagagctaaatacgctagttgatgtacaagtgacccaacaagatggcgggtttgttaatgtcagctttgccaatggtcttcctcttgttgcggggacgcgctcttatgaagtctctgctattccttccagtaaaaacagtgaacgccttgttgttggttatagcaacggtattgatgaagtccgtgaagttgatgctaaacgtattaatggcggtgaattaggtggcgcttaccgtagccgtaatgaagtattagatgcaagccgaaatcaattaaaccaattagctttagtgttgggcgatcaatttaataaacaacatgagcaaggttttgatttaaacggcgataaaggtgataagttcttcaacctaggtggggcacataccatgcctaatggtaagaacaaaggtgatgcgactttcgatgtcaaatacactgacacaagagaagttaaagctgcggattatacggttaagtatgaaggtggtaaatggaatgtcactgtagagccggggaatcgtaaatttacagcaacacctaatgcaacaacgggtgaattagaattcgaaggaatgagcatcaaagtcaatggagctgcacaagagggcgattctatcgttgttcaatctgtaggcaacgtgattgcaggaatgagtgttgcaatcagcgatccaagcaaaatagctgccgcgggtacaaaagactctggacctagtgataatgagaacatgaaaaaattgttcgaattacccgatgaaaaacttatcgatggtaaagcaacaattgctggtggttatggctcactaataagtatggtgggtaataaagtgaatactgcgcaagttgattatgatgcgcaaaatgcgatcaccagcagtattttaacacagcaacaatcggtttcaggggtcaacttggatgaagaatacggcgaaatgtatcgtatccaagagtattacatggcaaatgcaaaagttattcaaactgcaaataccatgtttgatgcgattatgcaggtcttataa

SEQ ID NO: 3902 - DNA, 555 bp, Proteus mirabilis
aacgctatgcaactaaatattccaacttggctaactttatttcgtgtcgctttaattccattctttgttctggtgttttatttaccatttaaagatgctccccttatttgtgccattatttttatggtagcagccgccacagactggtttgacggttttttagcccgccgttggaaacaaaccactcgctttggggctttccttgatccggttgcggataaggtaatggttgctacagcattagtattaattactgaacactatcatgtatggtggatcactttaccggcagcgaccatgatcgcacgtgaaattatcatctcatcactaagagagtggatggctgaattaggtaaacgtaatagtgtggcagtttcttggatcggaaaagtgaagactaccgcacaaatgggtgcacttgttgtgctattatggcgtccgactattgaagctgagtggttcggatttgtattgttatacattgcgacggtattaacattctggtctatgttccaatatttgagtgctgcatggtcagatttgcgtgaagcttga

SEQ ID NO: 3903 - DNA, 822 bp, Proteus mirabilis
cttttagtgcaccataacaacagtcgttttttggtcactgttttatcaaagacaatatggaaaatcatcgtgagtaaaaagaaaattgttatttctttagccataatcgctggattgagtacaccgacagccttcgcgggagaatggtcaatagggggttctgtattatcacaagtaacaccttataagggtgctaaatctaaagactatttattacctgtacctttggttaattatcaatctgaaaatttctattttgcgacattagccgcaggatattatttatggaattcaccgaaagatcagctgtctgtcgatgttcactattacccacaagcatttaaaccaagtgactctgatgatgagcagatgaaaaaacttaatcgtcgccgtgataccgtcatgggtggatttacctataaacatcatgagtcatggggaagtttacgagggattatttctggtgatcttttaggtaaaagtaatggcattattgctgatgctgcttacctttatccttttgaactaggcaattggtcacttcaaccgggaattggtgctgtttgggaaaataaaaagcagaatcgttacgcatatgggattagtcagggagaatctcagcgtagtggtttagctgaatatcgaccaaatgatagctggagaccttatgttgaaatctcagctaactataagtttgctgaaaactgggatttcttcgcgatgggacgagtggatcgcttacccagcgaagttaaagatagcccgatggtaaataaatcggtaacggctattttatggacaggtgtcacttatactttctaa

SEQ ID NO: 3904 - DNA, 390 bp, Proteus mirabilis
tttggaaagcataacatgaaacggatattattgattatagcagggtggttatgtgttggattagccacattaggtgttgttttaccagtgttacccacaacaccatttttgttattagcggcatggtgtttttctcgctcatcaacacgctttcatcactggttgctatatcgctcttggtttggtggttatttgcgctattggcaaacttatcgcgccatgcctaagggggctaagccgaaagctattttagtcattttagtaacttttgctatctcgctgtggttggtctcaatgtggtgggtgagaattttattgctgataattttagcctgtctgttgatatttatgtggagacttcctgtaatagataaacaagatgtctcctaa

SEQ ID NO: 3905 - DNA, 297 bp, Proteus mirabilis
tatatggagcaatcaatggaagttaatgatttaatttcaatggtcacacctgagatttatcaacgtctttctaccgcagttgagctaggtaaatggccagacggcgttgcactcacggcagagcaaaaagagcattgcatgcaaattgttctcttatggcaagcgcagaataaccataatccggaacatatgacggttggcacaaacggacaaattacgatgaaaagcaaacaagagctaaaagcgcaatttcaagctgaacgtttagccacattaataccaatggatgatgattaa

SEQ ID NO: 3906 - DNA, 501 bp, Proteus mirabilis
ggagctattaaaatgacacatagtgatctgtgtgaaatagcggtgcgattcctgcaaaataacggatttaatgtagcctttggtgacagattccagtcaagaaacggaacaggggagcaacctgacgcgatagggttcagaagtggtataagttgtcttattgaagcgaaagtcagtcggtctgattttcttgcggacaaaaagaagtggttcagacaacaaccggaaaaaggaatgggcgactggcgtttcttcttatcgccaccggatattatttcatcggaagatttacctgctggctgggggttgctccacgtcaaaggaaagagagtgttcaaggttcacggatggcctcccaatacatattggtatgacaaaaaaccatttaaagccaataagcaggcagaatgtgaccatatgtatagcgcgttgcgccgattgcaaatacgtggacatcttcatgaaatctacgaaggcattccgaaaggagttatttcatga

SEQ ID NO: 3907 - DNA, 252 bp, Proteus mirabilis
ttaaaaattaacttaatacattgtaataaaaggatttatctatcattagaacttttattagtcgttttggttattttcttttttacccgtaacaataattggtgtaatattgccaaccgtcaattttattttcttattgttttaataagatatctgattctaatttttattccttatttggaatttattttttattttctgctgttgaaaagattacgcatattattttttagggagaggggttatgcctag

SEQ ID NO: 3908 - DNA, 240 bp, Proteus mirabilis
caatcagttaaacccagcgttctctttctcactttatttttgagaccacctttaacttacttatctattaaaggtggtttttttatttctggaataaaaaataaaaaggagcaacataatgttacccctttttttaggtctctcttgaatgcgattagtgaccactactcatcgaggttggcgcttggcaccaatcaagatattgctcatacttacgtagggcaatgttgtagttactaa

SEQ ID NO: 3909 - DNA, 447 bp, Proteus mirabilis
attatggctaaaacaatactggtagcaattgacttattagaagatgatagaattcaccgtatggttaaagatattcaatttctagcaagaaaagctgatcactattttcattttgtcacagtcatgcctaatttacgttctcttgaagcttatgggcttgattgtgatagcccttcagttatagagaaaaaacatcaagccgttattttgttaactgaaaaactagcacactgtgttcaacaacaattccaattacctaaagagcagtatcaatgccatgcccttatagggacaccaaattataatattctcgaactcgccaataagatggatgtagacactattgtcattggctctagctctcgtaatagacataatatattgcttggctctactgcagattatattgttaacaacaccaattgttctgttttggtgatccgttga

SEQ ID NO: 3910 - DNA, 357 bp, Proteus mirabilis
ttaccctataacaaattaaccatagactcattaatacagaggaaaaatatgattatcgcttattcaacagctcctaatgaaactgtcgcccatgaaatagctcaccatcttatacaggcgaagcttgcagcttgtattaacgtccttcctaatatcaaatctatctatcattggaataatgaaattgttgaagataatgaggtacttatgatgatcaaaagtgaaagttcaaaacaacagattttgattgatacactagtaaaaatacacccttacgatacacccgaagtcattattatccctatagaaaatgggtttcatggttatctagaatggatacatcaaagcctaaattaa

SEQ ID NO: 3911 - DNA, 1023 bp, Proteus mirabilis
ttcactaataaagctggtggaatacatatgactatcaaagtaggtattaatggttttggtcgtatcggccgcatcgttttccgtgctgcacaagaacgttcagatatcgaaatcgtaggtattaacgatctgttagacgcagaatacatggcatacatgctgaaatacgattcaactcatggtcgtttcaacggtactgttgaagtaaaagatggccacctcgttgttaatggtaaaaccatccgcgtaacatcagaaagagatccagcaaacctgaaatggaacgaaattggtgttgatgttgttgctgaagcaactggtctgttcttaactgacgaaactgcacgtaaacacatccaagctggtgcgaaaaaagttgttctgactggtccttcaaaagacagcacacctatgttcgttatgggtgtaaaccacaaatcatatgcaggtcaagatatcgtttctaacgcatcttgtacaactaactgcttagcgcctttagcaaaagttatcaacgacaaattcggtatcgttgaaggtctgatgacaactgttcacgcaacaactgcaactcaacgtactgttgatggtccttcaatgaaagactggcgtggtggtcgtggtgcttctcaaaacatcatcccttcatcaactggtgctgctaaagcagtaggtaaagttattcctgaactgaacggcaaactgactggtatgtctttccgtgttcctactcctaacgtttctgttgttgacttaactgcacgtctggaaaaaccagcaacttatgctcaaatctgtgaagcaatcaaagaagctgccgaaggcgaactgaaaggcgttctgggttacactgaagatgcagttgtttcaactgattttaacggtgaagtattaacttcagtattcgatgctaaagcaggtatcgcgctgaatgacaactttgttaaattagtttcttggtacgataacgaagttggttattcaaacaaagttctagatctgatttctcatatctctaaataa

SEQ ID NO: 3912 - DNA, 423 bp, Proteus mirabilis
aataagaataattcatacaatataaagggaacactgatgaaaaaagttttacctatcgccatcgttttaatgggttcactctcttttggtgcaatagccaataattcacatatgaatatgaatatgagtactaatgtggcacagagtaactctcctatgaaccaagagctcatggattcaatgaataaaatgcatgaaaatatggcaaaaggaatgaatagtgctaatgcagatgttgcatttgcgcagggaatgattgctcaccatttgggagcaattgatatggcaaaaatcgagctaaagtatggtactgatcctgaaatgcgcaaattagcacaagctattattgatgcacaaggccctgaaattgaacaaatgcaaaaatggttagaaaaaaataataccaatatgcaaaataactaa

SEQ ID NO: 3913 - DNA, 1869 bp, Proteus mirabilis
tgtggagataatatgagtaaaattatggagttaatcggcactatttttcgatttagttggcaggcgattaactttatcaggaaactaatcttaaacgttattttcttctttctactttttatgggtgtaggactctatttcatcgtccaagaaacgcaaaaacctaccgattaccaaggtgcattactggttgatttaaaaggcgttattgttgaccaaacagctaaccaaaatcctttagggcaaatgagccgagagcttttgggtgtttcgggtagccagttacaagaaaattcgttattcgaagtcgttgataccttacgcaaagcagcgactgaccccaaaattaaaggaatggtactaaaacttgacgaatttgctggggcagaccaaccttcactcaattatgttggtaaagcgctgactgaatttaaaaaaacaggcaaacctatctatgcgattagtggttattatagccaaccgcaatattacttagcctcttatgcagataaaatttatttagcatcacaaggtgctgtgggtatttatggtttaggttttagtaatctctattacaaatcgctattagaaaaacttaaagttaatacccatatattccgtgtaggaacctataaatcagctgttgaaccgctgatgcgcgataatatgtctgatgaagctcgagccgcatcgaatcgattagtttccgtactctggtctaattatttaacgcaagttgcagaaaatcgtagtattaccaaggaagatgttttccctggtgcaaaagagatgattgtcgagttgcgtaaagccgatggcgataatgctacttatgcacttaatcgcaaactggtcgatactgttagctcttatgcccaatttgaagcggatatgaaagagacctttcaatgggatcatgaagctaagcagtttaataatatcagtatttatgattatgccgataacctcaccgcattcgccccagaaaacgaagacggcaatattgcggttgtggtcgttcaaggcgcaattattgatggtgaaagcattcctggctctgcaggtggttcaactattgctaatcaaatccgtcaagcgcgtttaaatcctaatattagagcattagtattacgagttaatagccccggtggtagtgtatctgcatctgagcagatccgcagtgaaatagccgcctttaaacaagagaaaaaacatgtcgtggtttcaatgggcggaatggctgcatcagggggatattggatctctacacctgcgagtaaaattatcgctagcccttcaacattaacaggctctattggtatatttggtgtcatcaatacctttgaaaatagcttagaatcaataggtgtgcatagtgatggcgtgagtacatcgcctcttgcaggactttcggtaaccaataaattaccagaagatttttcagagctattccaacttaatattgaaagtggctataaaacattcctgaaattagtagctgaatcacgtaataaaacaccggcacaagttgatcgtattgcgcaaggtcgtgtttgggttggtgttgatgctaaacaagtaggattagttgatgaatttggtgatttcgatgatgctattaatgcagcagcaaccatggcaaaaatcaaacaaccagtcattgattggatgaaaccggaattaagcttatcagagcaaatattaatgagcttatcggccaatgcaaaagccattattcctgatccattacaatcctatttacctgcactggtatttaaagaagttaaaacacaaactgagttttatcgtaatatgaacgatccgcaaaaccgctatgcgtattgtttatcttgtggtgatattcaataa

SEQ ID NO: 3914 - DNA, 369 bp, Proteus mirabilis
ataagggataatatgaccaacaaagtaacgatttatcataatccgcgctgttctaaaagccgtgaaaccttacatttattagaagagatgcatatcacccctgacgttattcattatttagatacgccgccttctgtcgatgagttaaaagcattactcaaagcgctagattttgacgatgcaagaaaattaatgcgcaccaaagaagaaatttataaaaccctaaagcttgctgatgagagctcacaagaagcattaattcaggccatgaataatcaccctaaattaattgaacgtcctattgtggtcgttggcaataaagcgcgtttaggccgtccacctgagcaagttactgccctttttaagtag

SEQ ID NO: 3915 - DNA, 378 bp, Proteus mirabilis
aggcaatgtaatcaagtttataaaggggtgaatatgtcactagttgataaacaaaatacgtttacaggtatggttgcaaaactgatcacctttgctcagcagaagggatataaattgacgtttggtgagacttatcgtaccgaagaacaagctaaattaaatgcaaagaaaggatctggtattagcaacagtctgcatactcaacgtttagcagttgatttcaacctatttgatactaacggcaaataccttacagccaccagcgactataaagaactgggtgagtattgggaatcattgggtggaagttggggtgggcgttttaaaactcgtcctgacggtaatcatttttcattagagcacaatggggttcgttaa

SEQ ID NO: 3916 - DNA, 363 bp, Proteus mirabilis
ataaaatgtaaaagagaggtgggtatgaacagcgtaatacaaaaacgaacatcacaacaattatcggtagagagagtggctgttctagaaagaatgactgttcttacaaaagaattggttaatgaattagcagagaagaaaagtttagcaagtgctttaaaaatgagtgataacgaattggctcagttaatttttgaaactcaactgatacgttcgtctgcaatttcaccaagagaacaacgtaaaatagcccgtttaaacgaaggcgctattaagttttctgaacggctaaaagagcttggaggcacatgtagagctagccaagttgcagctatttttgggagtaaaacgtcaaacgattaa

SEQ ID NO: 3917 - DNA, 1176 bp, Proteus mirabilis
ttttttagtaaaacatacaaggaatttttaattatgacagtattaaccgtttatttatgtggtaccggcgcttcatcttttgataataataatcataataatcctgtttattggcaaggtgagcttgtttccaccttggcgcataataatctagatcgcgaatttgctcagtggtttattgtagatggcccaggtagcggtaatttgcaagaagatgatttatgggttgaaagccctaattattcagatataaaaggctctttatttggcagtggatgggaagaaaatgttgaacatgcactgtgcttaatgaaaggcaactttgactggcaacgtgaaaagttaacagaacaacaatataatcaactgaaaaaagcgggtattcccattgaagatgttgaagtgactggctcttttttatggcgtaaatataattatggtgaccgctatgtcactcaacaacaacttcagcaacaaattattcgtacctttcgcaaagatggcatcattcccacccaagtgaatttaatgggttggagccgtggtggcatcacctgtcatatgcttgccaatgccatgttaaaagatcccctattaaaagatattccggtcaatatttttgctattgatcccgtcccagggccacttaatttccaaccagaaaaggtgacactaggtagcaatgttaaggaatatgtcggattttatgccattgatgaacgctcaaaaggatttgcttgcgttattccaaccgtgactgctgagactaaaatgcatattttcccgctttcaggacgccatgcgactttagtaggcaatgctgctattgatggtagtgaaggtaaaaatgcactattttcaccggggttaattgtgcgacattttgcagaaagatgtttaacacgttggggatgtcaattagcgaacaagctagaattaactgataaggagatatttgagcatcatactgatattaaaaatgatgcagataaatatattgctatgcgccgtaaaacttattccatatatgaaagtagcggtgatgatgaacgtaaagtttcattaggtaaagaggggaaagcattctctgatatatatggggcacaatatgagccttctatggcattaaccgcagactattttgcagatcctcaactctacgatgtgattaaataa

SEQ ID NO: 3918 - DNA, 198 bp, Proteus mirabilis
gataagagtaacattatgtttctaggaatgcctacattaacacatgaagaacaacaaaaagcagtagaaaaaattcaacatctgatgtccgaaggtatgagtagtggtgaggcgatccaattggtcgctcaagaattaagagaaaaacacacgactcgtgaatcagtctctattgtgtttgacgatgacaatgattaa

SEQ ID NO: 3919 - DNA, 339 bp, Proteus mirabilis
ctacttcccaatgccattatttatggtctttttacaccaccctctcaattaggagtggtgcccagggcgggacttgaacccgcacagcctaaaggccgagggattttaaatcccttgtgtctaccgatttcaccacctgggcatttatggaggcgcgtcccggaatcgaaccgaggtacacggatttgcaatccgctgcatgaccactctgccaacgcgcctcaactgctcaatctcttaagagattggagcgggaaacgagactcgaactcgcgaccccaaccttggcaaggttgtgctctaccaactgagctattcccgctttaccgaacttgctga

SEQ ID NO: 3920 - DNA, 447 bp, Proteus mirabilis
aactcacccaaagccccagacggaattgttcacaatgggtttctggaattgttttttaggcgcaggggttattatgcccgaaggaatgaaaatcagggtcttaataccgcgccgacacttggttgctctgcgggcattggtgtgttatgtggacttggactctatccacttgctaccgtagcgacattgcttatcttttgtgccaatattctattacgggaagcggctcaacgaataaatgcccaaccgcaatatcaagcgacagatattgaacaacgctattctattcgtattgtttgtgatacccacgatgaagttttggtaagaacacttattttgcaagccataaacggtttacacgtgagattgcaatcattaagtagcgcagatacaccaatgcctagtcaattagaagtttgtgctgaagtgttgggctaccccagctga

SEQ ID NO: 3921 - DNA, 681 bp, Proteus mirabilis
atggttaacaaaaaaaatttgcataaagaattggcacaattagaagccgaaggtcatatcccctataaaatccaagaggaaaaccagcaaaaaagatggcaatggaaacattacacgtcaggagtgcactattttgcacctacagatccattagaaatgggtcgctacaatgatccaacaggcataacgggaatatgctataccgctgattatgcagttgtagctattgctgaatcattaggacgtcactatcaacataataaggcttttattttaggtcttagtgatctaaaaaaagctcagatatacacacttgcaactacacgtaaaacaaaacttattgatataccaaagttacagggcatattgcatatcactgcagaccaagtcatggggaaaagttatgacattactcagaatattgttgattgggcagccaatactccagggcttgattatgatggtatagcctactcttcaaggcattactatggaatgtgtacagccttttggtgtagaaaacatattatccctcctcttgttgatatttctcactgctcccttgatttatacacagattgtaaaaaagaaaattttccgcaaaattggccctatcaagacataacaggacttgagatcattactgaaacattacattttaagatcaacgataatgagtag

SEQ ID NO: 3922 - DNA, 1245 bp, Proteus mirabilis
gtttgtaacaaagcttttaaaagggtgacgacgctagttatggaaaaacttgttgatatatacgactttatcgtatctaagcagattttcaccacgctgtttttagtgatcacgttgctggtggtgtggtttctggcaaagatgatctttcgtcgtatagccaagcgtctattgtttttattcaccgaactctcagatgaagagacgatagaagatattgcgaaaaaaagtgcctctattgttgcagtcactctggttctctatataaaccagttattgccttcgttttcagcacagatgaatattatctttgaaacggtttgtcgtgcttttatcgtcatcaatattgcttctcttcttaataacgcgttagatatttttaatatcaggcatgctaaaaaatcgtggcaccgtaacaattcgattaaaggttatattgaaattgctaagatagtggtgtggatcatcgcctttattcttattatcgcgctatttactgaacaatccccactgattattatttccagctttggtgcgatcgctgcggtattgatgtttgttttccaacatacccttatctcattcgtcgctaatattctgatctcaaatggtaaagtgttaaaactatatgattggattgaattacccagcagtaatattagtggtgaagtgattgatatcgcactgcacacaattacagtacgtaattgggataacacgatttctcgtatacccacaaaggactttttaaccgaaaaatacactaactggcaaccgatgttctcttcaggaggccgtcgtatcaagcgtagtttctatattgatcaatcctctatttcatttgctacagaacagttagtgcaggagctaaaaaatactgcgccacttaaaaaaagcattgaagcgatgttagaaggtaaagaagaagagataggtgatattaatacttggttagaaaccaacggggtgaccaatctacaactttttagaaagtatatgttaaattggatcaaaatgcgtggtgatgtgaggccggatatgtatttggtgataagaacaatgccccccacaccaatgggactacccgttgaattatattgttttactcgtgctaccacatgggtggaatatgaagagacgcaatcagaaatttttgagtatataaatgcttgtgctaagtattttaaattagatatttaccagcaaccctcaggtcacgatctctctaagataacgtttaaatag

SEQ ID NO: 3923 - DNA, 1284 bp, Proteus mirabilis
tcagttttaaaaccaaaggaaatgtccatgaaaaaaaacgctctatttactgtctcactgttatctgtatttatttcattatcttgctatgctcatcaagatgttattttacattctgattcattatcagatgcaaaagtatctattaatgatgacacagggaaaacacaaattgaagtgataaatactaatcaagatggtaccgcccatatctattataatcgtcttgatgttggtaattttggtttatcattaaaaaataatgctgaagcagaattaattattaatgaggttgtttctaaagatgtttcaattctaagaggtgagcttgagttacaaggaaaaaaggcgacagtggttatagctaatcctaatggaatttcttgtcgtgattgttctttctctggaattaatgatattaaactaattgtaggtagcagtacagggaaattttctaagacattcactatagcagatataggttctagtgttgtttttgatatgagaaataaattagataaaaatgaatatagtcatattcatcgcaattataaagatatttcatctggaatgataaatattatctctaataatgtagacttgattgacggtgatttaaatgctgaatatattcgttttgatatagggttaagtgagtttaatcttggagctaaaaatgattataataaatacagccattttttgttaaggacagaggcaggaataaatagtcgatatttaataataaaagcaaaacagggtaacgtttataatgatggtaatataaatactttgtcactaaatcatgagtcttatagcttaattaatgcaggaaacatagatataaatcaagatgataatttatatagaacagcttatgatgggacgaaacaatcaaaagtaatggtttataaatattcttctgttcttaataattcatcatttaatgttaaagatagtattctatttatgaaagcggatacgttgcttttagatagaacatttaatattgatgatagttatttatatggaagagtaggaaccataggaataggtaatatatcattgtcgtataatagtgtttttcatattgtcgctgaggatagtatatttcttggtggtaaaatccagggggatggtcatgttatattacaattaaatgatgataaagttgatattgaaggtaaaaacttgttaataggaacagagggattaagattagaggggggaacaaaatataaattaggtagatcaactattatagattatactgaatacaaataa

SEQ ID NO: 3924 - DNA, 2283 bp, Proteus mirabilis
gcctatttaaataaaacaaagaataggtttattatgaaaactcaattaacaaggaacatacttggctcttgtattttattttctggtattcattctctggtgtttgcggctgaaacggaaaaaacagttcaatttagtagtttaaaagtctcatcggcacaaaaacaaacaccagagcaaaaagcgttatctaagccgggggcttatagcgctattggtgaaatcaataatcttagctcggtagaacaagcattacgatctacaccgggaacttacacccaaatggatgccagtcagccgggggttggggttaatatccggggattaagtggttttggtcgagtcaatatgatgattgatggggtgactcaaacgatgtatagcacgtcacctagccaatatgcgcatggtggacaaccatacaaccagtttaatagcatgatcgatcctaactttattgtgcaaattgatatttctcgtggtcaacaagatggtgaaaatagtattaatgcgttagcggggagtgctaattttaaaacaataggtattgatgatgttttattttctaatcatcgttggggaataagaagtaaagcggctcgagggactaatggattaggttataacggtatggttgcgattgcaggaaaacagccgatatttaatcatgatggttatattggcgctatgtttgccataagtggacataatattgaatcttcttataaaaatggggcaggttttaatagtcatgagtttgcaaccactaaagactttaaccaaaagccacattctgaattagcaaaaatatcgtttaaacccaatgattctcatgaaatagaattaagtggtcggttttataataataaatttaatcgaagaaccatagagagccaagattattatgctaaatatcgttataccccgctaaacgatctttttgatagtgaaatattattgagtagaagccaagcttcacaaaaatttgccggtgactctttaatgtcattacgcaatggacatgcgaaaaatatttccaatgcacttgtcgctaaaaataccagtcgatttaattatcatgagctggatatggcactaacattaggtactaaactgatgtcgattgattataatcgagaagtgacagctccttcgagcgatccatggcaatcacaaaatatgattgaatacaatgtatttgctccgcaaggaaaaaacgacatcagcagtcttttttcacaaatgaaatttgaatacgatatttataccctcgcattaaatttaaactatacggattatcatattaaaggatataaacccgcttgtgatcccaaagcagcgtgtttccctgaaggtgcgatgaatgttaatcgccacgaaaaagcgtgggagccgggagcactcttttctgcacaaattatccctgaatttgaaccatttatcagttatgcccatacgacaagggcaccaaacccacaggaaattttctttgctaatgaaggtggggcatcgatgaacccctttttaagaagtgagaaagcggatactttccaaataggttttaatagttatcgccctgatttaattgttgccggagacagctttcgcttaaaagcactttggtatcatactaaagttaaaaactatatttccagtgattcttataatgtttgtaaagggggtaaacgctgtaaaatcgatggcacttttactgacgatgactacagtggcatggaatacgatggaaatatctatttatacacaaatagccttgatcctgtgacgatgagaggttatgaactacaagtaaactatgatgctgatgtattctataccacgctttcttatagcaatgagcgcacctcacaacccacttctcttgcgatgggggattttgggcaaagtcctgcatcagaacttcccaaatactacgcaacgattgatgctggtgtgaggttattcgatgaccgatctctcgaattaggcaccatcattcaaattaccggtaaaagtcgtaaagcttcagctgaagggtttgattttgatacaggcactattcccatggtcgaacaagaaaaaatccctaccgtgatcaacgcgtacgctaactatcaaatgaataaaaatgtgtcattaaaatttgcggtacataatctcatgaataaaaattattcaaatgcacttgatagaagtaattcagcgccaattatggatgaacagggacaaaataaacaaacggctagaggcagaagtttcctgtttggtggagaaattcgtttttaa

SEQ ID NO: 3925 - DNA, 456 bp, Proteus mirabilis
ataatattaaagattatgatggaagaactccgccagaccttagatcttcagttatcgcagctcaataccattgcgggtattttacgtgctgagcaacagttattatgtgcaggaagtattgatatcaataagctgcatgaaataactgaacagaaaaattttgtattaacagctctgggtcataccgatcaaaaacgtcaaatactcagtaaacaagttggtattgatagaccctatcaaggacagccttttttagctgatttatggggacaactggttgatctaacggaagagttaaaacatcttaatcaacacaatggcttattgtcagagcaacatattactcgcaatagtgaaacgctacattttctacagaaaaatcatagcccaacactttatggtgcagatggacaagcacagcgttcaatattagctgggcgaaaaatacaaatataa

SEQ ID NO: 3926 - DNA, 321 bp, Proteus mirabilis
tgcctaacaaaggattttcctatgagtattgaacgcacaaatccacttatcccaatcacggccatttctcagcgtaaccttaatgaaggtgcccaagaagcacgaaaaaccggtaatacgcaaacaaaagcaatggcgggtgatacttctgtgaaactaagtgaagcacagaaaaaattagttcaacctagcaatcaagacatcaatgtcgagaaagttgcccgtttaaaagcagcgattgccgatggaacattaacaatggatagcagcaaaattgcggaagcacttttccgagaagctgctgaaagcataactaaataa

SEQ ID NO: 3927 - DNA, 201 bp, Proteus mirabilis
tgtctacaaaattatatagcaattgtgatcctagctagaggatcacactgcttgcccccctgctttatagccatttattatgcttcttttcctgctggatcaggattaaacacctatttcttcttacatctctgtcagaatttgttactatcaattctcttttcgttattcaaacactatttttacaagataattacctag

SEQ ID NO: 3928 - DNA, 1059 bp, Proteus mirabilis
atcagtaaaaagagcaggggcataatcatgaaaggttatattcaaacggtaacgggtccggttaaaaaagcggatatggggctgacactacctcacgaacatttatttaatgatttatctggcgttgttgatgaacctttttatgaattctcacacgttttagtagataaaaaagtcagtgcagatattcagtggggactaaaatacgatccatattgttgttgcgataatatggataaaaaacccattgaagacgttatttttgaattaaataattttaaagagcttgggggcaaaacgattgttgatgctacaggttcatcgtcaattggtcgtgatattagaaaattaaaacaagttgcagaattaacggggattaatgtcgttgcttcttccggcctttatattgagaaatttgaaggaaaacgcctagctgatgatattgatgcgatggcaaaaatgatcgatgatgaattaaatatcggcattgacggtacagatattcgtgctggtatgattggcgaaattggtgtatctcctttctttacagatggtgaaaaaaatagtttacgtgccgctgcactggctcaaaataataacccttatgcctcaatgaatattcatatgccaggttggcaacgccgtggtgatgaagtattagatattcttttaacagaaatggggtgtgatccagctaaaatatcgttagcccattcagatccttctggtaaagatatcgattatcaatgcaaaatgcttgatcgaggtgtttggcttgaatttgacatgataggtcttgatatttctttccctaaagaaggcgccgcacccagtgtgatggatacggttgaagctgtcgcaaccttaatagaaagaggttatggtaaccaaattgtattaagtcatgatgtgtttttaaaacagatgtgggcaaaaaatggcggaaatggttggggttttgtgcctaacgtttttctttcattattagcacagcgtggcattgataaggcgataatagataggctgtgtattgataatccagctaatttattagcatga

SEQ ID NO: 3929 - DNA, 1161 bp, Proteus mirabilis
tttgggaaaaaacacaggagtctcatgatgcttcataaaaaattacatagcgaaatgtcatgggaacaacttggtgagtactatgatgaaattagtgatatgtccggtgttcgacaagatccgatccaccatgctgaaggtgatgtagctattcatacacagcaggtgatccacgctataaaatcactccctgaataccaagagctgtcagaaagagagcaacaaattctatggattgcagcacttttacatgatgtagaaaaacgttcaactacccgtgaagagaatgggcgaattatttcgccaggccatgctcgtaaaggagaattaacgacaagacgttttttatatgaaaaagtgccggttagctttattgatagagaacagattgcggcattagtacgctatcacggattacctttatggttaatggataaacccgatcctaaaaaagccttattagcggcttcgttaagggtagattgttatttattggcattgctggctaaggcggatgttctgggacgaagctgtgaagataagccctctttattggataaaatagcgttatttacactttactgtgaagaattaaattgttggagaacacccgcacgatttatttctgatggcgctcgatttcactattttcatagtgaaaatagtgtcgatcctcactatgaaccttatcctgagcaaggaagtgaagttattgtgctttgtgggctaccgggaatgggcaaagatagttatattcgccaatattgtgcagatatgcctgtagtaagtttagatgcattacgtcagcagcataatataaaaccagatgatcgtgatgcgaatggatggattgcacaacttgccaaagagcaagcgagaatatatttaagagagcataagccttttgtttggaatgcaacaaatattactaaacaaatgcgtaatcaacttattgctctgttttatcgttatcaagctaaagtgacattggtatatattgaagtcccttatttgcaatggaaaaaacaaaacagcgcaagaaaggaagcggttcccgataaagtgatggaaagaatgttgagcaaactggaagtcccaacaccagaagaagcgcttaatgtgatttattgggttgatggggaagctcaaaatttgatttaa

SEQ ID NO: 3930 - DNA, 603 bp, Proteus mirabilis
acccagagaaatagaagttttgcttatttttgtttttatttattaagactacaacacagggctttatctcttatgtctgtttcaacacaaaagaaacggccgctaagccgttacattaaagactataaacacagccaaactcattgtttgcattgccataaggcgcttgatcggatttctctcgtattcaatcgccaagttatcaataaagaagccatttctgaaatgacagatttaattgatgatgaaacatgggaaaccttgcaaggaaagttttctgcgctgtgccgtttttgtagtgagatttactgtaatagtgaaactgattactttgacattatgtcttttaagcagtatttgttcgaacaaacggagatgagccacagtactgttcgtgagtatgtggttcgtttacgtcgactcgatgaattgctgacttccactaattttcctcgtcaagaattcacgacagagaaaattcagtcagacttgagtaaaaagctcactccctccgcatttagtaactacaacattgccctacgtaagtatgagcaatatcttgattggtgccaagcgccaacctcgatgagtagtggtcactaa

SEQ ID NO: 3931 - DNA, 996 bp, Proteus mirabilis
caaagaggaaataacatgcctgctttaactctcgttgattgggctaaacgacaaggccctgacagcaagcaagcgaagatcgtcgaattgctgaatcagtctaatgaaatccttgatgatatggttttcgttgaaggtaacttaccaacgggtcaccgtacaaccgttcgtacaggtctgccgtcggcaacatggcgcttgcttaactatggtgtaccaccaagcaaatcaaccacagcacaggttactgatgcgattggtatgcttgaaacctattctgaggttgataaagatcttgctaacttgaacgggcaaaagaatgaatttctattgtctgaatcaattgcattcttagagtcaatgaaccagcaaatggcggaaacggttatttatggtgatgcgacggttcatcctcagcgctttacgggtttagctgcacgctttaacgatatgaaagcaaagaatgccgtcaacatcattgatgctggaggtactggcagtaacttaacttctgtgtggttagtggtatggggggaaaacacggttcacggtattttccctaaaggttctaaagcaggtttagagcaaaaccatttaggtgaagttactttagaagatgagaacaaaggtaaataccaaggctttcgtactcacttccaatggaaaaatggtatctcagttcgtgactggcgttatgttgtccgtatcgccaatattgatttatccaaaattggtaaagatccagaaaaagcggacacactcgatttgccagacttgtttattcaagcaattgagaagatccctaacctctctatggggcgtcctgttttttattgtaaccagcaaattcgtagctggatgcgtcgccaaattaaaaacagtaaaaacgtcaatatttctatggcagaagttgccggtaagaaagttgtttcattcgatgaaattcctgttcgccgtgttgatgccattctaacgactgaagatcaggtgaaataa

SEQ ID NO: 3932 - DNA, 240 bp, Proteus mirabilis; identical to SEQ ID NO: 439

SEQ ID NO: 3933 - DNA, 1233 bp, Proteus mirabilis
acaattatgaatatcaccacacccaatagcgttaatgaagtaagccgtaaaacggcgtggatcagggtaattattctatcatttgctgctttcgtatttaatacgacagagtttgtacctgttgcattgttaagtaatatttctgaaagttttgccatggtgccggctcaaacagggttgatgatcactatttatgcttgggttgttgccctaatgtctttgccattaatgataatgaccagcaaagtagagcgacgtaaactactgattattttgtttattgtatttattctaagccatgtcttatctggcgtggcatgggattttaattcgctaattgtaggtcgggttggagtcgcctttgctcatgctgttttttggtcgattactgcctcattagcaataagaatggcaccccatggtaaaaaagcacaagcattaagtttattagcaaccggtgttgcactagctaccgtgctgggtttacctctgggaagggtggttggacaatggttaggatggcgagctacctttttgggtataggtgtactggcgctgataaccatgcttgctttaatgcgctatttacctttattacctagtgaacattccggctcgttaaaaagtgtcccaatattgctaaaacgagcaccattagtgggtattttcttactaacggtgatcgcagtgaccgctcattttactgcttatagttatattgagccttttgttattgatattgcaaaattagatgaaaattttgccactattgtattactgatttttggcggtgcaggaattttggggagtgtgttatttagtcgctatagtaccaaaatgccaacctcattcttattctttgcacttattctcttaaccgtatgcttaagtacgctgatgatgagtagccaacatacactcacatttattgccttaatcatcttttgggggataggctttatgtgtattgcgttaggattgcaggttaaagtgattgacttagcacctgatgcaacagatatcgccatgtcgatctactcaggtatctttaatatcggtattggggcaggggctttgttaggtaatcaagtaatattgcacgcgggaatgccaaatatcggctatgcaggaacagccttaagtattattgcactagcgtggtgtggctttatttttacccgttatcgtgttgcgatgggaggcaaacctcgcgaaaaaaaccggctccattaa

SEQ ID NO: 3934 - DNA, 303 bp, Proteus mirabilis
atgaatatgaataaacctattagaaatgcagaaaaagataaaagtgacgctcaaatgaattctagaatagggctatatatattttttgctggaatagtattacttataagcaaatacatatggggaacagatgttagttccgcacttgctggcggtatagctggaggtggtttagtctactggggaatgaattacgacaaggttagtaaactaaagcgaaaacttgatgagctatgttataaaaaatataacaaacctcataaagattcatggaatgatattgctgatgacgaggggtattga

SEQ ID NO: 3935 - DNA, 897 bp, Proteus mirabilis
aaaataatgaaacgtaatgttactgaagaattgccagatatcgctgctcaaccgttagattttttttctgaacggtttatgttgtccgatgatcagtttcaatcaatctgccaattgatttatcaaaaagcaggtattgtgctgactaacaacaaacgggaaatggtttataaccgtctcacgaggaggttacgtgaattacggatgaataactttggtgactatcttgcgtttctaaaaagtgatgtatgcaaccctgaatggcaagagtttattaatgcgttaaccacaaacttaactgcattttttagggaagcacatcactttcctattttggctaaacacgccaaaaacagggcaggaggagtttaccgagtatggtgtgctgccgcatctactggagaagagccttattcaatagcgatgactttgcgcgatgtttttggggataacccctataaaacaaaaattattgccagcgatatcgacactaatgtgttggaaaaagcccgtaaaggtgtttatcgactggaagagttaaaaacgttaaacgaagaatatttgaaaaaatattttctcaaaggtgttggtgattttgccggatacgtgaaaattagaccacaagtaagtgaaatggtcacttttcagtatttgaatttactcgacaagcagtggaaattagaagggccatttgatgcgattttttgtcgtaatgtcatgatttattttgataaaacgacacagcaaagcttacttcatcgatttataccattgcttaaacccgatggaatgctgtttgtagggcattctgaaaatgtgagccaactaagcaaggatttttacttgcaggggcatacggtttacgggctgacaccagcaaggagaggttatgaataa

SEQ ID NO: 3936 - DNA, 1428 bp, Proteus mirabilis
atgatacagaatacttgtttaaatggtcataaaatagatatgcaattacagcaacgtgaattaacttatacccctgatttagcattacgggtatttgcgcctatcgcctctttgtcttggtctagtttactgcattcaggttttgccgaacatcaccataatcgttttgatattgttgtatccgatcctgctattaccttagaaacacgcaaacaaattaccactattaaagagaaaaccggtcgagtcaaacgctctaaaaaagatccctttacgcttatccaaacagcattagacgcttttaattttcatccagtcagtgatgaaaggcttccttttctaggtggcgcattaggtatatggagttacgatttaggtcgtcgcattgaaatattaccagaattagcaaaaaatgaacttaatttcgctgatatggctatcggtatttatgattgggcactaattgttgaccatcaactgaaaaaagccacattaataagctaccaagatattgacgcacgtctccaatggctaacaaagcacgctgataataacacaatagaaaaaaaagaaccttttgtcttaacttctccatggcaatcaaatatgagtagtgatgaatacaatgaaaaaattgctaaaattcatcaatacttactttcaggggattgctatcaagtcaatttagcacaacgtttttgtgctaattatagcggtgatgaatggaatgcatttttaacactaaatcaagcgaataaagcgccattttctgcttttatgcatttacctcatcattttgttatgagtatttctcctgaacgttttattcatttaagtgatcataaaattgaaacacgtccaataaagggtacccttccccgtaaagcgcatcccgatgaagatgatgaacaagcgcaattgttggccaattctcgtaaagatcgtgctgaaaacttaatgattgtcgatttaatgcgcaatgatattggtaaagttgccacaacaggatcagtcaaagtacctgagttattcgttgttgaacgctttcccgccgtacaccacttagtcagcaccattaccgctgaacttccagaaaatttaaacgcaactgacttattacgtgcggccttccccggtggctccattactggcgcacctaaaattagagcaatggagattatcgaagaactagagccacatcgtcgccatggatattgtggtgccattggctatattagtttttgtggtacgatggatactaatatctcaattagaaccctactgacggaaaaaaataaaatttactgttgggcggggggtggaattgtcgctgatagcgttgccgaacaagagtaccaagaaacctttgataaacttggtcaaatattaactgttttaagtgaagtttctcccgatgacacttattga

SEQ ID NO: 3937 - DNA, 1662 bp, Proteus mirabilis
ttattcgagaaaggcttgaaaacagaaaatgttaacaagcctttcaatttaatgactttttatttgttttggaattcaccacaaatgacagcaaatatccataatcatcgcattcttatccttgatttcggttcgcaatatacacaacttattgctcgccgtattcgcgaaatcggcgtttattgtgaactctgggcatgggatgttaccgaagaacaaattcgtgaatttaaccccaatggtattattctgtctggtggccctgaaagtactacagaagacaatagcccacgcgctccggaatacgtctttaatgcgggtgtgccggtattaggtatctgctatggcatgcaaactatgtctatgcaattaggcggtgatgttgaagtctcaggtgagcgtgaatttggttattcacaagttgagatccgcgaaacctgcgaactgttccgtgatattcaagactccgtaagtgaagatggcaaacctttattagatgtatggatgagccacggtgataaagttacggctattcccgctgattttgtcactattgctagcactgaaacttgcccatttgcgattatggcaaatgaagagaagcgtttctatggtgtacagttccacccagaagttacccatacccatcaaggtttagccattttaaaacgctttgtgttagatatctgtggttgtgacgcattatggacatccgcggcgattattgaagatactgttgctcgtttaaaacaacaaattggcgacgatcacgttattctcgcgctatcgggtggtgtagactcttctgttaccgcattattattaaatcgtgccattggtaaacgcttaacctgtgtatttgttgataatggcttattacgccttaacgaagccgaacaagttatggcgatgtttaaaggcaaatttgacctcaacattatccatgttgaagctgaagatcgtttcttaactgcgctaaaaggtgaaaacgatccggagaaaaaacgcaaaattatcggtcataccttcattgaaatctttgatgaagaagcgattaaattaccgcaagtcaaatggctagcacaaggcacaatctatcctgatgtgattgaatcagccgcatctgcaacaggtaaagcgcatgtgatcaaatcacaccataacgtaggtggcttacctgaagatatgaagttaggtttagtggagccactaaaagaactatttaaagatgaagtgcgtaaaatcggacttgagttaggtttaccttacgacatgctataccgtcatccattcccaggaccaggtttaggggttcgtgtattgggtgaaatcaagaaagagtattgtgatttactacgtcgtgctgacgctatctttattgaagagctacataaagccgatttatacaataaagtcagccaagcatttacagtattcctacctgtccgttcagtgggtgttatgggcgatggtcgtaaatacgactgggtagtttcattacgtgctgtggaaaccgtagactttatgactgcacattgggcacacctaccttacgatttcttaggccgtgtttctaatcgcattatcaatgaagtaaatggtatttctcgcgtggtttatgatatcagcggaaaaccaccagcaacgattgagtgggaataa

SEQ ID NO: 3938 - DNA, 798 bp, Proteus mirabilis
tgtaaggggaaaaccatgatccgttctttatggattgctaaaacagggttggatgcacaacaaactaacatggatgtgatttccaacaacctcgcaaacgtcagcacaaatggttttaaacgccagcgtgcggtttttgaggatttactctatcaaactattcgtcaaccgggagcgatgacatccgagcagacgaatgcgccttctggtttacaaattggtactggtgttcgcccagtggcgacagaacgtttacatagccaaggtaatttagcccaaactaatggtacgcgtgatgttgctatcaaagggcaaggttttttccatgttcaattacctgatggtacggatgcttatactcgtgatggctcttttcaaatggaccaaaatgggcaactagtgacctccagtggctttcaaatcgtcccagcgattattttgccagaaaccgctaaaaaggtgatggtaggtcgtgatggtattgtcagtgtggagattgaaggatcgcctgcacctcaacaagtagggcaattaaccctcaccacatttattaatgatagcgggttagaaagtgttggggaaaatctgtacttagaaacagccagctccggagcacccactgagaatgcgccgggtattaacggtgcgggcttgttatatcagggatatgttgaaacctctaacgttaatgtcgcggaagaattggtcaatatgatccaaactcagcgtgcttatgaaattaatagtaaagcgatttcaacttctgatcagatgttacagaaactcacgcaactctaa

SEQ ID NO: 3939 - DNA, 636 bp, Proteus mirabilis
tgcgcttctgatcttggcagaaatcaaattttgtgtttacctgttaggaataaactgaaagtcaaaaggaagcctattttgcctatacctgataaacattttctcgtactcactgcattagggactgaccgtcctggtatcgttgataccattacgcaattagttagccaatgcgggtgtaatatcgaagacagccggcttgcgatgttcggtcaagaatttacgtttatcatgctactttctggtggttggaatgcgattgcccaacttgaagcattactgccgataaaaagtgcagaacttgatttattgactgtgatgaaaagaactaaaatgggtgcgccagtctcttacccatcaaccattactgcaaaagtagatatagaagatgcccccggcattgttgaacgttttaccaatttatttagtcaacatcactttaatcttgcagaattagtttctaaaactcatccttctgaggatggtactcctgctcgtttagaaattcagatcacggcccataatccgttagatgatcatggtctcgttattcatgagaaattcaatcaattatgtacagagttaaacgctcaaggcacaataagtatcgtaaatagtctgatgatgaaacaataa

SEQ ID NO: 3940 - DNA, 1053 bp, Proteus mirabilis
gtaatgactgatatagtaagtttgttaggtgctgatgctaactcattattggaacatcgctgccaaaccatcccaagcgaaaatctctacctgccaggttctgactttgttgatcgtgtgatgattgataacaatcgccctaataccgtattgcgttctatgcaaaccctgtttaaccatggtcgtttagcaggaacgggttatctttctattttacctgtcgatcagggtgttgaacactctgccgctgcctcatttgccgcgaacccactctattttgatcccaaaaatattgttgagcttgccattgaagccggatgtaactgtgttgcttccacctatggtgttctggcttctgtttctcgtcgttatgcacacaaaatcccatttttggtaaaacttaatcataacgaaacattaagctatccaactcaatacgaccaaacgctgtatgccagtgttgaacaagcctttgaaatgggggctgttgctgtaggtgcgactatctattttggttctccagaaagccgccgccaaatcgaagagatctcgatggcatttgaacgtgcccatgaattaggcatggttaccgtattatgggcatatttacgtaatccagcctttaagaaagatggggttgattaccatgcaagtgctgatttaacaggtcaagccaaccatttagcatcaaccattggtgccgatattgttaaacagaaaatggctgaaaataacggtggctttaaagcgattggttttggtcatactgatgagcgtgtttacactaaactgacgagcgaaaaccccattgatttagtgcgttaccaattagctaactgctatatgggacgtgcaggattaattaactcaggtggagcatcgggtaataacgatcttgctgatgcagtacgtactgcagtcattaataaacgtgctgggggcatggggcttatcttaggtcgtaaagcctttaagaaatccatgaaagacggtgttgctctaattaatgccgtacaagatgtctatttagataaatctgtgactattgcttaa

SEQ ID NO: 3941 - DNA, 495 bp, Proteus mirabilis
agccgtgctgatgaaaatcagcacaacacaatcattgcgtatctgattaagttcagtttaaacagcaacacagtaatttgccaatatattttgaaggagttttcaatggcaagtaaggatctgagatttttagtggttgatgatttttcaacaatgcgccgcatcgttcgtaatttactaaaggagttaggatttatgaacgtagaagaagcagaagatggtgctgacgcgttagccaagttacagagttcggcatatgattttgttatcaccgattggaatatgcccaatatggatgggttagagttgctgaagaatattcgtagtgacgcagggcttgcaacgcttcccgttctgatggtgaccgccgaagcgaaaaaagaaaatattattgctgctgcgcaatcaggagcaagtggatatgttgttaaaccttttactgcagccattcttgaagaaaaactcaataaaatttttgaaaaactgggcatctaa

SEQ ID NO: 3942 - DNA, 705 bp, Proteus mirabilis
aggaataatgatatgaaaaaagtattactcagtcttgctatgctgagtgtaatatcaacgccggtattggctaaaacgcctgttgctaacttaaaaatcaatggtgatattaagccaccaacttgtactgttcatggggcgacacaaagtgatgttatttttgattacggagtcataagcccaacacttatccctcaatcgaaaaactacgagtatcctttagctacaggtaaaaataccgttacggttgaatgtgatgctaaaacatatttaacctttgttgcatctgatacttatgacagtgcggaattagctaatgatacgacaggacaatttcatttagttgataaagcaaatcctgaaaccgctgttggtgcagctttttttatatggacaaatattactgtcgatggtaagcctgcgtatatttcacgagcaaatgatgttgctattacggggaataaatttaataacgtcctatacaaaggccctaccaatggttggacctcagaacaacaatcagatattaataaaaactctctgtctctcatttcaggtgaaattttccaagcgaatttcagtcaaggaaagacaagtcgtacttttattttatccaaagatgcactaagtaaaaaaggaatagatattgctgatggattagattttgtcggagaggttgttctcacttttaactttggggtctaa

SEQ ID NO: 3943 - DNA, 549 bp, Proteus mirabilis
ataatgtgtgaaccaacaacattagcggcagcagtaattggtacttctgcattgcaagcatacggacaatataccgatggtaaatttcaagcatcagtggctaatcaaaacgccaaaattaatgaaggtgctgcacttgatgcaattaataaaggcaatgctcaggcacaagaacagcgtagacgcactcgccaattagcaggtacacaggcagcaacaatgtcagccagtggcattgatttgagcactgcgggggctttagatattttaggtgatactgctgcaatgggtgagcttgatgcgttaactatggtcaataacgcttctcgtgaagcgtatggctatcgtatgcaagctgaaaatgatcgccttaatgcaaaaatggcaagacgctcaggcaatatgggtgcaatgacaacgttattaacagcacctattcaagcttatggcgcgtatcagttggctggtggtacatggagtccgttcggtggtggctcaggtgctgtgaaagccggcaaaacattcgctaaagcaccaaaaggattttaa

SEQ ID NO: 3944 - DNA, 417 bp, Proteus mirabilis
aagatgctcgataaattagaaaatacgtttcattttcaacaagaagcgctttcactacgtaataaacgccaagaaattttggcggcaaatattgctaatgctgatacgccaggcttccaagctcgggatattgatttcgcggctgagttgaaaaaaaccatggaaaacgggcgtactggtagtcatggattgcaactgacaatgacatcagaacgccatattcctattaagccgggttatcgcttagaggctgatttgctttatcgggttcctcatcaaacatcgatggatggtaacacggtcgatatggatatggaacggagtaattttgccgataatagcgttaaatatcaggcagatgtgacatttattaactctcaagttaaaagcatgatggctgtattgcaacaaggataa

SEQ ID NO: 3945 - DNA, 225 bp, Proteus mirabilis
aggtgtgtcgatatgtgtaatccatttggcaatactccaaaaattacaactcctcctgctgttcaggcagcacctcaagaacaagatgcggcagtaacgggtagtcgtgatgatgaaatgcgtcgtcgccgtgcagccgcaggtcgtaagtctacgttactaacaggtgcgcagggtgcgacaagttcagcatccaccagcggtaaaaccttacttggtcaataa

SEQ ID NO: 3946 - DNA, 276 bp, Proteus mirabilis
  unsure (68): Identity of nucleotide at the above locations are unknown.
atgggtcccgaagccaagggtgcaaagaatgccaggctttgcacccatgttttagtggcggacggttnctccggattattcttaggttcaattgaaactcacccaaagccccagacggaattgttcacaatgggtttctggaattgttttttaggcgcaggggttattatgcccgaaggaatgaaaatcagggtcttaataccgcgccgacacttggttgctctgcgggcattggtgtgttatgtggacttggactctatccacttgctaccgtag

SEQ ID NO: 3947 - DNA, 948 bp, Proteus mirabilis
atcgtgcgtttaagttcaaatcaaatttacactcagcgagtggataatattactagctcgcaaagtagatggatgacagaagggaataaaatttccagtggtcgacgtgttgaaaaaccttctgatgatccgatggcggcctcacaagcggtaatggttaagcaatctgaagcgcgtaatcagcaatatgcgacagcacgtggatttgctaaaaacagcatgtcattgcaaatgagcctttcaagccaaatggtcaatatcaccacaaaaattcaagaaacattagtggctgccggtaatgatggcgcattaagtgatgaagatcgtgcctctcttgcggaacaattaagtggtttaaaagatcagttagtggggattggcaatacgaaagatggtgttggacgttatgtttttgctggtttccaaacagataaaccaccttttgttgctgacaaaacgggtaaaatcacctaccaaggtggagacaagcaaattactcaaaaagttgatagcaatattgaaatggtatccaactttacagggatagaaacgttacaatcatcgggaggaaaaggcacagagccagatatttttaatgccttagatgaagccatcagtgcactacgtgaacctctagttggaaaaccacaagctgatcgtgatgctgcattagataagattaatacggctaaccgtgttaatcgcgccacattaaataatatttctagtgtagaagctaaattaggtttacagcttcaagaacttgataatttagatgatttaggtgcagatacctcattaagaaatgctaaacgcttaagtgagttacgtgacttagattggacacaagcaatttcagattattatcaagaagagtcggtattacaggcatcttataaagtctttaatgacatgaaagagatgtcgatgtttaagatgtatcgttaa

SEQ ID NO: 3948 - DNA, 1359 bp, Proteus mirabilis
aagtgtatagatatcggcaaactaactgaaaatatagccaacatatgggcgactaaaactaatcaatcatcaaaataccagatgattgccaggctaataggaaatttaatgaacatcgtacatagactcaaacttgtttcattcctccaattttttatttggggctcttggcttgttacgtttgcttcatatctatttgataaattacattttaaaggtactgacgttgggctaatttttagtgctttaggattagcatcactgatcgcaccggtgatcatgggatttattgcggacaagataaataaccgtaagctggtctttattattctgcatattttatccgcgtttgctttagtgctgatgtctcaaatgaccacagtgactaccctcttctttgcgacacttctgcatttattgttctttatgccaagcatttctatggcaaacagtattatttttgagttactagaacaaaaacacctagagccaaatgactatttccccaaaatccgtgtttatggcaccgtgggttttattgctgcaatgtgggttattagcttcttaggtttcggtaatagctacgatcaactgtttgttgctgcaatagcctctattatcttagcggtatttgcgatgtttttaccggcgacaaaagcgacagataaaacagaagcaaaagaagaagtggccgcttttagcttatcgaataccttacaagtgtttaaaaagaaaaatgtggttattttccttttctttgccacattgttaggttcagtattgcaaattaccaatacatttggggttccattcttacaagatatggccaaagcacctaatgctgatgactctttcttggctcattatccttctgttttcttatccatttctcaaatttctgaagtggtctttattctatttttacccctgttattaaaacgagtgagaatagaaactatcgtattatttagtatgattgcatggatcttacgttttggtttcttcgcttacggtgactattcatcattaggccaaatcgttctgttgttatccatgattgtctatggttgtgctttcgatttctttaatatctccggctcactattcctagaaaaagagatcccattacaatatcgctctaccgcacaaggtatgtttatgaccttagtgaatggttttggtacttatttaggtgcgatgttaagtggctgggttattgatttgtataccacagatggtgttattgattggcagtcattctggttgatctttacgggttacactgtggctatcaccgcactttatctgatttacttagtggttccgcagaagaaaacaaaagttgtagaagcacattaa

SEQ ID NO: 3949 - DNA, 1488 bp, Proteus mirabilis
gtaatgtcagaagctttgcagaaatcaccagaagaacaactcatagaagatatcgcatcatttacgcatgatccattaggctatgcgtattacgcgtttccgtggggggaagctggtggagagcttgaagaatacaatggtcctcgccagtggcaagccgaagcattaaatgaaatcggtgaacatctacgcaatccaaagacacgccaccagccattgttacttgctcgtgcttctggtcacggtatcggtaaatctgcctttatttcaatgatcatcaagtggggtatggatacctgcgaagattgtaaggtagtcgtcactgctaacaccgaaaatcaactacgcactaaaacgtggccagaaatagcgaaatggcaacgtctatcacttaccaataattggtttacttgcactaagacagctatctattcaaatgatcctaatcacgctaatgcttggcgtgctgatgcggtaccgtggtcagagaacaacacggaggcattcgcagggcttcacaacaaaggtaagcgtattatcttagtgtttgatgaagcgtctaacattgccgatcttgtatgggaagttgccgaaggggcgttaacggatgaaggtaccgaaatcatttggatagcatttggtaacccaacccgtaacacagggcgctttcgtgagtgctttcgtaagtttaaacatcgttggaataccaagcagattgatagccgtaccgttgaaggtagcaacaaagagcagattaaaaactgggaagaggactacggcgaagatagcgacttctttaaagtccgtgttcgtggtgtgttcccgtcagcatcagaactacagtttattccaacaggcttaacggatgaagccatgaaacgcattgtcacacaagctgaagttgctcatgcgcccgtaatcattggtgttgaccccgcctattctggtattgatgatgcggtgatttatctgcgccaaggtttatttagtaaatgtttgtggacgggctttaaaacaactgacgatgttgttatggcaaagcgcattgctgactttgaagatcaatacaaggctgacgctgttcatatcgactttggatatggtaccggtattcactctattggaacaagttgggggcgcgtgtggcgtttagttaagtttggtggtgcatcaactgatccacaaatgctgaacaaacgcggtgaaatgtataacagcgttaagacatggctaaaaattggcggtgctattgacgatcaagaaaccgcagatgatttgtcatgtggtgaatacaaagttcgtgttattgatagcaagattgtactagaagataaaacagaaattaaaaaacgtcttggtcgttcacctggtaaaggtgatgcactagcactgacattcgcctatccagtcactaaaatagatagaaattacacctcacctcattctggcgttaatgtcagcaattcagattacgatccattcgcataa

SEQ ID NO: 3950 - DNA, 462 bp, Proteus mirabilis
ttatatacagatacaaagatgattagtgatgtgggggctttcatgaaacaaataattattattgcaggaggaattatatcattgactattatgattgctatttttgttgcaatcttagttgtttctgtatttaaagaagataccgttgctgcttggaataatagccgtaatgttattgaaaactcctcaacacaaatcaacgatatgttttcttttgtcaaaggtaagcgtgatgatgtcatggcacgttatcaatcattagaaaacagtgaaagttgtaatcaactcgtgtctaaattagacagtgttgaaaaagcactagcggaaggtagtttgttacttcctcggtcatcaattgagcaaatttttgctattaaaaatagccttaatgatagctcatctccagcccaaagctttgcctgtgagcaagctattcaatttatagacagaattaatccataa

SEQ ID NO: 3951 - DNA, 222 bp, Proteus mirabilis
tttaaagcagagaaattacgccgtattatgggttctgcttgtagctccattgccaaacgtgcatttgacactacagccggtacatgcaaattaatactgcaacctgaaaacttattggcgatcaaagcggcagattccgcagtagtaaaatcaggttgtggggctacagccccaatcatttgtaacacggtgacattttctagtgttttagtggggagatag

SEQ ID NO: 3952 - DNA, 1221 bp, Proteus mirabilis
atgaaagcagagcgtcataaaaaaattgttaatctgatcaaaggtcatggtgcagtaaaagtttctgttttagcaaaagagcttagtgttaccaaagaaacgatacgatcagatttaaatacattggctgagaaaggaataattaaaagatgccatggtggggcctttattgaatttgaaacattagacaaagttgccaaaaaagaaatcatacaatttttagaatgtaatgatcaaattgataaaattaatttagcggggcagccggcagtaaataaagtatgtgtattaggttcatttaatgttgatatgattagttatttgcccagactgccagaaaccggggaatctttattggcgaataaatttatcttctcaccaggaggtaaaggatgtaatcaagcattagcggcaagttatgctgatgcacaggtgcattttatcaccaaaatcggtactgatcagtttagtgattatgcagtaaattttatatcgtcatcaagaataaaaacatcaacgatatatcaaactgaaaatcatcaaactggaacagcatcaatctttgtgtcagaagagagtggtgaaaatattatttctatttattcaggggctaatatggatatttcttctgatgaggtaaaaatacaaaaagataaaattatagatgccgatataattttattgcaattagaaactaatattgaagcattaaaggaaattatttcaatcggaaatgaaaataatattcccattattttaaatcctgcaccttacaataaaattattgataagctattgccaatgctagatatattaacacctaatgaaacagaagccagcttattatcaggtattgaagttgttgatttagtatctgctaaaaatgcagccaatgctatttatcaaaaaggtgttaataaagttgtcattactttaggtagtaaaggttcattagcttatgacggttataaatatatttactcaccagcttatcctgcggtggtaaaaaatacagcgggcgctggtgatgcttttaatggtgcactagcagcctcactagcaaaaggaaagcagttttcttacgcgttacgctatgcatcagcttttgcatcactagctgttgagacgagtaatgcttcagaaatgcctgaagatattaatgtcatgcatcgcatcaatcaaacaacatattcacagattgtcactcaatcccctgaataa

SEQ ID NO: 3953 - DNA, 696 bp, Proteus mirabilis
agaatgggagaagcagtcatgaacttatggcagaaactaatcatgcgtcgcttgtataacgagcaacacagcgagggaggtgaaggcggtggtggtacagcaacggaacctactcaagaaacatcagcaacagataaaaatgagccaccagcaaacagtgatgatcctaataaaagcactgaaaaagagaatggtggagagcagggcaagccggctgataagaaaaatgatgccaataaatcagatgtaggtgcgcctgaaaagtatgaatttaaagcaccagaagaagggcaagagcttgataaaggtgcattggaagtctttgagcctattgctcgtgagctgaatttaaacaatgaacaagcgcaaaaactggttgatgtttatggctctaaaatcatgcctgctattcagaaacaaatcaatgatggttggcaaaagcagactgagcaatgggctaaaactgttaaagcagatgaagaattaggatcaaatgagtctattggtgcagcacaaaaggcattagatacctatggttctgatgatttgaaattgtatttaacagaaacagggttaggtaatcacccagagattattcgggctttcgccaagataggcaaagcaatgtcagaggacggtcttgtcactggcaacagtaacggcagtaaaagtgctgctgatgttttatttggataa

SEQ ID NO: 3954 - DNA, 666 bp, Proteus mirabilis
ttttatttggagttttgtatggatgttgattgggggttgatggtcgcagtgttatctatgttttttacaatgtttattggtgtaataacgattaggtatactaaaaaatcattaggatatacgaagaaatcaaccgaaattgcagatgaatcattaagagccgcaaaaaaatcagttgatacaactattagaatttataggcaacagagaataaatgaatataaaaataataaaaaggcagttattgcatataaaaaattaatatcagaagaattaaaagaaaattatatttatttgtctaatgtttgtaaattcattgatttttatttattgaactatagttttgataaaaattatgtaggtaacagtccattatactcagtagtcaataatggcgatgaagttaacatgatatttaggaaaaacactactttttatattgatgaatttttgcatgatattacaaaaattgatctacaattttctataaaattaattgacttaaaaagaaagattaatttttcaaatgaattacttatgttaatgaaagttgagttagataataattcacataagcgtttttctattgattataaaagtgaattaacgctattacttaatcaagtaaaaagtatttattatgaatgtactggtgagaacttatag

SEQ ID NO: 3955 - DNA, 363 bp, Proteus mirabilis
aagagcttggaggcacatgtagagctagccaagttgcagctatttttgggagtaaaacgtcaaacgattaataatcggttaaaggctaataaactattagcggttaaagtgggaggagaatatcgattacctatttttcaatttgatggtaatcgattagtggatggattagatgagatcttaattttattggatagtttaagctcaacaacaaaagtatcatttttaacgagtatgtatttttttgaggatgaacaagatattaatgttattgatgcgcttaaaaaatatggacgcatgagtgaacaaatgcaagaaattattcatcaagctaaactttttggaaaacatatttcaaactaa

SEQ ID NO: 3956 - DNA, 2226 bp, Proteus mirabilis
gtaacgatggatattaccgagttttatcaaacattttttgatgaagcagatgagttgttagctgatatggaacagcatttactgttacttgatccgcaaaacccagatcaagagcagttaaatgctatttttcgtagtgcgcactccataaaaggaggagccgcaacatttggcttcgttaaacttcagcagaccactcatgtgctggaaaacttgctcgatagtgcaagacgccatgaaatggtacttaccgatgacattattaacctgtttctggaagcgaaagatattatgcaacagcaattggatgcacataaaaactcacaagagccagacgaggaaacatttaactatatttgtgagaagttgcgtcagttagctctagaagtcaaagaggaacaatcaactcaattaggtgaggggaatgactcagtatctttaactgaaagtaatgccccaacggagaacatcactcctgtttctgcagtgcatcatactgacgatgagcttagtaaagaaaatcaaccgctagcaacggctaatacaccaaatactgacggtctttatcagcatcatattattttatctgatttaaaagagaccgatattgatttaatgctagatgaattaaagcatctgggtgaagtcagtcaggttgaaaaacagcaccatgggttggaagcggtattaaaaaccacagcaactcaagaagatatcagtgcggtattatgttttgtgattgaaccagaacagatttcctttgctaacgttgctgctactgaggaaaaggtaacgtctacagataaaacgcaagagcaagccgaacactcaccctcatctgtgacagaaagtatccagcctgctgctcaaacagagcagccagctacgatagagaaaaacgttgctgagttgaataaaaatagtcaagcagatgaagtgactaaagttgccacaaccttgccaccaactgcgacaccagcccctgcgcgaaaacctgttgttgctcaggccaaaacggaatcaaccagtattcgcgttgcggttgaaaaggtggaccaactgattaacttggtcggggaattggtgatcactcagtctatgttagcgcaacatagtgacacgcttgagccatctattcatagtgatctactcagttgtattgcacagctacagcgtaactctcgtgatctgcaagagtcagtgatgtctatccgtatgatgccgatggaatatgtttttagtcgttttccgcgggtcgttcgtgatttagctggcaaaatgcataaaaaagttgagttaaatatgattggtagttcaactgaacttgataaaagtttaattgagaaaatcatcgatcctttaactcacttagtccgtaatagtcttgatcatggtattgaaatgcctgccgatcgcattgccgcgggcaaaccagaggcgggtcaattaacgctttcagcagagcatcaaggtggcaatatttgtattgaagtgacagatgatggtgctggattaaatcgtgagcgtattttgaaaaaggcgatatcatcgggcttagctgtttctgaaaatatgagcaatgaagaagttgcgatgttgatatttgcgccaggtttctctaccgctgaggttgtcaccgatgtttctggacgtggtgtgggtatggatgttgtaaaacgaaatatccaagaaatgggggggcaaattcaaattagttttgaagttggaaaaggtacacgcattcgcatcttgctgccactcacattggccattttagatggcatgtcagtaaaagtgaatgatgaagtatttattttaccattaggaacagtggttagctcattacaacctgaagaggaagatatttatcctttagcaggagatgaaaaattattgcaagtaagaggtgaatatttaccgcttattgaattacaccgtacttttaatattgaaggtgcgcaaaccgatattactcaagcgattgcggttatcgtacaaagtgcagggcgccgttatgctttattggtcgataagttagttggtcaacatcaagtggttgttaaaaatatagaaagcaattaccgaaaagtaccgggtatttctgctgccacaatcatgggcgatggtagtgttgctttaattcttgatgttccagaattacaacgtttaagtcattctcaaatgacagaaaagaaaaagaatacaactgcgcatacagttatttaa

SEQ ID NO: 3957 - DNA, 1434 bp, Proteus mirabilis
tactttacggagaacaacttgatggagataacgcttctgaccatggatgtcacagcaacctctccgggaacgacatccgctacaacaagtcaacccggtgataatgcgtcgacatttgcacaacttctgagtactcaacctcagaatacacccagtgataaaaaaaacgcctctatttcaggccattcctcaaaagagaataaggcgcacaatcacactgaaaaaaataaagaccaacaaaatgatgacgatattgatactattgtcactgaatatgcggcattagaggcgccagcaacgaaaaatacccatcttgccctctcgttacctgataatgagcaatttagctcaattcttgaaaataaaacggcctcttcattaatgtccgcagaagaattagcggcagagcttccagtacaacttgccggacttgcagggttaaaatctacatcgctttcagccaaccaagctcatcagccacatttattgggaacctcgttaaagcatgctgggaatggaaacgagttatctcaccttatggcagaaaatgcccgtgctgaacgtgatcttgtcgataaatggcaacaattcaatacgcaagctaatgcagatgacaaatcattacttgctcaattacgccctgagacagcgtcattaacccaacttgcaacacatgaagctcgccatttaacgaatgggcattcagcaaagaaagttgataacgcttcactgttatcttccgtggcagaaaaagcggatggattgttagccgatgacaaagcatcagccaatacaaaattaaccgataatctggcaaaccaaataatcggtaataaccgtattgctgaacgcgatctacacaatagattatcgacctcttcggtgtttgcctcttcatcagtagcaagtcatgcgcaaccgtcatcaatgatgcaagcgcaaatgcactttccttcgatgcctaccccgatgttaaatgcacaaataggcacaccggaatggcaacagcaactcaatcagcaaattgtgatgtttagtcgtaatggtttacaaaaagctgagctacgtttacatcccgaagagttgggttcattacatattcgcatgaaaattgaagatggacaggctcaattacatcttgcctctcaaaatggacaagtgcgtactgtgttagaaaattccctgcatcatttgcgtcaagcgctctctgaaaatgggatacaactcacacaaagtcaagtgtctagcgacagtcatgacggttggcaacaacaaaatatgtcagattcctctcaatttagtggaaatggtgccgataatcatcaaagaagcgagggtaattctatgcaattagcctcagaaacggcacaaaagataacccttacgcctcaagagttagcctctgctcgtggtggtgtcgatatttttgcctaa

SEQ ID NO: 3958 - DNA, 504 bp, Proteus mirabilis
agacataaggatatacctatgaaaataaaatcacttattgctatttcattattaagtgttagtgcttctctttttgccgctgaaagcaccagcacaacacaacaagttcaaggcgtaactcaagcacaaaaagatctcaatgattatgaaaaagtcatggtagaaaaagtttgggttaccacgcaagccattgacgagaaaggcaataaagttgacgctaataatccacaagtcagtaattattttggcctagcagaatattatcctaatggcacttttattatgtttacccctgaaggtaaacaaaaaatgcaaggggattggtcaatgtctaatgatggaaaaacgcgtacattagttgccaaagatgcacaaggaaaaacactatttactcgtgatgtagaaaatatcaccatcaataatgatgagtatacctatcgtatttacccaactgaaggggataatactgtttattttgatattattcatcacgttaagaaataa

SEQ ID NO: 3959 - DNA, 858 bp, Proteus mirabilis
cgatgtaaggataggttatatacgttattacataaggggattaatttgacagggctaattaactttgcaaataacattttatggggatatgtacttatttacttactccttggtgtgggtatttatttcactattcgaacaggatttattcaaatccgccattttggtcatatgttttctattttaaaaaatagtcataagtcagataaatcaggtatctcttcattccaagctttatgtacaagtttagctgcacgtgttggaacaggtaacttaaccggtgtagcaattgcgctgaccgcaggtggccctggggccattttttggatgtgggtagttgcaattataggtatggcgacttccttaatagaaagtacattagcacagttgtataaaactaaagatgatgaaggtaactatcgcggtggccctgcttattatatgacaaaaggtctcaatatgcgttggatgggcgtattattcgccattttcctcatcattgccttcggacttgtttttaatgcggtacaagctaactcaatagcgcaagcagctgcatcagcatttaatttcgatccattatatgttggtattggactggtggtgatgagcggctttattatttttggcggtctacgttggattgcgcgtgttgctgagctggttgtacccattatggctatcgcctatttattattagcattttgggttgtcgccgatcattttgaacgtttacctgaagtgtttatgctaatttttaaaagcgcatttggtttacaggaagccgcagcaggggcaattggctatggtattagttcaagcgatgacccaaggtattcaacgcggcctattttctaa

SEQ ID NO: 3960 - DNA, 2187 bp, Proteus mirabilis
cataacaaggaattaaacatgttatccgcgacaagaaaaacggtgacgcagggattaacaggtgccatgatggcaatcttgatcactgcaacaccgacaatggctcaaacagagaaggacgttattatgatgccaccgaaagcgaataaaatcccccatgtgatgacagaacatggtgactctcgtactgataattattattggcttagggatgatgcacgcaaagataaacaagttattgactatcttaaggctgaaaatgcttatactgagtcagtaatggcagcgggcaaaacactagaaaatacgctctataatgagatggtcgagcgtatggcacaaaatgatgcctcagtgccttatgactataatggctatacttaccaaaccatttaccaagaaggtaaagactttcctatttatcaacgtaaaccaataggaagtgatggagaatgggaaattcttgttgatggtaatgaacgagctaaaggacatgagttttatcaattaggtgatttagccattagtccagataacaaacgtattgctattgctgaagataaagaaggacgtcgcaactatacagttgcttataaagatctgacagacaaaacatggcaagagaatgttttaaccaatatttcagcgaatttagtatgggcaaatgatagccaaacactgttctatgtagataaagatccgcaaactttattgccataccagatttatcgccatcaatacggtagtgatagaaaacaagacgtgaaaatctttgaagagaatgatgatcgtttttatacctggatggaaaaaagcaaatcagaagattatattctagtcactattgcaagctctacaacttctgaatatcgtttaattgatgccaatgcaccagaaaaacccatggtggttttttctcctcgccaagaagggcgagaatattatatcgatcattttaaaggtgaattttatattcgctctaatcatgaaagtgagctatatggtctttataaaacggcctctattgatgcaccttggcaaaccgtaattgctcctcagccagaagtagacttggaaagcttcgaactgtttaatcgttggttagtgcttgaagagcgcaaacaaggtttagtgtcattacgccaaattgattggaaaacaggacaatcaacaaatattatttttgatgatcctgtctatatggcatggctaagtgtcaatccacaagctgatagcgaagagttacgttttggttatacctcaatgactacgccttcttctacctatcaatggaatatgcaaaccaaagaaaaacaattgcttaaacagcaggaagtgaaaggctttaagcatgatttgtatgaaagtgaacgtatttgggtaaaagcacaagatggtgtcgaggtgcctgtatcgctggtttatcgtaaagacttatttaagaaaggcgaaaatccaatcttaatttacggttatggctcttacggcagcagtatcgacccctcgtttagctctgcccgtttaagtttattagatagaggttttgtatatgccattgtccatgttagaggtggtggtgaattaggcaaacgctggtataaccaagggaaaatggagcataaagtcaactcctttactgactttatcgacgccacaaaataccttattaaccaaggttatggtgcacccaaacatgtctacgcgatgggcggtagtgctggtggattacttatgggagccgttattaatatggctcctgaactctaccgtggtgttgtggctcaggtaccatttgtcgatgttttgacaaccatgctggatgcttctattccgctcacaacaggtgaatatgaagagtggggtgatcctgcggataaagacgtttatttccgcttaaaatcttatagcccttacgataatgttgaggctaaagcctatcctcatttattggtcactacaggtttacatgattctcaagttcaatattgggagccggcaaaatgggtggctaaattacgtgaattaaaaacagataataatttacttctgcttgaaaccgatatgagtgcaggacatggaggtaaatccggtcgttttaatcgtctacgtgatactgcgagagaatatgcctttattttaatgttagagcagcctgatatttattttaagacacaaaatatcaagtaa

SEQ ID NO: 3961 - DNA, 417 bp, Proteus mirabilis
tttcctcgggatcttactttaaacaagatcctctttgttcaatataatcggacgggatgtaaagagatgagtacggttgaattgcttaagcatatttatgacataaatttatcgtatttgcttttggcgcagaggttaattaaccaagaaaaggcttccgcaatgtttagactgggtatcagcgattctatggctgatgcactaaaagagctaacattgcctcaattggttaagttggctgaaacaaaccaactaatctgtaatttccggtttgaagacagcgaaacaatagaacaactcactaaagaatccagagtggatgatttgcaacaaattcatactggtatccttctttcttctaacttgttccgtcaactatcggaacatgatacctctgctacaaagaaacgggcataa

SEQ ID NO: 3962 - DNA, 1077 bp, Proteus mirabilis
ataattggtttaggaaaatacttgatgaaactgaccattgacaatataaagccttaccttttatttgaaacaatttcaggtagtcgttcacaaaatttggcaacagatagttcagatactgatattaaaggtgttttttatctacctaaagagatgttttattgctctgattatgtgccacaagtaagtaataaaactaatgatatcgtttattatgaattagggcgatttgttgaattactgtgtgcgtctaatcctaatattttagaattattaaatgcaccagagcatgttgttatttatcgtcatccattatttatgcaatttaacccagaatggtttttatcaaaggaatgcgtacagacttttgtgcattatgctcaagggcaaataaaaaaagcgcaagggttaaataagaagatcatggatcctatagataaagagttaaaaacaatccttgatttctgttatatcattgaagatggaaaaagcctattactcaataattggcttaaaaaacgttgttgggagcagcaaaatattgggttggttaaaatcaatcatgcacaaaatctttatgcagttttttatgatccaaatagtgattatcaaggcgtaataaaaaaagataatgccaccgatgttttactaagcagtgtctctgaaacagctatattacaagcctatcttagttttaataaagacggctacagtacctattgcaagcagtatcatgcttattggcaatgggttgaggagcgtaatgaagcccgctatcagcaaaatattgaacatggacgaagttacgatagtaaaaatatgatgcacacttttaggttgctttatattgcattaggaattgctactgaaaaaaaagtcaaagtttggtgtgataacagggatgaattgttagaaattaaatctggggctttaagttatgaaacattatttgagcgaagcaaaatattaatagaaaaaattgagcaagcttttcaacaaagtcaattaccagaaaaaatcaatcctcaattaattaaacaagtattagtgaatattcgtaaagaattatatcaataa

SEQ ID NO: 3963 - DNA, 777 bp, Proteus mirabilis
atatactcactgaattttaatataaatttagtagggttcctgttacttaatgagtataacacaatgaataatcaatcaaaaaaatatgacagaacatatcactatcctttttcaccaggcacaacaagcgatgatcgtattaatgccaattggtggcaagatatctgcaaaataaagcatcttattcatactgaaaaattagatggtgaaaataattgcttaaatcgaatgggagtttttgctcgctctcatgcgactccgacacaatctgcatggacagtacaactacgccagcgttggcaatccatcagaaatgatttaggtaatttagatatttttggtgaaaatctttatgccattcattctattgaataccaacatttggaagagtatttctatgtttttgccatacgttgtcaggataaatggctaagttgggaagaagtgcaattttatgccactttatttgatttacccaccgtaccggaaatctcgctaccaaaatcggaaaataaaatagagtttgaaaagaatattattttacacgcacaaaagcatagctcttttcaatcacgagatgtgttaaccaagaaaccaagtgcgatggaaggcattgtcacacgagatgctcaagcattttcattagatgaattttcacatcgggtgtttaaatatgtgagaaaagatcatgttaaaacagatgtgcattggaaacgtaattggaaaagagcgccactgatttgggaaaaaacacaggagtctcatgatgcttcataa

SEQ ID NO: 3964 - DNA, 354 bp, Proteus mirabilis
cacctcacactaatcagagataacagagataatttaggtgtttttataatgcaaagaaaaatgaaagtaacgtgttttttgttgatgttgaccagctttgcgttgcttactggctgtagtcaatctaaacaagcacaaaataccaccgctcaagtgattaatagcaataaaacgatagcgaccacaccttctattcctttagaggaaccagcaaaagagacctgtatattttctggtggagtgcctgcgttaacttatgaattacacggcggtcaaacacccgtttgtcaatttgctaatggtaaacgttgtagtgaacaagcgttgattgatggtgcctgtattccaggttaa

SEQ ID NO: 3965 - DNA, 186 bp, Proteus mirabilis
aggatcacactgcttgcccccctgctttatagccatttattatgcttcttttcctgctggatcaggattaaacacctatttcttcttacatctctgtcagaatttgttactatcaattctcttttcgttattcaaacactatttttacaagataattacctagtaattaggctaaatatagaataa

SEQ ID NO: 3966 - DNA, 1719 bp, Proteus mirabilis
aaagggaaactcatgtttagccgaatgaaaatagtgactgggttgttatccattcttctgttgtttggtgttttgcagtttatctccgggggtgttttttactcaaatctcagtgaaacaagacaagatctggataaaactctcacaatacaaaaacagcgtgaacgtttagatgaaagctgggcaaacttattgcaagcgcgtaacaatatcaatcgtgcagctataagctatctgttacaggataaagatctgaatgttgatagctcgttgtctgtagaatatttaactggtctggcacgtaaaaatatgtctcgggccgatgataaatttaaagagtttgaacagcatataaatgcttatcaaattcattcacaagaagaaatacgcaatttaaaagggcgttttattgagtatttttctgcattaaatcagttagaaattttactgcaagataaaaacttaaaagattttttcgaacaaccaacgacttcttatcaagatggtttttataaagagtatcttgcttatgttatgcgtaatgagaagtttaataatcaattaaatagtgcattagaagcttctcatcagcgttctattatcacgatggtgatattagccattattgttgttacagcactcatcatttgttggtttgcactacgcaatgcattaattcgaccacttaattcattgttattaaatattaaagcattttctgaaggggatctacgtcccgatatcgaggtgcatggacgtaatgaaatgagcttattagcaagtggcttaaagcacatgcaacaagagcttatacatactgttcgtggagtttatcaaagtactgagaatatctataacagcaccagtgaaattgccgcaggtaataatgatttatcctcacgtactgaggagcaagttgcttcattagaagagactgctgcgagtatggagcagttaacggcgacagtaaaacaaaatgctgataatgcacgtcaagcaagtaaccttgccaatgatgcctcagatattgcccgccaaggtggaaaagttgtggctaatgtggtgcaaacgatgcacgacatagccggaagttctcaaaaaatcaccgatattactgcagtgattgatggtatcgcatttcaaaccaatattttagcgttgaatgcggctgttgaagctgcgagagccggtgagcatggtcgcggatttgcggtagttgccggcgaagtccgtaatcttgcacagagaagtgcagaagctgctaaagaaataaaaacgttgattgaagactctgttagtcgcactgaaaccggatcggtattagttgaaagtgcaggggaaaccatgactcgtattgtcgaatctgtgacacgtgttaccgatattatgggggaaattgcctcggcatcggatgaacaaagtcgaggaatttcacaagtgggtcttgcggtttctgaaatggatcgtgttactcagcaaaacgcctctttagtagaacaatctgccgccgctgctgcgggtcttgaagatcaagcagttgcattaacccgcttagtttccatcttcaaattaccgggtcaggaagaaaaagcattagagaaaaaggaattggatgcactccctgtagtacaagccgctgctccacttataaaaccaggaacctcagaaaagaaaaagagcagcagtgttgaagatcccgctaactgggaaactttctaa

SEQ ID NO: 3967 - DNA, 579 bp, Proteus mirabilis
gagcgaccttggaatagctcgatttcacccggagattcttctgtacctgcaaacatagagccaaccattacacatgctgctccagcggctaatgctttagcaatatcaccagagaaacgaataccaccatcagcaatcaccggaatattgcgatctttcagtgcttcaacagcatcagcaatcgcagtgatttgtggaaccccaacacctgttacgatacgagtggtacaaatagagccagggccaatacccactttaacagcactcacacctgcatccgccagcgctaaagccccttctgcggttgccacattccccccaataataggtaagtttggatataaagcgcgagtttcacgaatacgctgtaataccccttcggaatggccatgtgaggagtcgataagaagaacatcaacaccagctgccactaatgcggcgatacgctcttcgttacctgcgccagcgccaaccgcagcacctacacgtaaacgaccatgctcatctttacatgcattaggcttgcgttctgcttttttgaaatctttaacggtgatcatgccttttaagtggaaatga

SEQ ID NO: 3968 - DNA, 186 bp, Proteus mirabilis
ggtgttacttgtgataatacagaaccccctattgaccattctcccgcgaaggctgtcggtgtactcaatccagcgattatggctaaagaaataacaattttctttttactcacgatgattttccatattgtctttgataaaacagtgaccaaaaaacgactgttgttatggtgcactaaaagttag

SEQ ID NO: 3969 - DNA, 453 bp, Proteus mirabilis
gatgcttattgtattaaattaaatatttatggtgatggtgaatttatgttaaagaaaatgatgggatttatgtttcttgcggtggcaatgatgacattatctgcatgtggtgataaacaagacgaagcaggaaaagccgcggttgaatttattgaagctgtcgcttccggtgatggtgataaggctgtgtcattaatgtattttggtgatttagaaaaagatccaatggcagagcaaattaccggcaaatttaaaatgatcgttgccgaagcgggcaaaaaaattaaagagcaaggtggcttgggtaaggttgaagtagcaaaagttgaatacagcgaagataaaaataaagccgttgtcacactcaaaacagtgttgaaaaatggtgaagaaaaaacagaaaatcaaaatatgatcaaagttgatggcaaatggaaagttgaagttaagtga

SEQ ID NO: 3970 - DNA, 657 bp, Proteus mirabilis
acacataattgtacttctttggttgggggtcaattgtgtgtatatggaaacaccccaaccgaggctattgttatgagtttttacgccacaattattctcgcccttgctctttctatggacgcatttgccgtcgcagtctgtaaaggcgccaccttacataaacctcattttcgtgaagccctccgcaccggttttatctttggtattattgaagcaagcaccccgattattggttgggcattaggtttatataccagtcaatatattattcagtgggatcactgggtcgcctttggtttattggttatcttgggtggacgaatgatttatcagagtttaaagcgtggtgatgattgcatttgtgaagaggctcctcaacgtcacggttcactctctttaattgcgacaggtattgccaccagccttgatgcgatggcaattggtgtcggcttagcctttctacaagtcgatattgtccataccgcgatgaccatcggtatgatgactatgattatggcaacactgggtatgctgatcggtcgctatattggccctgtgcttggcaaaaaagctgaaattatcgggggtatggtgttgattgctatcggctttaatattctttttgaacatcttgatctgtttatgtacgcacattaa

SEQ ID NO: 3971 - DNA, 3156 bp, Proteus mirabilis
tcccgttgttgcggagaaagcataatgagcgaaaaaatccccgctacaggtggtgggccatctcgtttatttattttacgtccagtggcaacaacgctgtttatggtcgcgattttattagcaggaattgtcggttatcgtatgctgccagtgtcggcattacctgaagttgattatccgaccattcaagtcgtcacactctatcctggggcaaaccccgaggtgatgacctctgcggtaacagcaccgttagagcgtcaatttggacagatgtcaggcttaaaacagatgtcctcacaaagttcaggtggggcatcagtcattacactgatgttccaactcacattaccgttagatgtcgcagagcaagaagtacaagcggccattaatgcagcaactaacttattacctactgatttaccttatccgcccatttacagcaaagtaaatccggctgatccgccagtgttaaccttagccgtcaccagctctgtattgccgatgacacagctacaggatatggtagaaacgcgaatatcgcagaaaatatcgcaagttaacggcgttggtttagtctctttagccggcggacaacgccctgctgtgcgcgtaaaattgaatgcccaagcagccgcctcttatgggttagatagtgaaacaatccgcgtggctattaataatgccaatgttaactctgccaaaggtagccttgatggccccactcgctcggtaacgttatccgccaacgatcaaatgaaatcattagatgattatcgcaaactgattgttagctataaaaatggcgcccccatccgccttgccgatattgccaccattgaacaagccccagaaaataaccagcttggtgcttgggccaataatcaacaagccattattatcaatgtgcaacgccaaccgggtgttaatgttattgaaacaacggataatattcgtaatttattaccggatttagtgtctaatttacctaagtcggtaaatgttgagatcttaaccgatagaaccacgaccattcgggcatcagtgaaagatgtccagtttgaactgggactggcgattgcacttgtggtcatggttatctatctatttttacgtaatggtgttgccactcttattcctagcattgccgtccccctctccttagtgggtacttttgcggtgatgtatttttgcggtttttctgtcaataacctcaccttaatggcacttaccattgcgacaggctttgtggttgatgacgccattgtggtgatagaaaatatctcccgttatctagagcgaggagataagccgttaaccgcagccttaaaaggggcgggagaaatcggctttactattatctcactgactttttctttaattgccgtactgatccctctgttatttatgggagatattgttggtcgtttatttagagagtttgccattaccttagccgtggcgattttaatttccgcggtagtctctttaaccttaacgccgatgatgtgcgcacgcttacttaaaccagaaagtcaaattaagcacaatcgttttgaaatggcttgtgagcgcttttttgaaaagatgatcgccgtgtatgcggtttggttaaaacgtgtattaaatcatcaatggataacattaggtgttgccctcagtacattagcattaacagttttgctctatctatttatccctaaaggctttttccctttacaagataatgggttactacaaggtacaatagaaacctcacaatccatctcttatcaagcgatggttgaaaaacaacaacaagtggttgagaaactgattgacgatccggccgttgagaatattgcgagttttgtgggtatcgatggcagtaatgccaccctcaatacaggtcgcttgcaaattaccttaaaacccctcgatcaacgtgattcacgcattgatgaaattattcctcgtttacaagcacgagtcgcatctattgcaggtattacactctatttacaacccacacaagacttaactattgatacacaagtttcccgtactcaatatcaatttaccttgcaagcaacctcgctcgatgagcttgcctattgggtgcctaaattatcacaggcactacaagagagtccggaacttaccgacatcagcagtgattggcaagctgatgggatgatggcctatatcaatgtagatagagattcagccagtcgcttagggatctcaatgagtgccattgataatgcgctgtataatgcctttggacagcgacttatttcaacgatttacacccaagcaaatcagtatcgtgttgtcttagaacagaatatgcacaatagtgaaggactacaggcactttctgcagttcatttaaccggcaaagagggtgctatggtgccactcttatctattgcctctgtggagcaacgtctcgcgcctttatctatcaatcaccaagagcaatttcctgctaccacattctcatttaatgtcgcgaaagacgcatctcttgaagctgctgttaatgccgttaagcaagcagaagagcaaattgcgatgccaaaagatattacgacacagtttcaaggggctacattagcttttgaaagcgccctttccagcacgctgtggcttatcattgcggccatcgttgctatgtatattgtattaggcgtgttatacgaaagttttattcacccaattactattttatctaccctacctactgcgggtgtcggtgctttattggcactgatggcagccggtaatgagctagatattattgcgattattggcatcattttgttgattggtattgttaagaaaaatgccatcatgatgatcgatttcgcactggccgctgaaagagaacaaggactatctccttacgaagcaatttatcaagcttgtctgctacgttttcgccctattttaatgaccactatggctgcgttattaggtgcattacctttaatgctaagcactggcgtaggggctgaattacgccaaccattaggtgtatgcatggtgggaggcttaattatgagtcaaatactcaccttatttaccacccctgttatctatttgctgtttgataagttatcactttaccttaatcgccataaacgcgttgaacatgataatggagcggtgtcatga

SEQ ID NO: 3972 - DNA, 204 bp, Proteus mirabilis
catactacctgtattatcaagatagcactagaaaaaaatgtttatatttattattcattttctctcaatttttttcgttatttaacactccatgatgattgttcatctatccttaatagggtgacaacgctaataatgtcactctatgggtatttatacttaaataatgataaatatcttaatcctcagtcgctgtttacataa

SEQ ID NO: 3973 - DNA, 822 bp, Proteus mirabilis
cttatttactggcattccaggaatgattggctaataacaatgataaccttgaccagtgaaatacttaatggctacatcagtgattttttctggccatttgtgcgtattttggcactctttagtaccgcgcctttgtttagtgaaaaacagacacctaaaaaatttcgtattggactcgcctttttaaccacggcgttaattgcaccagggctaccgcaaagtcaagtacctctcttttctatcatggctttttgggtactgatccaacaaattttaattggcacaattttaggcttatctatgcagttagcttttgcttctgtacgtcatgcaggagaagtgattggtttacagatggggctgtcatttgcgactttcgtcgatccttcaggtggcccgaatatgcctattcttgctcgtatctttaacatgttaaccatgttgctttttatggtgtttgatgggcatttatggctgttatcgatattagcagataccttctatgttgttcctattgaaaatcagacctttaattcattgggtatccttactttagtacaaagtggtggcactatatttattaacgggatgatgttagccatgccattaatcactctactattagtgctcaacctttcattaggtattttaaaccgtatgacaccacagctttctgtttttgtggtcggtttccctcttaccctcacgatcggtatgttggcgttatcaatgatcatgcccgctcttcctgtctttactgagcgagtctttagcgatacgtttaatcgtattaccttaatattgcagcaattagtttcttga

SEQ ID NO: 3974 - DNA, 1491 bp, Proteus mirabilis
ctatcaggatgttgttgtatgaaactcagacttaaaaaaccactggtcgcgcttcttgtttctactttgctatcaacatcagtgttgcctgctcacgctgcgattgatattgaagataccctgcccgatatgggaacgacagcaggctcaacattgagtatcaatcaagaaatcgctatgggtgattactatactcgccaattaagaaatagtgcaccattagtttttgaccctctactttctaattacatcaataacttaggtcaaagattagtctctaatgccagttcggtaaaaaccccctttcacttttatttagtgaataaccccaatattaatgcctttgcttattttggtggcaatatcgtattgcactcagcactatttagatacagtcgcaatgaaagtgaattagcttctgttatcgcccacgaaatttctcacgttacccagcgtcatcttgcaagaatgttagaagatcagtctaaaaccacgccactggctatggctggaatattaggctctattttaatatttatggctaaccccaatgctggtttagccacctttacgggaagtatggctgggatgcaacaaaacatgatcaccttcacgcaaatgaacgaacaagaagctgatcggataggaatacaaactctttatcgtgcagggtttgatccacaaggtatgcctaattttatgcagatcttagcagaccaagtgcgctatagttctaagccgcctgaaatgctattaacgcaccccttacctgacagccgtttatctgatgcacgtagccgagcagcgcaatatgctccgcgcaaagtgccacaatcggctaattttctctatgctaaaatgcgggtattgaccatgcttgagaaaaaccccgcatcaagtaacgccttgcaaaccacgctggatcagtttaggcaaggaacggaattagaaaaatcagccgccaattatgcacaagccttactctattctcgtgatcgtaaatttaatgacgcgagaaaaatactcgcccctatgctggcaaaagagccaaataatatctggcttattgatgccattaccgatattgacgtagagcaaaaccgtgctgcagaagcgataacacgtttacaacaagcgcttaagcaatcacctaacaacaaagtactgacggttaatttagctaatgcttatatgcaaaataagcaatataacgaagctaatcgattattatatcgctatacctttgacaatcctgacgatcctattggttggcaattggtggcggaaaatgcggcaaaacaaggtaatcgagcccaagagcttgcagcttacgctgaagatttggcattacgaggagattttgaaactgccattcgttatcttggtgatgcgagtcgtcaagtaaaattaggcagtaatgagcaagctcgttttgatgcacgtattgatcaattgcgtaaacttcaacataaagacagtcaatttaaataa

SEQ ID NO: 3975 - DNA, 2139 bp, Proteus mirabilis
acttgccagtgcctcccgcactggactttgctggagaagataatcgtcatggctaatttggcctcattactccgcttgccgggaaattggaaaagttctcagtggcagatactggcagggccagtacttattttgcttatactgtcaatgatggtactgccattgccaccttttctattggacttattgtttacctttaacattgccctttctatcatggtgctattagtggccatgtttactaggcgcacattggactttgctgcctttcctacaatactcctgttcactacattgttacgcttatcgcttaacgttgcatcaacacgtattatcttgatggaaggacatacaggttcagcagctgcagggcgtgttgttgaagcttttggtcatttcctcgtaggtggcaattttgctatcggtatcgttgtttttatcattcttattctgattaactttatggttatcaccaaaggtgcagggcgtattgctgaagtaggcgcacgctttgtattagatgggatgccgggtaagcagatggctatcgatgctgatttaaatgctgggatcataaacgaagaagaagctaaaaaacgtcgtaaagaagtctcgcttgagtctgacttttatggatctatggatggtgcaagtaaattcgtccgaggggatgcgattgccggcttaatgatcttggtaataaacgtcgttggtggtttagtggtcggtgttgcacaacataatatggcacttaacgatgcggcaagcacttataccttattaaccatcggtgatgggctggtggcacaaataccagcactgattatatcaacagcggcgggtgttattgttactcgcgttgcaaccgatgaagatgtcggtcaacaaatggtgacgcaactctttgataaccctcgtgtactaatgctaactgcgggcgttttaggattgctggggttagtaccaggtatgccaaactttgttttcctcttctttacggctgcattagcaggattaggatggtatatcttaaaacgccatagcagtcctcaagtgcaacaacaaaaagagttggaacaagttgaaaaacaaaaccgggttgttgaagcctcttgggaagatgtgcaattagaagatccgctgtcaatggaagtaggttatcgtcttattcccatggtcgacaatcgccaaaatggtgaattgttaggtcgaattagtggtattcgcaaaaagtttgcacaagaaatggggtatttacctcctgttgtacatattcgcgataatatggaagtaaaaccttcctcctaccgcattttaatgaaaggggtagaaatcggccatggcgaagctcatcctgggcgttggttggccataaaccctggtaatgcagtcggaacgctagaaggtgataacactcaagagccggcatttggtttacctgcagtatggattgatgacagtttaagagagcaagcacaagtacaaggctatacggttgtggcggcaagtacagtgattgcaacacattttaatcatgtacttaaccaatacgcatcagagttatttggtcgccaagaagcgcaaatgctatttgatagggtaagcaaagaactaccgaaaatgacggaaaatatgatccccgatatgctgtcattaacggtgttacataaagtattgcaaaacctgttggcagagcaagtgcctattcgcgatatgagaaccatattagaagcactagcagagcatgcacctgagcaaaaagatccggcagaattaacggcggtagttcgtgtggcattacgcagggcgataacacaacactggtttggtgataaagaagagatacaagttatcggattagatgcgggactagagcgtctattattacaagcgatgcaaagtggggggggattagagcctggccttgctgaaaacattgaacaacaagccttagatgcggtacgccgtcaagagatgtcagggggcgtgccagtactcttggttaaccatgcactacgttcgctgttatcgcgctttttacgccgtagcttgccacagttagcggtattatcaaatatggaaattagcgaaggtcgtcatattcgtatgacatcaatgattggtggacaaaatcattaa

SEQ ID NO: 3976 - DNA, 198 bp, Proteus mirabilis
aaacttattttaaatcaaaaaacgcattttaaaattatgttaagccgatttggtggagtggctttcctactaaaaacccatttgatgagtctattaattgtcctagcacacaaaatcgttactaaagggcttaagacaagatgcatttacttacatgcctctattgaaaactttggtgtcgtacatatcactcgatga

SEQ ID NO: 3977 - DNA, 348 bp, Proteus mirabilis
tgccttgtccgctatggctggtggaggtgctcaatgacacatccattcgatgcgtatgaagacgagagaattgctcgcactgaatacgatattcaacaaaaaaataggcaagagaaagaagaacaacagctaaaagaggttatgtccacagaagctgggcgtgctgttatttggcgtttgatttctgactctggcgtatttcgtagctctttttctaacgatccctatgcaatggcatttagagagggcgaacgtaactatgggttaaaagttttcaatcaattacaccaagtttgccctgagctttatgcgcaaatggcaaatgaagcaactacaccaagcgtttaa

SEQ ID NO: 3978 - DNA, 1755 bp, Proteus mirabilis
tattcatcccgaactacaaggcaaggattgtctatgaatgccgaaaaaaccgacgttgtgaaccagaaaaaaggttttaacgccattattaaccggataaaagccgatccgaaaattccgcttattattgcgggatcggcggcgattgccatttttgttgctgcttttttatggctacaaagccctgattataaagtgctttatagtaatcttagcgataaagatggtggcgaaattgtcacacagttaacacaaatgaatgtaccctatcgcctatcacaaaatggttctgcgattatggtacctgacaatcaggttcatgaattacgcctgaaactcgcacaagcggggcttccaaaaggtggagctgccggttttgaactacttgataaagaaaagtttgggatcagccagttcagtgaacagattaactatcaacgtgcacttgaaggggagcttgctcgtaccatcgaaaccttaggtccagtgcaaaatgctcgtgttcatttagcattacctaaaccctctctttttgttcgtgagcaaaaatcaccttctgcttctgtaacagtaggtctgctgcaaggtagagccttggacgaaggtcaaattaatgccatcgtacatattgtagcaagtagtgttgcaggtatgcccgatagtaatgtgaccattgttgatcaaagcggtaagttattaacacagcccgatgctttaggtcgtgatcttaattctattcaactcaaatatgtccaagagttggaaagtcgctaccagcaacgtattgaaacactattaggccctattgttggacgtggtaatgttcatgcgcaggtcaccgctcaagttgatttttctcatacagaagaaaccgcagaagagtacaagcctaatcagccccctaaccaagctgcagtacgctcaaaacaagtgagccaaagtgagcaaaatggaggcatgttagctggcggtgtgcccggtgcgttatctaatcaacctattgcaccaccgcaagcgccgattgaaaaagccaaagacacggcggctgatgagaaagcaacatctaccaatgctaatcgttcaatgacgcgtaatccaaacagcaatagccgtttagatgaaacaaccaactatgaagtagatcgtcgtattcgtcatgttaaacgacctgttggcaatattgagcgcctttctgttgcggtaatcgtcaattacaaaaccgtagaagacaagaaaaaagcaacagaaggtgaagagcctattgtcgaaaataaacaagttccgttaaccgatgaacagcttcaacaaattgaaagtttagtacgtgaagcgatgggttattcccaagagcgcggtgactctttaagtgtggttaattctcaatttaacgataccgaagagccagtgattagcgttcctatgtgggaaaatccacaaatattggctaaagcattagatttaggccgctggttattgcttgttatcatcgcgtggatcttatggcgtaaattagtgaaacctcaacttgaaaaacgccgtgaagcagaagtcgccgcacaaaaagcgattttgaaaaccaagcttgaagtgacagatgatgtcaacgaagccgaattagatgaagaatcaagacgtaaacaagcacgtcaacgtgttagtgccgaattacaaagccaacgcattcgagagatggcagaaaaagatcctcgtgttgtagccatggtaattcgtcaatggatgagtaaagaacaatga

SEQ ID NO: 3979 - DNA, 192 bp, Proteus mirabilis
ataagtgtgctcccgctcaatatgagcgggattatcttagcctttgattattttttagttattttgctaaatggtgtaaataatgatttaaaacatcaattgctgtatttcaattgtgctttttgtctcccctttctttttttattctgcaaaccccctataatcaactctttcttatcgcttaattcataa

SEQ ID NO: 3980 - DNA, 555 bp, Proteus mirabilis
gtgataatacgctttactcttgcattaactttatacttagcgagcacattgactgtgctcgctttcccttatcagttaaaaagtggtgatctggtttttcgcgatggtgatgaagttattagcgacataataaagcaagttgataacagcgggttcagccacgtaggaatgttgtggataactgagcaaggtatacaggttgttcactcaacacccagtgaacatgctgatagtaaagatggtgttactatcgatagtttggatttctttatcagtcgtgctaagcctaattctgtacgcttttaccaagtgcgtggaagtgaacaagcacgacaacaagcgttagaagctgttttaaatcgagtaggggaaaacttcagtattcagcaagataaaggtgtttattgtacagagctggtggctgatgcatggttaaaagcaggggtttctatttcaacgggcacacgtacattacatatgccgtttatttctgaaagagcacttatttttcctgataatattatccattccgaaaatgttattttgattgaataa

SEQ ID NO: 3981 - DNA, 750 bp, Proteus mirabilis
cagaaaaaacgcttcggaagaaataaaaatatggttattaaggctcaaagccccgcaggttttgcggaagagtacattgttgaaagtatttggaacaaccgttttccaccaggttctattctgcccgcagaacgtgagctttccgaattaattggtgtgacaagaacgacattgagagaggttttacaacgtttagctcgtgatggttggttaactatccagcatggaaaaccaaccaaagtgaataacttttgggaaacgtcaggtcttaatattcttgaaactgtcgcgcgtcttgatcatgatcgcgtgccacaattaatcgataatttattagccgtaagaacgaatatctcagcaatttttattcgcacggcatttaaaaataatccagaaaaatccctagaagtactgactcatcaactaacgactgaaaatagtgctgatgagtttagtgagttggactataacattttccgtggtttggcatttgccagcggtaatcctatttatggattgatcttaaacggacttaagggattatatacccgtgtagggcgttattatttctctaatgttcaggcgaaagagttggcgctatcattttataaaaaattggcgttgctatgtgaacaaaaagatactgagcatgttatggattgcgttcgccaatacggaaaagagagtggcattatttggcatgagctccaatcgccactacctagtgacttagaagaagtaaaacgttaa

SEQ ID NO: 3982 - DNA, 429 bp, Proteus mirabilis
ccgtatgaacgcaatgctggtggcggtacgcgcatgaaacagaaaatttattatatcaatcctgtaccaaagccacgtatgacacagcgtgacgcatggaagaaaagacccgttgtcgttaagtaccacgctttttgtgacgagatgagagctaaccgttttatgttacctgaaagcggtgctcacctaacgtttgttatccctatgcctaaatcatggagcaagaagaaacgcattgagatgaatggtaaacctcaccagcaacgtcctgatgtcgataatctgattaaagccgttatggacgccatctttgatgaagattgcagggtgtggaatatcagcgcgtcaaagctttggggtgagcagggaaagataggggtgacgttacctgaaaatacagaaaatcatgaacttattaccattcgttaa

SEQ ID NO: 3983 - DNA, 393 bp, Proteus mirabilis
cccaaacgacgattaatcacggactcagtgcaaggatgcaaacaggagatagatatgacagataaactcaaagaagaaataagtagcatcatggatagagcagcaatgggtaatgctaccgtctgcattttaaatcgctttgctaacaccgtccaaatagctgcatttttaattagcaaaggcaaagtaaaagaagctaccgattggctatatggtgctttggaatgggattctgaggttgatatttttggcgacctgaaagatagcgacggcaattcagaagatattcaaacttggttcgataagcagatagaaggcgaaattagctttgccgaagcaattgaattaatccgcaaacattacaccgaactcgaaaagctacggacagcttaa

SEQ ID NO: 3984 - DNA, 870 bp, Proteus mirabilis
ttaacagcgctaagtgaatggtgttttatgcgtgactatggaaaagtttccccacaattttggataggaaaaacaggtaaggaaataagagaaaaagggcatgaagcacttattgtctctatgtacttattaaccaatcctcacgccaatatgatcggaatgtattacctacctattatctatatggcgcacgaaacagggctaggtttagaaggggcttctaaggggcttctaaggtgcattgaagcaggtttttgccactatgatgaggatgctgaagttgtttgggtgatcgagatggcaaaatatcaaatagcatcatctttgaagccatcagataaccggtgtatcggtatacaaagagagtatgactctcagcctaaaaatcaatttctatcaatgttttatgataagtataaagatgcttttaatttaagttctgcaagagaatcatcgataaaaaatgaaaggggcttggaaggggctttgaagaccctacgaagccaagaacaggagcaggaacaagaacaagatataaaaccccctaaatcccccttgaaaaaaaagtcggtacaaaagcgaggttttaatatcttggaagaaaaaatacctgattggctaaatcctgaagtttgggagaagtggattgagtaccgaaaggaaatcaagcacccgataaaatcgaaacaaacgttcagtggacaaataaaattactcactgagtgttatgagttaggtttttcacctgaagaaataattagcaaaaccattacaaatggctggcaaggactattcaaaccaaacgtttcaccaccacaacggatcattcaacctcaaaagaacgatgagtttataccggaggacttctga

SEQ ID NO: 3985 - DNA, 1071 bp, Proteus mirabilis
acaatcaggcgcacgcttggagtaaatattatgtcagaagtagcaactctcgaaagaaaccaatcagtaatgaataacacatcattactttttaatcctgaatcattagaccgtattgttaaatttgctgagctaatggcatcaggtacagcaacggtgccaaggcatctgcaaggtaaaccatctgattgtcttgctatcacaatgcagtctgcacgctggggaatggatcctttcgttgtcggtcaaaaaacacatgtcatcaatggtgtgcttggttatgaagcccaattagtaaatgcagttattaccagttcaaatgctgttgtaggtcgattccattacaaatacggtggcgactgggaaaagattgtaggcatgaaagataaacgtgatgaatcgggtttatttattgaagtcggtgcaattttaagaggtgaagaagaaattacatggggtgagcctgtttaccttgctgatgtacagacgagaaactcacctctttggaaaacaatgcctaagcaacaaatcgcgtatctcgctgtaaaatattgggcccgtctttattgtcctgaagttatccttggtgtgtatacgccagaagaacttgaagatcgaccgattaaagacatcaccccacagaaagaacgtgtaagcattaatgaaatcaccaaccagcaacaaccaaataatgctgaacctgtaaaagaagctcaaggcgagtttatacctaagttcgatgctgaagcatttagattagctattgatgatgttcagactgtcgaagaagctaaaaatattcgcgcagaaattgagaacttaaaaaatgaaatggggatcaacctgtttactgaattaaaaaataaagcagtacaggcataccaccgcattgatgcacgtaatgccctagaagcttctatcaactcacttcctgaatctggctcaccagaagccacagaagcatttgaaaaagtagacaagctacttaaatcaagcaaaagaaaactcggtgatgagttatacgagtctttctctatcacacttgatgatatgcgccctgaataccagtga

SEQ ID NO: 3986 - DNA, 1329 bp, Proteus mirabilis
tcaaatatttttcgcctgtattttgtgacaaagaccaaatggacgtgcatcaggaatacacaatgtctgccacggcgaatattagtttcatttttcatggaccaaagtataatagataatatgaaacgtctacaagcctttaaattccagttaagacccaatggtcagcaagagcgtgagatgagacgctttgcaggggcttgtcgttttgttttcaatcgggcattagcacgtcagaatgagaattacgaagcagggaataaatacattccctatacaaaaatggcttcatggctcattgagtggaaatctgacacagagacacaatggttgaaggaagccccatcacaaccgttacaacagtcacttaaagatttggaacgggcttacaagaattttttccagaagcgtaccgcttttcctcgattcaagaaacgcggtaaaaatgacgcttttcgctacccgcagggcgtgaagctcgatcaatccaatagtcgtatatcattgccaaagttgggatggatgcgctaccgcaacagtcgtgaagtcgtcggagaagtgagaaacgtcacggtcagtcagtcatgcggtaaatggtacgtcagcattcagactgagcatgaagcgacagaaccacaacatggatcaacctcaatagtcgggcttgatgcaggcgttacaaaacttgccacgctttcagacggtacggtatatccgcccgtcagcagttttaaagtaaaccagcgaaagctggcaaggcttcaacggaaattaagccgtaaaatcaaattcagtgccaactggcaaaaacaaaagcgcaaaattcaacgtctgcattctcatattgccaatataaggaaagactaccttcacaaagtcaccagcgaaatcagcaaaaaccacgcaatgattgtcattgaggacttaaaggtcagtaacatgtctaaatcggcaaaaggtacgacagaacggcctggacggaacgtaaaagctaaatctggtttaaaccgctcaatactggagcagggctggtatgaaatgcgccgacagcttgagtacaagcagctctggcgaggtggtcaggtactggcaataccaccagcctacaccagtcagaagtgcgcttgttgtggtcatacagcaaaggaaaaccgacagtcacaaagtcaattcgagtgccttgaatgtggatatacagcgaatgctgatatcaacggggcacgtaacattttagcggcaggacatgccgtgcttgcctgtggagggagggtgcagtcagaccgcccgtcgaatcaggaacccgccgaggtgattcagacatcagtctga

SEQ ID NO: 3987 - DNA, 1044 bp, Proteus mirabilis
tttaaatttagggctctcttttacacaacgagtacaagtattatgccaataaatataacgaaggaaaggggattactaattagcttactcacagtgatagccagttgtttgttattgattgcttattattggtctgaactaacttattttaatgttcaatggcaaaaagttatcaatagctatcttgcagaattaatgcaagatattagcgaaaataattggcaagtaggctttatattaataggtgttagttttttgtatgggttactgcatgctgttggccctgggcatggaaaagtcattattagtacttatattgctactcacccgactaaattaaaacaaagtgcgtggttaagtgtccttgcttcattgctacaaggtacagttgccatagttatcattactgttatattaataatattaaacctatcaagctctcatttaaaaatagcgagtcattacattgaaaatagtagctatttattaatttcattatctggcattattatttttatccagtctattcgtcgtttattgtcagactataaaaagcgtgctttttatattaaacaggcaacacctatcatcaagcgatctagatatctctataaacataaaagcaaccaaacaatctcacaaacatcatgttgtggtcataaacatgtggtgacttccaatgaattacaagggaattggtcggcacaattgttggtactattcgctattggcagccgcccttgctctggcgcattgttagtattgttattttcatatgcattaaatatctatctttggggaatagcagctgtcattgcaatggcaataggaacggctttaaccattactgcaattgcattaacagtttattatatgcgaaatgttgcttatcggttttcggtaaaaaatactaacttatcttttaggtatatggcggagttactacgtctattagcaggaatattgtttatatttttaggtatactgatgtttaatagtgcaataacgttaaatagagaagatataatgccgttatttcgctaa

SEQ ID NO: 3988 - DNA, 654 bp, Proteus mirabilis
ttatcaattagtaaaagtacccccatgaaaaatattgtggtcctgatctcaggaaatggtagcaacctacaggcgattattgacgcctgtagggcgcataagatcgctggccaagttgtggctgttttcagcaataaagcacaagcttatgggcttgaacgagcgagacaagcggatatccctgcttactttatcgatccggctgattatcctgatagagaagcttatgataaagcgttaatcactcaaattgatggctatcagcctgatattgtggttcttgctggctttatgcgtattttatcgccgttatttgtcaaccattatcagcataagctattaaatattcatccctctttacttcccaaatatcccggtctgcatacacataaacaagttattgagaataaagatacttttcatggtactaccgtacactttgtcacggaagaattagacggtggcccgatgatcattcaagcgcgtattcccgtctctcctgatgataccgaacaaagtttgcaagcaaaaatacaaacacaagagtatcgcatttatcctctcgcaattagttggttagcagaagagagattaaaaatgatagataatcgggcgctacttgatggtaatgttctgtttgacaatcttgattaa

SEQ ID NO: 3989 - DNA, 201 bp, Proteus mirabilis
aatgttactagctccttgttttcagatatttttactgatgtatatggttcattttttataaaatttattaaattaaatatttcttcatatattaaaattgatgcttccaattctaatctaaatgttttttttactgcgattcctttattatttaatctttcattttctattttgttattgtttcttttttgtgcaaaataa

SEQ ID NO: 3990 - DNA, 315 bp, Proteus mirabilis
agctggtgtagtttgggggtgacaatgcagggaactaattcaactaagagcattcaactagaagttctttacatgggtaaagattgcatttgtgtgatttttctcaaagggcctgcgccagtaaatgtattgcaggacattgaaactcagctactagaagtagccgatgagcatgagatgtttactaagcacggcacatatcaaatcagcgttacgagagataacggtgaatatgatgggttaggcaattgttataacgcaccttattgggatttcgatattcaatcatttgaaccaatgccagagggtgaatga

SEQ ID NO: 3991 - DNA, 1431 bp, Proteus mirabilis
aaacatttcaggtattgtatggaagagcaaacagaagttactcagcccgttagagtgaaaaatgccactctacaacgcgggctaaccaatcgtcatatccaattaatcgctattggtggtgctatcggtactggtttatttatggggtctgggaaaaccatttcgctagctgggccatcgattatttttgtttacatgataatcggctttgtcctgttctttgttatgcgagcaatgggagagctattattatcaaatttagaatataaatcatttagcgattttgccggggatttattagggccttgggctggcttttttgttggatggagttattggttttgctgggttatcaccggtatcgctgatattgttgccattacctcctatattagttattgggcgcccaattttcctgaatggggaacgtcttttatttgtgtgctgacactccttattttgaatttagccacagtaaaattatttggggaaatggaattttggttttcgatgatcaaaattaccgctattgtctctttaattattgttggtatcgtattgattagcataaattttcaatctccagccggccacacggcaactattgaaaatatctggaatgatggcggtatgttccctaaagggatcagcggattttttgctggttttcaaattgctatctttgcttttgtggggattgagctggtaggtacagcagcggctgaaacacgtgatcctgagaaatcattacctaaggcgattaacgctattcctattcgtattattactttttatgttttggctttggcgattattatgtcagtaacgccgtggcgttcgattttggcagacaaaagcccgtttgtagaactctttgtcatgattggtattccagccgcagccagtttagttaactttgtggtattaacggcagccgcctcttcagcaaatagtggtatcttctcaaccagtcgtatgctatttggtttatcgaaagagggggaggcaccaaaacagtttagccagctatcaaaacgttcagtacctgccaatggtttactctttacgagtctctgtttatcttgcggtattgtgctaatttattttattccagatgtgatgcgggtatttacgttagtaacaacggtctctgcgttattatttatgtttatttggagtatgatcttatgctgctatttagcatatcgtaagaaacgtcctcaattacatcaacaatctatttataaaatgccattagggatagtgatgtcatggctatgcttagcattttttgtgtttatggtcgtgttattggcatttgaacatgatacccgtcaagcactgatggtaacgcccatttggtttattgctttaggaatagggtatcattttgtgaaaaagcgtaaacaaaaagcacaattaaaaaattaa

SEQ ID NO: 3992 - DNA, 1407 bp, Proteus mirabilis
cttgaaatcagaaccaggaaattaatcatgtttacacccgaattgctctctcctgcaggctcattaaaaaatatgcgctatgcattcgcttatggcgcagacgcggtctatgcaggtcagcctcgctatagtttacgcgtacgtaataatgagtttaatcacgaaaaccttgctaaaggaatacaagaagcgcatgaattaggtaaacgcttctatgttgtggttaacatcgccccccataatgcaaaattaaaaacctttatccgtgacttaaaaccagttattgatatggggcctgatgcgctgattatgtctgatccgggtttgatcatgatggtgcgtgaagctttccctgatatggatatccacctttcagtacaagctaacgccgttaactgggctaccgtaaaattctggcgtcaaatgggcttaactcgcgttattctttctcgtgagctatctattgacgaaattgcagaaattcgtaaacaagtccctgatatggagcttgaagtcttcgttcacggggccttgtgtatggcttattcgggtcgttgcttattatcaggctatatcaataaacgtgatccaaaccaaggtacatgcacaaatgcctgccgttgggaatacaaagttgaagaaggcaaagaagatgaagtggggaatatcgtcgagaagtaccaacctatcccggtaaaaaatgttgagccaacgttaggtgtaggtgcccccactgataaagtgttcttaattgaagaagctaaacgtccgggtgaatatatgacggcgttcgaagatgaacacggtacttatattatgaactcaaaagatctgcgcgctatcgaacacgttgagcagttaactaagatgggtgtacattcattgaaaattgaaggtcgtactaaatctttctattattgcgcacgcacagcacagatgtatcgccgtgctattgatgatgctgttgcaggtaagcctttcgatccgacactgctgacaacgctagaaggcttggcacaccgcggttataccgaaggttttttacgtcgccatacccatgatgcctaccaaacctatgaatacggctattctgtatcagatacacaacagtttgtaggggaatttacaggtaaacgtgttaacggtttagctgaagtggatgttaaaaataaatttatcttaggtgatagcttagagctaatgacaccaacaggaaatattcaattcactttagatgcgttatttaataaaaaacaacagccgacagatgttgctccgggtaatggccatgtggtttatttacctgttcctgacgatgttgatttaaactttgcactgcttattcgtaatctgccaggaacgacaacccgtcaacctcataaaattgatgcggtagaagtgaagtaa

SEQ ID NO: 3993 - DNA, 1263 bp, Proteus mirabilis
cgagttgtcagtaggatcaccaacgcaatgaataacaacaaaaagaccaaaaaaagattttctcttattatcaccctgcttattgttatcgctggcgctatcgcctattggcaatactcttcaaacaacagcgcacctcctgtgagtaaagatacccctactgcgaatacaccaaatagaagtacagctggctcaagacgaccaccgatgcctcctgtacaagtggcgacatctgcacaagaagatgtgccgcaatttttaactgctttaggtacagtgaaagccgtcaatagtgtgaccgtgacaagccgtgtggaagggcaattaatggcgttgcatttcaccgaaggccaacaagtgaatcaaggcgatttgttagcagaaatcgacccacgtccttttgaagtgcaattagcgcaagctaaagggcaattggcaaaagatcaggccacactggcaaatgcgcgccttgatttagctcgctaccaaaaactggcaaagacccatttggtttcacaacaagaattagacaaccaagcggctttagtcaaacagtctgaagccagtattagtatcgataaagcagcaattaataatgcacaattacaattaacctatagcaaaataacggcccctatttcaggacgggtgggattaaagcaggttgatgtcggtaactatatttctggtggctcatctacgccaattgtcgttattaaccagatggatcctgttgatgtactctttacattaccagagcaagatctatcacaggttatcttagcccgtaaaaatagccctacattacctgttattgcattagacagaaataataaaattgaattagcacaagggactctatttagtgttgataatcaaattgatgccactacagggactatcaaattaaaagcccgttttcctcaacaagaaagtacgctatttcccaatcaatttgtcaatattcgtttatatgtcactacattagaaaaagcggtagtgatccccaatgcagcattacaaatgggaaatgaaggacactttgtttgggttgttgatgaggaaaacaaagtcagcaaactcgctgttgaggttgcatcacaaaatgcagataaagttgtcattgcctcagggttatccgctaatcaacgtgttgtcaccgatggtgtggatagattaacgcaaggtgccaaagtcgagattgtaacaccgctggcacctaaagctaaaaccactgatcccgttgttgcggagaaagcataa

SEQ ID NO: 3994 - DNA, 504 bp, Proteus mirabilis
aattgcaccagttattgggattcacgacacgttaaaccacttgttgaacaatttgggatccctttccttctcattagtcatgaagggttaaccgttgttcagcatgatgaaaaactgatagcacaaattgaccaatacaaacctgattatgtggtattagctaaatatatgcgtgtattaacccccgcatttgtacaacattacccaaatcaaattattaatattcatcactctttcttaccggcatttattggcgcccgcccatatcatcaagcctatgaacgtggtgtaaaaattattggcgccacagctcactatgtaaatgataatttagatgaaggccctattattactcaaaatgtaataaacgtagaccacactttttcagcagaagatatgatgcgcgcaggacgggatgtagagaaaaacgtactaagccacgccctctattgggtgctctcgcaacgtgtttttgtctatggcaacagaacaattattttgtag

SEQ ID NO: 3995 - DNA, 195 bp, Proteus mirabilis
tctacaagcagcgtttttattcaacttatagtgcaagagagtttaccttgtcttgctatcattaaaacggttaacaagtcatttaatataggcttattctgcttatcgttacctttaattgttatctttaatgtattacaaggggatacgtacagagccattttccagcgcttcaccagtaataatttgccctga

SEQ ID NO: 3996 - DNA, 573 bp, Proteus mirabilis
tttttaggcagaataacaacttatttcaatattatcatggacattgttatgttgagtgctcttcgtcactggtcacaaagtcgtttttcatggttactgctggcattaacggcaattggtcttgaaggtgcggcattgtattttcagtacggaatggaattaatgccttgtgtgatgtgtgtttatcagcgcattgctgtattagggatcttagttgccgcattaattggtttttctttgccaaaactgacactaatgcgcatggcgggtagttttttatggctttatgcctcataccgcggtattgaactggcttgggaacatacgcaacttattcttaatccatcaccttttgcaacttgtgatttctttgttaccttgccttcttggtttgcattgcaagattggttccctgccgtattccaagcatcgggggattgttctgttagccaatggcggttcttgtcattagaaatgccacaatggatgttaattatcttttctgcttattttattgtcggtttattagtattaatcagccaagtcacctcttctttttccaaaaaagactaa

SEQ ID NO: 3997 - DNA, 246 bp, Proteus mirabilis
gaattaataagcgaatctacccaaattaaaatattaatgataattttttattttatacgatctattaaacttataaacctaaaaatacagcataaaaaattgacaaatctaaaattgaagtttttttcgatcacagtaacatatattgccatagctcctcctcatctttgtctgaacaaagcacttgtgtttaataaatatttctatagatatagtttttttagtcatttaccgaaaacaccataa

SEQ ID NO: 3998 - DNA, 903 bp, Proteus mirabilis
attatggtaagtaacaattttgattttacaggcagtatggtggcattagtcacccctatggatgcgaaaggcaatgttgaccgagttagtttacgcaagttggtcgattatcatgttaaagcaggtacagatgctattgtctctgtgggaacaacgggagaatcggcaacattaagccatgatgagcatgttgatgtcgtattaatgactctggatatggctgatggtcgtattcctgtgattgcaggcacgggggctaatgcaacttctgaagctatttggtttacacaacagtttgaaaataaaggtattgcagggtgcttaacggttactccatactataataaaccttcccaagaagggctttatcaacattttaaagcgatttctgaaagcacggctttaccccaaatcttgtataatgtgcccggccgtacaggatgtgatttattgccagtaacagttgcacgtttagctcagttggataatattgtggcaattaaagaggcgacagggaacttaagtcgtgttagtcaaatccaacagttagttaatgatgatagttttatcttattaagtggagatgacgcatcctcattagactttatgcaacttggcggtcatggtgttatttcggttactgctaacgttgctgcgttagaaatggtagaattatgtcgattggcaaaagcgggtgagtttgcaaaagcacgtgaacttaatcgacgcctgatggacttacatcatcagttatttgttgaacctaacccaatcccagctaaatgggcgtgtcaacgtattggattgattgaagacgccacattgcgcttaccgatgactccattaacatcagcgggtcaggatatcgtagagaaagcgctgttaacagcgggaatactgtaa

SEQ ID NO: 3999 - DNA, 2487 bp, Proteus mirabilis
attcacacaagcgaggttgtcataatgccatttagtcttattcaacctagtttttcaggcggtgaaattgcaccaagcctatatggtcgtgttgatcttgcgaagtattcaactgcactgcgcaagtgccataactttattgttcgtcaatatggtggcgctgagaatagaccaggcacacgatttattgctgaaacaaagtatcaaaataagaagtctcgccttattcctttccaattcagcaccgtacaaacctatgcgttagagtttggtgatcgttatattcgtgtatttaaagatggtgggcaggttctctatgctgatggtgaacataaaggcgaagtgtttgaattagccacaccttataaagaagctgatttgtttgatttgaagtatacgcaatcagccgatgttatgacgattgttcatactgattacccaccaatggagttacagcgttacgatcatgatgattggaagttagtctccgttgaaaccaagaacggcccttttgaagatataaataccgataaggcaatgaaagtttatgccagtgcaagcacgggacaaattacgttaacgtctacgcatgatatttttggtaccgagcaaataggtaagcagttctatttagagcaacgtgatattgatgcggttcctgtatgggaaacagataaaacaaccaaccttaatgatcaacgccgtgctgacagtaactactatcgtgccaatagtggcggtaaaacaggaacactaagaccgtctcatactgaaggaatgagctgggatggttggggtggtgatacagggatccagtgggaatatttgcatagtggttttggtatcgtaaaaattgaaactgtaagtgaagatggtaaaacagccacaggaaaggtgatctcttatattccatccaatgccgttggtgaagataatgcaagccataaatgggcgcgtgcagtgtggaatgatgttgatggttatccaagcaccgttgtttattatcaacaacgtttattctttgctggctctcgtgcctacccacaaacgatatgggccagttgtagcggtgactataaagactttgggcgcaacaatcctattcaagatgatgatcgcattatctacacgtatgcaggtcgtcaagttaatgaaattcgccatttgattgatgtcggttcgctggtggcattgacctcaggcggtgaatatcaaataacaggcgatcagaacaaagtacttacaccttccagtttttcaatgtcatcacaaggggctaacggttcaagtgatttaccgccaatctctgttgcgaacattgcgctttatatacaagagaaaggcagtgctgtgcgtgatttatcgtactcctttgatgtggatgggtatcaaggcactgacttaactatgttggcaaatcacctatttcaacgtcatcgtattgttgattggtcatttactacggttccatattctattgcatggtgcatacgtgacgatgggttaatgctggctttaacctatttaagagaacaacaagtttttgcatgggcgccacaatcgacagaagggaaatttgagtcaacgtgttcgatcagtgaaggcaatgaagattcagcctattttattgttcaacgcacagtaaacggtaaacaggttcggtatgtagaacgattagccagccgtttatttactagcacagaagatgctttctttgtggattctggcttaagttatgatggtagaaatactgatatatcaaaaacagcaaccatcactggtggagcgggtgagtggaactatcaagaaaactatccattagtgatttcaggtgatccggtctttagtgcttctgatatcggtagtgccgtcaatattccttattttgaagataatgagcacaaagagcttcgctgtaagattgttcaatatatatctgcaaatcaagttgttatttctgctaatcgcaatattccaccagcattacaaaatacacccactactgaatggagcattgcccgctatcgctttgctggcttaaatcatcttgaaggtaagacagttaatattctctctgatgctaatgtttcacctcaggctattgtcaccaatggtgcagtggaaattgatacgccatcagccgtagtgcatatcggattacctattaccagtgaattagaaacacttgatatccatattaatgggcaagaaacattacttgataagaagaaacttattaaggttgccagcttaattgtaaatagtagtcggggtatttgggctggtactgaaaaagaacggttatatgagtatcctcaacgccaattcgagttttacgacaatcctgttgatgatgccacaggcattgttgaaattaatttagatgcagattggagcaaaaacggacgtgtctttattagacaggttgatccgttaccgttagcggtgctctctgttattccgcgtattgatgctggtggtttctga

SEQ ID NO: 4000 - DNA, 3105 bp, Proteus mirabilis
agcaccaaaaggattttaattatgccaaaggttcctacatacgataatagaacggttatgcctgagcagttaccgaataatgggttttctgttcaatcatcacctgatgcttttggcgctggcattggtcgtgttggtgagcaatatgttggtttgtttgcagaagcaaaacaaagggccaatgttgcactggcgcaagatgccgcattacagctacgacaaaaagccaatgaactgatgaccgatccgcaaaatggattactttcacagcaaggtaagaatgcgattggtaaagcgtttgagtatgagcagtcatttcgtgattatgctgatgaaatatcatcaacattacctgacgatattgttcgacaaagctttatgcaacaagcgcaagaaatgggtgttcagtttgcatcacaagcgaatcgtcatgagatggggcaaatcaaagcttatgaacaagatcagtttaaatcaacgctaacattaaatgcagagtctgccgcatcaatgtacggtgataatcaggcttatatctctgcacataaacaagtgtttcagcaaatagaagagtttggattatcacacggttggggtgaagagcagatcctcgccaagaaacaagaattcaaagtggcaactgctcgtaaagcgattgaaaatcaactcggtgctgattatatggggttcttagaacgaaatggagaaccttcaagccttggtggtgctaccagaaataatgcgttctatggtggtactgttagtaaagttaaaggaatgacccagcagggcaatattaacttactcaatagaccaacagttaaaaacgaagacggctcaattagtacagtaagaacgatttctattggtactgatgatggtgaagtgctaatacctaccgtaagtgacgatggcaagctgttatctgatgatgaagccattgtgttatatgagcaaacaggtaagcacttaggaatttttgataacccagaagatgcaactgcttacgctgataatctgcataaacagcaagagaatatgtatacacctagtaacggtgatacaagaggtgttagaaacaacaaccctggtaatattcgtatatctagcaataaatgggtaggacaaaccggtgatgatggtgcatttgctaagtttgccacacctgagcacggcattagagcattaggtaaaaatctactttcttatgctcgacaagggtttgttacaccagagcagatcattaatcgttgggcgccaccagaagataataatgatactcaggcatacattgagtatgtatctgattaccttggtgttgcacctaatcagccattagatttaacgaatcttgataccttaacgcatttatcgacagcgataatgtataaagaaaatggccgtaatcgtgttaattacactgatgagcagatagcaacgggaatacagtcagcacttggttttgttgaattacaagcgacatctgaagcacccaaactattaacgggatctgccgctttcgatgccttagatgaagctgaccaagcaaaatatttacgacaagcagaacagctacgtaagcaaaagcaaagtgagttacagcaacaattcggtactcgtgtagcggactcttacgcagcatgggaaagaggacttgatgcacctaatgcgcctactcatgatgaattaatctctgcgtttggctatgacaaaggttcagctatgtctgctgatatgcaagaagctaagcgttatgctggttttatgtcagcagctaaagaaatgtcgccacaagcacagcaagctttgttatctcaaatcagaccacaaacgggcgaagcaaactacgaaagcaaaattcaacgttgggagaaatttggtaagttcgttgaaagtaacatcaaagaacaagataagcagtttgcagctaaccgattacaactttccattcaaaataactttccgcttgatcctaatgataagaataatcagcaggcagcagatgattactttgaacaacatattcagcagagctttaatttacgtgatgataatagcttaaatgccgttgctgaacttactgcaagaacagggattatcccatcacaagttaagtctgtattgaatatgggggcaacatctaaagatcctgaagttgttcttcctatcgcgaaaatgtatgggcagatatttgataataatccggcctcagcgactgatattccatcaagcacaatggcgtattactcaaaagtatatagtttaagtcgtgcgggtatgcctgatgagaaagcggtagaaactgcatttaagacgacatttgaacaagatgaacgcactaagcaaatgatcgcttctcaaatcagggataaaggatatatcaaggatagagataaggctgcacaatctaatatcaatgatttttacccttggtataaaccattttcttcaccaagcgttagtaagcctggtgctcaaaatggcgcttacttacgtgactatcaaacactgtatgacgctaactttgctgaaacaggcggtgacgcagaactagccaagaaaatgactaacgctcaaattaaaagaacgtgggcggtatcaaatattaatggcagtgaagaagttatgcgttatgcaccagaagctgtatacggtattaatgaatcaggtgccggaaactggattgctggccaatgggaagaagagaaaaagcaattaatgtctaagtcatttggtggcgcttcttctggcactgaaatcgttattgtctctgatgcagtgactcccagagattacagctacggcataatgataaaacaaaccggtagtgatgatatccctatttatcgcccatacacgggagataacggcttacctattcgttttaaaccagaacagtcatcatcaccaatgtataaagaggtaatggaaaaacgccagcaaagcgttaaggaagctcaggataaaagggaacgagaagaagcattggataaatcgcgctcagaatttgatgaacgtcgtcaaagtatccgtgagcaatataaagaagctcacaatgagcgagtaaataaattcaataattatttttcttgggataaaaactga

SEQ ID NO: 4001 - DNA, 1482 bp, Proteus mirabilis
gaattaaaaaggaataacatgtctcaatcagctatcaataatgatactgcggctgccatcaatccatattcacaaaaagtggcacacctgcgtcagcaaattctgaacatctttcttgaagatgaccgttttgttgaaacagtgttaggtgaagcaagtgaaagtgataggctgagccaccatgaacttcatgaaaaaatcaccactgttagagaattactacaagatctacacgcggcagatattgcagatattcttgaagcccttccctatgatgaacgtttagccctatggcatttggttgataataatgagcgtggtgcggttttagtcgaagcctctgtcgccgtttgggacagcctaattaaagatatgacggatcgtgaattattacgctcagtcgcttctttgcatgtggatgaacaggcctatattgcggagcatttaccccgtgataccatgcgtcgtcttttgacctatttagaaccaagtctgcgtaataggatcagagaagtcctgcaatatccgaaggatagtgttggacagatgatggattttgagtttgtcaccgtgcgtggcaacgtaacattaaaaacggttcaacgctatttacgccaacgtggctctattcctgaagccacggataaaattttcgttattgataatgccaatcatctgttaggtgaattacccttaaccacagtattaacccagtcgccggataaacgggtctctgatgtcatgaaaaccgatactgtcagctttatgcccgaagagaaaggcgaagatgcagcgggtgcgttcgaacgttatgacttaatttcggctgcagttgttgatagtaatggcctgttaatgggacgtttaaccgttgaagatatcgtcgataatatgcatgaagagagcgataccaacattcgtcgtatgggggggttaagcccagaagaggatgtattcgcccctgtcgggcaagcggttaaaacacgttggacatggcttgctatcaacttatgtactgcttttgtcgcttctcgtgttatcggtgtgtttgagcataccatttcccaattagtcgccttagcaactttaatgcccattgttgcaggtattgggggaaataccggtaaccaaaccattactatgattgtgcgtgcattagcactacatcaaattcagactggtagtttctcgttcttaattttaagagagttaggtgttgcccttatcaacggtattgtttgggggggaataatgggagttgtaacttacttcctttatggtgatattgcgatgggcgccgtaatgacaatggccatggtactcaacctattaatggctgccttgatgggagtattaataccgatgaccatgataaaactgggtaaagatccggctattggctcaagtgtgatgatcaccgcgatcaccgatactggtggcttctttattttcttaggcctagccactattttcttagtttaa

SEQ ID NO: 4002 - DNA, 1401 bp, Proteus mirabilis
atgaagaaaagaggatgtatggcgaaagagtcgcaacaagcagaattaaagcgcggtcttaaaaatcgacatatccagctgattgcgctgggtggggctgtcggcgctggtctgtttcttggtatcgcgcaaaccattaatatgactgggccatcagttatattaggctatgcgattggtggttttattgcgtttatgatcatgcgccaacttggtgaaatggttgccgaagagccggttgcgggttcatttagtcactttgccaataagtattgggggccatttgctggctttttatcaggttggaactactgggttatgtttattcttgtcggtatggctgaattaaccgccgcaggaaaatatattaattattggttacctgatattccggtgtgggtttcggtagcggtgttttttgttgctattaatttaattaacctaattaatgtcagaatgtatggtgaaaccgagttttggtttgccattataaaagttttggcgatcgttggtatgattttatttggtagctatttattggtcagtggtaatggtggtccgcaagcttctgtgagcaatttatgggagctaggtttcttccctcatggctttactgggtttatgtctgcattagctattgtgatgttctcatttgggggacttgagctggtggggatcaccgccgcagaagcagaaaatcctaaagtaagtattcccaaagcaactaaccaagttgtttatcgtattttgattttctatattggttcattgattgtactgctttctctttatccttggacccaagtggtgaaaggagaaagtcctttcgtacttattttccataatttagataattttgttgttgcccatattttaaatgtggtggttttaaccgcggcattatctgtctataacagtggcgtttattctaatagccggatgctgtacggtttagccaaacaaggcaatgcaccgcattcattatctaaggttaataaacgtggtgtacctgttatttctttggggttatctgcgatagccacatcactcgggatcttggttaactatttactccctgatcaagctttagagctattaatggcattagtggtaacaacattagtgcttaactggatcatgatctgtttagcaaacttaaaattccgtgcagctaaaattaaagagggtgtagagccttcatttaaagcactttggtatccttatggtaactatctgtgtttagcctttttatgtatgattttggtcattattctaatgatgccaaaaattaatatttccgttattttgatgccattttgggtaggcttgctctggataggttttaagatctcaagaactaaaaaatcgctgacaaccacacaagcaaggcaagatagttaa

SEQ ID NO: 4003 - DNA, 1071 bp, Proteus mirabilis
tgcaatgaaagaagagtaattatgaaaagtaattcacagataatcagagttaaaaagcgagggaaaaaacagcacaacgcacaacatggtgcgtggaagatagcttacgctgactttatgactgccatgatggctttctttctggtgatgtggttactttctatcgctagtcctcaagagttaactcgtgttgctgaatattttcgcacacctctaaaagttgccattgaaaaaggccgcgttagtggagacgtgacaaacccgataccagggggaggacgtgatcctgtgtataacgaaggtgatgtactgccaaaaggtgtcgaagataaacagctcaatgaaaaacagcaattccgtaaactgaaagagaatttagagcaagttattttacaagatcctcgcttaaaagatttaaaacctcatttattaatcgacatgatggacgaaggcttacgtatccaaattatagataaagaaagccggccaatgtttaaagttggtagtgccactgttgaaccttatatgaaagatattttaactgcgatagcgccaatactaaatgactcgccttataaaatcagtttatcaggtcataccgatgatattccttatgcgagtggtgcactcaaatacagtaactgggagttatcaacggatcgagccaatgcatctcgtcgagaacttattggtgcagggcttgcagaatggaaagtactacgggttgtaggtatggcatcaactgttcacttagtaaaagaggatggttttgctccggcgaatagaaggatcagtatattagttttaactaagcaggaagaaaagaaaattgtacatgaaaatgagcgggttgcaccagcaataaaagaggcatcagaaattaaacctctgctttcagggcaagaaaccccacaagaaaacggagaaaatacacagacgaattcgtctgtgtcttcttctacatctaagcttcccgaatcaaaaaaggaaaatgttgaaacaggagtttctggggaaagtttgccatcacaatcgacaaatattacgacaaaacaggaaacaactccttag

SEQ ID NO: 4004 - DNA, 378 bp, Proteus mirabilis
aatctacgaaggcattccgaaaggagttatttcatgacagcaaaatcacctgctgaacgcaaggcactacaacgtaagcgccaaaaggaacttggcgtaacgaagattgaattgctggtggataatcaagagctggagatgttaaagcgtaattgtgttctacgtatgcctggtcgtgagtcgtatgatgttgttgaatacatacagatgcttattcgcaaagatgatgcagagtataagcgacaagctgaggaactatctaaaagcaagtgtgagcgttgtggcgaacagttacccgttcagcaatgctgtttatctggtgatgctaagtgttgggtaacaaagggctggcgtgaaatgatgttgaaggtagaataa

SEQ ID NO: 4005 - DNA, 1005 bp, Proteus mirabilis
agaacaatgagtaatgacttaactggaaccgaaaaaagcgccgttatgttactgacattgggtgaagatcgcgcagcagaagtatttaaacatctaacgacacgtgaagtgcaacaactgagtattgcgatgtcttctatgcgtcagatctccaatcaacaactcattgatgtgatggcaagcttcgaagaagatgctgttcagtatgcagcattaaatgtgaatgctaatgattatttacgctctgtacttgttaaagccttaggtgaagagcgtgctaataatctgctcgatgagatctcagaaacccgtgaaaccacaacaggtattgagacacttaactttatggagccacaaatggctgccgatattatccgtgatgaacatccacagattatcgccaccattttagttcacttaaaacgtggtcaagccgctgatattcttgctctgtttgatgaaaaattacgtaatgacgttatgttacgtatcgcaacatttggtggtgttcagccatcagccttagctgaattaacggaagtactgaacaatttacttgatggtcaaaatctcaaacgtagcaaaatgggtggtgttcgtactgcagctgaaattatcaacttgatgaaaagtcagcaagaagaaaatgttatcaccgcagtacgcgattacgacggcgaattggcacagaaaattatcgacgaaatgttcctgttcgaaaaccttatcgatatcgacaaccgttcaattcagcgcattctacaggaagtggaatccgaatccttggttgtggcattaaaaggttgcgatcaagaactacgcgatcatttcctcaacaatatgtcgcagcgtgctgctgaaattatgcgtgatgacttggcgtctcgtggacctgttcgcatgtctcaagtggaagctgagcaaaaagcaattctgcttattgtacgtcgcttagctgagagcggtgaagttgttcttcatggaggagacgatacctatgtctga

SEQ ID NO: 4006 - DNA, 288 bp, Proteus mirabilis
ctagcaaagaggttctttatgacgcctgaatctgttttagcattaggaacggaagcgatgaaaattgccttatcccttgctggacctctattattgtctgcactggttaccggtttagtaataagcatgctgcaagcagcaacacaaataaacgaaatgacactgtcgtttattcctaagatccttgctgtattagcggctattttagtcgcaggcccgtggatgctcagtttgttattagactatatgcataacttatttactggcattccaggaatgattggctaa

SEQ ID NO: 4007 - DNA, 1323 bp, Proteus mirabilis
attatttggagtctagccatgaaagtgatcatcttaggtggcggcgttattggtgtaacaagtgcgtggtacttagtacaacaagggcatgaagtcattgttgtcgataggcaaagtagtgcggcagaagaaacgagtgcaggtaatgcagggcaaatatctccgggttatgcaacaccttggggtgctccgggtattccattaaaagcagtaaaatggatgtttcaaaaacatgcacctttagcgatccgacctgatggctcactgttccaattacgctggatgtggcaaatgctacgtaattgtgatgcttctcattatgcgatgaataagagtcgtatggtgcgtattgctgagtatagtcgtgattgtatccgtcaattacgccaagataccggtattgaatacgaaggacgccaagggggaacgttacagctatttcgtgatcaaaaacaatttgataatgccgctaatgatattgctgtattaaagcaagaaggtgtggcttatgaactgctaacagccgagcaactaaaatcagcagaacccgctttagagcatgtgagtcataaacttaccggaggattacgtcttcctaatgatgaaacgggtgattgccaaatctttactaagaagctggctaaaatggctgaagaggccggggttactttcttatttaataaagaaataaaacacctactttttgatggtgataaagtcaccggtgtgcaatgccatgatggtttattgaccgcagatcactatgttgtcgccatgggatcgtactcgactgaatttttgaaaaacaaaatcacaattccggtttatcctttaaaaggctattcattaaccatgcctattattgatgcaagcagagcaccaacatccactattttagatgaaacatataagattgcggtgactcgctttgataatcgcattcgtgtgggcggtatggcggaagtggtaggttttaatttgaatattttaaaatcacgttgtgaaacgctcaaaatggttgttcaagatctctatgagggtggtggtgatatcagtaaagcgacattctggacaggcttaaggccaatgacgccagatggtacaccgatagttgggccaaccgcatatcgtaatttatccctaaatacggggcatggtacattaggatggacgatggcatgtggctcaggacagctgttagctgatttaatatcaggtaataaaacggcaattgctgcagatgatctctccgtgttccgttatatcgatggatttaatactaaattgctccgtccagggcaaaaacttgacgctgtttattaa

SEQ ID NO: 4008 - DNA, 654 bp, Proteus mirabilis
aggatgcggagaatgaaaaaatacgaccttatctattgtgatcctccgtgggattacaaaaataaagtttcaaacggtgctgctaaaaatcattatccaacaacctccctcttcaatttaacccatatccctattcattccattacatctgataacgcagttcttgccatgtggtatacaggtaattttgtactcgaggctattaaattagccgaagcgtggggctttaaagtacgcacaatgaaagcttttacttgggttaagtttaaccctttagcatggcaacgaattgataaggctattcaaaacagcgagttatttgattatcacgacctgtttgaactattagatgccgaaacaaaaatgaatgggggaaactacaccagagccaatagtgaagatgttttaatcgctactcgaggcaatggattacagcgcattagtgctagtgttaagcaaatcgtatttagttgtttaggtgagcatagcgaaaagccatgggaagtaaaaaaccgtcttgaacagttgtacggtgatgtaagtcgcattgagctattcgctcgtgacatgtcacaaggttgggatgcatggggcgatcaatgtcctaacaacagtatcgaacttatcaattctcattttatttgtaaggaataa

SEQ ID NO: 4009 - DNA, 315 bp, Proteus mirabilis
ttaagttatggtgtattaaacaaacaaataacccttttggtaaagtacctaaacggttactattatttgttggttaatcaaattggtgaaattatggaagttttcgactttaaaaaattttggaatagcttaacgattaagcaaagagaagcattctctcaaagaacggggtatagccaactgtatctatcacatcagctacgctatgcaaaacgtaagccttcactgagtaaactcaataagttatatgatatttgtgttgagttcggtgcagatgcaaccagagagcaattaatcaatttctttattcgataa

SEQ ID NO: 4010 - DNA, 1239 bp, Proteus mirabilis
ttcaataatggagggcgcatgtccttttctcaagcagtcagtggtttaaatgcagcagccgctaatttagatactattggtaataatatctcaaactctgcaacctacggttttaagggggcaacagtctcttttgccgatgtttttgccggctctggtgcagggcttggtgtaaaagtatcaggcattagccaaaactttaaagatggtagtatcactactactaaccgcccaaccgatgtggcgatttctggtggtggtttcttccgtattgaagatagtaacggtggcgttttctattcacgtaacggtgaatttggcaaagataaaaacggctatctcactaatatgcaaggcatgcgtattacaggttatccagtacaaaacgtagacggtaaaaatgtagtacaaaaaggggcaacaccaacgcctatcattattcctaccgatatgatgaatgcaagtgcaaccgataaaatggatatgacggttaacttgaattcagctgaagaggctatcgatcaaacaacacataaatttgatcccaaagataacgattcttataactttagtactaacgtgacaacctacgatagcttaggtaatgaacataacctgaacttattctttgttaaaaccaaagataacgaatggagtgtttatgctcaagacaccacaacaggtgagccagcacaagatctgggtaaattagtttataaggataacggggtattagatgaaacagcacctaagctgaaaaactttactaccgttgcttataaaggttcacaacccatggatatggaaatgaactttagtggtagtacgcagcaaaaagtcgctgaatcaagtgtctctaaactcgcgcaaaatggttatcaagcaggggaatttaccaatttccgtattgagccagatggttccattatggcgacctactcaaaccaacaaagccaagtggttggtcaaatcgcattagctaactttgccaatcctggtggcttaagttcacaaggtgacaatatgtggtctgaaaccaatggttcaggctcacccattgttggtgtggcaggctctggcgtattcggtaaattaaccaacaatgccttagaagcctctaacgtagatatgagccaagagttagttaacatgattgttgctcaacgtaactatcaatctaatgcgcagactatcaaaactcaggatcagatcctgcaaacactagttagcatgcgctaa

SEQ ID NO: 4011 - DNA, 627 bp, Proteus mirabilis
ttagcaaatggatggaaaataatgaatgtaattgatgcagtaaaaaaccgtcgtgcaacaaaacagtttgatgctgatttcaaaataccacaagaagagaaaaaagccttacttgaagatgcgttacaatatacgccaagtgcatttaatctgcagcattggcgtcttttggttgttgatgatgttaagcaacgtcaagcattaagaaaagtgggttgggatcagcctcaaataacagactctgctatgctgattgttttatgtgcagatctcaatgtttgggagagtgaagttaaaacaatttggcaagatgctaaccctgaagtcagagatattatgtgcagtgctgttgatagttattatcgtaataaaccacaagtacaacgggatgagattatgcgtagtgcgggtttgtttgctcaaacactgatgttattagcacaagagcgcggttttgattcttgtcctatggatgggtttgattttgcagaggtagcaaaaacaattaacttgcctgatcactatgctatctgtttaatgattgccattggtaaaggtaaaggaaaaccttttccacgattaggtaaattatcttttgataaagcggtgacatttgatcatttttaa

SEQ ID NO: 4012 - DNA, 441 bp, Proteus mirabilis
aagcatgatggctgtattgcaacaaggataaagagtatgtctttatttagtattttcgatatttcaggttctgcactttcagcacaatcacaacgtttaaacgtcagtgcaagtaatatggccaacgtagatagcgttgtggggcctgatggtgaaccttaccgtgcaaaacaagtggttttccaagtgaatgcgccagcgggtcaagatattggtggtgttcatgttacgcaagtagtggatgatccgacaccctttcgtatggaataccagccaggaaatccatttgcagatgaaaaaggctatgtgcgtaagcctaatgtcgatgtagtcggtgaaatgatcaacaccatttcggcgtcaagaagttatcaggctaacgttgaagtgatgaatacagcgaaatcgctgatgcaaaaaacgttaatgataggtcaatag

SEQ ID NO: 4013 - DNA, 318 bp, Proteus mirabilis
aagcattccggtgctttaatatcttctaaattgatcccaccaaaagtcggttctaatgaagcgataatatccaccaatttatcaggatcggtttcattcacttcaatatcaaatacatcaatgccggagaattttttaaataatacgcctttaccttccatcacaggtttacctgctaaggcgccaatattaccgagtcctaaaacagccgtaccattagagataacggcaaccaaattacctttcgctgtaaagcgatacgcagctaaaggattagccgcaatttcaaggcaaggagccgcaacacccggtgaataa

SEQ ID NO: 4014 - DNA, 759 bp, Proteus mirabilis
gtttataccggaggacttctgatgactgcatcatcaaccttagcaaggctaaagcgaataatgcctgagcatattaaacctaaatttactacttctgctgaattaatggcatggcaacgagagcagggtgaaattgattcaatgaggatcgcaaatgaaaaccgagtagctcgtttaaataaaatcatgggtagatcaggtattagcccattacaccaaaattgttcattcgataattatgacgttacatgtgaagaccaacaaagagcattgtgcaaagctaagagatacgcggagcaatttggtaaatcatttggtgggttcattttcagtggtaatcctggtactggaaaaaatcatttagcgtcagccataggcaatcacattatccaaaaagggaaaagtattctgatcgctacactgccggacataatgatgaaggttcgtgaaacctatcaaaaggatgctaaaacaacagagtcaaaactgatagatgatctgtgtgatgttgatttgctagtgcttgatgatgttggtgtgcaacgtggaaacctcaatgaggaattaattatatttcaagtagtggatcgaagactagcaaacaaaaagcctgttggagtgcttacaaacctaaattatacccaactatccaaagtgttggatgaacgagtaatagatcgactccgaatgggaaatccaacaacgataaatttcacatggcaaagctatcggcgtttattaagtaatctcataaactaa

SEQ ID NO: 4015 - DNA, 195 bp, Proteus mirabilis
tggatattaggcgaattaccattttttttacaaagtatcaccaaagccaaaagcaatttacgttactcaaaaaataataataaaaatagcgggggggtaaaaaaagaaaaggcaaatccaagggagattggatttgccaaggaggtggttcctagtcttactgtattcattctagttctttatttttcgaaatag

SEQ ID NO: 4016 - DNA, 225 bp, Proteus mirabilis
gtgaacattttatcaatagcatcaggttgtaacagtggatcgccacttttggcaagcataacagtatcaagtacgacaaaaggaatgggatattgttgcagtttatcgcaaacgacatcaataatactggcattagaaagcataccaattttagcgctatctattctgacatcagaaagtaccgcatctaattgtgctgcgacaaaatcaggggataaatcatag

SEQ ID NO: 4017 - DNA, 453 bp, Proteus mirabilis
aaaataataggaggcgatatgtataagactattttggttcccattgatatcgatgaagataacttactaaataaagccattacattagtggagaacattgccaaaagagaagatccctatgtccattttttgtatgttttaccaaagttgccacaatcttcttattatcgcttagtgatgaatggcgatcaacttgaccaagtatgtttaaaaaaatcagcagaaaaagagttaaaaaaaattattgctcgatttgatttaccggaagatcgtattgaaacgcatatctgtattggtaaaccacgggatggcatattgcagatagccgatcaggttaatgctgatttaattgttgttagctcacataatcctgaagcagacagctatcatttaggctcaacagcggcagatattacccgttatgcgaaacgttcagtgatggtagcaagatag

SEQ ID NO: 4018 - DNA, 1071 bp, Proteus mirabilis
caccagcaaggagaggttatgaataaaataacggtactctgtgttgatgattcggcgttaatgcgccagatcatgcgagaaataattaatagtcaccatgatatggaggtcgttgattgtgcgccagatccgatagtcgctcgtgacttaataaaaaagtttaatccacaggtattgacgttagatgttgaaatgccacgcatggatggtattgattttttggaaaaattaatgcgcttacgccctatgccagtggtgatggtttcatcactcacggcaaaaggttcagaagtgacattaaaagcattagaactgggggcggttgattttgtcactaaacctcagttaggtctacgtgaaggaatgttggcctacagtgaacttattgcagaaaaaatccgagcagcggctcaggcaagaattagtcgtcatgaaacgaaaacattaccgtctaagtcgttatcatttactcccatgatttcgagtgaaaagttaatcgctgttggtgcttcaacagggggcacggaggccattcgtcattttttagagccattacctattaccagccctgcagtattaataacccaacatatgccggcgggttttacccactcatttgcagagcggttaaaccgtttatgccaaatcagtgtgaaagaagctgaagatggagaacgggttttacctggacacgcctacatcgcaccgggtgattatcatatggagcttcgtcgtaatggtgctaattaccagatccatataaataaagatcctgcggtaaatcggcatcgaccttctgttgatgtgctatttaattcggttgctaaatatgcggggcgtaatgctattggtgtcattttaacagggatgggcagtgatggtgctacaggtttattagcaatgcgtcgtgcaggtagctacacatttgcacaagatgaagcaagctgcgtcgtctttgggatgcctcgttccgcggtcgaattgggagccgtggatgaggtaaaaagtataagctcaatgagtaaagccgtgctgatgaaaatcagcacaacacaatcattgcgtatctga

SEQ ID NO: 4019 - DNA, 1659 bp, Proteus mirabilis
cgaggtgaaggcatgtttaggtttcgtaaattaaagatatccaccagtctctatttattactgatgatgttttgtgtgatgcaagttatttccagtgggatctcactgggaattattcatttaaacaacaatcagatcactagaattgatttagatactgctaagcgagatgaattaggattaagttgggtatctttagtacaagcacgtaatgcaataaatcgcgttgcgataggaatgaaaactgaacagtcaacagattatatccaatctattgaatcaatcgcattatcacgtttggaaacagcaaatactcattttcaaaatttccttacagatattaatcaagaggttattccacaagaagaaaaagagatttttaataccgtaaaaaatgattatcacgttctttatagtgcactaattgaattacatggcatgttaaaaaaaggcgattttcaagggtttttagatcaaccaacggaacgctatcaaactgcgatggaaaattcatttaatacctatatgaattacgttcaatatgaagtggctgattcgattgaacaaggacatcatttttataccatcgctattttaatgtttattggcgcaatcaccatggtaattgtggtgtcaatcgcctctcatcgctggttaagttttaatattattaaacctttcgcaagtttaagccgttactttaatgatgtcgcaacaggcaaattaaatcgtgaaattctggtttttactgatgacgaaataggtgacatttttagacggttacgtgagatgcgtggcgagttggcgcgctctattcgtattgttcgtgataacagtcaggcgatgtattcgggtattcaagaaatttccaaaggtaataccgatttatcctcgcgcacagaacaacaagctgcttctttggaagagacggctgcgagtatggagcaattaacggcgacagttaaacaaaatgcggataacgcgttacaagcgagtaagttggcggaatctgcatctgaaactgcactacgaggcggtgaaattactcacagtgtggtcgaaatgatggatgctattactcaaagttctcaaaagataggcgctattattagtgtcattgatggtattgcctttcaaaccaatatcttagcgcttaatgctgcggtagaagcggcgcgagcgggtgaacaaggacgaggtttctcagttgttgcaggagaggtgcgtaatcttgctcagcgtagtgctgaagcggctaaagaaattaaaacacttattgacgagtctgtgtctcgagtctctcagggatctcgattagtaaatgatgcggggcaaacgatggaggagcttgtcacatctgtaaataaagtcactgagttaatggccgaaattgcctcggcttcagacgaacaaagtagaggtattcaccaagttgctgatgctgttagtcagatggatcaggtgacacaacaaaacgctgctttggtggagcaatcagcatctgctgccacagcattagaagatcaggctaacaacctggttaatgctgtatcggcattcgaattgcctgacacggatgaagacggatcttctcactccttagaaggtaatgggttgaagaaagcagataaaaaatcattttttaaaaagacccattaa

SEQ ID NO: 4020 - DNA, 1395 bp, Proteus mirabilis
caaaaaagaggcaaatgcatgaaattaagaagtaagctatttttggtgatcttcgcgacttgcatgatagtggtatttgctatgcatatcggtattcgtagtagcttccagcaggggtttattggctatatcaagaagaacagtgaacagcgggcaaccttgttagccgaagcattaagcgatcaatatcaattaaccggagattggcgttttcttaatcgagatgatcgctctatttatcagatactacgaaccattgaccaaataagtcaaagtggtgaaggccctgcacctcgaggatggcgtactcagttttggatcgtcgataaacagatgaaacgcttatttggccatgataatcaatttcccgcagaaacctttaaaaaacctattacttatcatgatgaaattgtcggctgggtgattgtcagtgcagcggacaaaatcagcaacgaagcagatattagctttgataagcaacagttacgaaccagttggatcattgccggcttaacggtgctttttgcgctattaattacgttaatactgtcacgcagcatgatccgcccagtaaagcgattagtggaggcaacccataaattagccgctggcgattttgctgttcgcgtgaccccaaccaataaagatgaaatcagccagctagcaacggattttaatcaacttgccagtacactggaaaaaaatgagcaaattcgccgtgattatatggcagatatctcccatgagttacgtacgccattggctatcttaaaaggagagcttgaagcgttacaagatggtgtaagaaagccaacagcagaaaccttaaattcattactctttgaagtaacaaatttaactaaactggtaaacgatctacatcagctatcattatctgatagaggctctttgacctatcgtaaggattttattgatattaatgaaattattttgttagctgtcgcctcttatcggcatatttatcaagccaaagagattgctttacagactgatttagatgataacgtcaaactgattgtacaagctgatccggataggttgatccaactttttcataatctattagaaaacagtgttcgttataccaattctggtggtcaattgcatattagtagcaaaagagaacataataatgtgttgattgtgtgggaagatagtgccccggggctagataaagcacaatatgaagcggtattccaacgtttttatcgggccgaaagctctcgtaatcgttccagcggtggctctggtttggggcttgcgatttgcgaaaatattgtcgaagctcataatggtaaaattacggctatgccatccgctatcggtggagtaaaaatacttatcgtattacctgtctattctgaagataattaa

SEQ ID NO: 4021 - DNA, 1002 bp, Proteus mirabilis
aaaatagtggggtttaaaatggataataattcgctaaaaaatgcgagtttatttgataatgatcccgttctttatgctgcatggctttactatcaggacggactcagtcaaagtgaagttgcaaatattatgagcgtttctcgagtgactgttgtgaagtatttacatctcgcgagagaaaaaggtttcgttaatataagcttggattcatcagtattttctacgattgattattcaatcagaataaaagcaaaatttaatcttaataatgtgcttattttacctgatgaagaaaagaataaatcgcaacaaacatcaaatatgaatcgagaaagattagctaaagcaggggctatgtatctttctcagataatcagcaatgatgatattttaggtgtagcttggggaagaacaatccataaactagggcactatctccccactaaaacactagaaaatgtcaccgtgttacaaatgattggggctgtagccccacaacctgattttactactgcggaatctgccgctttgatcgccaataagttttcaggttgcagtattaatttgcatgtaccggctgtagtgtcaaatgcacgtttggcaatggagctacaagcagaacccataatacggcgtaatttctctgctttaaatcaatgtaataaagctttgtttgtagtgggtaatactcaagatgacaatcctttgattacaacaggcgtactcaccacaaatgagatggcacaatatcgcgatttaggtgctgttggtgtcatttgtggtcgattctatgatgcacaaggtaatcctctgctttctgatatcgaccttagaattatgggaattagtcttgcacagttaagacagatcccacagcgtatttttattgctggaggcgttgaaaatgttgctgcaaccataggcgcaataaaagggggatatgctacagatattgtcatcgatgaagtgacggcattagcattattggagttgagtatttaa

SEQ ID NO: 4022 - DNA, 207 bp, Proteus mirabilis
ggcgggtttatgcactggatcactgactattggtgggttattttaattcttttagttggaataattattaatgccataaaagatatgaataaaatagatccaaaacagtttctaaaaaataaacggaaactgcctccccatcgcgattttaatgataaatgggatgatgaggacgattggcccaacaaaaatgaccagaagaagtag

SEQ ID NO: 4023 - DNA, 1383 bp, Proteus mirabilis
gttgttattatgacatcacaatcacactccactcagccgttgagtcaacctacggcaagacctttaaaccgcaacgactataaaacgttgggtttatcctcactaggaggaacattggagttctatgatttcgtgatcttcgtgttctttacgaaaacattgagccatttattctttcctggtgataacgcttttatcgctcagatgcagacattaggtatttttgctgccggttatcttgctcgtcctttaggtggcatcattatggctcactatggcgatattatcggccgtaaacgtatgtttaccttaagtatctttttaatggctgtacctactttggtgattggcttattacctacctatgccagcatcggtgtggctgcaccgttattactgttattgatgcgtattatgcaaggggcggctatcggtggtgaaatgcccggggcttgggtatttattgccgaacacaccccgaaacagcgttatggcttaggggtgggtaccttaacatccggtattactggtggcatcttattaggctctatcgtcgctattattgtacaacgcagctatagcgctcaagaagtgaatgattttgcatggcgaattccctttattttaggtggtatatttggcttgatctcggtttatttacgtcgttttttacaagaaacacctatctttaaagagatggcggctaaaaaagccttagcacaagaaatgccggtggtttcggttatcaaaaaccataaacaagcctgcttaattactgcagcattaacatggtctttatctacagctattgttgttactattttgatgacacccagtgtcattgttgaagggatctacaaaatagacagaacaacatcgttagaagcgaactgtgttgccaccttaacgctgaccttaggatgtatcttctggggctggttgggtgataaattaggaacccgtgcatccatgaccttatcatggggtggattaattgttactgcattccatttttatggaagcttagatgccaatatgtctggtatccaattagcatttaactatggtttgatgggcttttttgtcggtgcaattgccacaaccccaattgtgagtactagagcatttcctccttcaattcgtttttctggcctctcttttgcttataatatggcctatgccgtatttggtggcttaacgccaatgttaacgggcgcttggttggaaaaaacggcaatggcaggagcttattatgttgcagctgtttctgcattagccattgttatcgcattcttacctttagcttataaaggctggatcgcggtaaacaccagctcacgggaaaaagagatagcgttgcaagttgataaagtcgctagttaa

SEQ ID NO: 4024 - DNA, 828 bp, Proteus mirabilis
ttaaaaattatgcttactattacggcactactagaaaataagacaagcgctcccacccttagccattatcctggcctttcactgctattagaagacactgaaagcgaaagtaaaattttatttgatactggtaaagatctcacttttatcaataatgctaaaaaaatggcgattgatttgacatcattaacgacaattgttatttcccatgggcactatgatcattttggtggattaactcatttaaatgaggatttctttattactaagccacatattattgcccatcctgatttattttcagtacgttattcagcactttttatggggcgccagtctattaaatttaagcgccttactccattttttaaccgacagcagctagaacagcagttttcatttcagttaacagcgacacctaaagctatcgataaaagatttatctattctggtcaagtgacagagcgtcaaatacataaacgttatggcgttattgtcagtgaaagtagcgaaacggatgattatgtacttgatgatagttttctaatttggcaaggtcagcaaggactggtgattatcacgggatgtagccattctggtattgatgcaattattcgccatgcgaaaaaaataacgggaaatgacaagatccaagctattgtcggagggctacatcttcgctgtgcctcactggcggcgttaaaaagagcgaaaaaagcaataggtcaccatgttgaggtttatggttgccattgtaccggtgcgcttggccgtagctatcttaatgccaaagattttaatacagggcaaagattattttttaaatga

SEQ ID NO: 4025 - DNA, 510 bp, Proteus mirabilis
aataagattatggctgcggaacatttcgagaaattatccggtgaaactgttggacaaggatttctaatttttacgttgggcaacgaagaatatggcattgatattctaaaagtacaagaaattcggggctatgaccaagtcactcgtattgcgaatgcacctagttttattaaaggtgtgaccaatttacggggggttattgtacctatcgttgatctacgaattaagttttcacaagaaaatgttacctataatgacaacacagtggtgatcgtggttaatttactcaaccgtattgtcggcattgttgttgatggtgtttctgatgtattaaccttaaaacctgaacaaatctgtcctgctcctgaatttgcggtaacaatgtcaacagaatatttaacaggattgggtactttagatgaaagaatgttaattctggttgatattgaaaaattactcaatagcgaagaaatggaattagttgatagcgcaacaattatggctaaataa

SEQ ID NO: 4026 - DNA, 495 bp, Proteus mirabilis
atctttgttattatttgctgttgttttaaaaaacatttttgtcagtgtgaggtgtttatgagcaataatgaaaaaaaagtgcatatttcaagtgataacaatcacattgatttatcaaacctcaatgaaatgcagcattatgtgacgcaacagcggggtactgaaccgccgtttagtggtaaattattacataatagagaaacaggtatttatcattgcttatgttgttctgcgcctttgttttattcggaaactaaatttgatgcaggatgtggctggccaagtttttatcaacctgtaagtgatgatgcaattctttatcttgatgatttttcgcataatatgaaaagaacagagatccgctgtcatcaatgtggtgctcatttagggcatgtatttaatgatggcccagcaccgacaggacaacgttattgtgttaattctgcctctttggcatttagcaatacagaaacaggtgaagtgcaaaagggctaa

SEQ ID NO: 4027 - DNA, 1104 bp, Proteus mirabilis
aggacctctattttcatgctggacttgcttgttcaatggtataaacgtcgatttgctgatccccaagttatcgcgctggtggtgatcttaattgccggtttttcaattatctactttttcagtggcatacttgcaccattattagtcgccattgtattagcttatttgctggaatggccaacacacttacttgagaagttaggatgtgcacgaatttgggccgtatcaatcgttctgacactatttataggtattagtgccattgttattttgattttagcgccaacggtatggcaacaagccatgacgctaatttcagatatccctaatatgatcaataaattcaatgcatttgctcgagaattacctgagcgattccccgcattaatggatgttggcatcgtggatatgatggcggaaaacttgcgcagtaaattttcaacggtggcagagtcagtgttaaaagtctctttagcctctttaatcggcgttatcacgctctctatttatctgatccttgtgccattaatgacgttttttttattaaaagataagcaacaaatgctcaatgctgtccgtcgagtattacccaaaaatagaattcttgcagcacaagtgtggattgaggttaatcagcaaatcaccaactatattcgtggtaaggttaccgaaatggtgattgttggtgtatttacctattttgtctttgctttttttgatttgcgttattcagtcttattagcggttttagttggcgtttcggttttagtgccttatgtgggggcggtactcgcaactattccagtcattgtaattgcactttctcaatggggattaggctctgatttttgggcgctatttatcgcttacttagtggttcaaggtttagatagcaacttattagtaccgatattattctctgaagctgtcaatatgcaccccttagtcattatcttatccgtgattatatttggtggtatgtggggcttttggggggtgtttttcgccattcctttagcgacgttaatcaaagcagtattacatgcgctgcctgatgaaattgccaatgagccacctttagaaacattagaaaagaaaaagtaa

SEQ ID NO: 4028 - DNA, 915 bp, Proteus mirabilis
tctaagcctatattaaaaataagtaaatataactataaggttaatatgtttttttcaatatctaaatggttcctattattagtttcacttattactgtctgcgcatgtagtacagtagaaaaaaacaccgtacctagcacaactcccgctattattacatcagccaatattattgatacgcgtacaggaaagacaatcacagctaatgcgctattaactcaattagccagccaatcgcgggtgattgttggcgaaaaacatgacaatcaatatcaccatgagattgagtattggttaatgacacaacttcccaataaacgtcctcaaggtgcggttttattagagatgttgacgccagatcagcaaaacttagttgataatacgaaaaaacgttactctagctcacaatatttacgtgatgaacgtttaatgtctgtactcaattggaataaaggctggtcttggaaagggtatggcaatctgattaaagaagggctacaagcagattatccattgttagctgctaatatcgatcgcagtgatattacaaatgcatataaaaatccacctaatattgaaggtgaatattcaacgcaacctgctgttcgtcagcttattagtaaaactattgagctttctcatggtggtgcacttgataaaacacaaattgaaaaaatgaccgtgatccaacaactgcgtgatcgtgcaatggcaaaaagtttattaaatgcccctatgcccgcactgttgattgccggctcatttcatgccactaaattaatgggtgtacctttacatattaaagatttagcccctaatgaaacagtcacggtacttatcatggcagaagaaggtagcgatattacctatgaacatgccgattatttgtggataacccctgcagcccatccttga

SEQ ID NO: 4029 - DNA, 1674 bp, Proteus mirabilis
ggggtgactatgtcaacgccattgaaagaacagctactgcaacaacttaatcagttggaaacagagcgtagctcatttgaaccgcattggtgtgaattgtcagatttcactcgtcctcgtagtacgcgctttactgcatctgatgttaatcgaggtgatcgccgtaatagtaagatcattgaccctacggcgtctttggcttcatcggtgctttccagtggcatgatgtcaggtattacaagtcctgctcgtccttggtttcgtttagcaacccctgatcctgatttaatggattatggccctgtaaaactttggctagaaaccacagaacagcgtatgaacgaagtgttcaatcgttctaatctctatcagtcattaccgttgatgtatggtgatttaggtactttcggcactgctgcaatggccgttgttgaagatagtcagcgtattattcgtaccgtgcattttcctcttggtagttactacattgcgaatagcccaagcttgagtgttgatgtttgctatcgcaagtttacgatgaccgttcgccagttggtgatggagttcgggcttgatagcgtcagcgatactgttaaatcaatgtggaattcaagccagtacagccaatgggttgaagtggttcatgccgtatatccaaaccttgaacgacaaacaggaaagttagaggcgaagcacaagccttttaaatccgtttatcttgaagtggcgggtgataacgagaaagtgttacgtgaatctggctatgatgaatttcctattatggcgccacgctgggaagtcaatggtgaagatgtttacggttcatcttgccccggtatgtttgcgttaggtggtactaaagcacttcaattaatgcaaaaacgtaaagcgcagatgattgataagctgaccaatccacctttacaagtgccagcttcattaaaaaaccaacgggtaaataccataccagggggcattaactatcttgatgaggtaaatcctactaataaaattcaaacgatttttgatgttcaacccgtagcattgaaagcactacttgaagatgttcaagatacccgtcaactgattgatactgcttactttgtcgatttattccgcatgatgcaaatggtgaatacgcgctctatgccgattgaagccgttgttgagatgcgagaagagaagctattgcaattagggcctgttctgcaacgccttgattctgagttactcgacaagctgattaatcgcactttctcaatcttggtaaataaaaatttacttcccgttgcgcctgatgaaatgcagggaatggatctaaaggttgagtacatttctgtaatggctcaggcacagaaagcgattggtgttggcagtatcgaacgctttgctggctttgttggcaatctggcaaaagttaagcctgaagcccttgataagcttaatgctgatgatgctattgataattatgcgtctgctattggtgtttctccaacaatcgttgctaccaatgagcaagtgcaagccatacgtcaacaacgacaagcacagcaacaacaaatggcacagatgcaaatggcgcagtccgctattgatggtgctaaaaccctcagtgataccaatcttgataatgatagtgccttgtccgctatggctggtggaggtgctcaatga

SEQ ID NO: 4030 - DNA, 1476 bp, Proteus mirabilis
gatattgctatgttacgaattaaaaaagaagcacttacatttgatgatgttttgttagttcctgcacactcgactgtccttcctaatactgctgatttatctactcaactgactgaaacaattcgcttaaatgtgcctatgctttctgctgcaatggatactgtgactgaagcatctttagctattgcattagctcaagaaggtggaattggttttatccacaaaaacatgcctatcgaacgccaagctgaagaagttcgtcgtgttaaaaaacatgaaagcggtgttgtgacggatcctatcacggtaacaccagaaacttctttacgcgaagtccaagcaatgacagagcgtaatggttttgctggctatccggtagtgactaaagataatgaattagtgggtattattactggtcgtgatgttcgctttgtcactgatttagaccaacctgtcactgcggtaatgacgccaaaagagcgtttagttaccgttaaagaaggtgaagcacgtgatgttgttatgcaaaaaatgcatgagaagcgtgtagaaaaagccttagtagtcgatgatcatttccacttaaaaggcatgatcaccgttaaagatttcaaaaaagcagaacgcaagcctaatgcatgtaaagatgagcatggtcgtttacgtgtaggtgctgcggttggcgctggcgcaggtaacgaagagcgtatcgccgcattagtggcagctggtgttgatgttcttcttatcgactcctcacatggccattccgaaggggtattacagcgtattcgtgaaactcgcgctttatatccaaacttacctattattggggggaatgtggcaaccgcagaaggggctttagcgctggcggatgcaggtgtgagtgctgttaaagtgggtattggccctggctctatttgtaccactcgtatcgtaacaggtgttggggttccacaaatcactgcgattgctgatgctgttgaagcactgaaagatcgcaatattccggtgattgctgatggtggtattcgtttctctggtgatattgctaaagcattagccgctggagcagcatgtgtaatggttggctctatgtttgcaggtacagaagaatctccgggtgaaatcgagctattccaaggtcgctcttataaatcttatcgtggtatgggctctttaggcgcaatgtctaaaggttcatcagatcgttatttccaaactgataatgcagcagacaaattagtaccagaaggtattgaaggtcgtgtggcatataaaggcttactgaaaaatatcgttcaccaacaaatgggtggcttacgttcatgtatgggcttaacaggctgtgcaaccatcaaagaattaaataccaaagctgaatttgttcgcatcagtggtgcgggtattcaggaaagccatgttcatgatgtgactatcacgaaagaatcgcctaactatcgtttaggtatgtaa

SEQ ID NO: 4031 - DNA, 267 bp, Proteus mirabilis
gggtatgctatgtttacttcacagctcatgctggtcggttatgttttattagtcagtccatgcgggcatgattcttgtgatgcggttccagtaacagaaaccatttataccaaggatgaatgtactattcgcttaaactatctcaaaaagaaaagacccgatctctatattttttgtggtgaagtattacgtgatcccgaagtgactgatgaaaatccatacctaacaccgccaaatagcgccgatgatgtctttcaattaaaataa

SEQ ID NO: 4032 - DNA, 1392 bp, Proteus mirabilis
attattaatatattctctctcagacaggtagtattagttatgctttcaacaaaagacatgctagtccttggaatgatggtttttgctcttttccttggcgctggtaatattattttccctccaatggcaggtttccaatctggaaaccaatggtttagtacgtcattaggatttttggttacgggtgtcttactcccttttttaaccttagtcaccgtagctattcgtggacgtggtgaacgcctttctatcgacttgccatcatggtttgcggtgttattttggattgcactttacctgattgtcggttctacctttgcaatgcctcgggtcacgaacaccgcctatgagatgggatttttacctcttggtcttattgaaaaaaataccacgacacatctgactttcgcattaatatttaacctattaagtatgttctttatgcttaaacaaggtacgatgatcagtgccatcggtaaattcatgaccccagcgctcttaatacttctggttgtcgttggtattgctgtagtggctaaaccgctttcccctattgaagagcctaccggcctttatgcggtaaatggcttcttctccggtattattgacggttatcaaaccatggatgtgctatctgctatggcttttggcgggatcgtcgctcgtgcgttatataccaaagggatcaccaatcctaaacaaattggttttatcaccataaaagcggggatgatttcggttttactcttagccgccctttatttatgtttattctatttaggtgccacaagtcacgcagtatctgtttttgctgatccggcactaaatgccactaacggtggtcaaatcttctcacgctacgtagacgctttatttggctctgtcggtacttggttgatgggcgggattgttttattagccagtatgacaaccttagtcggggttactagtgctgcggcagactactttgcgacattccatcatcgtttaggctatcgcttctgggttgtagtatttacactgttaacgacgttagtctctacttttggtcttgataccttattacgtgtcactattcctgcattattaatgatttatccaacatcggtgacactagtcttactacaatttgttcgccataaactaaaatcaccgcgttttacttaccgctttacaatctgtgtcattgttttaatgagcctacttgacacattaaaacagttaaaatggctaaatggagatttattacaactatttagttacattccactgtctgagtatgggctaggttggttattaccgggtattattgcattcgcaatttcattactaattagtctcagttttaaagaaaccgacacagaaattgctacacctaatacagtaaaataa

SEQ ID NO: 4033 - DNA, 207 bp, Proteus mirabilis
ggaataaatatgcctgatatcgcagatgatgctaatgacttaacggctctacaaatcaataccgcattagcaaacagagaaccaccagcaaaaagcttaacagggttttgtatctggtgtcgtgaagagcctgtaacagagaacagcgcttactgttctaaagagtgtggtgatgatcacgctcagtacaaaaggaaaaatggctaa

SEQ ID NO: 4034 - DNA, 219 bp, Proteus mirabilis
ccaaaggatataaccatgaaaaaattatttgataccacagattttaataactgtgatgtatgtggagacgatatgtgcaccatcgcaacagaaggtgacggaaagaaggtgtttaatggcgatagtgttacttgctgtggatgttcaaacacaggtcagataacggttgaagcagaagattgcgcttatatcgaatgggataacccaaacgacgattaa

SEQ ID NO: 4035 - DNA, 804 bp, Proteus mirabilis
attgtgggtatttctgcctcaatgaatgaacctactgataataccattatcggggaagcgccttcatcctaccacactaaaaaaggggggagtgatgatattaaaggtaatttcctgacgttgcttatcacgcagatgcaaaaccaagatcccaccaatccaatgcagaataatgagttaacgtcacagttagcacagatttctacggttgaggggatagagacgctaaataaaacagtcaataccattgttgggcaaattgaccaaagtcaggcattacgtgcgacctcattggttaatcatatggtgatgattgccggtaatgaaatcagcgttgataagattaataatggtgaaaacgctggatctgatgcagatacagataaagatacagatacaacacctgatactaaattaggtaagttacgtgcatctactgatgcgacagataatgaaaatatcttctccagcgcttttggttttgaatcctttagtccaatagatacgcttacagtcaatattactgatagtagtggggctaaagttcgcacgatcgaaatgaattcaaaaattctgccggatgtttatcacttcttttgggattgcactgatgatgatggtaataaagttcctactggaaaatatcaatttacagtaaatgccacatttaatgatgctcaagttccagtaaaaacacttaaaagtgcgatagtcaattccgtttctatgaaagagggaaaacctcatcttgatgttggcctcggtgtcatcgtttcattggacgaaattcgtaaagttttttaa

SEQ ID NO: 4036 - DNA, 528 bp, Proteus mirabilis
tcatttttcattagagcacaatggggttcgttaatgaataaaaccgtcatagcgctaattgctttggctgtttcctttaccgctggctttgttgctggcggtatttattttgataaccgagcaatgaataaacagattgcaggtaatcaattagatgaaaaggatgtggccacaaatattgttctgcgtaaacaagcagacaatgaacagcagaataggttggagatatatcatgacgcacaacagcatgatacgatacgcacagatgctttgcttgatcgtgttcttaatcactttgacagggtgcagctctcaaccggtacctcgaaaacagaagttgcaagtaccgataacgccaatacctgccgagttgagaaagccaaagccagtgaactttctcgacaactacgagaaacacttgaacgatatgggcgtgaagctcagcgtgcagatgaaaataccagaacactcaacctttgtatttcagagctgggagcaaaggaaaaactcctcaattcttaccgatga

SEQ ID NO: 4037 - DNA, 702 bp, Proteus mirabilis
gagtcactcatgtctattgcaaaacgcaccaaagacaaacgtattgcgttaggtttaacacaatctgagcttgctaccttggctggtacaacgcaacaatcaattgaacagcttgagagtggcaaaaccaaacgccctcgttttttacctgaattagcaaaagcgttaaattgtgaattatcgtggttgctcgaaggggataataaacaaacacacgcttctgaaattcctccccaagatgaatggcattcagtcagtgaatgggataacgatacccctctcaatgctgatgaagtcgagatccgttattttaaaagtattgaacttgccgctggtgatggctgctgtactaacgaagatcataatggctataaattgagattctccaaaagcacactacgccgctatggcgcttcaccacaaaatgtgatctgtttttccgtctatggtgatagtatgtctccggttattccaaatggttcaacagtgaccgttgatacaggtaatacgcggattgtggatggcggtatttatgctatcgaacaagattcattatttagaataaaattgctctaccgtcagccaggcggaaaattaattattcgtagctacaataaagatgaatttcctgatgaatttgcagaaattgactccgttaaaattatgggacgcgttattcactggtctgtgatggcttggtga

SEQ ID NO: 4038 - DNA, 783 bp, Proteus mirabilis
aggcaactcataatgcatcagtgtgtctcttattttaacgcattaaagcgctggcctctcttcgctagtgtccttattttgtcactattgccaagccatgcgtttgctcaattccccagtgttatttcacacccattaccgggaggtggccaaagctggtcattgccagtacaaacactgatttttatcacagccctaggttttattcccgccgtattactgatgatgacgagttttactcggattatcattgtgctgggtttattacgtaatgcgttaggtacaccttctgctccccctaaccaagtggtactgggtcttgcgctatttatgacattttttattatggcaccagtgtttgataaaatttatcaagatgcttatctcccttttagtgaagataaaatcacttttgaacaagcgctagataatggctcacaaccactgcgccagtttatgatgcaacaaacgcgcgaaaccgatcttgcactctttgctcgtcttgctgatgcccccgcatttgaaacacgcgatagcgtacctatgcgaattttagtgcctgcttatattaccagtgagctaaaaaccgcttttcaaattggttttatgatttttatcccttttctcatcatagacttagtggttgccagcgtcttgatggcactcggtatgatgatggtgccacccgccaccgtttcactgccttttaaactcatgttatttgtattagtcgatggctggcagttaatacttggctcattggctcaaagcttttttaactag

SEQ ID NO: 4039 - DNA, 249 bp, Proteus mirabilis
gcgatagccataatgggtacaaccagctcagcaacacgcgcaatccaacgtagaccgccaaaaataataaagccgctcatcaccaccagtccaataccaacatataatggatcgaaattaaatgctgatgcagctgcttgcgctattgagttagcttgtaccgcattaaaaacaagtccgaaggcaatgatgaggaaaatggcgaataatacgcccatccaacgcatattgagaccttttgtcatataa

SEQ ID NO: 4040 - DNA, 741 bp, Proteus mirabilis
acctatcacatctttggagtgtgtcagatgcaaaaaaaagctgagttgtatcgtggtaaagcgaaaacggtttataccactgagtcttctgattatcttattcttgaattcagaaacgatacatcagcgttagatggccaacgtattgaacagtttgatcgtaaaggaatggtgaacaataagttcaattatttcattatgaacaaattggaagaagcgggtatcccaacgcagatggaacgtttgctctctgataatgaagtgctagtaaaaaaactcgatatggtgcctgttgaatgtgttattcgtaaccgagcggctggatcactggttaaacgtttaggtattgaagaaggtactgtcttaaacccacctatttttgatctcttcttaaaagacgatgcccgtcatgatccgatggttaatgaatcttactgtgaaacttttggttgggtatcaaaagaaaacctcgcagaaatgaaacgtcttagttataaagcaaacgatgtcctcagtgaactatttgataaagccggtctgatcctcgttgactttaaattagagtttggcctctttaacggtaaagttgtgctgggggatgaattctcaccagatggtagccgtttatgggataaaaacaccttagataaaatggataaagatcgcttccgtcaaagtttaggtggattaattgaagcctatgaagaagttgcacgtcgaattggtgtttctttagactaa

SEQ ID NO: 4041 - DNA, 771 bp, Proteus mirabilis
attagtcacatggatgtgagtatgatttctcttttaaataaggagacaactatgtctgatgaaaaagaaagtcaatttatctcaaaattagtaatttacttatttatatttattttgattgtataccatatatgggaggctgaacctggaacatcagaaaaactagctaacatattcagctttatatcatcgcttggtattttagcaactattggggtttattttgcacaaaaaagaaacaataacaaaatagaaaatgaaagattaaataataaaggaatcgcagtaaaaaaaacatttagattagaattggaagcatcaattttaatatatgaagaaatatttaatttaataaattttataaaaaatgaaccatatacatcagtaaaaatatctgaaaacaaggagctagtaacattttatgttcataatggaaaaattttagttggtcaatttcatatggaaaaacatagtaccaacgtaatgaaagatttactattattatcagttgatgttgatgataacttatatcaacaattattattttgttacaactcaatagttacatcaaattggttcttgaacacattcattcttttccataaaacaatgatggacataatgaaaattaagcaaagaaatataatcctaactgtaaaaacaatgaattacattattttcaatactgagattcataataataaatacagcgaattattgattcgggaactaaaaacactaaaagaaatacataatgcatattatctttaa

SEQ ID NO: 4042 - DNA, 252 bp, Proteus mirabilis
tccgcaaacattacaccgaactcgaaaagctacggacagcttaatttaactcacagggatgcaataagaggaatgaatatgagtaagcaaatgcatttgcaggcagccactaatgctgtcggctctgaatgttcaactgagttagatataacggaagatgagtggaataagttatcacttgaacagcagaatcagcttataggtgagtttatggggaatgtgtgtgagtggtgggtgcagccagaagattaa

SEQ ID NO: 4043 - DNA, 633 bp, Proteus mirabilis
gaaattagcatgttaaccattcactcgttaactaccggtattttaacagaggtttcattacacctagagcaagggtgttgtttagggatcagtggctcatcaggtagcggcaaaacaacgttactcaatgctattgccggttataccgactatacaggggatattgttttagctaaccaaaatatgaataaattacctgtttggcagcgcccctgtcgttatttaaatcagcgtctttatttatttccttttctcactgtaaagcaaaatttatggctggcacaatatgcggctaagcaaaagcgcagtaaagaaaaagagatagcgttacttgaacagatgggaattgctcatttagcaacacgttatccatctcaaatatcagggggagagcagcaacgagttgcattagcaagagcactcattagccaacccaaactgttattaatggatgaacccttttcaagtttggattgggaaacacgttatcagctgtgggagcttattatctcattaaaaaaacagcagataacgatgataatagtcactcatgagcctcgtgaattgcaagcattagcagataaaacgctgttattatctaatgggaaaattgtgcaagaaagtaaaaactaa

SEQ ID NO: 4044 - DNA, 1206 bp, Proteus mirabilis
ggttatagcatgctgaccgatacaaaactaagaagtttaaagccacaagacaagctttataaagtgtctgatcgagatggtttatacgttgcagtgacaaaaagtggtgttatttcatttagatatgattatcgttttaatggaaggagagaaacggttacttttggtcgatacagtgctgacggtatcacgcttgcagaagcaagagctgaattaactgaagcaaaaaggctactaaacgcaggtatatcgccggcttcaaaaaaacgtgacggtattgagagtaaaaaaatagggacggtattcaaagactataccgtcaatttccttaatgatgcccaatatgccgactctactagggccatgaaagaagcaattattgaaaaagaaatctatcctgtattcggcaagcttcaactagaagagatcaccacaccacggcttagagctttgtgtgaaaagataaaggatagaggcgcaaaagcgactgcattacaagtgcgtgagattgttggatccgtttttacttatgccatagatagaggttatgaaattagtaacccagcagatgcaataaaggcatcttcgatagggacttttcaagcgcgcgaaagggcaatgtcgccgaaagaaatcggtatcttatttcgtgaactagaaaactatagttgttatccaaccttaaaattggccgttaagtttgtattgctaacattagtcagaaagtctgagtttattcatgcaacatgggatgaaatagactttaaaaatagacaatgggtgatccctaaagggcgaatgaaggggagaaaagagcatgttatttatctctctgaccaagcaatggatatcctaactggtatgaaagtttgtgctatgggaagcgattacttaatgcctggtcgatatgatattaaaaagccactttctaatgctgcattgaataacgtgattgatggcaccgtaaaacgtatcaatgaaaaaggtattgagttcgaaccggttaccgttcacgatttacgacgcacagcaagcacgctattgcacgaagcaggttataactcagattggatagagaaatgtttagcacacgttcaaaatggcgttagagccgtttacaacaaagctgaatatgctgaacagcgtaggaagatgttacaagagtgggctgatatggtggatgaatggataaaagagaaagattaa

SEQ ID NO: 4045 - DNA, 609 bp, Proteus mirabilis
atgaaaagcattgctgaaattagaaaagataacctgatttatattattgaacgctactataacggcaaacaaaaattactggctgatgcgttaggtgtagcaccaagtatgatctctcgttacctatcaccaaaagatttaaaaagtcatcgtgaactcaccgatccaatgtcacgcaaaattgaatatgtgactagaattagcaaatattggatggatgtagaccacttaaaagaaggtcatgcggagtcagaaaaagaagaatatattccgactgaaattggcaagatactctcagataacatcacaacatttatgttaaacgatggaataaaatcaagagttaagctttctgtcgattcagggcttgcacaatcaacagttaaccgcattatcaattgtgaagccagcgccaccgctgaaagcattgatgctattgcaaaagcaatgggtcgccaagcctatgaactactgatccccaaaaatgataaaggcactattaactatgatagaagagcctattcaaaacttcccgccagcgaacaagccgctattgaaaatttcattgaatttatcattaataaaaaccagcctatctcccacgactaa

SEQ ID NO: 4046 - DNA, 1056 bp, Proteus mirabilis
ggaattttaatggcaacactattgcataaatcaaagattatgaaagtcgcgggtctgtcgctggtggttttattggcagcctgttccagtgatcagcgctataaacgtcaagtcagtggtgacgagtcgtatttagagtcagcagcgctaaaaaatttagttgtcccagcgggtatggtgttgcctttgcaaaatggggaatatgatattcctacgcctaaaaagagtgagcctgtgggtttagcattagatattcgcccaccaacacaggctttaaacttattaagtggctcacgtagtgagaataatgcggataatagccgactgttattacccaacacgcccgaaaataccaccttatacgagcaagtttctgctgttttagcggataaaggtgtggcactggctaaaagtgatgcaggacaaaaacagattgttaccgattggatcacttggactcgtgctgatgaaaatgtgcctttccaaagtcgccataatttagcgataagccagtcaggtaatgttgtgatattaacgattacgaatactgggttacgccaaggtgaaaacgagatttccgatccaatggaagtgaagcgttataacaccttactattaaatgaagtggttgacggtttaaaccgcatgcgtaacttaagtgaaaatagcgcaacgagtaatttgcaaggtattatcgacgtacaaacgggaagtgataatgctgggctgcctgtcattattgttcgagcaccatttgatgttgtgtgggatagattacctatcgcgctagaaagcgtgggtatgaaaatgggcgatcgtactcgttcgaaaggttcaattgaagtgacttataaaggcttaagtagtgcaagttggagcacattaggggttgataaaccaacaattaatgaaggggattacaaactacaagtcggtgacttaaataaccgcagtagtttgcaatttatcagtgataaaggtaaacctcttacacagtctgaaaatgatcagatggttgctgcaatgaaagcggcctttagtaagccaataaaataa

SEQ ID NO: 4047 - DNA, 1419 bp, Proteus mirabilis
gtctttgttttaaaatttgatctggctcacatgactctaccgataaacaataatatttttactgttagccgtctaaataagaccgttcgccagttattagaaatggaaatgggtcgcatttggatcagtgctgaaatttccaattttactcaacctgcttctggccattggtatttcacgttaaaagatacccatgctcaaattagagcggcgatgtttcgcggtcaaaacacaaaagtcacttttcgccctcaacatggtcagcaagtattagtacgtgcgactatcacactgtacgaaccccgtggtgattaccaactgattgtcgaaagtatgcaaccggcgggtgatggattattacagcagcaatttgagcttttaaaacaaaaactaagtgctgaaggtttatttgatgctcttcataaaaaaccactaccaacacctgctaaacaaattggggtgatcacctcctcaactggcgcagccttacacgatattttaaatattctacgtcgtcgtgatccctcattacctattattatttatcccacagccgttcaaggtgcggaagcaccaatgcagatagtccatgccattgaactggctaaccgtcgtaaagaatgtgatgtgctaattgtcggccgaggcggtggctcattggaagatctctgggcatttaacgatgagcgcgtagcccgtgctatttttgctagtgatattcctattgtcagtgccgtgggtcatgaaactgatgtgactattgctgattttattgccgatcttagagcgccaaccccttctgccgctgctgagttaattagccgcaacaaactcgagctattacgccaattgcagtcacagcaacaacgtcttgaaatggcgatggattattatctagcaaaaaaattacgcgcactaacacaacttcatcatcgcttacaacaacagcatccacacttacgccttgctcgccaacaaaatgtattggctacaactaaacagcgtttagtgaccagttttcagcgccttctacaaacaaaacagaatcaacatactcagctacaaaaacgccttaattaccaagagccaagccctcaaatacaagcactactgcgccaacaacaacagttaatttatcgtatgagagaaagtatttcacaacagcttgctcgtcaacgtgaacaatttgcaattagctgttcacgtttagaaagtgtgaatcctctcgcaaccctttctcgcggttacagtattagtgaagttgcttcaggtgacgtactgaaaaatacgaaacaagttaaaaaaggtgatacgctaaaaacgcgtgttgaagatggctggatcaccagtgaagtgataaatacacaaaaaatatctgttaaacgtaaaccagcccccaagagaaagtcatccatttaa

SEQ ID NO: 4048 - DNA, 975 bp, Proteus mirabilis
ttaaaaataatatttatttcgcatggatttctttcagttaatatgtgttttatttatattaataaaattaatttaattgttttgtttaacacagcaaaggaatggtggattatgtttttttctcgtaaattagaggcctttatggccgtcgttgaaaatggatccttaagtaaagctgctcgtgtgatgaaccgaacgacaccacctgtagcgaaatcaatcaaagattttgaagccgtgctagggaagcgcttgtttaagcgggaaaagtttggtatgagtttaacgcaagaagggttagaactctataatgatttaaaatcactttatctgcaagaaaaagagataacaaaaaaacacacatcgggcgttattaataatagcattcatgtttattatgattggggtaaaagtcaatatttaacagcactctatcaagcagccaataagaattgttcacatataaatatgatgagattttcgaaagataattttgaagagataccagattatgatggaaacacgttaatcttaagctcagataaaattattagtgaaaagtttagcttaatacatcaagttaaaaataaatatctaggaatatgttgccaacaaatcttagcacaaaaagcacaagagaatatcaatacattgctaaaagaaaatatttggttatgtgatcccgctttatataaaacagcaaaaataaagaaattagaaaatgaaatagcggatcagggtaaacctgtcagtattagattgatggatgatttaaattgttgtttaaactttattcaaactcaccattcgctattatttactgatgaaaacccgattaaaagtgaggatgaaaagcaactgtgctttatacctttaacacaaacggagctgatttataattgttatatctataaatctaaatatcactcgagtatattgaacaggtttgttgatttaatcaaagaattggaatga

SEQ ID NO: 4049 - DNA, 372 bp, Proteus mirabilis
ctattagtaataaagttttttatccattatctatacaattgctttctatttctttttttaaaattttttaaaataatttcttttagttacttgcattactcatcgctctcttttactttactctcatataacaagggagaaagtacgatgggttataaccttgctgaacttacacaagaagaaaaagataaaattaatgtcaacctagccgcttcaggggttgcctttaaagagcgttataatatgccagtagtagctgatgcgatagcaagagagcaacctcaagctttacaaagctattttcaagaaagagtgaccttttatcgagcacgaagccaacactattctcgcttaccttttgagtcgaaataa

SEQ ID NO: 4050 - DNA, 666 bp, Proteus mirabilis
ggagtcgcaatgagtggggatccaattatgccgaaagataatgtcgaaataacgtcagatattatcagtcggatcggacaattgacgcgtatgttacgcgacagtttgcgagaattaggattggataaagcaatagcagaagcagcagaagccattcctgatgcaagggaaagattggactatgttgctcaaatgaccgctcaggcagctgagcgtacattaaattgtgtggaagctgcgcaaccaaaacaggatgagttaagtagtcatgcaactaagttaactgaacgctgggatcaatggtttgagcatccagaagatctcaaagatgtacgctctcttgtaacggatacccgcaattatttgcgggatatccctgaaagtgcggcttttacaaatagccaattacttgaaattatgatggcgcaagatttccaagatttaacaggccaagtgattaaacgtatgatgagtgtggttcaagaaattgaaaaacaacttgttatggtattaatggaaaatctgccaccagagcaacttgaaaaatccaatgcgaaaaaagagactgattcattattaaatggcccacaagtcaataaaaacaatgctggtgtgattaagaatcaagatcaggttgatgatttactggaaagtttaggtttctaa

SEQ ID NO: 4051 - DNA, 1581 bp, Proteus mirabilis
gcgcctaaaatctctattcggaggataaaaaacataatggatatgagtataagacaagcattactgaaaaatttcatggggaactcccctgattggtataagcttgctattattacttttttaatcatcaacccactgatttttttctttgttgaccctttcattgctggctggctactcgttgttgagtttatcttcactttagccatggcattaaaatgttatccgctacaaccagggggattacttgctattgaggccgtcattattggtatgacaacgccgaaacaaataggtcatgaaatagccaacaaccttgaagtcattttattgctggtctttatggttgcgggtatttattttatgaagcaattacttctatttgcttttacaaaattactcctctctatccgttctaaacgcttattatcattagcattctgttttgctagtgcttttttatctgcttttttagatgctttaaccgttattgccgtggtgatcagtgtttctttaggcttctattccatctaccataactttgcttctaaccaggctgatgcagagttaagcaatgatggctttattgatagcacagagaaaaaacagaccttagaacaattccgtgctttcttacgtagcttaatgatgcatgccggtgttggtactgcattaggtggtgtgatgacgatggttggtgagccacaaaacttgatcattgcaaaacacctagaatgggattttgtcaccttctttatcaggatgtcacccgttactattcccgttttctttgctggacttgcagtatgttatttggttgagcgctttaagctgtttggttatggtgccgaactacctgaattagtgcgtaaagttctcactgactacgataaaaagaacagtgaaaaacgaactcaacaagaaaaagcccagttattaatccaagcattaattggtatttggttaattgttgcactggccttacaccttgctgaggtcggtattattggtctttctgttattatcttagccaccactttctgtggtatcactgaagagcacgctttaggtaaagcttttgaagaagcactgcctttcaccgcattacttacggtattcttctccgttgttgccgtgattattgatcaacagctatttggtcctattattcaatttgttctgcaggcatcagaatcttcacaactgtcactcttttatctctttaatggcctactttctgccatttcagataacgtatttgtgggtacggtctatatcagtgaagcattaagcgcattgcaagaaggattaattagccaatctcaatatgaacatattggtgtcgcaattaatactgggactaacttaccgtcagtggcaacgccaaacggacaagcggctttcttattcttattaacttctgcattatccccgctgatccgcttatcttatggacgtatggtgataatggcacttccttataccatcgttatgacactgttaggattactggctgtagaattctggctcgtgcctatgacacattggttatatgaaattggcttaatcgctattccataa

SEQ ID NO: 4052 - DNA, 897 bp, Proteus mirabilis
ggttataaaataatgaatgagaaaattttttctttgccggttattgaacaaatatcaccttacttaagtcgacgccaattaggtgaactccctattctggtgatctctcaccccaaagtacgtgcggctattagtcttcaaggtgcccatcttatcgcatggcaacccgcacaaacgcaccccgttttgtggctcagtgaagatgccttatttactcccggtgttgctattcgtggtggtatccctatttgttggccttggtttgcctcagcgggaaccccaagccatggatttgcacgtatcttaccttgggaatttagtgctcattctgaacaagaagacggagtgcttatcaccatgacactcaaagaaagtgcacaaactcaaaagtattggcctcatgaatttactgttattgctcgatttaaattaggtgatacctgtgaaattgaattagagtcatacggtgactatgaagccactgcggcgctacactcctattttaatgtcagtgatatcgataaagtttccattacaggccttggtggtcactatattgacacagtggcggataaagaagtttataccgacgaaacagccctacgctttaacggccgtactgacagactttatactgaacctgaagattttaatcttattcatgatgatggttgggatcgtactattgaggttcaccattatcatcacagtgatgtcgtttgttggaatccgggtgcagaactcgccagttcaatgaaagatatgagttcaggtggttaccgtaaaatggcatgtgttgaaacagctcgtattcatcgtccacttaagccggataatgttcatcctggacgtttatctgctgtgatacgcgtgcgcaaaaatattgctgaaaaatag

SEQ ID NO: 4053 - DNA, 1734 bp, Proteus mirabilis
gtaaacaaaatgtcagacactaagcacttaaatgtgttgattgcaaaagctcttttacttaaccaagatattactgatagcgaacaagtagatgcgctaacagctcatatcaatggtgatattgaaaaagaagagtttaagcaatatgaccactttattaatatcacgttacttgcactttcattggttcctaatatcagcagcgaactcagtgaagagcaaatcgttaacgctattatgtcatttattgataaccctgatatgcgtagcgttcgtcatagagttaatcactttaactcattaacaaatccaaaaaccacctcaaatgaggtagaaaaaaaggaagcacctcaggaagaggtgatttttcacgccaacaaagataaccaaaacggtcaacacgaggaagcggaagataatccaaaggaagaaaatgaccaacctgcttattttgaaccgggtcgttatccagatattcctaacgaagtgtatcacagttcaaacggcatcagtagttcgatgctaaaagatgctcgtattagtttgatgtattacgagttacgccatgtaacaaaagttattgagcgtgaaaataagcgttgtttcgacttaggtagtgcatttcacacattaacaatggaacctgaaaagtttgatgctgaattcagtgttaaaccaattattccagaaggtgcctttacaacaacggaaacaatgaagtcatggattgacgaatacaacaataagttgcctaaaaagctctcacaagatgagttaaaagcaattattgaagaacataatgccactctgacaccgcaactttccaccagcggaaaagccgaagagctaggtcagatatacatgcagttgcccgatgaatttaaaaccatccctgaagatgggaaatttactggtgcagcaatgaaagcctgtatcaaagcctataacgatactttgccaacaccattgaaaacctcaggtaatacagacgcattacttgatcagatatacttccacatcaaccctgaattatatttggcagaaacacataagcctgagccacttagaaaacccgtcaaaaaagatgacctcatgcaggttattaaagaagtgaaccctgatgctgtatttgaagatgaaatcattagccaatggcttagtgacgattcaaaaattcatgttcaaaccgttgactatgaaatggcaaataacatgcgtaacgctgttatgaaccacaaagaagcatccagtttattaaaccaccctaaccgcgtatcagaagtgagctactacggtattgatgaagataccggccttgaaattcgtgttcgtcctgatatcgaaattcaaacagaaaataaccgattaggttttgatctcaaatcagtagcacttggtcgatttaaacaagatgccattgaagccatgatccgcagagaaattattaatcgcgattatcacatcagtgcagctatgtattgtgatgtggcaatgctggatcagttcttctggatattcgttaacaaagacgagcattaccactgggtcgctatcgttgaagcctctcctgaattacttgaactaggtcgcacagagtacaaaaagacactgcgtgatatccgtgaagctatggatacaggatattggccagcgcctatcaccacgactctcactatcggtatcactgactttgagcagagaaagttagaagaactgcaaaacgaagtcgcttaa

SEQ ID NO: 4054 - DNA, 471 bp, Proteus mirabilis
tcaggaaaaataaagagggttccaatgcgggagcagtcacctttagtgacactgagggaactggcacagacagcggcagaacaagccgctgtccaactagcccaagtccgccagagtcatcaacagatggaacagcaactcaatatgttgatcgggtatcaggatgaataccgtgttcgtctcaaccagacgttaaatgtgggaggcatgtcatcagcatcatggcaaaactatcaacaatttctcaaaacacttgaattaactatcgagcaacataaacagcaacttcgtcattggcaagcgcaactcgaccttgcaacggaacattggcgagaaaaacagcaacgactcaatgcgtttgagacattggagcaacgcgctgaagatagccgtaagcgacagcttgatcgtattgagcagaaacaaatggatgagtacgcacagcgtagtactttacggagaacaacttga

SEQ ID NO: 4055 - DNA, 360 bp, Proteus mirabilis
atgatgaaaattaaaacctcaaaactaaaaggattagcgcttgattgggcggtaggtaaagctattggcgttgatgttcgtattggcaaagagtttattgttgatgctaataactgcgtatatagcccatctagcgactggttaaagtgtggtaagtttattgagacttacgctattgaactgatcaatgagatgttgagtaacgatttcggacattatcaaattgcatggtctgctatctgtaattacttacaagatgattattacgatggtgatacacctcaagaggcaatttgtcgcgctactgtcgctgtggtgttaggtggtgaagttgatgtgcctgaggagctattaaaatga

SEQ ID NO: 4056 - DNA, 342 bp, Proteus mirabilis
ggcgaagaaatgaatggattaacttacctaatattagccattatatctgaagttattgcaacaacggtgttaaaagcatccgatggctttagtcgattatatccatctattgtcgtcgtggtggggtattgtttttctttttgggcgctatctcaagttgtgaaagttatgccactgggtattgcatatgcaatttggagcggattaggtattgttttagtttctgttgcggctgtttttgtctatcaacaaaaactcgatttacccgccatcgtcggtatgacattaattattgccggcgtcttagtgattaacttactttccaatagcacctcacactaa

SEQ ID NO: 4057 - DNA, 789 bp, Proteus mirabilis
cctgacagaatttctgtcaggcgtattactaaaagagtatcgaagatggatacaaaggtcattactgacaattctggggcaagcaagcttagtgtcagatggcgtcgtcatcaacgtttaggtaccgccctgttggtactgacactagcagggtgcgctcagataccgaaaaaaccattggttgaaggacacaccacggcaatacctactgcgcctaccacaccagcacctaatggctctatttttcaggctacccagccggtttattttggttatcagccattatttgaagataggcgaccgcgaaatattggcgatacattgactatcaccttgcaagaaaatgtcagtgccagtaaaaactcgtcggcgaatgccagtcgcaatggtaaagccggtttccttgcttctattacaccaaggttcttagaaggattattagggaatagccgtactgatatgggcatggaaggaaacagtgagttcggtggtaaaggtggtgctaatgcgaataacacctttaaaggcaccattacggtaacggttgatcagttattggcaaatggcaatctacacgttgtaggtgaaaaacaaattgcgataaaccaaggcactgaatttattcgattttcaggcgttgtgaatccgcgcactatcagtggctcaaacacggtcaattcaacccaagttgctgatgcgcgtattgaatatatcggagacggttatattaatgaagcgcaatccatgggatggctacaacgtttcttcttaaatgtatcacctttttaa

SEQ ID NO: 4058 - DNA, 438 bp, Proteus mirabilis
atgataaccttaggttataaagctatgagaaaatcaagcgaagaattattaaaatgtattgcaacaatattacaatgggtgctgaattgcggattacttattctagccatcgtattagtcagttttttgatcaaagaaacttatgttatcgcctctttattatttaacttagctgctgaagaatcttcttatcagttattagaaggaattttgatctacttcctctattttgagtttatcgcattgattgtaaaatattttttatccggtggtcatttccctttaaggtattttatttatataggtattacagctattgtgcgtctgattattgttgaacataaagactcggtagatactttgattcagtccggcgccattttattgctcgttatcgcgttatttattgcaaatactgaaaaattaaaacgaagctaa

SEQ ID NO: 4059 - DNA, 270 bp, Proteus mirabilis
aaattattgattattatcacattaacgtcagtcataaaccgttatggtaattttatgattaataacgtaaacggtgatgatatggaatattggtttattgcgtataaagtgcgttccagaaatggtgatacctacgccgggcataaaatagtagaaactgagagtgggatcacaccccatattgcgttagaaaaagcatgtcaggaagttgcacaaggggctcaagctgatattcctgcggtgagagttgtggcatttaatcgtttataa

SEQ ID NO: 4060 - DNA, 312 bp, Proteus mirabilis
ataccagtgatcctatttaaagcggagcgatacagctccgcaaggagtttaaatatgaatattaaattacctatcaaccctattcgtatgcctgatgttttaaagctaacagggctttctcgctcaactattcgcaccttagagaagaaaggcgattttccaaagcgtatgtacttatctgtgcgctgtgttgcttgggaagcagaagaagttgatgagtggttgaaaaagcgttctcaatcaagagagacacctaagtgttacaccgaacgtaagcgtaatgaagcaggtcagtttgtgagtaacgcctaa

SEQ ID NO: 4061 - DNA, 1122 bp, Proteus mirabilis
ggagagacgatgtccagacctgccaaaattagcataaatttagatgcgctgagtcataatctttcggtgatcaaatcgaaagcgcagggaagtaaagtgtggtcagtggttaaagctgatgcttatggacatggtctttcttgtgtttggcctgcattaagtcataccgatggttttgccttaattgaattagataaagcaattatgctaagagagcaaggatgggtaggccccattcttttgcttgaaggttttttcaaaccagatgatgtgtatttattagagcgttattcattaacgacggttgtgcatgctgattggcaatttgaagccattgagcaagcgcaattagagcggcctatcaatatttatctgaaactcaatagtggcatgaatcggttaggttaccgaccagaagactatcagcaagccatacaaagagcaaaacgcataactaatattggctctattgtacaaatgtcccattttgccaatgctgatacagggctgaatatggcgacacaaaaacagattattgatagctcaatggtaaatgatttaccgcgctgtttagccaattctgcggctattttatttgaaccacaaacccatcattcatgggttcgtcccggtattattttatatggtgtatctcccactggggtgtggcaagatattgctgattttgatttgcaacctgtgatgacctttaacagtgaagtattagccattcagtcagtaaaaaaaggtgagcaaattggttatggtagccgatataccgcacaacgtgatatgagaattgctgttgtcgcttgtggttatgctgatggttatccaaggcatgccccagatggtactcccgttatcgttaaaggacataaaacacaattagttgggcgtatttcaatggatatgcttactattgatgtaaccgatttgccggatgttgaacatggaagccctgttgagttatggggaaatcaattaccggttgatgaagttgcactggcttgtggcactattggttatgaattactgtgtgctattgcaccgcgagtggcggttgaagtgacgataaatgtagcaaactctactttttctgatctaaatgaaagttgttaa

SEQ ID NO: 4062 - DNA, 258 bp, Proteus mirabilis
ttacatcagatgtcggtggatatagcagggggagtgatgaattcaatttcgataagtgcggtgttgttagccgcgattgtgctatttgcatctgtgtttgttgtcgctttagctagtagtctgctactaaaaaaaacgctgtatgggagtctgcaacaagataatttatcagtcagtgttgcggtaagaagaacgtttatggtatcgcttgttgtcgcattactactggtctattactttctttcaacaacaacctaa

SEQ ID NO: 4063 - DNA, 870 bp, Proteus mirabilis
ttgggggagatatgttattatctctcccaattttattttggaatatgtaaaaatattatgtcttatcaatgtccactttgctcccagccacttgctcttaaagcccatagttgggtttgtgacaatcaccatcaatttgattgtgctaaagaggggtatgttaatttactcccggtacaatttaaacgttctaaagagccgggggatagtgcagagatgattagtgctcggcgtgattttttagatgcgggcttttatcaaccaatgcgagacaaagtggctcaattagtggctgaacatttaccggaagataatcctcaggtgttagatattggttgtggagaagggtattatacctatcagatatatcaacaactaaagtcaaaaaatccacaagtctatggcttagatgtggcgaaggttgccattaaatatgcagcaaaacgctatgctcctattcagttttgtgttgcgtccagccaacgtctgcctttttgtgatgcgtcattaaatgcagtggtacgtatttatgccccttgcaatgccagcgaattaacacgagttattgctcaagatggatatattattacggtgacacccgcaccacgccatctttatcaactcaaagcgttgatttattcaacagtgcatcttcatccactaaaagatgaaatatttgctgggttcaagctaatagcacagcatcaagttgcttataatatggcgttaacaggtaaacaagcggttgatttattacaaatgacgccttttgcttggcgtgcgagtgaagaggtaaaagagacattagataaaacagagcaatttgcttgtgaaactgattttctaattcgtgtttatcaacgtgtttag

SEQ ID NO: 4064 - DNA, 435 bp, Proteus mirabilis
acgctctggatgaggaacaaaccaatgagtgatgaaaatcgcccaactgataattcacaatcggctgaggatatgtgggctgatgcaatggaacagcaaactggcaaaagccaagataatagttccgacgtattcgaacatctgttacctgaagatgatacgcttaatcatctatctgatatcaatttgattatggatattcctgtcaaattgacagtagagttagggcgtaccaaaatgacgattaaaaaactcctaagcctatcacaaggctctgtagtgtcattagatgggcttgcgggtgaaccccttgatattcttatcaatggctacttaatcgcccaaggagaagtcgtggtcgtttctgataaatatggtattcgcattaccgatatcatcaccccttcagaacgtatgcgccgtctgagtcgttga

SEQ ID NO: 4065 - DNA, 834 bp, Proteus mirabilis
ctgctttactttaatatggggatgataatgagtattaagcttatcgttattgatttagatggaacgttactaaacgaacaacatgagatcacacctgaagtacatcaagcgatccaacatgctaaaaattctggagtgcatattgttcttgcatctgggcgatcttttaacggcatctctccctatttaaaagcactgaatcttgatacatctgataacttttgcattagcaataatggtagccaaattcaccaagcagaaaatggtgaaattatcaccgaagacttgctcaattttgaagattacctctattttgaagatctctcccgtgagataggtgttcactttcatgttttaagtgataataaaatttataccaccaatcgccatattagccattttacttgtcgtgaagcattcttaacgtggacacctctctattatcgccctttaagcgaaatgcaaagagatatgcgctttagtaaatttatgatcgttggtacacctacggtattagataacgcgatgcaatatttacctgctaatatctatcaacaatacagcatattacgtagcgctccttattttattgagatattaaataccgatgtcaataaaggaaatgcggtacaaaaaatagcagaacatttaaaaatcactccagagaaaataatgtgtattggcgatcaagataatgatttagcgatgttacagtatgcaggattgggtgttgcgatgggaaacgcccctgaagagatcaaaaaagtggcgaaatttattacattatctaataaagaacacggtgttgccgtcgctatcaataaatttatttaa

SEQ ID NO: 4066 - DNA, 1161 bp, Proteus mirabilis
ttacctgacttttacaggagcctaatttttatgtcctgccctgttattgaacttgcacaacaacttatttctcgaccttccgtaagcccagatgaccaaggttgtcagcaactgatcatcgaaagattagcacctttgggctttaccattgaaaaaatgccttttggtcagaccgaaaatctttgggcatgtcgtggtggtgagggagaaaccctcgcatttgcaggacataccgatgttgtgcctcctggcgctaatgcattatgggataatccaccttttgagccgtctattcgtgatggaatgttatatggccgaggtgccgccgatatgaaaggctctcttgcagccatggttgtcgcggctgaacgatttgtgcatgcttatccgcaacatcgtggacgtcttgcttttttaattacctccgatgaagaagccgatgctcatgatggtaccgttaaagtggtcgagtcattaatatctcgaggagagcgacttgattattgcttagtgggtgaaccatcgagtcaacatcaactcggcgatatgataaaaaatggccgacggggttcaataacagcaaatgtcactatttatggtacgcagggccacgttgcttaccctcaccttgcacaaaaccctattcatatggcgtcaccttttattcacgagttagtgaatacagtatgggataatggcaatgagtattttcccgccactaccatgcaaattgccaatattaatagtggaactggcagtaataatgtgatcccaggtgagttatttatacagtttaactttcgttttagcaccgctattacagatgaagaaattcgtcaacgtactgaagcattactacaaaaatatcagttgcgttatcacatttcttggtctttatctgggcaaccttttatcactggtgaaggaaaattactggatgcggtacgttattcagtaaaacactacaccaatatagagccaacgctttcaactagcggaggcacctccgatggacgatttatcgcccaaatgggtgcacaagttgttgaattagggcctattaatgccaccattcataaagtaaatgagtgtgtcagtgctgctgatttacaacaacttagtcgcatctatcagcggatcatggagcagattattttatga

SEQ ID NO: 4067 - DNA, 399 bp, Proteus mirabilis
aatggaactgtaatgccacaagataatcatctcgcattagtttgcgcgctaagtaaatggattgaggagcatttaggtcgcgtaatacaccttgaagagctagcggcttactccggctattccctttggcatatgcagaaaatttttaaagaagtcacgggcacctctttaggaaagtatattcgccaacgccgtttagcgggggctatccatcttttacgcaccagtgaccgctcaatatttgatattgcattagatttcggctttggctcgcaatcacactttacttatatgtttcgtaaagagtatggcatcactccatttgactttaggcaaaatcaaaatatcgagttagagacaaaacagcccttacatttgcaatcactttgttgtgattag

SEQ ID NO: 4068 - DNA, 852 bp, Proteus mirabilis
cactttgctgtttttttcttactaagatcttgccttaatttctcatatctatcattatataaaaaattatataacgatattgtgtttgaggatgttatgaaacgccaaattttggtaggtttaggttttgcgctaggattattttgccataatagctttgctgtagagcttcatctttatgctggcgcaggattaaaacagcctgtagagcaagttgttggtctatttgaaaaagaaaccggcaatacagtgactatcgaatatggcggttcaggccaaattcttacacgctttaatctcactcaacaaggtgatctgttttttcccggctctcaagagtatgtagagaagttagcgaaacaaaatcaggtggttagccaatatcctattgtgcgtcatattcctgttattgctgtcagaaaagataaaatcggtgagatcaaaactatcacagatcttgcaaatagttcattgaaattaggtatgggagatgcaaaagcaattgcattaggtaaaagcggtgaacaattaatcgaagcgtcaggccaaggtgagcagttacgaaataaagtggttgttcgtacagcaaccattaaacagttacttatgtatttattaaatggtgaggttgatgctgccattattggttacgctgatgcaatgaaaaatcaagataaattagttttattacctatacctgaaggaagccccgaagaaattgcgacattagcggtattaaaaacttcaacaaatcccacacaagcacaacaattggctgattatttttctcgtcccgaaggaataaaggcttttactgattatggttttctacctgttatttcaaaaccatag

SEQ ID NO: 4069 - DNA, 873 bp, Proteus mirabilis
agtagttatgttgctattgttagccctagtcatcatcataattggcaacatattaaatttaagagttgtaaggaaataccgagtaacatcatcatgcataatcagatattaaaaaaactgccacaaatagagcaaacgcatcaaataaaactactttatgttgctgaaagtggaagccgtgcttggggcttcgcatcaacggatagtgactatgatgtacgtggtatttttatacgacctcgcaatgcatatctttcaattgataaacctaaagaaacatttgagtggatagaaaataattggtttgatgtaggagcttgggatattacgaaagcattgcatctattacgtaagtcaaatgctatcttatttgagtggttacaatcacctattgtttatcaacaatatgctggtatccaaaaagaattatttgagttggcacaattatattatcaaccccaaatcattgttcatcattatagagggatcgcaaaagccgttagtagacatcattttgaagagagtcatgcaagtaaagcgatagatgagcccataaaattaaaaaaatatttctatctattacgttcacttttagctgcttattggacagtaaaaacggagaatatcccaccgatggagcttaatcagctaataaatatattaaccacagatgagcaaataattattcgagagttagtgagctttaaagcagataaagatgaacactttacttggctaccaaccgataatatgcaaaaactgatcacttttttatggcaagaaacagcaactcaattagcgaaacgcaccgtaccagatagtgaaatattaaataattggtttaggaaaatacttgatgaaactgaccattga

SEQ ID NO: 4070 - DNA, 894 bp, Proteus mirabilis
cattggcatgtaaccgacttacatttatttcattatcctgttagtataagttatcctattattcaatctataaatggttatagtcacatgaaatttgtctcattcaatattaatggattacgtgctcgccctcatcagctcgaagccattgtagaaaaacaccaacccgatgttattggactgcaagaaacaaaagttcatgatgatatgtttccattagaaactgtcagtgccttgggctaccacgttttttatcatggacagaaaggccattatggtgtggctttgttaactaaggcgaaacctgtcgcggtacgtaaaggattccctggtgatggtgaagaagctcagcgtcgtatgatcatggcggacattgaaacccccgctggattattaacggtaatgaatggttatttccctcaaggtgaaagtcgtgatcatgagacaaaattccctgctaaagcaaaattctatgctgatctacagcagtatctgaccaccagcttaacgccttcctctcccgtactgattatgggggatttaaatattagcccaaccgataaagatatcggtatcggcgaaaataatatgaaacgttggctaaaaatgggtaaatgttcatttttaccggaagagcgagagtggttagcaacgcttatgggttggggattaaccgatacttaccgcgcccaacatcctgaagtcgaagaccaattttcttggtttgattatcgctcaaaaggctttgatgataaccgaggcttacgtatcgatttactgctagcaagtcgttgcttagcagataattgtatttcaaccggcattgactacgatattcgtgcgatggaaaaaccttccgatcacgcacctgtttgggccgagtttaagctttaa

SEQ ID NO: 4071 - DNA, 195 bp, Proteus mirabilis
caatttaatgttgattattttttgattaataaaaaaatcaatattcacgtaaatttacttattaaccatttagttaattttatttataatacatttttccctggtgttgtattattttttgccctgtttccccaacagggcttttttttatccttatttttcattctgttagtgattactcaatcgtttttataa

SEQ ID NO: 4072 - DNA, 453 bp, Proteus mirabilis
atgagtaatgttgatccctcattgctaattttgctggtactcgcaggccttggcattattagtcataatatgactgtcactttagcgatgatctttttattggttattaaaatcacaccgttaaaccaatattttccattagtcgaaaaatacggtatgaccattgggatcttgatcctcaccgtaggtgttatgacaccgattgccacaggccgcatttccgcacaagaagttttcaattcttttttaaattggaaatcattactagcgattgcaattggtatcatcgtctcttggttaggggcacggggggtgtcacttatgaataaccaaccgtcaacggtagcgggtttactcgtaggaactgttattggtgtcgctctatttagaggggttccagtaggtccactgattgctgcggggatcctttcgttattgataggtaagtcatag

SEQ ID NO: 4073 - DNA, 3096 bp, Proteus mirabilis
tggagcggtgtcatgaagctgtttgctctatttattcaacgacctgttgctactacactacttagcctagccatttctctttgtggtgcgttaggttttatgttgttacctgtcgcaccactgccacaagttgattatccggtcattaatatttatgcctcattaccgggggcatcacctgaaacgatggcttcttctgttgccactccccttgaacgctccttagggcgtattgcggggattgatgagatgacgtcaagtagtgctttaggtagtaccagtatcacattagtatttgacttaaataaagatattaataccgcagctagagatgtacaggctgcgttaaatgcctcacaaagcctattaccttcaggtatgccaagtcgcccgcgttattacaaatcaaatccttctgatgcaccgattatgatcttaacgctgacctcagagacacaaaataccggtgagctttatgatctcgcatcaacacgcttggcacaaaaaatttcgcaaattgaaggagtaagtgaagtttccgtagggggaggttcattgccggctgtgcgtgttgcactcaatcctgatgcgctatttaatcaaaatgtcagtcttgatgatgtacgcaaagccattagtcaatccaatgtcagaagaccacaaggctttattcataatgatgaaaatcgttggcagatacaaactaacgatgagttaagcaaagctcaagattatcgcccaattattgtgcattataatcaagatgctatcgtgcgtttaagtgatgttgcccaagtgacagactctgtacaaaacgcacgggcggcaggaatgagtggtggtgaaccggctattttactggttattcgccgtgaagcaggcgccaatatcatcgaaactgtcaaccgcattcgtgatgaactccccgaattacgtgagctactccctgccagtgtcaatttaaaggtagctcaagatagaacccccactattcgtgcctcgttagcagaagttgaacgcgcattagcgattgccgtggcactggttattttagtggtattcttatttctacgttcagggcgtgctaccttgatccccgctgttgccgtacccgtttcattaattggtactttttcagccatgtatttatgtggctttagcttaaacaatctatcattaatggcattaacggttgcaaccggctttgtcgtggatgatgcgattgtcgtactcgaaaatatctctcgccatatcgaaaatggcttaaaacctaaacaagccgccctaaaaggagttagcgaagtgggctttacggtactttcaatgagtatttcattggtggcggtatttattcctctcttgttgatggatggccttgtcggacgactttttaaagagtttgccattaccttaaccaccgcgattgggatctctttatttgtctccttaacattaaccccaatgatgtgtgcccatttattaaaaggcataaaacccaaagcacagtcacatttacgcggatttggtaagttaatttttcgcttacaacaaggttacagtgtcacactacaagcggcattacggcataaacgctggatcatggctatttttattaccaccttaggactgaatgcttatttatatatcagtgcgccgaaaaccttttttccagatcaagataccggtcgtttaatgggatttgtacgtgcagaccaaagtatttcattccaatcgatgaaagaaaaaatgacccgttttatgcaggagattaatgcagataaagatgttgatagcgtcacgggatttacggggggaggacgtattaatagtggatttatgtttatttcacttaatccgctctcagagcgcacagatagtgcaaatcaagtgatcaatcgccttcgtatcaaactggctaatgaacccggtgcaacactatttttaatgcctgtacaagatgtacgtgctggaggacgccaagctaatgccagttatcagtttactttactcgctgatgatttaagtgaattacgtaaatgggagccattaatacgtaaagcgttaggcgaattacctgagctggttgatgtcaactcagataaagaagataaaggtgccgaaatggcactcacttatgatcgcgatactatgtcgcaattaggcattaatgtcagtgatgccaataatttattgaataacgcctttgggcagcggcagatctctaccatttatgccccgctaaatcagtataaagtcgtgatggaagtgtctgaacaatatacgcaagatgtttctgcactggataaaatgtatgtgatgaatacacaaggtgaacgtattccattatctgcatttgccagttggtatcccgctaatgcacctttaagtgttaatcaccaagggttgtctgccgcctctaccatcgcttttaatgtgccagagggctataccttatctgatgccattaacgccattgagcgaaccatgacagagttaggtgtacctaacacggtacgaggcacctttgcgggtacagcgcaaatttttcaagaaaccattaagtcacagcttatcttgatcttagcggctattgtcaccgtctatattgtccttggtgtgctttatgagagctatattcatccattgactattttatccacattgccttctgccggtgttggcgcattattagcactgcgcttgtttgataccccctttagcttaattgctcttattggcattatgctgttaattggtattgtgaagaaaaatgccattattatggtggattttgcgattacggctcaacgagaaggaaaactatccgctcaagaagcgattattcaagccagtttattgcgtttccgccctataattatgaccaccttagccgcgctctttggcgctttacctctgatgttaagtagcggtgatggggcggaattaaggcagccattaggcattaccattgttggtggcttacttatgagccaattattaaccctatataccactccgattatctatctgttttttgatggtgttcgccaacgttggcaacagcgacgccataacaaaaaagaggcaaatgcatga

SEQ ID NO: 4074 - DNA, 1521 bp, Proteus mirabilis
caattgatcgtaacagatatatggagaactgcgattatggctctaaattcgccaatgctaattacctttacgatctatatattggggatgctttttatcggctatctagcgtatcgatcaacaaaaaattttgatgattatattttagggggccgaaggcttggtagtgtagtaacggcactttctgcgggcgcttctgatatgagtggctggctattaatgggattaccaggtgtggttttttttgcggggatctccgaaagttggatagccattggtttatgtttaggtgcatggcttaactggcgtttagttgcagggcgcttacgtttacaaacagaaaaaaacaataatgcactgactttaccagactatttaacttctcgctttgatgacaaaagcaaaatgctacgcattatttctgcgttagttattcttattttcttcactatttattgtgcatcaggtgtcgtcgcaggaggtatgctttttgagtctacctttggcattccttatcatgaagcgatgatttatggtgcactagcaaccattgcatatactttcctaggtggttttttagcggtaagttggacggatacggtacaagccacattaatgattttcgcacttattctgacaccaattattgttattttctcaattggtggaattgacacctctatagagatcattaaagcgaaagatcctacttatcttgatatgtttaaagggcttgattttattgctattgtttcattattagcttggggattaggttattttggacagcctcatattctcgcgcgttttatggctgcagattcaaatcaaactattcgtaaagcgcgtcgtattggtatgacttggatgatcctctgtttaggcggaacggtggcggtgggcttctttggtattgcttattttgaggttaatccggccgttgcaggtccggttatggctaaaaatgagcgtatctttatggaattagcttcgttactttttaacccgtggatagctggtattttgttatctgcgattttagctgcggtaatgagtacgttaagctgccaattattagtctgcgccagtgcattaactgaagatttatataagccttttattcgtaaaaatgccagtcaaaaagagctagtttgggttggtcgtggcatggtgttattagttgcggttatcgctatttatttagcccgtgatccagaaaataaagtacttgatttggtgagtaatgcttgggcaggatttggtgctgcatttggtccggtgatccttatctctgtcacttggaaacgtatgactcgtaatggtgcttttgcgggaatgttaattggtgcattaacggtactggtatggatgcaatataaatggttcggtctttatgaaattattccgggctttattttcgcgtccatagccattgttattgtcagtttaatgggtaagtcaccaacggcagaaaatcaacaacgttttgatgaagcagaagcggaatatcgtaacacttaa

SEQ ID NO: 4075 - DNA, 1317 bp, Proteus mirabilis
agagaggtcgtaagcatgactcgtcgtgcaatcggggtagaagagcgcccaccattattacaaacaatcccattgagttttcaacatctgtttgccatgtttggtgctactgtacttgtgccgattttgtttaaggttaatccggccaccatattattgtttaacggtatcggtactctgctttatctctttatctgtaaaggtcgtattcctgcttatttaggttcaagtttcgcctttatctctccggtgttattgctacttcctttaggctatgaattagcattgggcgggtttattgtctgtggggtgctattttgccttgttgctggcattgtgaaaatcgccggacgaggatggattaatgtgatgtttcctcctgcggcaatgggcgcaatcgttgccgtaataggtcttgagttggctggaactgccgctaatatggctggattattacctagcgcagataatcccgttgatagccaaacattgataatctctatggtgacactgggtgtgactattttaggctcagtgatgtttaggggatttttggccattattcctattcttattggcgtgttagccggttacgcactctctttctttatgggcgtggttgatgtgacaccgattaaagaagccaattggtttgctctgcctaccttttattcgccgcgttttgagtggagtgctatttttattatcttgccggcggcattagtggttattgccgaacacgtagggcaccttgtggtaaccgcgaatattgttcaacgtgatctcatgaaaaacccaggcttacatcgctctatgtttgcaaatggtttttcaaccattatctccggattttttggctctacacctaacacgacttacggtgaaaatatcggtgttatggctattactaaagtgtatagcacttgggtcattggtggtgcagcaattattgctatcttactttcttgtgtcggtaaattggcagccgcgattgcagcggttcccgtaccggtaatgggcggtgtctctttattactgtatggtgtaataggggcgtccggtattcgcgtattattagattcgaaagttgattataacaaaccacaaaacttgatattaacagcgatcattttaattgtcggtgtaagtggtgcatcaattcaaattggcgcagctgaactaaaaggcatggccttagcaacgatagtcggtattgttttaagtttagtatttaagttggtgagtattattcgcccagaaactgagttagtggatgatactctggagtcaattaacgaacatacaaacaccaagtaa

SEQ ID NO: 4076 - DNA, 1980 bp, Proteus mirabilis
caaactaacgtaatgagattatttattgcagaaaaacccagccttgctcgagctattgctgatgtattaccaaaaccgcataaacgtggtgatggttttattgtttgtggtgataaccagtatgtgacgtggtgtgttggtcatttacttgagcaggctgagccggatgcatatgatccgcgctatgcgcgttggtcgttagatgatttgcccattattccgaataaatggcaactcaaaccgcgcgctgatgtgaaaaaacagctagatacgatcaacacattactaaaacaagccgatgaagtgatccacgcaggagaccccgatcgcgaagggcaactgttagtagatgaagtacttaattaccttaatattagtgatgctcaaaggaaacaggcacgccgctgcctgattaacgatttaaaccccgccgcggtatctcgggcaattgataagctccgctacaatcatgaatttattccattatgtgtttctgccttagcaagagcgagggcggattggctatatggcattaacatgacacgcgcttacacgttattaggacagcgcaatggttaccaaggcgtactctctgttgggcgagtacaaaccccggtgctaggtttagtcgtacgccgtgatgaagaaattgaaaactttgtaccgaaagatttttttgaagtcaaagcgcatatcgttactcctgcagatgagcgatttaccgctatttggcagccgagtgaacactgcgagccttggcaagatgaagaagggcgtttattacatcgcaaattagcagagcatgttgttgatagaatagctggcaagcctgctaatgttaccgattatcaagataaacaagagtctgaaatagcacctttgcctttttcattatctgctttacaaattgaagcggcgaaacgctttggtttaagcgctcaacaagtgttagacacatgtcaacgcttatatgaaacgcataaacttattacttatccacgctccgatagtcgctatctccctgatgaacactttgctgggcgtcatgcggtgatgaatgccattagtgtgcatgataatagtcttttaccacaagaaacattagatattgataaaaagaaccgttgctgggatgacaagaaagtagatgcgcaccatgccattattcctactgcgaaaacaggtaatatttcattaagtgaaaatgaaaagaatatttactatttgattgcccgacaatatctaatgcaatttatgccagatgcggtgtaccgcaaatgtgtgattgaactcgatattgagaatggaaagtttattgctaaggcacgatttttagcacaagccggctggcgtaccttattaggtagtaaagagcaagatgcggaaaatgatggtagcgccttacctattgtggctaaaggtgatgaattactttgtgaaaaaggcgaaattgttgccaagcagacccaaccaccaagaccttttacagatgctacgctactttcggctatgaccggtattgcacgttttgtgcaagacaaagagctaaagaagatcctaagagcgacagatgggctaggtactgaagcgactagggctggtattattgaattactgtttaaacgcggctttctgcaaaagaaagggcgagctatcaactcaacaccagcaggaagagcattaattcatgttttgccagatatggcgacattacccgatatgaccgctcattgggaatcaatattaacgcaaattagtgagaagcaatttaagtatcaagattttatgatgccattaagtaacacactatttgaattaattactcaagctaaacgtcgtcctaatattcaagcgtttagaaacctgcctgcgcctgcgcagaataaaaaacgtaaaggtgcgacgaaaaaaagtgcacaagggaaaagtcgttcagcgcagtctcaatctacgaatcgcaatataaagagtgatgcttag

SEQ ID NO: 4077 - DNA, 1050 bp, Proteus mirabilis
gggctagacgtgactaacaaatcctctctcagctataaagatgccggtgtcgatattgatgcaggtaatgctttagtcgatcgtattaaaagtgtagtaaaagaaactcgccgtcctgaagttatggggggtttaggtggttttggtgcattatgcgctattcccactaaataccgcgaacctattttagtgtcaggcactgacggtgtcggtactaaacttcgccttgcgatggacttaaatcgccacgatgatattggtatcgatttagtcgcaatgtgtgttaacgatttaatcgttcaaggtgctgagcctctcttctttcttgactactatgccacaggcaagttagatgtcgatactgccgcacgggttgtaacgggtatcgctgaaggttgtaagcaatccggctgtgccttagtgggtggcgaaacagcggaaatgcccggcatgtatcatggtaacgattatgatatcgccggtttttgtgttggtgtcgttgaaaaatcacagattatcgatggtagcaaagttaaagcgggtgatgcattaattgctctcgcttcaagtggccctcattctaatggctattcactgatcagaaaaattcttgaagtcagtggtgcctgtgctgaaactaccccattaggtgatacatcactggctgataaactcttagcgccaacccgtatttatgtaaaatcactcctgtcattaattgaaaacgttgatattcacgcagtggcacatattactggcggtggattttgggaaaatattccgcgcgtgctacctgaaaatacgcaagctcgtattaatagccaaagttggcagtggcctgaggtctttaactggctacaacaggcaggtaatgtcagcactcatgaaatgtatcgtacctttaactgtggtgtcggcttattaatcgccgtgagccaagctgatgttgaaaaaacgctatcacatcttaatgcctgtggtgaaaaggcatggttaattggtgatattgccccgcaagcagcgggtgatgcacaagtgattatcaattag

SEQ ID NO: 4078 - DNA, 210 bp, Proteus mirabilis
agtaaaagcgtgtatttctcaccatcaaacaaaagccgcttagataaagcggcttacattttcttcaatagcctgcgctatcaacctgttttttggttgttttttatccataaaatagaacatcctcaaagagcagagatagagcgaatgcctcctgcaagccagttatgtccttatcgccctaaactcaccaatagattagaaacctaa

SEQ ID NO: 4079 - DNA, 1476 bp, Proteus mirabilis
aggtttttagtgtcaactgcaaacacacctgaagatgaacagaaaccgagtctgaatgcgtttaaacagcctcgtgcattttatctcatcttctcaatcgaattatgggaacgttttggatattacggcttacaagggatcatggccgtttatctggttaaaatgctgggtatgagtgaggcggaagctattactgtttttgccgcatttaccgcattagtttatggctttgtggcaattggtggctggcttggcgataaaattctcgggacaaaaagggttattgtcctaggggctattgtgctggcaattggttatgccatggttgctttctccgatcatgataaggatatgatttactggggattagctactattgcggtgggtaatggtttatttaaagccaacccttcctctttattagccacctgttatgagaaagatgatccacaattagatggtgcatttaccatgtactatatgtcgattaatgtgggatcatttttatccatgttagcgacaccatggttagcggcgaattatggttgggatgtcgctttcgcattaagtgtggtggggatgttgatcacactggcaaactttatgctatgtcgcggttggatcaaagataaaggctctaggcctgactttgagccactaaactacctgaaactgttattaacgctggtggggattgttgctttaacggcagtatcaacgtggttattacataataatgaagtggcaacatggtctttagcgattatttcattaggtattatcctgatttttgcccgtgaaacttttatgatgaaaggggttgcacggcgtaaaatgatcgtcgctttcttactgatggtggaagccgtggtattttttgttctttatgatcaaatgccaacatcattaaacttttttgcgatccataatgttgaacacgctattttaggctttagtgttgagccagagcaatttcaatcacttaacccattttggatcatgctagctagtccattattggctgctatatataactttatgggtgataaattacccatgccttataaattcacagtgggaatgtttttgagtgcaactgcattcttagtattaccattgggggcgagtatggcaaatgaagccggtatcgtttcatcatggtggcttgttgccagttatggctttcaaagtattggtgagctgatgatctcaggattaggtcttgcgatggtggcccaactagtgccacagcgtttaatgggctttattatgggtgcatggttcttaacatctgcggcagctgcaattattgctggtaaagtggcaagcttaatggccgttcctgaagacgtacaaaatgcacacgcatcattagaaatttatagcagtgtatttttacaaataggtatcgtaacaggtgttattgcactgttaatgctatttactgcccctatgctgagtaaaatgacacagtaa

SEQ ID NO: 4080 - DNA, 351 bp, Proteus mirabilis
gaaaaaatagtgccaattatctgttttctgtcgaggaagcatttaactttctttatgaaaactatgctaaatttaatcttagagataacttattgcgaattttataacaacagtgataggcgttgttatcgtattaaagcgaatgcctattttgtaataagtactattaacaaaatgtatttaaaggattttaatttgaacgcaaagaaaataattattagcttaataattatattagctatcagcttggggttgtaccttgtggcgttagataatttttgcgatcaaggcgaagattttcagcaaggtatctgtcgctttaccatcttattcccctctaagcagccgtaa

SEQ ID NO: 4081 - DNA, 2061 bp, Proteus mirabilis
gtcatagtagtgccatctttagatttattgcgctatcaacaagccttcgctcgactaggccagcggcgattactccttttagcggggagctatacatggcaaagagaacaacttcgagctatccaacagcagtgtaaaggcgattggctaatactctcgtcagagatgtctgaggcgataaaaccagaacatgctcatcaactattaggccgtgaatatcttcacgctgtatttgacgctaaccatgcttttaatgctgatgcactagcgatgctaacgggaacgttgaaagcaggaagttggcttatcttatgtttacccgatattgttcagtggcaacattatattgataacgatagtcagcgctggaatgatgcgcaaggggttatatctactccccattttatggcttggttagcaaaaattacactagcagataaacaggccattatttggcaagcatcgcagccccttgttctacctgaaataaaaaatacaggccaacagtgggcgttgcctcaagggatgccaaccatacaacagcaacagttattagcgcatcttttacaggtaaaatctggcgtatggagtatcacggcaccacgaggcagaggaaaatcagcgttagcaggaatgttgatagagcagtggcctggctcagtgacggtttgtgcccctgcgagaaacagtattgaagtgctattatctcatacacataaaaccatcgagttctactcaccggataatttgttagccctttgtcatacagagcgtttgtgtcgagattggttaattattgatgaagcggcgactatacccattgctcaactgatagctctttgtcagcacttccctcgagtgttaatgaccaccacggtacaaggctatgaaggaacagggcgcggctttattttaaaactgggtgatagcattccaacgttacaaaattatcaacttaccgtacctattcgctgggcgcaggacgatccactcgaaaattggcttaatcaactgttgttacttgatgagccttcttttcatcatgctaaccaatctggcgaggtggtgatcacctcatgccagcatttcgatagtgaacaacgagccaatttttatcaacttttaaccagtgctcattatcgaaccacgcctttagatcttagacgtttattcgatggacaaaaacagcattattggtctgcatttattcatcggcatcttgttggggcggtgtggtgtattgaagaagggggactagcgaaagccttagcacaagatgtttggcgaggtatacgtcgaccaagaggtaatcttgttgcccaatcgttagtcacttacggcttatccattgaggcaatgtgtttaacttcattacgcatcagccgaattgcggtattgccagcatatcgacgtcaaaaagtcgctgcaaaattagttgcggatattgctaagcagtgccagaaacagaatattgattacctttctgtcagttttggctataccgacgcattagccaatttttggcaacaatgtggtttttatctggtgagattaggcgttcataaagaagccagtagtggctgttatactgctatggctatttacccaatcagtgctcaggggcagcaattattacaagttgcacaacaagcactcgcattacaaagtgattatatcactcagcaaacaggtatctctcttgctactgcattgcctagcgcctgtgaagcagatcactggctgatgatggcaggttttgcttttgcccatcgctctgtattaacggtatatcaaagtgttggttattttctgcaagatgagagatcacgctacccgttattagtggcattttttattgataagcaatctgtagaggcctgtgtaaaacaattttcgttatcgggcaagaaagcccttgtcacgacactacgtcggcaatgccaacaactgatggcagaaaaagatgagcaattagcacaggcttaccaacattggttaacgactacttcttctggtcatttttgttgggccaatcgtcctcatcatcccatttatcattaa

SEQ ID NO: 4082 - DNA, 219 bp, Proteus mirabilis
tcacgctcagtacaaaaggaaaaatggctaatgattattttactcacattattagctgtgtacttatggcttgctgggtacttgttttcagaatctaagcacgaaatcgacaatataaaagatattgtggccagactgttttactcaacaatctggcctgttgtcggtgtgctttacctatcgtcactacttgcttataaaacacttggcgaagaatga

SEQ ID NO: 4083 - DNA, 1044 bp, Proteus mirabilis
ttcataagagtgttaggtctgatgcaaaaaaaatccatttacgttgtgtatactggtggaactatcggtatgcaacattctgatcacggctatatacctgtatcaggacatttacaacgccaattagctaagatgcccgaattccatcgtgaagagatgcccaatttcacaatcaaagagcaccttcctttaattgattcatcaaatattacccctgaagattggcaatctatcgctgatgatattagcgagaattattgccactatgatggttttgtcatcttgcatggtaccgataccatggcatttaccgcttctgcactttcctttatgtttgaggggctggcaaaaccggttatcgtcaccggctctcaaattccattagaagctttacgctcagatggacaaactaacctattaaatgctctctatattgctgcacatcatccgattaatgaagttgcactgtttttcaacaatactctgtatcgtggtaatcgtgcgataaaagcacatgcagatggcttcaatgcttttgcttctcctaatagtgcacctttattagaagcaggcattaatattaaaacgtttaaaataaacccattacctaagccaaaaggtgagtttattgctcatcatattacccctcaaccaattggtgtggtaacaatatatccgggactttctgatgaggtggtgaaaaatatcttaatgcaacccgttaaggcacttattttgcgctcttatggtgtgggtaatgccccttctcatcctgccttgttatcaacgctacgcgaagcaactgagcgcggtgttgtcgtggttaacctaacacaatgtatttctggtcgtgtcaatatggggggctatgcaacaggacaagcactcgccgatgttggggtgatcagtggttatgatatgacttttgaagcagcgttaactaaactccactatctacttagtcagcaatatagctatactgagatctgccgtttaatgcaacaaaatctccgtggtgaaatgacattaaacgatgacgactag

SEQ ID NO: 4084 - DNA, 759 bp, Proteus mirabilis
tggtttccggtcttttatccaaaggtgtcttttgttgtgagtgatttgtataccgccgaaggcgtgatggacaaaaatagcctctgggagcgatatgtccctttggttcgccatgaagcattacgattacaggtcaagttacctgcgagtgttgaattggatgatcttttgcaagcaggggggattggcctactgaatgctgttgagcgttatgactcaatgcaaggtgccgcctttactacttatgctgtgcaacgtattcgaggctctatgttagatgagctacgaagtcgtgattgggcgccccgtagtgtgcgccgtaatgcaagagaagtgacacaatccattcatcagttagagcaggatctaggacgaccaccatcagaacaggaagttgctgatcatttgcagattgagttagcagaataccggcagatcctattggatacaaataacagccagttgttctcttatgacgaatggcatgaaatttacggtgaaagctgtgaaccgtctcaagacgaagatcacgatgacaatcctttacaaatgttattggaaagtgatattcgccaaagagtcatagacgcgatagaattgcttcccgaaagggaaaaaatggttcttaccctgtattatcaggaagaacttaatttgaaagaaataggcgcagtgcttaatgtcggggaatcccgcgtaagtcagctacacagccaagcaatcaaaaggctgcgagcacgcttaaacccagagaaatag

SEQ ID NO: 4085 - DNA, 2190 bp, Proteus mirabilis
gcaatgacggtatctactgaactaagccatgaagagtatgtaggcaatggcgtaacaacggattttgattttcgattccgtatctttgaaagcagacatttgattgttgtggttgctgacaacgatggcaatgaaacaacattaaagaatggtactgattacactattgtcggagcaggttcttttcatggtggtaaagtggttttaaataaaccattagctaaagggtggaaaatattattagaacgcgatttaccagttgtacaagaaactgatttacgtaatcaggggaaattctttgctgaagtacatgaagatgcctttgattatctaacaatgttaattcaaaaagcattgggcactttctctttaagcttacgtaagcctacctatctatcgaactactatgatgctaaaggcaatcatattgctaatttggcaccgcctaagttgggtactgatgcagctaataaagactatgttgataatagtattaaggatattgatagtaagacattaagagtaaaagataagcctattcctgcattaccatccgctgaacaacgcaggaataaacagcttggttttgataatgaaggctatcctcaattacttgatcctgctgaaactggatctcttggttatgttttggttgattcttttgagaaaggagctgaaataacaactcgttatcaagctcttcattttgaaaataatggagaatattatcgctgggatggagaactaccaaaaatagtagtttcagggtcaacccctgatagctctgggggcactggtgctggtaaatggattagcgttggagattcaaccttaagaagtcaaagaatatttttaaataaaaacaataaattatcactttctgattatccttcagtattggattttgatttcatttaccctaatgacgagacgaaagatagcacccagggttttttaaacgcattaaatgatgattccatcactgatatttgggtacctaaaggtctttatagagttgacgaaaaaattgtcacacaagctggtaaaagaataagattcgcaaagggtgcaaggttaatacgcttatctaaatatagcgataatactgatcctgtttttattttaagaggaagttattctgagagctatggaggtgaatttataactgaaaacgatcatccacatggtgttgttagacttggtcaccaggatagtaatgataataaaaatgctctatggtggcgatttgagaacccttttattaaaggggtacaaagagaaggtaatattggtatagatattactaatgcgcaagttaacataggtactagctcagcaaattattttggttacgttagtaatccaattattcacggttctgatgaggggatagttcttaatgagattgctaatgctcatacaattatttcacctcaactgtatcgctgtgtaacatctggtatatcttattatggcgcttacgctaatcatgttataggtggatttttacatcaaagtcaaaatggtgttattggcataaatctgagaaacaagcgtatagaatcagcacatcactcatcaaacaatcaagttgatgggtttggtattgagccaggaggtagtttatcaaaagcaatatatatagacagtgagtgtactagaaatagaattaatgtgatggggaatgttgctggtggtgtagtaattttaaataaaaaaaacgactacaatacattatttgcaaactcaacgaacgaacaaaatgtaaataatttacacataaaagataaagttagatctataaatactcagactgaatttaacaaaaagactaatattacagagaataccagcattgatttttttaaaataacattaccttccaatggctcagggtatttaattaactgcaatttaacagcaaggaatccatcaatagataacgtatatccagcaatggctgttatatcagcaatgaatagaagtcaactgaaagctgcttatgtaagagaagaaaaaccaacaggaagatgtggtgaagtttattatcgcgttgatggcaatgtgctaattataggaggtaaaagctacaataatggtacgtctactgtatttattaactttagtatgtctataactattgagtccagcgaagatggaatgtctggagttatggtatctaaaatgtaa

SEQ ID NO: 4086 - DNA, 765 bp, Proteus mirabilis
ctgagagcggtgaagttgttcttcatggaggagacgatacctatgtctgataaaaatactgatacaaactggaagccttgggttccaaaagaacttattgactgggaattaaaagtcaaggaagacacggggttagacgagaaggaagacgaaaatcaagaaaaagaagtcgttcagcaacagaaagtcctcgagcaaattaatatgcttgatgacatgaaagaaaaggcccaaaaactgggccatgctgaaggctttgaggcagggaaaaaccagggttatcaggaaggctatcaggcaggattacaatcgggtatcgaagaaggtatccgtcaaggcattgctaaacaagaaccttttattaatgaatggcaaggcttattagctgaatttaggcattcattaaatggtttagatagtgttattgcctcacgattaatgcagatagcactcacagcggccaaagaagtacttggacaacctgcggtctgtgatggctctgcattacttgctcaaattacactgatgttgcaacaagagcagatgtttgcaggggatccacagctacggattaaccctaaacatatccctctgattgaaaaggaattaggcgattctcttaccgcccacggttggaaagtggtggctgataatagtatccatgtagggggctgccgtgttgtaaccaatgatggtgatcttgattccacaattgcgacacgttggcatgaattgtgtcgtcttgctgcaccggaggcgttgtaa

SEQ ID NO: 4087 - DNA, 201 bp, Proteus mirabilis
tcaaatgaggttgaaatggagattattagtcgaaaagaagctgcttcaaaagggcttggaaaattttttacaggtaagaaatgcaagaacggtcatgttgctgaacgttatgtttgtaatggtgtttgcgttaaatgcaactttgaaaattcaacagtctatcgctctgtgttaaagcaattaattaacagcgctaagtga

SEQ ID NO: 4088 - DNA, 897 bp, Proteus mirabilis
tggggaagggttatgcgttggaatgatcgccgaagaagcaataatgttgaagatagaagagggcagccttcttctgcatccggtggtggtaatctcccattaggattaattgcactattattacgtacaaaatatggctttgtgatcattattattttggtgatcgcaagctttatggggtttgattttaattcgcttacagggcaaacatcacaaccaacacaaaatagccaacaacaatccgccctttataatgaagcggcagattttagcagtgttgtattagccagtacggaagatttttggcaagggatgtttgccaaagccggcgaacaatatcgtgatcctaaattagtgctatataccaacagtaccacaacgcaatgcggtaccggcactaaaatgatggggcctttttattgtcctgcagaccaaaaaatttatctcgatctctctttttataatgaaatgaaaaacagccttggtggggggggagagtttgctcaaggttatgtgatttctcatgaagtgggacatcatgttcagcatctacttggtatcaccacacaaatgcgtgaaaaacagcaaatggcacgttcaaaagtggaagcaaatcgcttatcagtaagactagaactgcaagctgattgttttgcgggtatgtgggggcgctttattgccggtgaaggccgtgttgatgaagcggacttactgacggccattaaaaccgcacaagctatcggtgatgataggctgcaacgccaacaacagggttacgctgtaccggatagctttactcacggcactgcagaacaacgtaagacatggtttatgcgcggctacaatagtggcgatattaaatcttgtgatacatttgcttcttcgtcattgaactaa

SEQ ID NO: 4089 - DNA, 765 bp, Proteus mirabilis
tataaattttttataggagagctattaatgaaagaaaatctattattatttttattatttttacattctacacaggtattttgtagcgaagaaaaaattaagaaaactgcaataattgatattgatcgtcctattgtaaaaggaatttctcataactattttgaatattttaatgtgccaccagaaggcgtgatattgaataataaagaagcacaggctgacactattattaatgaaatcacaggagatcaaattagttttctcaatggcaatatacatgttatcgggaaaatggcacatgttattatagctaatccaaatggtattgaatgttatcaatgctctgcatctgatgtcactggttttacattaatcagtggatataccaaaaatcagggtagcgacttttttttatctaatagaaattatgtttatattaatgacgtaagaattttctctagagtagcaaaaaatataaatatcatttctaacgaagtctatttagagggtgggatatatgggaatgttaatgatttaaatataacaagtggattagtaacttataatccgcagttagagaataaagtaaattcatatgggcggatttctttttttgatggttttgacgcttatttaaataaaattaatattaagcatggatatggtgagatttattttgataaagaagcttatagaataatagaaagaaaattaaatattaatagcttgtttggtaatagggctgtttatatatcttattattaa

SEQ ID NO: 4090 - DNA, 495 bp, Proteus mirabilis
aataagttattgcggtgtcgtttaacggctccgctaactttcatttatttggagatagtcaaaatgattttagataaagaaacgcttttttcactggatcaggcggttactgcatctgctgtaagtaagcaaattatcgacttaacgccagtgtatggtgcatttcgtgatatcggtattggtgagccattagagctgtttgcacaggtgactgaacaggctaaagcagcaggtgaagcgacggttcaaattaagttagaaaccgcgacagatgataaattctctgatgctaaatctatctttgaatcagtggcaatgccaattgctgatttaaatgcaggtaaacgtattgtggcgaaagtacctcaaggcgttctgaagtatctgcgcctgcaatatgttgttgcagaagggccattaacagcgggtaagttcactgcgggtatcaacctaactgttgatgctcatcctatttacgatgctgtaactcaataa

SEQ ID NO: 4091 - DNA, 1467 bp, Proteus mirabilis
actagactattaacgggacgatataatcgtaaaaacgctccccttactataaataactatatttttattatttttttaaccctcactcttattaaggagtctgacgtgattagcgttttcgacatgtttaaagtgggcattgggccatctagctctcacaccgtaggccccatgaaagcggggaaagaatttgtcgatgatttagtcagccaggatctgattgcgtctgtcactcgcgtagctgttgatgtatacggctcattgtcattgacaggcaaaggtcaccacactgatatcgcaattattatgggcttagcaggtaatgcacccgctactgtcgatattgacagcattcccggttttattcgtgaagttgaagaaactggccgtttaccattagcaaatggattaaaagttgtcgattttccagctgaaagtatgcattttagcaatgataatctttcattacatgaaaatggcatgacaattcatgcttttgcaggtgacaaagaaatttatcgtaaaacctactactctattggtggtggatttattgttgatgaagaaaacttcggcaaatctgtgcttgacagccaacctgtttcttatccttatgcaagcgctgaagagttattaaaacattgtaaagaaaccggattatcaatctctagcttaatgatgaaaaatgagctagatcttcatactcaagccgaaattagtgcctattttgctgatgtttataaaaccatgcaagagtgtatcgagcatggtttaaataccgaaggcgtattaccgggaccacttcgtgttcctcgtcgtgctgcgtcactaaatcgtttattaacttccagtaatagcctgtcaaacgatccgatgaaagtcgttgatcttatcaatatgtttgcactggcagtgaatgaagaaaatgccgcaggtggacgagtggtcaccgcaccaactaatggcgcatgtggtattgttccagctgtattggcttattacgatcgctgtattgaaaaggtcacgcctgaaatttatacccgttatttcttagcctcaggggcgattggtattctttacaaaatgaatgcttctatttctggcgctgaagtgggttgccaaggcgaagtgggcgttgcttgctcaatggctgccgcaggacttgctgaattactcggtgctagccctgaacaagtctgtgttgctgctgaaatcggtatggagcataacttaggtttaacttgcgatcctgttgcaggacaagtacaagttccttgtattgaacgcaatgcaattgcctctgttaaagcggtaaatgctgctcgtatggcattacgtcgtaccagtgaaccacgagtttcacttgataaagtgattgaaaccatgtacgaaacaggtaaagacatgaacgcaaaatatcgcgaaacttctcgtggtggattagcaataaaagttcaatgtgactaa

SEQ ID NO: 4092 - DNA, 906 bp, Proteus mirabilis
ggagtcatattgatgggccaaatcagtttgctgattatcaatggaaaaaactcaggcaatgaggctctgcgacaagcggtttatcaacaacgcaaggaaggtaatgatatccaagtcagagtgacatgggaatcaagtgatattcaacgctttgtgcaagaagcactacatattcaagcgcaaaccattatcgccgcagggggtgatggtacgatcaacaatgtcgcctctgagctggttcgtttagccccctcttcgccccccgcgttaggcattatccctttagggactgcaaatgattttgccaccagtgcacaaatcccattagagatggacaaagcgctcagtttagcgattaaaggtcgcgccgttcctgtcgatattattaatgtgaacaaaacacattactttatcaatatggcctcaggtggctttggcaccaagatcaccactgaaacccctgaagcactaaaatccgccttaggtggtgctgcatattttattaatggtttattgcgtattgataccttaaaagcggatcaatgcaccgttgaagctgaaaattttcattggaaaggtgaagctttaattatcggtattggtaatggacgccaagcgggaggtggacaacaactttgccccgaagcactgattaatgacaataaactcaatattacccttgttgaagcccgtgaattgcttccttctctattaaccagtctgttcgatcgtaagaaaaatgacaaaattattgagcgagaaagtgattgggtcactattagtgcggctcatgaaatggtatttaatttagatggtgaaccccttttaggggataaatttgaatttattgtactacctgaagcgatccactgccggttaccgccccaatgtgacttgttatcttaa

SEQ ID NO: 4093 - DNA, 324 bp, Proteus mirabilis
cgaggggtattgatgaaaaacttattattaataacatcgttgttatttagttttaatgcatattcttatgtgtatggtggtagcaatttatatggtagtaattacccatcattcaatgatatggaaccaagcagaccatatacagacgatcagtactcttggcagaattataaaaatgaggctgaacgctatgttgatgcagctaaagaatatgttgataaagcaaacaatgatatacaacgtatacaggaagctaagtcagaagctatagaaaacgcaaatagagtaattgaagaatataatagaaatgtaagagggtattaa

SEQ ID NO: 4094 - DNA, 279 bp, Proteus mirabilis
ccgttttcattagtgaggactttagcaatggaaaagaagtatgaataccctgcaccagctaactatccagatgtagtgaataccgatgaagggattgaaaaattaattacaaaatcaaaccttgaagcacttttaacaaagatgggagaagatggtcatgatgtatcagctccacttgtagaactgattgcaatgagaaactttatagttcaaaagatgagaggcaataaaaatataataccgttggtggaatgtattttagctgaattgaaaaaatga

SEQ ID NO: 4095 - DNA, 318 bp, Proteus mirabilis
ctatattcatttttatctaatttatttctcatatcaaaaacaacactagaacctatatctgctatagtgaatgtcttagaaaatttccctgtactgctacctacaattagtttaatatcattaattccagagaaagaacaatcacgacaagaaattccattaggattagctataaccactgtcgccttttttccttgtaactcaagctcacctcttagaattgaaacatctttagaaacaacctcattaataattaattctgcttcagcattattttttaatgataaaccaaaattaccaacatcaagacgattataa

SEQ ID NO: 4096 - DNA, 210 bp, Proteus mirabilis
ttcatctcatttattataaactgctcatacctatttctgggtatattattaacccagtttaatttcattatggaaataaacacgaacagaaaaaatacaatctttgtttattatttatctataactaaattaactcttaaaataattaaactttttatattgttttataaatcaataactatttttacttgtagttgcattttaatatag

SEQ ID NO: 4097 - DNA, 1107 bp, Proteus mirabilis
atgaaaaaattagcgattagccttttctttatcgtgatgacatgtgtcggcttttctgcccatgccgaacggatcagagatcttacttcggttgaaggggtaagagaaaatgcgctgattggttatggtttggttgtcggcctcgatggtacgggtgaccaaaccatgcaaacaccttttaccacgcaaagtctaaataacatgctctcacaattggggatcaccgtacctgcgggcaccaatatgcagttaaaaaacgtcgcggcagtgatggtgacagcaaaactacctccttttggtcgtactgggcaatctatcgatgtggttgtttcttcattaggtaatgccaaaagtttacgaggtggtacgttactgatgaccccacttaaaggggtagatagtcaggtttatgcggtagcccaagggaatattattgtcggtggctctggtgcttctgcgggaggcagtagcgtaaaagtcaatcaattagcgggtggacgtattagtaacggtgccattattgagcgtgagttaccttctcagtttggtcaaacgggattattaaacttacagcttaacgaagaaaacttcacgctagcacaaagtattgctgatgcgattaataagctacgtggggtaggaacggctcttcctcttgatgcccgtacggtgcaattacgtgtacctcttggtaaaagtgaacaagttcgtttcttagcagatgtgcaaaaccttgaggtaaaacgagttattgctgatgctaaagtgattatcaatgcaagaacaggttccgttgtaatgaaccgtgatgtggtattaggtagctgtgccatcgcacaaggcaacttatctgttacggtagatagccaagtgaatgtgagtcaaccgaataccccctttgcaggtggcagtacggttgtgtcacgtaatacgagtgttaatgtcaatgaaaagggtggttcattacaaaaagtcaacgccagtgctagcctcaatgaagtgatccgttcactcaatgcgctaggtgcgaccccaacagatctcatgtcgatattacaagcgatggaaagtgcgggttgtttacgggcgagattggagattatctga

SEQ ID NO: 4098 - DNA, 909 bp, Proteus mirabilis
ttatggttttctacctgttatttcaaaaccatagatttttctcacattatttgtatttttgccaccggctcacaggtggcttttttcatttttacaataaatgtcatcagtaaattaagagaaggcttcactgtgtatcgttgggcactaataccacttttattattattatttttgatattgggatcacttattgcattaatttgccaactctcttatcacgaactcaccatggttattactgatgctgaatttcattttgccgtattgatgtcactgagcaccgcgttaacatcattgtgtttagccgtgctcttagctgtacctgcagcttgggtgatggcaagatcgtcatttaaaggacagcgttttattgatgcgttactcgatttacccttagtcacgcctcctttggtaataggtattggattattattattgttaggtcatcaaggacctttaacaggggttttccctcaattatctcgtgcccttttttctcccttggggattattattgctcaaacatatgttgcaagtgcaatcattatgcgtaatagccttgcggcgtttaaagctattgaacctgcttatattcaaaccgcacagaatttaggattaacaccaacaaaaacgcttattttggttgagatcccactttgttggtctgtattaatcagtggttgtattgtggctttttctcgagcattaggggagtttggggcaacattaatgttggcaggggccacacgattaaaaacagaaaccttaccaatggcaatctatttaaatatagcgagtggtgatttctcgcttgcgataggttgcgctttagtactgatagcaattgcaattactctattgtttgctttacaccgtttacagcgtgataggaaattagcatgttaa

SEQ ID NO: 4099 - DNA, 192 bp, Proteus mirabilis
gagatgaaatttaaaataagtgacaaggttagaatagttaaagatacgctagatggtgaaatggatggctacactggcgtatttgcaagatatgaccatcatgatgattcattgctcaattattatgttgagtttgatgatggaggggaaaattggtttctagaggaagagctggagttaataaatgaatag

SEQ ID NO: 4100 - DNA, 285 bp, Proteus mirabilis
catgccgcttcgccttcccagcttatttgtttaggtgataatcccaaagagcaagcaactgcgtcaaataatcgtccacaagatgatgctagcggtgaatttaaaccacgagccactgccttactcaaaatctgtaactcagtgagcggaattgcttgggtgataacactaccttgccaatcttttgtaaaagtagctaaatgtgcgaaccaatttcgccaaggctgtattgaagctaaatttcctcccggcatagcaaccgcaggtagcccgccaatacgttga

SEQ ID NO: 4101 - DNA, 219 bp, Proteus mirabilis
tatcagcattcgctgtatatccacattcaaggcactcgaattgactttgtgactgtcggttttcctttgctgtatgaccacaacaagcgcacttctgactggtgtaggctggtggtattgccagtacctgaccacctcgccagagctgcttgtactcaagctgtcggcgcatttcataccagccctgctccagtattgagcggtttaaaccagatttag

SEQ ID NO: 4102 - DNA, 234 bp, Proteus mirabilis
atattatcatcaaaaataaggtttaatttaatgaaaaaaattataatttttggagctactggaaatgtaggctcttacttaactcgctattgtacagagttttttgataaagatgaatttgagatcatagctgttggtaagcgtgatactgatgcttttaatatatataatataaaatacattagtgttgatatttacaagctcggccgatttcgaaaaattacctacggataa

SEQ ID NO: 4103 - DNA, 849 bp, Proteus mirabilis
caattaaaatcaccctctttcaggatagaatatatgagccagacgaaaacctctcttatgggtcaatgcatttccgagtttatcggtactgcattgctagtcttctttggtcttggttgtgttgcagcagcacgtatcgcaggcgctcaactcggtctttgggagataagtattatctggggcttaggtgttgccttagccgtttaccttactgcgggtacctctggtgctcacctcaacccggcggtcacagtcgcattctggttgtttgcgtgctttgaacgtaaaaaagttatcccttatattgttgcacaaatgttaggtggtttttttgccgccgctgttgtgtactttatgtattacaatttatttatcgactacgaacaggtcaacggaattgtacgaggatcacaagaaagcctctttactgcgggcgtcttctctacttacccagcagcccaaatctctgtgatccacgcattttttatcgaagtaattattgccgttattctcgttggcttaattttagccttaacagatgatggtaacggtgtacctcgtgggcctttagcgccattacttatcggtattctgattgcggttatcggtggtgcatttggcccattaactggattcgccttaaaccctgcccgtgattttgggccaaaattagtcgcattctttgccggatggggtgatattgctttaacaggtggacgcgatattccttatttcttagtcccactcattgctccaatgattgggggtattttaggcgcacttgcttatcgtaaacttattggccgtcacttaccttgtgatacctgcaaaattgaaaacgacaaataa

SEQ ID NO: 4104 - DNA, 1011 bp, Proteus mirabilis
atcacgatgttaaaacgatggggattattgacgacgctagcgctgacggcactgtttacacaaagcatctgggcgaaggatattcagttattaaatgtttcttacgatccgactcgagagctttatcaacaatataaccacgcatttagtcaatattggcaacaaaaaaccggcgatcatgtgactattcgtcaatctcatggtggctctggtaaacaggcaaccgccgtaattaatggtattgaagcggatattgtcaccctcgcattagcttatgatattgatgccattgcacagagaggacgtatagataagcagtggatcactcgcttatcggataactcagcaccttacacttcaaccattgtttttttagtgagaaaaggtaatcccaaacagataaccgactgggattctttaattaaacccggtgtatcgattatcacgcctaatcctaaaacctccggtggagcaagatggaattatctggctgcatggggatatggattaaaggccaatcagcaagacagtgaaaaagcaaaagcctttgtaaagtcactgtatcaacaggttgaagtattagactcaggcgcgagaggcgcgacaaatacttttgttgagcgtggtattggtgatgtgttaattgcatgggaaaatgaagcgctactggcgattaatgagttaggtacagataagtttgaaatagtcaccccttccgtctctattttggcagagccaaccgtctctgtggtggataaagtggttgataagcgaggtacgcgggaagtggcaaccgcttatttagagtatctttattcacctcaagggcaagaaattgctgctaaaaactattatcgtccaagagataaaagcattgctgagaaatatcaaaaacgttttccaaccctgcaattattcactattgatgagctttttggcgattggcaatcagcacaacaaactcattttgccaccgggggaatatttgatgaaatcagccgacgtgattag

SEQ ID NO: 4105 - DNA, 1131 bp, Proteus mirabilis
attaaaaaaccgtcgcatctttgtattttggacaacgacggtttttttgcaacaaaaaagcaatcgtttaaccaaaccatcagtacggaggtatggggtttgcaacagaataataaagagagcgcacaagcaacaatgaaagatgttgcttttgctgctggcgtgtcaacagccacggtgtcacgcacattaatgaatccagaaaaagtatcctcacaaacccgtcaaaaagttgagcaagctgttcttgacgtgggttattacccacataatttgtcaaaaaacctgaaacgtaacgagtcaaaaacgatcctcgtgatcgtccctaacatcagtgatcccttttttacagatgttgtatgtggcattgaagaaaccgcagctcaacacggctatcttgtgttaattggtgactgtaaacaccaacaaaaacatgaaaatgcctttattaatttaattattactaagcagattgacggcatgttactgcttggctctcatatcccttttgatgtttctaaagaagagcaaaaaaatcttcctcctatgatcatggcaaatgaatttgcgccagagcttgaattgccaaccgttcatattgataatttgactgcttcttttagagccacccactatctacaacagatgggacataagcgtattgcctgtattactggccctgaagatatgccactatgtcgttatcgcttacaaggttatattcaagctatgcgtagaaccggtgtccctctacgcgaagattatattattagaggtgattttacccacgaaagcggtgcagaaagtctgaaaaagttaatttcgttacctgaaccaccgacagcggtattttgtcatagcgatattatggcgattggtgtgatgtggcaggctaaaaaacttggcttacaattacctgacgatctctctgtgattggcttcgataaccttgatattacgcgctatagcgagcctgcattaaccaccatggaacagccacgttaccaaattggtcgtcaatccatgttgttactgcttgatcagttacaaggtagacctgttgcacccggctctcgcctattagattgtgagttaatagtaagagaaagtgtctgtcggcttaaaagctag

SEQ ID NO: 4106 - DNA, 942 bp, Proteus mirabilis
cgacctttgccattgaaccgattaagctttcacttaatagcaatatcgattcagctattccgtgataaaaaacaaagctattctattcaatgttctctatactgttgtgcatcaacagaatttgagtttatcgataaattaaatttaaaccactcggttggaggaaaagttatgcgccatccattagtcatgggtaactggaaacttaacggcagcattcatatggttcatgaattaatcgctgcattacgtaaagaaatcagcggtgttgctggatgtgatgttgctattgcaccaccaacagtttatctgtgccaagctcgtcatgaaatcggtggaagccgtattgcgttaggtgcccaagataccggtgttaacttatctggtgctttcactggcgaaacttccccagaaatgctgaaaaacgttgatgttaaatacgtgatcatcggtcactctgaacgtcgtacttaccataaagaatctgatgaatttatcgcacaaaaatttggtgtgttaaaagaattaggcttaacacctgtgttatgcatcggtgaaacagaagctgaaaacgaagctggtaaaacacaagaagtgtgcgcacgtcaaatcgacgcgattttaaatgcacatggtgcacaagcattcaaagatgcagtgatcgcttatgaacctatttgggcgatcggtacaggtaaatcagcaacgcctgcacaagcacaagcggtacataaatttattcgtgatcatatcgctaaacaagatgcgactatcgctgagcaagtcattattcaatacggcggttcagtcaacgataaaaacgcagcagagctatttagccaacctgatatcgacggtgcattagttggtggcgcgtcactgaaagcagatgcctttgccgttatcgtgaaagcagcagcagaagcgaaagcgaaaaaataa

SEQ ID NO: 4107 - DNA, 1542 bp, Proteus mirabilis
caacaatttactaataccttaattgaaaggtcacttaatatgaaattgaagaaaaaaagaaacaaaccattaagaatcaatgatataaccattattgatgatagcaaacttaaaaaagccattactgcggcagcgttaggtaatgcaatggagtggtttgattttggtgtatatggcttcttggcttatgtattaggtcaagtgtttttccctggtgcatcacctggcgtacaaatgatcgcagcacttgcgacattctcagtcccattccttgttagaccattaggtggggttgtatttggtatgttgggggataagtttggacgacaaaaagtcttatctgtcaccatcataattatggcactaagtacttttgctatcggtcttattcctgggtatgacaccattggaatttgggcacccgtcttactgttattagcaaaactagcccaaggtttctcaattggtggtgagtactcaggtgcggcgattttcgttgccgaatattcaccagaccgtaaacggggctttatgggaagctggttagatttcggctctattgccggcttcgttatgggggcgggtgttgtagtccttatctcaactattatgggtgaagctgcattccatgagtggggatggcgtattccattcttcttggcattacctttaggtctgattggcttatatttacgtcatgccttagaagaaaccccggcattccaacaacatgttgatgaaatgaacagcgatgatcgtaaatctatcgaaaatccgccacgtgtttcattacgagaaatcgcttccaagtattggaaaagtttaacggtatgtgtgggcttagtgattgcgactaacgtcacttactacatgctgctaacctatatgccaagttatttatcccataacttaaattattccgccgatcatggggtcttgatcatcatcgcgattatgatagggatgctatttgttcagcctgtgattggattactgagtgataagattggtcgtaaaccttttgttatcgggggtagcgttggactgtttatattggcatatccggcatttatgatgattaacagtgatgaaatcggcttaattttcttaggattattaattcttgcggttttattaaactgttttactggggtgatggcctctattttaccggctattttcccaacccatattcgttatagtgccttagctattgcatttaatatctcggtattaattgctggtgccacaccaacagcagcggcttggttagttgaagcgactggcaatttatatatgcccgcctattatctaatggtagttgctgttgtcggtttgataacgggtataaaaatgattgaaacagccaacaaaccattacgtggagcaacaccggcagcatcagataaatcagaagcgaaagagattttatctgagcactatgacaatatcgaacaacgtgttgaagatatcgaagcggaaattgaagcattacagaaaaaacgccaagcgcttatcgatcaacatccaaaattagattaa

SEQ ID NO: 4108 - DNA, 1548 bp, Proteus mirabilis
aaacaggttactaacatgacaacagaaacaaacaaatcgaatagtgaaaaaaaatatatcgttgctctggatcagggaacaaccagttcacgcgctgtcgtaatcgatcatgacgccaacattgttagcatctcacaacgcgaatttacccaaatttatcctaagcccggctgggttgagcacgatccaatggaaatctgggcaactcaaagcgcaacgctaattgaagtattggccaaagaagacatcccttctgatcatgttgccggtatcggtattaccaaccaacgtgaaacgactatcgtctgggaaaaagagaccggtaaacctatctataatgctatcgtgtggcaatgtcgccgtactgcagacttttgtactcgcttaaaagatcaagaaggggttgaagagtacattcgtcaaaatactgggcttatggttgacccctatttttcaggcaccaaattaaaatggatcctcgataatgttgaaggcgctcgtgaacgagcagaaaaaggagagttactctttggtaccgttgatacttggttagtctggaaaatgacacaaggtcgtgttcacgtaacagattataccaacgcttcacgtactatgttgtttaatattcactctttagattgggatcaaaaaatcctcgatctgctgaatattccccgcaatatgctacctaaagtggtgccttcttctgaagtttatggtcaaaccaacattggtggtaaaggtggtacacgtattcctatcgccggtatggctggtgaccaacaagcggcactctatggtcagctctgtgtacaaagtggtatggcaaaaaacacctacggaacaggctgcttcttgctgatgaatacaggtaaagaagccgtgcgctctaaccacggtctattaaccactatctgctgtggcccacgtggtgaagtaaactatgccttagaaggtgcggtcttcgtcggtggtgcttccattcagtggctacgtgatgagctaaaattaattgatgaagcaactgactcagaatactttgccactaaagttaatgacaccaacggtgtttatgtcgtacctgcatttactggcttaggtgcaccttattgggatccgtatgcccgtggcgctatcttcggtttaacccgtggcgctaaccgtaatcatattattcgagctactttagaatctatcgcttatcaaacccgcgatgtccttgatgcgatgcaagcagactccggagcacgcttacaagcactacgtgtagatggtggtgccgttgccaataacttcttaatgcagttccaatctgacatcttaggtacccgtgttgaacgtcctgtggtacgtgaaagtactgcgttaggggctgcgttccttgcaggccttgcggtaggtttctggtctgatctggaagaggtaaaaaataaagccgagattgataaagagttccgcccaggtattgaaaccacagagcgtaattatcgttataacggctggaaaaaagcggttgcccgtgcacaagaatgggaagatcgcggttaa

SEQ ID NO: 4109 - DNA, 534 bp, Proteus mirabilis
ctcatgactacaatcgtaagtgttcgccgtaatggccaagtcgtaatcggtggtgatggacaggcgacgatgggtaataccgtcatgaaaggcaatgttcgcaaagtacgccgtctttataacgacaaagtgattgcgggatttgccggcggcactgctgatgctttcacgctttttgaactttttgagcgtaaattagagctccatcaaggccatttaactaaagccgctgttgaacttgcgaaagattggcgtacagacagaatgttacgcaaactagaagcattactggctgtggcagacgaaacaacatctttgattatcactggtaacggtgatgttgtgcagccagaaaacgatctgattgctattggttctggtggcccttatgcacaagcagcggcgagagcgatgttagaaaacaccgatctaagtgcacgcgaaattgcggaaaaagcactgaatattgccggtgatatctgcatctacaccaaccataatgtcaactttgaagaaatctcttcaaaagagtaa

SEQ ID NO: 4110 - DNA, 789 bp, Proteus mirabilis
tacagtataacaaacagtacagtaggaggttttatgtttgatttaacgggtaaaattgctttagtttccggcggagcaaaaggtattggtaaaggcattgttagcgcattaaaaaacagcggtgcacaggttattattgctgatattgatgatgtagcaggtaatgcaaccaaacaagcacttggtgttgattttatgcaccttgatgtcacctctcaagcagcctgtgaacaagtagtcaatgatattgttaaacagtatggcaaactcgatattctttgctctaataccggtattttcccccaagcgacaattaaagagatgagcgaagctgattgggataaaatgcataccgtcaatttaaaaggaatgtttttcttagtaaaagcggcccttgcggtaatggaaaaacaacaatatggtcgtgtgatcatcacctcttctattacaggcgccattactggctatccgggctggagccattacggagcaagcaaagcaggtcagttaggctttatgcgcagtgctgcactagaatatgcacgccacggtattaccattaatgccgttatgcccggcaatattttaaccgaaggcttacaagcccaaggagagacctatcttaatcaaatgaaggcctctatcccaacccataccttaggggagcctgaagatatcggctatgccgccgcattctttgcctctaatgaagcaaaatatattaccggtcaaaccattattgtcgatggcggccagattttacctgaatctccagaggcgttgttgtaa

SEQ ID NO: 4111 - DNA, 186 bp, Proteus mirabilis
gctagtaaaactacgttctgcactgagttggctaaaagctgcttcaatcaaagaacggcgggttttttctttttgtttcgctctgacgccaatattattactcacagcaatcctgataatccaaatgtggtttataaccaatatatcaaatttttacagaaaataagtacgtaccgttatccataa

SEQ ID NO: 4112 - DNA, 1956 bp, Proteus mirabilis
agtccgaagacctgccgaacatttgtcgcatgtaaaattaagtacgcgttttatttaattttggcggcatcctgctacttatttctgttggatgcagatttcatgaataataaaaaagtattttttctttcaagtgttgctttaagtgttatgacgagcagtttcaacctatttgcacaggctgataatacattgagtgtgactgctaatcgttttcaacaacctacctcctctattttagcgccagtgactattgttgatcgtgaacagatcgatcgctggcagagcaatagtgtgcttgatgtattgcgtagaatgccagggattgatgtagcacaaagtggtggtatagggcagatgagttcagtctttgtgcgaggaactgactcaagacatgtattaatattaattgatggtgtacgtactaaccaagcagggatttctggctcttacgatatgagtcaactgcctctttctttagtacaacgtattgaatatataagaggccctcgttcggctgtttatggctccgatgcgattggtggggtcattaattttataacgaaacgcccaaatgatggtttaacgttaaatgcaggaataggaagccatggatatcaaaattacaatggttcaatacaacaaaaggtaggtgagagaaccacattatctgcggcaggtggatatacttatactaagggaatacatgcaacggatgattctgtccctgttgccgccccttttcatgacagacatggatttatgaataaatcctattggtttggtatcgaccatatttttaatgataactttcaaggctacatgaaagggtatggttatgataatcgtactacttatgttgcatcttatcccggtaatacagatcaaagtaaaacttataatcgtaattatgaagcgggtattaagttcagtggtgattcctattttagtcaattaattacggtgtatagccaaactaaagactataactacatttcaacaaatggccgtgatggtaagggctcttctgtagataattctaaacaatataatgtccaatgggggaacacctttttaattccaagtggcatgatcagcgctggaatggattggcaaagacaaacgattgaagcgaattcagcatcagtacctcatcaaagaacaattgataatactgggctatatctcacatctcaaaaacaacttagttcagttatcgttgaaggcgctattcgttctgatcaccacgatgaatttaactggcatactacatggcaaaccagtgcaagttgggagttcgtcgataactatcgagtaattgcttcttatggtacggcatttaaggctcctacattggggcaactttatgcggataatcctacatggaacacaaaaggtaatcccaatttaaaaccagagaaaagtaagcagtgggaagtgggcgttgaagggttaactcaagggattgattggcgtttatctctatatcaaaatgatattgataatctgattgcttttagagataacacttacattaattacaataaagctaaaataaaaggtgctgaatgggttggtgagatggatactggatcattacatcatcaattaacattgcagtaccttgatgctagagatagtgataataatctattaagcagaagagcaaagcaacagcttaagtatcaagtagattggaatatcgcagatatagatattggaattaattatcaatatataggaaagcgctatgatacggactttaaccaatatcctacgaaaagaataaaactaggtggagtaagtctttgggatttaactgcgtcatatcctattacatctcatctctcaattcgtggtagaatagccaacctgtttgataaagattatgagacagcttatggctatcgcacgccaggacgtgaatatttcctcaccggaagctacaacttctga

SEQ ID NO: 4113 - DNA, 753 bp, Proteus mirabilis
gagattatggcaaattgggtcactggaaaagtcattcaagttaggtattggacagatacattaatcagtttagttgtacacgcccctatcgataagtttacagcaggtcaatttgccaaactggcactcgaaattgacggtgaacgtatacaacgcgcctactcttatgttaactccccgcaagatcccaacttagagttctatttagtcactgtacctgaaggtaaactcagcccacgcttagcagcgttaaccgttggtgatgaactcttagtgacagaacaagccagtggcttttttgttttagaagaggtgcctagcgcgaataccttatggatgttatcaacaggtacggcgatcgggccatttctctctattttacaacttggtgatgatctcgaccgtttcgaaaatattgttttagtccatgctgtacgctacgcccgtgatttaagctatctaccattaatggagctgttagctgaacgctaccaagggaaactgcgtatccaaactattgtcagccgtgaaaaccatataggttcactaaccggacgcattccagcattaattgaaagtggtgcattagaaaaaaccgtaggattaactatttccccagaagagagccatattatgctatgtggtaatccagaaatggtaagagacacgcaacagttactgaaaacacagcgtgatatgagaaaacatttacgccgtaaaccgggacatatcaccagtgaacagtattggtaa

SEQ ID NO: 4114 - DNA, 2238 bp, Proteus mirabilis
tactatcttttcgctaaaacactcggaaaccctgatatgactatagttcaggtaatattacctgtaccactgttttcttcctttgactacctgcttccagaaggttgtgccatgccaacaataggttgtcgcgtggtcgttccctttggcaaacagcgtcgctctatcggtattgttaaaggttttagttcacacagtgagtttcccattgaaaaactgaaacctattgaagaagtacttgatacagagactctgtttccagggatcttatgggatatgcttaattgggcaagtgcttattatcattatcctttaggtgaagttctctttcatgcgatgccaattctactacgacaagggaaaccggctgaatttacgcccttatggcaatggtatgccactcaagagggagaagcgcttgatcttaacagtctaaaaagcgctaaaaagcaacaacaagctttagcggcactacgccgtgcccctttgtatcgccaccagttagatgaatatgaaattacaacagcgacactaaataacttaaaaaagaaagcattagcggatttacgtcctattcaacccgcccctatacagtggcaaagcacttttgccgtacaaggcgaacgatttaaacttaatgccgaacaggcggttgctgttggtgctatcacggcacaagcagaccaattttcgccttggttattattggggatcaccggctctggtaaaacagaagtgtatctcagtgtacttgaaactattctcgctcaaggtaaacaggcactgatcttagtccctgaaataggtttgaccccacaaaccattcgccgttttaaagcacgttttaatgcccccgtcgatgttcttcactccggactcaacgatacggaacgccttgcggtatggctacgagcgaaacggggagataatgccattattatcggtacgcgctctgcattgctcaccccttttcagcaattagggattattattattgatgaagagcatgatggctcttataagcaacaagatggctggcgttaccatgcacgggatttagcggtctttcgcgccaagcaagaaaatattcctatcgtgatgggcacagccaccccatcgattgaaaccagctataacgttgcacaaaaaaaatatcaacaactgacgttaacgcaacgggcgggaaatgctaaacctgccacagagcatttaatcgacctaaaagggcaaccgctcacaaccggactctctccaacactcattaaagccataaaagagcatcttaatgccggtaaccaagtgatgttgtttttaaatcgccgtggctttgcgcctgcgttactctgccatgagtgtggttggattgccgaatgccctcgctgtgatcactattataccttacatcaaaaacacggcatgctacgttgccaccagtgtgatagccaacgtcgtattccatcacaatgtcctcaatgtggttcaactaatttaatgccagtaggattgggcacagaacaacttgaacaaggcattggcgagttatttcctaatacccccataacccgtattgataaagataccaccagtcgcaaaggagcattagagcaacaactagaagacatctatcaaggtggatcacgtattctaattggcacacagatgttggctaaaggtcaccacttcccagacgttacgctggtggcgctacttgatgttgatggtgctttattttctagtgactttcgtgctgctgaacgttttgctcagctttatactcaagtatcaggtcgtgcaggaagagctgggaaacaaggtgccgtctatttacaaactcaccaacccgatcacccactattattaacgctgttagaaaaaggctatgatgcttttactaaagaggcgttacaagagcgacaagcaacctttttacccccttattccagccatataatgatccgctctgaagatcataataaccaaaaagccccccagtttttacgccagcttaaacagttcttcgagcaacacccgatgagggatagtcatttatgggtgatgggccccattccggccattcaggcaaaacgagggggaaatttccgttggcaactattattgcaacatccttcaaggggttatttacaaaagttaatgtctgttacttatcctcagatagtggcgcttcctgagagtaaaaaagtgaaatggaatattgatgttgatccaacagattgctga

SEQ ID NO: 4115 - DNA, 608 bp, Proteus mirabilis
  unsure (41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(164),(165),(166),(167),(168),(169),(170),(171),(172),(173),(174),(175),(178),(179),(180),(181),(182),(183),(184),(185),(188),(189),(195),(214),(219),(233),(235),(240),(249),(266),(267),(268),(269),(270),(307): Identity of nucleotide at the above locations are unknown.
acgctggcggcaggaccagcccgggccgtcgaccacgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnttnnnnnnnnccnncccccnccccccccccccccccccnccccncccccccccccccncnccccnccccccccnccaccccccgccccccnnnnnccccccccccccccccccccccccccccccccctccnccccccccccccctcacccaatcctacctttcctttctccattactcttctattatatatacttatttcatcccatctactatctttcatttcctatctttccttcatcttacactactctctcttttccttctctctttatcctttctccactctatccttccgcttccctcactttaatttgtcacttctttaatatctttattctcctttacatttttccttttctttccattctatcttactctttcatcacttatcttaatctcctattcaatctttcaccccacactcacactcc

SEQ ID NO: 4116 - DNA, 1368 bp, Proteus mirabilis
agtctctttcttatcttgttgtgtacctttattagcatttgctggtttatccgttggtggccaattagaagaactgaagaaaatgtcatggaaagtgatccttattttcatgattgtttctacctgctgtttcttcggcgcatcaatcgtcgcacaaattggatttactatccagggagttatctaatgaataatatttataatgtcagcgaaaaactctttcaattaaatgactttagtaaaaaaacacgacaagatctgcacaaaattcctgagttatcaggtgaagaatataaaacatcaaagtattgccgtgaattgatggaaagctttggctatcaaattaaaacctttgatggctatactggatttactgccgatttaattgttaatgctgattttccactgattgccatccgtgcagatatggatggattagaaatgccagacttaacgaacaacgaacacagctctatccatcaaggttgtgcacataattgtggtcacgatactcatatgaccattgcattaacggccgctaaataccttgctgaaaaccaagcagaaatgagcgccaatgtgcgttttattttccaaatggcagaagaggatatgcgtgttcctggtgctgacaaaatggttgagttaggttgcatggaaggcgttgatgaaacttacgcactacataatgatgcagctatcgaaaccggttgtgtacgttttaatgatggtgtcatgtcatcttacggctcagcatggacattagatgtttatggtgtttctgcgcacggatctacaccgcataaaggtttagatgctattcgtgaagcaactcgcttaattgattatatggattatgtggttgccaaaaaaactgatccctttagccctgcggtatttggttgcggcatgatcaatggcggtactattcctaatgcgttagcagatcacgttcaagcccgtggtactatccgctctatggatgaaaataccgacaaagtattaaaagaaagctttaatgaaatcgtagcgcgcagtacagcgggtggatttaaaacaacattaacagcgacaggctaccctgctgttattaaccatcctacggcttatcagcgtttactagaagccactcgccaatttttgccagaagagaatatcgaatctaacggtaaaccaatgacgggtagtgaagactttagctatatggtgaatgccactaaaggtaaagttggcgcaatgttctttttaggcagtggtaatcaagctaaaggtatcaataactaccttcatgctaatccttattttgttgatgatgattgtttattagtgggtgcacagatttttgttaatctgctaactcgcaaataa

SEQ ID NO: 4117 - DNA, 933 bp, Proteus mirabilis
gtattgaatttcagcatgagcgctcaacattccattagccggacacaagcctggcttgaaagtttacgacccaaaaccctacctttagggttaattgctattgtgacaggctccgccttagcgtattggacgggtcattttgagctacctattgcattactggcgattttaactgctggcacactacaaattctctctaacttagcgaatgactatggtgatgccgttaaagggacagatactgaagagcgattagggccactgcgtggaatgcaaaaaggggtgatcacccctgctcaaatgaaaaaagccttaattattaatgtaattatctcctgtgtttcaggtatcgccttgataattgtcgcatgtaaaaaacccgaagatgctattggctttttagtgatgggcttattggctatcgtggctgccattacctataccgtagggaaacgcccttatggctatatgggattgggcgatatttcggtattaattttctttggctggctaagtgtgattggcacttattatttgcaagctaatgcttttaatattgtgacactactgcctgccaccgcctgcggactgctctcggtcgcagtacttaacattaacaatatgcgtgatcttgaaaacgacattcaagccggtaaaaataccttagcggtgcgtttgggggcttctggctcacggatttaccacacctgcgtgattgccatagccattatctgtttgattgtgttcaccctgatttatatgcaccgttggacggcgtggctatttttattagccgtacccatgctattactgcatattaaacgcgttaatgccgatcttagtggcgaagccatgcgaccactgcttgaacatatggtcaaagcggcgctgttaaccaatattcttttttctttaggtttagttttagagtaa

SEQ ID NO: 4118 - DNA, 237 bp, Proteus mirabilis
aatgagagctacagcacgtcgttatttttaaccttggctatacttaaatcatctctagtcacaaaggagcgattaatgtcaaaaattgaaaaacatgttgatcagctaaaagataaagcgacggaggtgaagcatcggacagaagaaaaattatctgaagttgcccacgatttaaaacatggtgcatctgatcttaaagaaaacgtagaaaaaaagattgattcattgaaaaagtga

SEQ ID NO: 4119 - DNA, 1413 bp, Proteus mirabilis
aacaggtctcttcctatgcaacattctcatttcgatgcaattgtaatcggttcaggtcctggtggtgaaggcgcggccatggggctggttaaacaaggaaaacgcgtcgccgtcattgaacgttatgatcaagtcggtggtggttgtactcactggggaactatcccatcaaaagctctacgccacgcggtcagtcgtattatcgagtttaatcaaaacccgctctatagcgaccaatctcgcctgatcaactcctctttttctcaaatactacgccaagccagcacggtaatcagtcaacagactaaaatgcgtcaaggcttctacgagcgtaatcattgtacgatgtattcaggcgaagctgcttttattgatgatcatagaattagcgtacgttatcctgatggtacttgtgatattctcagtgcagataattttattattgccacaggctctcgcccttattgcccaccggatgttgatttctcacactctcgtatttataacagcgataccatactcgaccttgagcatgaacctcgccatgtcattatttatggtgctggggtcattggttgtgaatacgcttctatttttagaggtctaagagtaaaagttgatttaattaatactcgtgatcatctactgtcattccttgatcaagaaatgtcagatgcactctcttaccatttttggaataacggtattgttattcgacacaatgaagattacgacaccatcgaaggcgttgatgatggcgttattgttcatctaaaatccggtaagaaagtcaaagccgattgtctgctttatgctaatggtagaacgggtaataccgatacgcttggtttagaaaatgttgggatcaaaaccgatagccgtggacaagtggcagttaatgcgcattatcaaaccagttgtgaacatatctatgcagtaggtgatgtgattggctatccaagcttagcctctgcggcttatgatcaagggcgcattgcggcacttgcgcttaccacaggcacctcggaaacgcatttaattgaagatattccaacgggtatctataccattccagaaatcagctctgtgggtaaaacggaacagcaactcaccgcaatgaagatcccctatgaggtcggtcgttcacaatttaagcatcttgctagggcccaaattgcaggtatgaatgtcggtagcttaaaaattctttttcaccgtgaaaccaagcaaattttaggtattcactgctttggcgagcgcgctgctgaaataattcatatcggccaagcaattatggagcaaaaaggagaaggcaatactatcgaatacttcgttaataccaccttcaactacccaaccatggcggaagcctatcgtgttgctgctttaaatggtttaaatcgcttattttga

SEQ ID NO: 4120 - DNA, 1176 bp, Proteus mirabilis
taccaatatcataaactctgggtactttcccagtgcggtagctatgcctattggttttttagagaaaatacttatatggaaacaatcacagtaactagcccattatttccaccattggaagagctagagccttacttaaaagatatatggaagagaaaatggctaaccaataatggttactatcatcaacgccttgaagaggcgctatgcaaatacctaaatgtaccttacattagtttatattcaaacggaacattagcgctaattgcagcaataaacgtcttaaagctaaaaggtgaagtaatcacaacaccatatagttttgtcgcaactagccattcattactacatagtcatattacgcctgtctttgtagatatagagccaaatacctataatatagatcccaataaaattgaagcagctatcacagataagacaaccgcgattttacctgttcatgtatatggtcgcccatgtaatcatgaagcgattcaaaaaattgcagataagtataaccttcccgtgatttatgacgcagcccacgccttcggggtaaaagaaaatggtaactccatattaaatcgcggtaacttatctattttaagttttcatgcgactaagacttattctactattgaaggaggtgcgattatttgccatagcgcagagatgaaagaaaaattagataaatataaaaattttggttacacaaatgaaacagaaatcgatgagctaggattcaatgcgaaacttaatgaagtacaatcagcatttggtttgctaacattagactatatagataaagcaatagaaaaaagaaaagaagtttctgatttttataaaactaatctaagcaatgtacctggtattacattacctaatataccaaaagatttaacttggaattactcttactaccctataataatagataaagacaggtatggtaaaacaagagatgaactttatttagagttaaaagaaaataaaatattaagtcgaaggtatttttatccattaataactgatttcaatatttataatcaatataaaacaaaaacccctatcgctgaaaaaatatctgaaaatgttatttgcttaccaatccatcatttattaagtaatgatgacttgaatagaataattaatattattaaatatgactataaataa

SEQ ID NO: 4121 - DNA, 411 bp, Proteus mirabilis
  unsure (37): Identity of nucleotide at the above locations are unknown.
gtgcatttccaggtctctagtccttctgacttaattnctgagttacaaggccgtctgcctattcgtgttgaactacaagcactgactgcagaagattttgaacgtatccttactgagccaaatgcatcattaacaaaacagtatcaagcattaatggctaccgaaggggtaagcattaactttagccaagacggtattcgcaaaattgccgaatctgcatggcgtgtaaatgaaaccactgaaaacattggtgcacgtcgtctacatacggtattagagcgtttaatggaagaaatttcctatgatgcgagtgaacgtcaaggcgaaactattcttattgatgcagaatatgtgaaacagcatctggatgagcttgtagcagatgaagatctgagtcgatttattttataa

SEQ ID NO: 4122 - DNA, 474 bp, Proteus mirabilis
agttttcaccagaggcaaaactgcatgaaaaatataattatagatatgaaattagtattcgttgctattttactggcaatgtttactcaaacgttaacatcagggattgctatttatgcaatgtgggatagctttattgctatgtctgtagtggtttttatttcactcgttgctaaacaatatttaccttcatctctaccaacatttgcttatgcaactattatcgggatacttatttgtttacctgaaacacctgtaagagagttttttattagttctatcggtaaagtctctttcttatcttgttgtgtacctttattagcatttgctggtttatccgttggtggccaattagaagaactgaagaaaatgtcatggaaagtgatccttattttcatgattgtttctacctgctgtttcttcggcgcatcaatcgtcgcacaaattggatttactatccagggagttatctaa

SEQ ID NO: 4123 - DNA, 405 bp, Proteus mirabilis
atgatggaacaaaatcgctgtgaaaaaagcacactattactttccgtagttatcggtgttgctttacatggtagttactcaactttatttaacccacttactggaccttggtctatttttccactgattagtttagttctagctgtttactgcttataccaacgttatttaaatcaaccaatgactgatggtatgcctaagttaattttctcattctttttattagggctatttggttacaatgcatatttaaaaacctctaaccctgaaatgggctctaacttcttctcttctgtatgtattgtgattattgctctatggatttatcgtcaaattaaacagcgtaaacgtctacgtgaacaggaagaagacgctgagaaagcatcgcaagcagagcaatattaa

SEQ ID NO: 4124 - DNA, 1050 bp, Proteus mirabilis
aaatacattaatcggtttgtgttcatagtacaaggtaagaatgacatgttaaatactctgattgtaggagcaagtggttacaccggtgctgaattagcagcctatcttcagcagcatccccatgtaaatttgagcagactgatggtatccgctcaaagtgtagatgcagggaagtgcttttctgagctttacccacaatatcgtggcttagttgatttgccacttgagcctatggtcgatgttgctaatgccgctaaaaatatcgatatcgtttttttagccaccgcacatgaagtcagtcatgacattgctcctatttttctcgctcaggggtgtgtggtgttcgatttatctggcgcctaccgagtacaaaataagcatttctatcaacaatactatggattcgagcataagaatactgattggttatcacaggcggtttatggtcttgccgaatggaacgctgatcagattagtcaggctcaacttattgctgtgccgggttgttatcccaccgtttctcagctgtcgttaaagccattagttgaagcgggattattagacagcactcactggcctgttatcaatgccaccagcggtgtaagtggcgcaggcagaaaagcgtctttaacaaacagcttttgtgaagtgagtttacaaccttacggtgtttttacgcatcgtcaccaaccggaaattgctactcaccttggcattgatgtcatttttactcctcatcttggtaattttgctagggggatcttggccactatcacctgtaagttaaaacaaggtgtcacagaaaatgaggtaaggcaggcatttgaaacagcgtatcaaggccaaccgttggtacgtgtgtatgacaaaggtctacctgcattaaaagccgttgtcggtaccgccttttgtgatatcgggttagcacaacaaggtgagcatttaattattgtcggtgcggaagataacttattaaaaggggccgcagcacaagcggtgcaatgtatgaacattcggttcggttttgcaccaaccgaaacacttatctaa

SEQ ID NO: 4125 - DNA, 702 bp, Proteus mirabilis
cgaatgcataaaatcttattagtggatgacgatcgcgaattaacctcgctattgaaagaactacttgaaatggaaggctttaatgttgtgctcgccactgacggcgaacaggccttaaaacttctggacgcgtctattgacttgttattactggatatcatgatgccacgtaagaacgggatcgagacacttaaagagttacgccaaaatttccaaacaccggtcattatgttaacggcaagaggcagcgatcttgatcgtgtacttggcctagagctgggagcagatgactatttacctaagccatttaacgatagagagctagttgcacgcattagggctattttacgtcgttccaactggagtgaacaaaaacagaccgatggcaacacctcaccgatattgcaagttgataagttacaacttaatccgggtagacaagaggccagctttgataatgaaccattagagctaacaggtactgagtttacgttactttatctacttgctcagcatttaggacaagtagtatcgcgcgagcatctcagccaagaagtgttaggtaaacgcttaacaccttttgatagagcgattgatatgcatatttccaacttacgtcgtaagttaccggaaagaacagacgggcagccttggtttaaaacattacgtggccgtggttatcttatggtttcaataacttaa

SEQ ID NO: 4126 - DNA, 660 bp, Proteus mirabilis
aggtatagtaatccacatcgagaacaattacacatatttaggtcagcattaataagtcggtattataaccgaatgaggagtgggacaatgcgtaaagtagcaatggttgcactagcatcaatgtttttagtagctccgacggtagtaatggctgaaacatcaaatacaaataatcagcctgctgggcaacaacagtataatgataattaccattgtggatacggttacggtatgcatgatggacgtgataaccgaggtcatcgtggacaacgtggccatatgatgggtaacaataatttcggtgagtcgcgtatgtttaatggtattacattaaccgagcaacaacgtactcaaatgcgcgatttaatgcgccagcatcatcaagatcgttttaataacagtgattttcgtcagcgtcacgaaaatatgcataagctaattaccgcggataagtttgatgaagcagcggtaagagcgcaaatacaagatatggacaaacaagcaatagagcgccgagttgaaatggcgaaagttcataatcaaatgtatcagctattaacccctgagcaaaaagcgcagctagaaaagaattatcaacagcgtgtctcttctgtttctgttagccagcaaaaccagcaaactcaagagaaagctaattag

SEQ ID NO: 4127 - DNA, 900 bp, Proteus mirabilis
ccaacctgtttgataaagattatgagacagcttatggctatcgcacgccaggacgtgaatatttcctcaccggaagctacaacttctgatgcacaatctaccgctaatcccactgtcttagtttttgactcaggggttggcggtttatctatttatcgagagatccgtgaaaaactgccggatgctcactatatctatgttttcgataatgaagcatttccttatggtgagaaacctcaagagtttattattgagcgtgtcgttcgtatcgtcagtgctgtcgcgcaacagcatgagttagcagcgattgtgatcgcttgtaataccgcaagtacagtaagtctgcctgctttacgtgctaaatttactgatatccccattgttggtgttgttcctgcgattaaacctgcagcaaaacttacctgtaatggtgtggtcggtctattagccacaagagcaacggttaagcgaccttatactcatgaacttatcgaacgctttgcgacagagtgtaaagtgcatctattaggttcagcagagctggtggagttggctgaaaaaaaactgcatggcgaaaaggtgtcatgcgatgagctacgtagaattttagccccttggcttaaaatgaaagagccaccagatacggtagtattagggtgtacccattttcctctattagaagaagagttactttctgttttgcctgatggtactcgaattattgattctggtggtgcaattgcaagaagaactgcgtggttagttgtaaatcaagataaaatcagaggttcaaaagaaattagttttgcttactgtcttaaagaagatgagtatagtgaattattaaaaccggttttagccgattttggctttaaaacgctcagaaaattggcgctttaa

SEQ ID NO: 4128 - DNA, 261 bp, Proteus mirabilis
caaaactgttttaaacgctgtaacgctgcttgttcgcttgctgggaacatcttggttgatgatattggtagtgcaaaaagtggtgcacttaacggtgaaacggctttttggtgtgctcttatttcgggggctggtaatgaagcattatcttgcgacagaaatagccgtaaaaatgcggttctaaaaggagtaaagactttgtacatctctccttgttgggtcacgacattccccggtggcacaaaaatgttatcgtggtaa

SEQ ID NO: 4129 - DNA, 825 bp, Proteus mirabilis
cggatggacaaaagtagaagtccgataaaggttttctttattagtattctggcagtccttttcttaatttttatttcacaatatgtgattggtaaaaaagaaattaagattggtattgcagtcattcctattctaccaatgttatttgcagttattattggtatgtttatgtcggctggatttacccgcaaaaaaattaaagtttggggtaaattatttacagaaaaagaagaaggcttctgcggtaaaatggtaggtttcagcctacttattttaggtacgcaatatgctggcatgatcgtcccaaatataaaaatgattttaagtgtcggtattcctttatttgttcaagagctaggaaacttattaccagtattaattgccgtaccattagccattaaatttggttttggtcgccgtgcaattggtgcatgttcatctattagtcgagaaccttctatcgccgttattcaaggtagatttgggactggctcacaagaatatattggtgtattagctatttacttatgtggttctgttatcgggactttatggtttagcgtattaggtagtcttgcaccattaacaggcttacacccacttgctctagcagcaggctccggcgtaggttcaggttcaatgttaagtgctgcatcaggggcattaattaacggtttagacgaagctttagcacaacaagtattaagtgttgcggctgcatctaacttattatcttctgcacttggcgcactctcattaacctatttaggtttacctctttcagaaaaaatttataaagttttcaccagaggcaaaactgcatga

SEQ ID NO: 4130 - DNA, 345 bp, Proteus mirabilis
cttggaaaaaagtttgattataaaggcgatcatgctgtttatgttatttcaaaaaatacagctctagaactcattgaacattatcatcaagaatataatcttaggaagtttattttcagattacccactatatataattatagtccttatcattactattatccaaatggtaagaagactaaaagacctttatatcaaatgatagaaaaagcagaaaaaggtgaagacatagaattatggggggatccaaaccattcaacagatatggtttatgtggatgattttagccaaatgctctgtaaagcggtattagtggatagagatcaaggagtttacaagtcttca

SEQ ID NO: 4131 - DNA, 300 bp, Proteus mirabilis
tcgacgctgaattggcgcaactgcacggtactcaacgaatgggaaggtattgttgtttatggtgcagtacgccaagtggacgctttatctgagcttgatttaggcattcaagcgatggctgccattcctgcaggttgcccaagtgaaggcatcggcgacagtgatatccgcgtaaactttggtggtgttactttcttctccggtgattatctttatgctgataatactggcattatcttatctgaagagcctttaggcttagatgatgacgatttagatgatgatttattagaagaataa

SEQ ID NO: 4132 - DNA, 813 bp, Proteus mirabilis
ttatcagcgaatcgaactgtggcacaacgagactatgtgggacgaggacagtcatctgctcgtcgtaaaaagacaacgaaaggcaaaggtaaaaaggcggccagtgggttgcctttaaccacacttattgtagcaattgcgcttgtggcgctatttgttggcggcctctattttattacccataataaaaaagaggttgtcgaaccaacgtcatcaagtgcagggcaacaaccaactaacaacttaccacctaaaccgcaagagcgttggcaatatatcaaagagctcgagaatcgacaggtggggaacccattacagccaccagcgacctcttcagggagccagattaatccgaaagcgacactttcaccggagcaattacgttttttacaacaaattgaagcggataaacgtcaaccggcggtagagttaccagaagtgccttataacggtgaagtaccacgttcacaggttgtcattaccccaccgacaaccaccgcaccttcggtacaaccttcgcaaccttcagcaccggtaaaacaggagcctgcacctgcgataacaacaccaaaaccagcgacgactgaagcgcgctttttagtccaatgcggttcatttaaaaccaatgaacaagccgaatctgtacgcgcaaccttagcattttccggtatcgaaagccgtgtgaccaaaggaaatgacggctggatccgcgttttatctggcccatttaataaagagcaagccaatacgctaagccgtcaagctgcaggcgcaggtgtatcaggttgtattcttcgtactgcggggggttga

SEQ ID NO: 4133 - DNA, 450 bp, Proteus mirabilis
gtctatattgagaaattattaatgaccttacaacattgggccttttcattcaaagggcgaattggacgctgtgacttttgggcgggttttgcactctgttttgtgctgttttgcggattatatacagttaatcagcactattcattgcctgctgtgctggtggggataatttcgctggctattttatatccgttatgtgccatttttactaagcgacttcacgatagaaataaacgtggtgcatggctgttactattgttgctggcggtgatgctaggattgactgataccagtagtttagagcccttttggcagtgggcgataggtcgttttctcccatcatttattatgatgatcatgttgttagattgtggggtgtttattggcacccaaggagaaaactattttggtgccacgactgaaaaggtcgactactcaagttttcgttaa

SEQ ID NO: 4134 - DNA, 300 bp, Proteus mirabilis
acagttgttgataggctacttacaatcgggagtatcgattatatgggggattacagtatgtcatttgaagtttttgaaaaattagagtcaaaagtacaacaagcactagataccatcacattattacagatggaaattgaagagctaaaagagaaaaatgatgcactgaatcaagaagtgcagggcgcaagagaatcaagagaagctttggttcgtgaaaacgaagagctgaaacaagagcaatcaagctggcaagagcgtttacgtgctctgctaggaaaaatggaagacgtacaataa

SEQ ID NO: 4135 - DNA, 321 bp, Proteus mirabilis
tccatggctgaatggaacggtgaatatatcagcccttacgctgagcatggtaaaaaaagcgaacaagtcaaaaaaattacagtttcaatcccattgaaagtgctaaaaattttgacagatgagcgcactcgtcgtcaggtcaataacctaaaacatgccaccaatagtgaattattgtgtgaagcatttttacacgcatttaccggacagcctctccccaatgatgaagacttacgcaaagagcgtaacgatgaaatccctgaagaggcaaaagaaataatgcgccagcggggtgttgatcccgagacttgggaatattga

SEQ ID NO: 4136 - DNA, 1191 bp, Proteus mirabilis
tactattatgaagaaaggctgtcaacagtgaatattaaattacctacatttattgagctttatcgacaattaattgcaacaccctcaattagtgcaacagatgctaagacagaccaaagtaacgaggcactgattaatctgttggctaattggttggaaacactcggtttttcaattgaaatacaaccagtacctgaaaccagagggaaatttaacctacttgctacccttggcagtggaaccggcgggttattactctgtggacatacggatacggtgccatttgatgaagggcgttggactcaagatccctttaccctaacggaaaaagaaggcaagttatatggtttaggtacggcagatatgaaaggcttttttgcctttattattgatgcattgcgagatatagatacctctcaactcacacatcctctgtatattcttgctacagcagatgaagaaacgtcgatggctggtgcacgttattttgccgctaataccgctattcgtcctgattttgctattattggcgaacccacctcattacaaccaatacgtgctcacaaagggcatttatctaatgctatccgtattactgggcaatccggtcactctagtgatccggaaaaaggtgtcaacgctattgagttaatgcatgaatctatcacccatctcagtacactgcgcgatagattaaaaacccgttataacaatccggcgtttgttattccctatcccaccatgaactttggttatattaacggtggtgatgctgctaatagaatttgtgcttgctgtgaattacatatggatattcgcccattaccgggattaacgctgcaagatcttgatgatctgctgcacgaaacattagccccggtaaaagcgcgctggccgggacgtttaagtgtcgaagcattgcacgagcctattcccggctacgagtgtccgaccgatcataaaatggttgccgtgattgaaaaactactgggtgagaaagcgcaaactgttaattactgtaccgaagcaccttttattcaagcgctatgccctacgctagtgcttggtccgggctccattgaacaagcccaccagcctgatgagtttattgatatggcttttattgagccaactcgtgaattaatggagcaattaattgaaaacttttgtttagcagagaaagcgaaataa

SEQ ID NO: 4137 - DNA, 252 bp, Proteus mirabilis
ttgagtagcctgtataaacactatactagtctatcgtctctgtattacaccgataagttaacactttttatacagatactttacagccttttgctatctatctcaaaaaacagtgtgttagccatatattactatcaagatataaagtgtaatgggcttattgacggtttgcttaacactttgcgcgctgttatcgatacttttttgtcattcggcataaatagaaaaagcgctcaccctacacaattgtga

SEQ ID NO: 4138 - DNA, 483 bp, Proteus mirabilis
  unsure (94),(131),(132),(133),(134),(135),(152),(161),(166),(168),(182),(187),(206),(212),(213),(216),(217),(218),(219),(220),(221),(222),(223),(226),(227),(228),(229),(230),(231),(232),(233),(234),(235),(236),(237),(239),(240),(241),(242),(243),(244),(245),(246),(247),(248),(249),(250),(251),(252),(253),(254),(255),(256),(257),(258),(259),(260),(261),(262),(263),(264),(265),(266),(267),(268),(269),(270),(271),(272),(273),(274),(275),(276),(277),(278),(279),(280),(281),(282),(283),(284),(285),(286),(287),(288),(289),(290),(291),(292),(293),(294),(295),(296),(297),(298),(299),(300),(301),(302),(303),(304),(305),(306),(307),(308),(309),(310),(311),(312),(313),(314),(315),(316),(317),(318),(319),(320),(321),(322),(323),(324),(325),(326),(327),(328),(329),(330),(331),(332),(333),(334),(335),(336),(337),(338),(339),(340),(341),(342),(343),(344),(345),(346),(347),(348),(349),(350),(351),(352),(353),(354),(355),(356),(357),(358),(359),(360): Identity of nucleotide at the above locations are unknown.
gaaatgaaagatagtagatgggatgaaataagtatatataatagaagagtaatggagaaaggaaaggtaggattgggtgagggggggggggggnggagggggggggggggggggggggggggggggggggnnnnnggggggcggggggtggnggggggggnggggngngggggggggggggnggggnggggggggggggggggggngggggnnggnnnnnnnnaannnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgtggtcgacggcccgggctggtcctgccgccagcgttcaatctgagccatgatcaaactcttcaattaaaagtgtttgatgctcaaagaaatcgaaaacttagcttattcattatatga

SEQ ID NO: 4139 - DNA, 1746 bp, Proteus mirabilis
aataaaaaggaaatgcgtcacatgagtaagcaaacagttgcaacctatattgctaaagtgctccataatgcaggtgtgaaacgtatttggggggtgacgggcgattcattgaatggattaagtgatagcttgcgcaaaatgggtaccattgaatggatgggcacacgccatgaagaagtcgcggcttttgccgccggagcagaagcggctatcaatggtgaattagccgtttgtgccggctcctgtggaccaggtaacttacacttaattaatggactttttgattgtcatcgtaatcatgttcccgtgttagcgattgccgctcatattccctctgctgaaattggtagtaattactttcaagaaactcatcctcaagagttatttcgtgaatgtagtcactattgtgaattagtctctaatcccgatcagatcccacaaattctggctatcgctatgcgcaccgctattttgaaaaagggtgttgcggtggtggtattacccggtgatgtagcgttaaaacccgctccagaagatgcccatgaaaattggtatccactacaatcaccactgattatgccgaatcgttttgaaatcgaaaaactgtctgaggcactgaataacgctaaaaatatcaccttaatgtgtggtgccggttgtgctcaagcacatgatgaagtggtgaaactagcacaaaccttaaaagcccctgttgtgcatgcactacgtgggaaagagtatcttgagtggaataatccatgtagcgtgggaatgacgggtcttatcggtttttcatcgggttatcacgcaatggagaatgccgatactttagtgctgttaggtactcaattcccttatcgcgctttctatcctgccaaagctaatattattcaaattgaccttaatccaagtagtattggctcacattgccatgtggatatggcttttgttggagatgtcaaagcaacccttaatgcattacaaccgcgattaaaagagaaaacagataccgcacatcttgatgcctcgttaaaacattatgctaaagcacgcaaagatttagatgcattggctcaacctagtgagcgtgagttgatccaccctcagtatttagcacgtcgattaagtgaattagccaacgatgatgcggtatttacctgtgatgttggcacgccaacagtttgggcagcacgttacgtgaaaatgaatggtaaacgtcgtttaattggttcatttaaccatggctcaatggcgaatgcgatggcgcaagctattggtattcaagcactggacagaaaacgtcaagttgtggcgatgtgcggtgacggtggttttaccatgttaatgggtgatttcatctcattggctcaaatgaacttaccggtgaaagtggtgatttttaataacagcgtattaggttttgtggcgatggaaatgaaagcggggggctatttgactgatggcaccgatttacataatcctgattttgccgctattgccaatgcggcgggaattaaaggtattcgcgttgagaaaggcgaagatcttgatgaagcattaaaaacagcctttgaacatgatggccctgttattgtggatgtggtaaccgcaaaacaagagctttccatgcctccggaaattaaatttgagcaggccaaaggttttagcttgtatatgatgaaagcgattattaatggtcgtggcgatgaaatagtgcaattagcgaaaaccaactggttgcgctaa

SEQ ID NO: 4140 - DNA, 516 bp, Proteus mirabilis
  unsure (70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(163),(164),(165),(166),(167),(168),(169),(170),(171),(172),(173),(174),(175),(176),(177),(178),(179),(180),(181),(182),(183),(184),(185),(186),(187),(188),(189),(190),(191),(193),(194),(195),(196),(197),(198),(199),(200),(201),(202),(203),(204),(207),(208),(209),(210),(211),(212),(213),(214),(217),(218),(224),(243),(248),(262),(264),(269),(278),(295),(296),(297),(298),(299),(336): Identity of nucleotide at the above locations are unknown.
ttgaagagtttgatcatggctcagattgaacgctggcggcaggaccagcccgggccgtcgaccacgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnttnnnnnnnnccnncccccnccccccccccccccccccnccccncccccccccccccncnccccnccccccccnccaccccccgccccccnnnnnccccccccccccccccccccccccccccccccctccnccccccccccccctcacccaatcctacctttcctttctccattactcttctattatatatacttatttcatcccatctactatctttcatttcctatctttccttcatcttacactactctctcttttccttctctctttatcctttctccactctatccttccgcttccctcactttaa

SEQ ID NO: 4141 - DNA, 1194 bp, Proteus mirabilis
ctgaattattgcgtttttttaataaaaaacaggcttagtatcatgaaaatacttcatttaattaatttacaagggtttggtggtgctgaacgtttgtttattgaatatttaaaaaatagctcatttcaaaatgaggttttgtgcaccagtaactctttaaataaaaacctgatccctgagcttaagcatttcgatataaaatacgctaataaaatcgcttctactaaaataaagtaccctgcttttttaagaaaacatgtcttaacaaaaaaaatagaagcaagtaaagccgatgtcactctagtatgggatttcgtccctagattatctagaaaacccaagaatactagcttagtctactatgatcatggctgttcttggcaatatcctatgaataaaaaaacacaaatcttttttgagatgcttgattctgccattgcggtatctaaagcatctaaaagagtaatggaattaagatttaaaccaaaatttgatattaacgttgttatcaatagattacctcatatagagtataaagaatcacgtacttttattaaacaaaatataattacagtaggtgtagcctctcgacttgttgggttaaaaggtatcgggattgcaattattgctttgaaagaactaagaaataaaaatattccagcaaaactcattattgcaggagaaggagaacaacggagtgatttagaaaatctagtatctaaattaaaccttgaagattcaattgagtttataggatatcaatcagatatgtctattttttactcaaaaatagacatttatttaagtacgccaatattagaggcatttggcctatcatgtatagaagccctatcaaacggcattccagttatatttcctaaattaaatggacaacccgaagcaataaaagataagtattgcggtctaggtattgctcccaaattatctattgatgaatatcataaattaacaaatttagatatcaactttccctataaagtttatgatcctatctcagatacattaattttgcccaaattaatatctccccaaaactgtgctacggctataatagaaataatgaataattatactaactttagccaaaatgcgattgaatggtcaaaagaaacgacagattacaatctatttattaaagaatttgaaagtacgataagagatagtcaaatatag

SEQ ID NO: 4142 - DNA, 2679 bp, Proteus mirabilis
aaagtatgttgttaccgacacaaagccaaggtcaggagtcttatgaatcaacaatattctgctatgcgtagtaatgtcagcatgcttggcaaactactcggcgacacgataaaagaggcactcggtgaagaaattttagataaagtggaatctatccgaaagttatctaagtcatcacgagcaggtaatgaagttcagcgacaaaagctactattaaccttacaaaatctctctaatgatgagttattacctgttgctagagcattcaaccaattcttaaacctgactaatgtagcagagcaataccatagcatttctcctcatggcgaggcggcaagtaatcctgtggcattggctaaattaattgaacggctgaaagataaaaattttactaatcagcaactcaaacaagccgttgaacaaatttcgattgaattagtcttaacggctcatccaacggaaattgctcgccgtacgcttattcataagctagtggaagtcaatacttgcttatctcagcttgatcatgatgatcttgccgattatgaacgtaccaatattatgcgccgtttacgccaattggttgcgcaatcgtggcataccgatgagatcagaaaaattcgcccaacccctattgatgaagcgaaatggggctttgcggtggtcgaaaatagcttatgggaaggtgtgcctgctttcttacgtgaatttaatgaacagttagaagagtctattgactacaatttaccggtagaagcttctcctattcgctttacttcatggatggggggagatcgtgatggtaacccaaatgttaccgctgaaattacccgtcatgcattattacttagtcgctggaaagccgccgatctatttttaaatgatattcaggtgctcgtttctgagctgtctatgacagaaagcacaccagaattacgcgaattagcgggcggtgccgatgttgccgagccttatcgtgaaatagccaaacaattgcgcactcgcttacaagtgactcgtgattatttagaacaacgtatcaaaggtcagcaatcattacctcctgaaggcttactgattgataattcagcactttgggaacctttgtatgcttgttaccaatcactgcatcagtgtggtatgcgcattattgccaatggacagttattagatactttgcgccgtatccgttgttttggattacagctggtgcgactcgatattcgccaagaaagcactaatcataccgaagcgctgtctgaattaacgcaatatttagagcttggtgattatgctagttggtctgaagagcaaaaacagacgtttttactgacagaacttaactctaaacgcccattgatccctactcattggcaaccgagtgaagcaactaaagaggtatttgaaacctgtcgggtaattgctgagtcaccaaaagattctattgcttcttatgtgatttccatggcgaaagtcccttcggatgtattagccgttaaactattactaaaagaagcaggggcagatattcgtttaccggtagcaccattatttgaaacgttagaagacttaaataacgcagaaagtgtgatgacccgtctgtttgatattccgtggtatcgcgatttaattgataacaaacagatggtaatgattggctattctgactcagcgaaagatgcgggtgtgatggcggcatcgtgggcgcaatatcgagcacaggatgcattaattaagttatgtgagaaatcaggcgtgacattaacgctatttcatggccgtggaggcactatcggccgtggaggtgcgccggcacatgctgcattattatcacaaccaccgggtagtttaaaaggtgggttgcgggtgacagagcaaggggagatgatccgctttaaatttggcttaccgcaagtgactatcagtagtttggctcactatgctggtgcgattttagaagctaatttattgcctcctccagagccaaaaacagcttggattgaggttatggatgctttatctgatgtatcttgcgagatgtatcgtggctatgtcagaggtgaaaaagattttgtgccttatttccgagcagcgacgccagaaggtgaattaggtaaattaccattaggctctcgacctgctaaacgtcgtccaactggaggcgttgaaacattgcgtgctattccgtggatcttcgcttggactcagaaccgtttaatgttacccgcatggttaggagccggtgctgctttacagcatgagatagataacggaaaacaagccgtattggatgatatgtgtgagaattggcctttctttaatactcgtattgctatgctagagatggtgtatgcaaaagcggatctatggcttgcggagtattacgatcagcgtttagtcgaagaaaatttatggccattaggggcgaaattacgtcaacaactctctgatgatattaagagtgtattagcgatttccaaagatgagcatttaatggcggacttaccgtgggttgctgaatctatcgcattgcgtaatgtttatactgatccacttaacgtcttacaggcagagctattgcaacgctctcgtactcatagcgagtctgatccacgtattgaacaagcgttgatggtgactatcgcaggtattgcagcgggtatgcgtaataccggctag

SEQ ID NO: 4143 - DNA, 1173 bp, Proteus mirabilis
caaggtgtctgtatgacgaagaaaaccgcaaccattgccattcacaatgggcttaatgaagataagcaatatggctgtgttgtaccgccaatctatctttctagcacctataatttcttagcatctaatcaaccttgggaacatgattactctcgtcggggcaatccctcgcgcgatatggtgcaaaatgcattagcagagcttgaaggcggggtgggagcggttgttactagcagtgggatgtcagcaattcatttaatttgtacgacttttttaaaaccgggtgatgtcattgtggcgccccatgattgttatgggggcagttatcgtctgtttaatagtcagcagcaacgtggtgcttatcgtgtggtatttgttgatcaaaacgatgagcaagcgttacaacaggcgttggcattagcaccaaaaatagtatttattgaaacacccagtaatccactattgcgcatcactgatattgagaaaataagccaattagctcaccaagttggggcgttggtggtggcggataacacctttatgagcccggtattgcaaaagccattggctttaggggctgatttagtggtgcattcttgcactaagtatcttaatgggcattctgatcttgtcgcgggtgttgtgattagtcagtgtaggaaacagcttgaggatttaagctggtgggcaaataatattggtgttactgctggggcgtttgatagttatttgttattacgagggatcagaaccttagtaccacgaattcgattacaacaagaaaatactcaagcattggtggattatctacaaacacaacccttagtggataaaatttattacccagcactagaacatcatgtcggtcacgtgatagcgaaaaaacagcaacaaggttttggtgcgatgttaagttttgagttaaaaggggggattgagacaattaaatcctttttatctcatttaacactctttacactggctgagtctttaggtggtgtagaaacattaatttgtcatccggcgaccatgacacacgcaggaatgtctgaagaagcgagaaaaaccgctgggatcagtaacgctttattgcgcatttccgtggggattgaggatagtctggatctcatcaacgatttacaaaatgcgtttaatgcagcaacgaaaaggtaa

SEQ ID NO: 4144 - DNA, 1053 bp, Proteus mirabilis
ttaacggcatgcttgtgccaattaacccaggtactcctcatgaatattaatcaactgaaaagctttgttgaagtagtgcgaaatgactttaacattacgaatgcggcagagaaactctatacctcacaaccaacgattagtaagcaacttaagatattagaagacgaactcagtgtttctttattcgtccgtaaaaataataatttattagcacttagtcctatggggaaagaggtccataaaatagctagcgatattcttgggcaggttgataaaattaaaagtattgtggcagaagaagatcgtaataaaaaagtagatttgcacattgccacaacacatacacaaatacgttactccttacccaacgtcattgatcattttcgccgctattacccgaatatttcactccattttcaccaaggtgctcctgctcagttagcagaaatggtaaaaaatggcgatgtcgattttgcgattgccacagaatcgatgcatttatatgaagatttaattactttgccttgctatcgctggactcgcagtttattagtaccttatgatcaccctcttgcatcattacctgatgatcaacaggttaccattgaacaacttggccaatatccccttattacctatgtgtttggtttcactcgaggctctaaactcgataaagtgttttataaaaaccatcttaaacctcaagtggcattgacggcgacagataccgaaattattaaatattatgtcaagcgccaccttgggattggtgtgattgccacggttgcttatgatgaaatagaagatagccaagcattaaagtgcatcaatatcgatcacttagtacagcccagttatacacatatatgcctaagtaaacatacgcatatgaaagattatatgcatgagtttatttcactctatgctccgcatattgatagaaatattattcagatgccagagcagtgggaaacccagtggcatagcaaagaagtgtatcaggggttacctgatctgatttcggtaaatagcaaagagaaaataatagaataa

SEQ ID NO: 4145 - DNA, 519 bp, Proteus mirabilis
  unsure (57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143),(144),(145),(146),(147),(148),(149),(150),(151),(152),(153),(154),(155),(156),(157),(158),(159),(160),(161),(162),(163),(164),(165),(166),(167),(168),(169),(170),(171),(172),(173),(174),(175),(176),(177),(178),(180),(181),(182),(183),(184),(185),(186),(187),(188),(189),(190),(191),(194),(195),(196),(197),(198),(199),(200),(201),(204),(205),(211),(230),(235),(249),(251),(256),(265),(282),(283),(284),(285),(286),(323): Identity of nucleotide at the above locations are unknown.
tcatggctcagattgaacgctggcggcaggaccagcccgggccgtcgaccacgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnttnnnnnnnnccnncccccnccccccccccccccccccnccccncccccccccccccncnccccnccccccccnccaccccccgccccccnnnnnccccccccccccccccccccccccccccccccctccnccccccccccccctcacccaatcctacctttcctttctccattactcttctattatatatacttatttcatcccatctactatctttcatttcctatctttccttcatcttacactactctctcttttccttctctctttatcctttctccactctatccttccgcttccctcactttaatttgtcacttctttaa

SEQ ID NO: 4146 - DNA, 1239 bp, Proteus mirabilis
acacaattgagaataaaggttatcactatgacaaaaggtattaaaaaaattgtactggcatattcaggtggtctagacacatcggctatcatcccttggttaaaagagcattatgacaattgcgaggtggttgcgtttgttgctgatgtgggacaaagccgtgaagatctggaaggtgtagagcaaaaagcattggcgtcaggggccagtgaatgctatgtggttgatttacgagaagagtttattaaagactatgtgtatccagtattaaaaacaggagcattatatgaagggagctatttgttaggcacttcaatggcacgtcctgtgattgctaaagcacaagttgaattggcattaaaactcggggctgatgccttggcgcatggcgcaacaggtaaaggtaatgaccaagttcgttttgaaagtacttataccgcactggcaccgcaacttaaagtggttgcgccttggagagagtgggacttgcgctcccgtgaagctctactggattatctaaaagttcgtcatattccaaccacggcgacacttgagaaaatttatagtcgtgatgaaaacgcatggcatatctcaacagaaggtggagtgttagaaagtccatggaatgcttctaatgaagattgctgggcatggacggtagatccgaaaaaagcccctgatacacctgaacaggtttctgtaacggtaaaagcaggtgaagtggttgctatcaatggcaaagctcaatccccttatgagtgtttagctacattaaatacgctaggcgtaaaacacggtattggtcgtattgatattgtggaaaatcgtctggtcggtatgaaatctcgcggttgctatgaaaccccgggaggcaccattatgatggcggcactgcgtggtgttgagcaactggttttggatagagatgcttttaaatggcgtcaacagttgggtttagagatgtcttatgttgtttatgacggtcgttggtttacgccaattcgggcttcattacaagctgctgctgactcgctggcaacagaggtaaatggcgaagtggtgttagagctttataaaggccatgtgaatgctattcagaaaaaatctgacaacagcctctactcggaagagttcgccacctttggtgaagatgaagtctatgatcacagccatgcagaagggtttatccgcctatactctttgccatcacgtattcgggcattaagtaaaaagaaataa

SEQ ID NO: 4147 - DNA, 339 bp, Proteus mirabilis
  unsure (24),(61),(62),(63),(64),(65),(82),(91),(96),(98),(112),(117),(136),(142),(143),(146),(147),(148),(149),(150),(151),(152),(153),(156),(157),(158),(159),(160),(161),(162),(163),(164),(165),(166),(167),(169),(170),(171),(172),(173),(174),(175),(176),(177),(178),(179),(180),(181),(182),(183),(184),(185),(186),(187),(188),(189),(190),(191),(192),(193),(194),(195),(196),(197),(198),(199),(200),(201),(202),(203),(204),(205),(206),(207),(208),(209),(210),(211),(212),(213),(214),(215),(216),(217),(218),(219),(220),(221),(222),(223),(224),(225),(226),(227),(228),(229),(230),(231),(232),(233),(234),(235),(236),(237),(238),(239),(240),(241),(242),(243),(244),(245),(246),(247),(248),(249),(250),(251),(252),(253),(254),(255),(256),(257),(258),(259),(260),(261),(262),(263),(264),(265),(266),(267),(268),(269),(270),(271),(272),(273),(274),(275),(276),(277),(278),(279),(280),(281),(282),(283),(284),(285),(286),(287),(288),(289),(290): Identity of nucleotide at the above locations are unknown.
gattgggtgagggggggggggggnggagggggggggggggggggggggggggggggggggnnnnnggggggcggggggtggnggggggggnggggngngggggggggggggnggggnggggggggggggggggggngggggnnggnnnnnnnnaannnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgtggtcgacggcccgggctggtcctgccgccagcgttcaatctga

SEQ ID NO: 4148 - DNA, 963 bp, Proteus mirabilis
ggatttgagagcatgtccgaaatgactcctcgcgaaattgccagcgaactcgacagatttattattggtcaagataaggccaaacgtgcggttgctattgcactgcgtaaccgctggcgtcgcatgcagcttgatgaagcgctgcgtcatgaagtaaccccaaaaaatattttgatgattggacctacaggggtaggtaaaactgaaattgcacgtcgcttagcaaaattagccaatgcaccttttatcaaagtcgaagccacaaaattcactgaagtgggttatgtaggtaaagaagtcgattctattatccgcgatttaactgattctgctgttaaaatggtacgtagccaagcgattgaaaaaaatcgttaccgtgctgaagaaatggcagaagagcgtattcttgatgtactgatcccaccagcaaaaaataactggggagtcacagaatcggcatcatcctcagagccttcagcagcgcgccaagcgttccgtaagaaactccgtgaaggccaattagacgacaaagagattgaaattgaattagccgccaccccaatgggtgttgaaattatggcacctccaggcatggaagagatgactaatcaattacaatccatgttccaaaatttagcgggacaaaagcaaaaagcgcgtaagatgaaaatcaaagaagcgtttaaactgattgtcgaagaagaagccgctaaactggttaatcctgaagagttaaaacaacaagccatcgatgcagttgagcaacatggtatcgtgtttattgatgaagtagataaaatctgtaaacgtggtggtcaaagctctggccctgatgtttctcgtgaaggtgtacaacgtgacctattaccactggtggaaggttgcaccgtatccactaagcacggtatggtgaaaacagatcatattctgtttattgccttaggtgcatttccaggtctctag

SEQ ID NO: 4149 - DNA, 1446 bp, Proteus mirabilis
attaagagaggttacatgcactcagcgcctgttcatttagtttggttccgtcatgatctaagagtgaccgataataaagcgctcttttatgcttgccaaaatacacaggcgcaggtgcatgccatttttaccgtcacgcctgcacagtggaaagcccatcatatggctttatcacagcaggcgtttattcatgatgcattgcttaatctttcccattcgctagctaaattaaatattccactgacacttatcatcagtgatacatatgctgatgcggcacaaagtattgtggattattgtcagcaacatcaggtcactgcgctattttttaatcatcaatatgcgcttaatgagcaaaaccgtgataaaaaagtaatggaattactcgcccataacaccacggtttattgttaccacgataacatttttgtgccaccggggaatgtcgtgacccaacaaggagagatgtacaaagtctttactccttttagaaccgcatttttacggctatttctgtcgcaagataatgcttcattaccagcccccgaaataagagcacaccaaaaagccgtttcaccgttaagtgcaccactttttgcactaccaatatcatcaaccaagatgttcccagcaagcgaacaagcagcgttacagcgtttaaaacagttttgctatgaaagggtgatacattatgcaaaatggcgagatattcctgctattgatggaaccagtcaattatccccttatcttgccataggcctagtgtctgtgcgccaatgttttaatcgcctttaccaaacagagcctgatttcttagaaaataaccattccagtgcatttgtttggtttaatgagttagtttggcgcgagttttatcaacatctaatagttgctaacccgagtttatccaaacagatagcttttcaaccatggacagaaaatattcgctggcgtaatgaccaaactgaatttaccgcttggacacagggcttaacaggctttcctattattgatgccgcgatgcgacaactgaatcaaaccggctggatgcacaatcgcttacgtatgctgacggcaagttttttagtcaaagatctattaattgattggcgctggggggaaaattattttatgtcacaattaattgatggtgatttcgcgtcaaataatggtggctggcaatgggctgcatcaacaggcactgatgctgtgccttattttcgtatttttaatccgacaacccaaggacgtaagtttgatcctgatggtgagtttatccgccactggctaccagagcttgctgatgtcccagatcgctatatccatactccttctgaatgggcaatcaaaacaggtcactacctcgattatccacagccaattgttgatcacgccaaagcacgagtaactgcaattgcgtcttatgaagaggccaaaaaaaggtaa

SEQ ID NO: 4150 - DNA, 336 bp, Proteus mirabilis
  unsure (14),(51),(52),(53),(54),(55),(72),(81),(86),(88),(102),(107),(126),(132),(133),(136),(137),(138),(139),(140),(141),(142),(143),(146),(147),(148),(149),(150),(151),(152),(153),(154),(155),(156),(157),(159),(160),(161),(162),(163),(164),(165),(166),(167),(168),(169),(170),(171),(172),(173),(174),(175),(176),(177),(178),(179),(180),(181),(182),(183),(184),(185),(186),(187),(188),(189),(190),(191),(192),(193),(194),(195),(196),(197),(198),(199),(200),(201),(202),(203),(204),(205),(206),(207),(208),(209),(210),(211),(212),(213),(214),(215),(216),(217),(218),(219),(220),(221),(222),(223),(224),(225),(226),(227),(228),(229),(230),(231),(232),(233),(234),(235),(236),(237),(238),(239),(240),(241),(242),(243),(244),(245),(246),(247),(248),(249),(250),(251),(252),(253),(254),(255),(256),(257),(258),(259),(260),(261),(262),(263),(264),(265),(266),(267),(268),(269),(270),(271),(272),(273),(274),(275),(276),(277),(278),(279),(280): Identity of nucleotide at the above locations are unknown.
gggggggggggggnggagggggggggggggggggggggggggggggggggnnnnnggggggcggggggtggnggggggggnggggngngggggggggggggnggggnggggggggggggggggggngggggnnggnnnnnnnnaannnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgtggtcgacggcccgggctggtcctgccgccagcgttcaatctgagccatga

SEQ ID NO: 4151 - DNA, 783 bp, Proteus mirabilis
ggacgttttatggaaccattaattatcaaactaggcggtgtactgctagataacgaaaaagcgttaacacgtttttttacagcactacaagaatatcgcactagtcatagccgtccattagtgattgttcatggtggtggctgtttggttgattctctgatgaaaaagctgcaattgcccgttgttaaaaaacaaggcctacgagttacccccgccgatcaaattgacattattactggcgcgttggcaggaagtgccaataaaacattgctgtcatgggccacacgctttggtttaaatggtgtcggactttgtttgggcgatggccaattagccaaagtaacaaaaattagtgatgagctaggtcatgtgggaaatgctgaacctggctctcctgagttattaaatctattactgaatgcagggtatctcccgattattagttctataggtgtgagtatccaaggtgaactgatgaatgttaatgctgaccaagcggcaacagcgattgctgaaaccttaggagcagatttggtgttgctctcagatgtaagtggcattttggatggcaaaggacaaaaactcacagaaatatctgccacaaaagcgcaagcattaatcgaccaaggcattatcaccgacggcatgattgttaaagttaatgctgcgttagaagcggcaaaaacgcttagacgtcctgttgaaatagccagttggcgtcacgcggaaaaactgactgatttatttaatggtatggcgatcgggacacgtattttagcttaa

SEQ ID NO: 4152 - DNA, 1401 bp, Proteus mirabilis
aaaatctttatgataaacagtttgtcagcgcgtatattcgccatattctggctgacactagcattagttctggtgctagttatgatggtacccaagctggactcgcgccagcttaccactttacttgaaagtgaataccgtcaaggtgttatgctagagcaacatatagaagccgaactagcgcaagatccggctaacgatctgctatggtggcggcgattaatccgcgccattgataaatgggcgccacctggtcaacgtcttattattgtcaccagtgaaggtcgtattatcggtgctcaacgtaatgagatacaagttgtcagaaactttatgggacagtctgataacgcagaccatccaaaaaagaaaaaatacggtcgctctgagatgttaggccccttttccattcgagatggtgaagatcactatcaactttacttagtgcgcccatcaagtagcccgcaatctgactttatcaatttattatttgataaaccgcttttattactgatattcaccatgcttatcagtacaccgctactggtttggctctcttggagcttggcaaaaccggcacgaaaactcaaaaatgcggcggatgatgtagcaaaaggtaatctgcgccctcaccctgaactggaaaccggcccacaagaatttttagcggcaggaaccagttttaatcagatgatcagcgccttagaacgcatggttgaagcgcaacagcgattgatttctgatatctcccatgaactacgcacaccgttaactcgtttgcagctcgccagtgcattactacgtcgtcgtagcggtgaaagtaaagagcttgagcgtattgaaacagaaacacagcggctagatagcatgatcaatgacttattagtgctttcccgcaaccagtataaaaatgagttattacgtgaaaccgtaaaagcgaatgagctttggaatgatattttagataatgcaaaatttgaggctgaacagagcaataaaactctaacagtaaccgccccgccaggcccatggacgatttattgtaatccttattcattagcgagtgcctttgaaaatatcgttcgcaatgccttgcgttattcacattctcgtattgaagtggcctttaccgaacaaaatcagggtatcactattattgttgatgatgatggcccaggggttagcccagaagatcgcgagcatattttccgacctttttatcgtacggacgaagcacgtgatagagaatccggcggtacagggctgggactggcaatagttgaaaccgcaattagtcaacatcgaggccatgttaaagctgacgatagcccattagggggattaagagtggagatttggttgccgagagggagtgtggtaaataagctaaacaataattaa

SEQ ID NO: 4153 - DNA, 534 bp, Proteus mirabilis
gtatggtttatttttataatgaaaaaagtattaattattggttataacttaggtggatttggcggcatggaaaccgtttttaaaaaatctataaatatattggcattgcatactatccactcggagtttatcttttttaatgaaggagataataaagttaatgatgattggttagttgattgtaaatatagaaggctatcttctaagataaaaaatactaagttaagaaggataagctatgcagttcagttagcaagaattcttaaacaagaaaagccagatattattatttcttatgatacggtgtgttgctatattgctaatttagcaagaaaaattgttagaagtaatgtttatatttactcatggatacatttttcattgcataatttatataagtctctttatttacataaagctgattatcatttatcgattagctcagggattacacaacagatgtatgggttgggaatagatagagaaaagtatttactatttataatccagtacgagaaagtgacattactatag

SEQ ID NO: 4154 - DNA, 1392 bp, Proteus mirabilis
gatgtgattatggcactttggggtggacgttttagtcagcaagctgatcaacggtttaaacaattcaatgattcactgcggtttgactatcgactcgcacaacaagatatctttggttcagtagcttggtctaaagcgttagtcacagtaggtgtcttatcgcaggatgaacaagctcaacttgaacaggcactttatgagctgtctgaggaagtaacagctaatccccattctattttacaaagtgatgcggaagatattcatagttgggtagagagcaaactgattgccaaagtgggtgatttaggtaagaagttgcacactggacgtagccgtaatgatcaggtcgcgacagatttaaaattgtggtgtaaagaagaagtcgcccacttacgtcaggctattattgaattacaaaaggcgttagtggtaaccgctgagcaaaatcaacatgctgtgatgcccggttatactcatttacaacgtgctcaacccgtcacttttgcgcattggtgtttagcttataaagagatgttagcaagagatgagagccgtttagcggatgcattaacgcgtttagatgtaagtccactgggtagtggcgctttggcgggtaccgcttatgatattgatcgtgaacaattagctcaatggttgggttttgccagtgcaacaaacaatagtttagatagcgtatcagatagagatcatgtgttagagctattatctgcggccgctattggtatggtgcatctttctcgttttgctgaagatttgattttctttaatagtggggaagcaggttttattgagctttcagataaagtcacttctggctcttcattaatgccacagaagaaaaatcctgatgcattagaacttattcgtggtaagtgcgggcgtgtgcaaggggcattaaccgcaatgatgatgaccctaaaagggttgcctcttgcttataataaagatatgcaagaagacaaagaagggctgtttgatgccgttgatacttggtctgattgtttgcatatggcaacattagtgcttgatgggttgcaggttcgccgtcctcgttgtgaagaggccgcaaaacaaggttatgccaatgcgacagagcttgctgattatttagtcgcaaaaggggtgccatttcgccaagctcaccatattgtcggtgaagttgttgttagtgcaattgagcaaggtaaagcgcttgaagagttggcgctatctgaattacagaagtttagtagcaaaattaccgttgaagtttacgagatcctttcattgcaatcttgtttagataaacgattagcaaaaggtggggtatctcaacagcaggtttcttatgccattactgaggccaaaaaacagcttaatatggatgagtag

SEQ ID NO: 4155 - DNA, 1317 bp, Proteus mirabilis
gtagctaatatcatgacacaacgagcagaagtcatacgaaaaatactacgtaatggacctgagccagcaaggcaactagctaatattatgaatattagtcagccaaccctgtcgagggcattaaaaatgttgtctaatgatattgttcaaattggctcgggtcgttctattcaatatgctttacgtgatggttcgcgtggcttcaactctgtacccatttatcgcataaatgaagaaggtaaaattaaattgttgggtaaattgacaccagtttatccagccggttttgttatggagcaggttgataatgtcaatcggtatagcgaaggattgccgtggtggttatttgatatgcgtccacaagggtatcttggacgtgcttatgctgcgacttattccgctgagttgggtttaccacataatccagacagttggtctgacatagatattatcagagctttaattgctcacggtcatgatgcagtgggaaatttgttaataggggaacaggcaaaaaaacattttttggcgatgccgataccagctgcggttgctcgttcaacaacttacccaacattagctcgagcggttagttcaggggaagatcctggctcatccgcaggtggcgaacaacccaagttttgtacctataccgatagaggccatgtcatcgttaaatttacggcttctgacaataatgctatcagcgagcgttggcgtgatctcctgcaagctgagcatcttgccttaaaggtgctaggcgttgaaacagaaatttttgattttgaagggcaacgttttcttgaaataccgcgttttgaccgtgtaggtgctctaggtcgtgtcggacttttttctttacaagcattagatgcacagtttgtcgggcgagcaagagagccatggcctgtgttagttgatgcgttaattgagcaaaaacaggttcagcctgatgcctcggtaagtacaatgcgacgttgggcatttggtatgttgattggaaatactgatatgcaccatggcaatttatcgtttattagtcgccatggccgaccatatgcgcttgcgcctgcttacgatattctaccaatgggatttgcgcctaaagtaggaggagaaatagtcaacacactgcgaccagcgacattacttgatgggatcagccgtgaaatttggcgggagagtttagcactcgcagagcagttttatactttgcttactcattgtcatgctctttctgacaatttttctccctgccttaacgcgttacgcaatcatctggatgaagcgagttcgcgtatctctcgtctagagtaa

SEQ ID NO: 4156 - DNA, 528 bp, Proteus mirabilis
agaggaaatatgaatagaattgttgaaaaatggatgtatcgctctcgttggttatttgcacctgtctatattggcttatctcttggattgttggcattaacgattaagttttttcagtcaatgtacgagatcttacccaatatatttgccttatctgaagctgatttagttttacgtttattatcgctaattgatttggcattagtgggggggttattgataatggttattttctcaggttatgagaattttattaccaatatggaaatcgaaggcgcgaaggataaactctcttggttaggtaacatggatgcagaatcgctgaaaaataaagttgctgcttctattgttgctatctcttctattcatttgttaggggtgtttatggacttaaaaaatatccctgataacaagttattatggtatgtggtgctacatctgacttttgttttttctgcttttgtgatgggctatttagagaagatctctaaacgaagtaagcgagcaaataaagccaatcaagggtga

SEQ ID NO: 4157 - DNA, 729 bp, Proteus mirabilis
aaatttgatatattggttataaaccacatttggattatcaggattgctgtgagtaataatattggcgtcagagcgaaacaaaaagaaaaaacccgccgttctttgattgaagcagcttttagccaactcagtgcagaacgtagttttactagcctaagcttacgagaagtggcgcgagaagcgggtattgcacctacctcattttatcgtcattttaaagatgttgatgagttggggttaactatggtcgatgaaagtggactgatgctacgtcaattgatgcgacaagcacgacagcgtatcgctaaaggtggaagtgtgatccgtacatcggtttctacctttatggaatttattggtaataatccgaatgcttttcgattattgttacgtgaacgctctggcacatctgctgaatttcgtgccgctgtcgcacgagagatccaacattttattgcagaactggcagactatcttgagcaagaaagtaatatgccacgttattttactgaaatgcaggctgaagcgatggtgactatcgtatttagtgcaggggcagaagcattagatattgatattgaaaaacgccaacaattagaagaaagattagtaatacaactacggatgattgccaaaggcgcttactattggtatcgacgtgatttagaaacacctctacaaaataaccccgaaataaagaaaaaaatgcatcagaaaggagataaatga

SEQ ID NO: 4158 - DNA, 2448 bp, Proteus mirabilis
ccatggatcatgagcgtagtggcgattaaacaacaggcgcaaccaacttgccgtcagttacataaattcggtggtagcagtcttgcagacataaaatgttatcagcgagtcgtgaatatcatgacaaattatagccaacctaatgatttaatggtggtttctgcagcaggctcgacaacaaatcagctgattaactggttaaaactgagtcaaagtgatcgtatttctgcccatcaagctcagcaagaattacgtcgttatcagctatccttaattgaaggactattatcaaaagagcatgcacaagctctttcacaggcctttattgctgatttagaaagactaagttacttacttgataagccgataacggatgcaacttatgctgaagtcgttggtcatggtgaaatttggtcagcgagattaatggcaagcttattaacggagcagggtttacctagtgtgtggttagatgcgcgagaatttttatgtgcagagcgcgccgcacagccccaagttaatgaagccttatcgcgtcctttgttacaatcactgctggctaaatatcctcaatgtcgctttgtggtaacgggttttattagtcgtaatcaacagggtgagacggtgctattaggccgtaatggtagtgactactcagcgacccaagtaggtgctttagcggatgtgggtaaagtgaccatttggagcgatgttgcaggggtttatagtgccgatccccgaaaagtgaaagatgcctgtttgctgccgttattgcgtttagatgaggcgagcgagctggcaagattagcggcacctgttttgcatacacgcacactacaacccgtctcagggagcaatatcgatttacaattacgttgcagttaccaaccagagcagggttcaactcgaattgaacgggtattagcatctggcacaggggcaaaaattgtcactagccatgatgatgtttgtttaattgagcttcaattagccgcacatcaaaattttgaacaaatcgctaaagaagtggatgcattacttcagcgggtacaaattcgtccactggcaacaggtattgatagagatagtcagttgctacagttgtgttataccagtgaagtcgctaatagtgcgttagatgttctgcaagatgcggccttaccgggtaaattacatctgcgagaaggcttttctcttgttgctttagttggcgccggggtatgtaaaaatccactccattgccaccgtttctaccaacaacttaaagatcaaccggtagagtttatttggcacgcggaagataacatcagtttagttgcggtattacgtaactatacggcttcattattgcaaggtttacatcaaacattattcagagcagaaaaacagattggtttagtgctgtttggtaaagggaatattggctcacgttggttagagctgtttgctcgtgaacaagagccattatctgcgcgtagtgattttgaatttattctggcgggggtggtagatagccgtcgcagcctactagatcaccaaggtattgatcctagtcgcgcactggccttttttgatgatgaagcaacagtgcatagtgaagagtcgcttcatttatggatgagatcgcatccttttgatgatttagtggtggtcgatattaccgctaatgaagagcttgccgcctgttatgaagattttgccagctatggttttcatgtgattagtgcaaataaaatcgctggctcggcatcaagtttacgctatcgcgcaactcgtgatgccttctctaaaacaggacgccactggttatataatgcgacagttggtgcgggattacctattaatcatacggtacgtgatctacgtgaaagcggtgatacgattttatctatcagtggtattttctccggcacattgtcatggctatttttacaatttgatggcagcgtaccttttagtgatttggtagaacaagcatggcaacaagggctaaccgagcctgatccgcgtatcgacttatcaggacaagatgtgatgcgcaaattgattattttagcccgtgaagctggctatgatattgaacctgagcaagtccgtgttgaatcgctggttcctgctcaagcgcaaagtggatcattagaagccttctttgaaaatagcagtgtgattaatgaacaaatggcacaacgtttagcggctgccaatgagatggatatggtactgcgttatattgcgcggtttgatgctaacggcaaagcgaaggttggggttgaagcggtgagaaaagatcatcctctggcatcactattaccgggggataacctatttgctattgaaagccgttggtatcgtgacaacccattagtcattagaggtcctggtgctggacgtgatgtgactgcgggggctattcagtctgatctcaatcgcctttctcaactattgtaa

SEQ ID NO: 4159 - DNA, 984 bp, Proteus mirabilis
aaatattacattatgaaaaaagaaataggtggttattttgaattagaatctttgattaataatccttggtatcaaaccgatataaaactaaatagtggaagagctgctttattacttttaataaaagaaaaaaatataaaaaaaatacacctcccatatttcttatgtgatagtgtaaaaaactatcttaataaagaagaaaagaatattcaaattagttattatcatatagatgataattttttacctaaaattaaaagtgaaaatctagataaatcatatttatatatcgtaaattattatggtttaattccgaataaaataatattacagtataaaaaaaagtataataatataattattgataatacccaagctttttttcaacctcctttaattaaggtaccaacaatatattcttgcagaaaatattttggggtcccagatggagcttatttatttcatgaaaagataaacatagatcatcttcaaagaataaaaataacaaactctttagctcctttaactgccagaactgaagaatgtgctagtaagtattatcaagaacatgttaataatgaaaataaatttgaaaacatcccaatacaatatatgtcattattttcagaaaacattcttggagcaattaattacaattatgttatagaaaaaagaaattctaacttttcttatttaaataagagactatctcaatttaataaattgaaagtattagaaaaaataatacctaacgctccctttgcttatcctttattagttgaaaatgcagtaagccttaaacaaattttaattaaaaataaaatatatataccaactttatggcaaaatgtaatagatgaatgtgctaaaagtagcattgaatataactatgctaaaaatatacttccgctcccctgcgaccaacgatatgatataaatgatatgaaactcatagtagatattatcatcaaaaataaggtttaa

SEQ ID NO: 4160 - DNA, 696 bp, Proteus mirabilis
catcaaataatacagagtgattttataatattctatcgcacaacagaccaaggaggacagatgataaaaaaaagcacgcttactcagttagcgcttatcataataagcatcgctttatctttgccaacccttgctatggcagcgtcgccctctattgctcatcaacccccaactaaagatgatattctttaccttaaacaggatgcccctgtttttgaaaccaccattccggagataagagctaaattcaatcaaaataatgcgtcgttatttctcaatgaatataaaattatcaccaacaacgatattactattccgttagtcagggccgcgacacgaataaccccttatttatactcatcagccgtattagagcgtggcagtgaaaaaattaagagtctacagctcaccctgatccattcacttgatacgccacaaatcgaaaaagagcatcaagatactgcaatgcgctatatcactgcattagtgacacagtttgatccctccattaatgcagcgcaaattcaagaggtgctcaatttatttgctgttaaacaagatgtgcctgcttatattagccataatgtcggtgctattcgctatattattgcccacgaggacaatcaactaacgacctttgccattgaaccgattaagctttcacttaatagcaatatcgattcagctattccgtga

SEQ ID NO: 4161 - DNA, 945 bp, Proteus mirabilis
ctatcagtaataagtatgggatctgcaatgaatatccgtgatttggaatatctggtggctctagctgagcataaacattttcgccgtgcggcagattcttgccatgtgagccagccaacattaagtggccaaattcgtaaacttgaggacgaattaggcgttatgttacttgaaagaaccagtcgcaaagtactgtttacccagcagggattattgctagtagagcaagcgaaaacggtattacgtgaagtgaaagtgctacaagaaatggcatcactacaaggtgagagtatggcagggccgttacatattgggcttattcctactgttggaccttatttattaccgcatattattcccgaattacatagaaactaccctaagttagagatgtatcttcacgaagcacaaaccaatagcttattagctcagttagatagcggtaaactcgactgtgctattttagccatggtaaaagagagtgccccttttatagaagtgcctttgtttgaagagccgatgaaattagctatttatgatgagcatccatggcatgatcgcaaatcagtgccgatgggggacttagcaggccaacgtttattaatgttagaagatgggcattgcttacgtgatcaagctttaggtttttgtttccaagcaggggctaaagaagatacccattttagagcaactagtttagaaacattgcgtaatatggtcgctgcaggaagtggtattacacttttacctgatttagcggtacctcaagcacaaaaacgcgatggcgtttgctatttagattgtacttcacctaatccatcacgttctattattttggcttatcgccccggatcgcctttgcgtaatcgttatgaacaattagcagagacaatccgtgatcatatgaccgcattttatgaggctaagaaagcagcatcaaaataa

SEQ ID NO: 4162 - DNA, 1023 bp, Proteus mirabilis
aatagcgcgatattatctctcaatccttggcgggctattgtgaaaacaccgattatttctgttatcgttcctatgtttaatgaggcatctcgcattacgcgattattagagagcctactttgccaaacctttcacgactttgaagtgatcattataaatgatggctcaacggataatagtgttgacatcgctatgctctattgccaacaagataatcgttttcacctttatcaccaaactaaccaagggttatctagcgcgagaaatgctggcttaaaatatgctcaaggtgattggatagtcttttttgatagcgatgattttattaaacctcaattactcgcacattggcatcaattagccagcgaacaacatatcgatgtattaattggcaatggtgaacgctatgatgtacataatccacaaaagcatcaaactaccatccatcaacgtcaaccttatcaacaagtgatcagcggtcaagagtgggtgatccatgccgttacgcaacatcaatggccacattttgtttggttacaatttattcgccacgaaataatcaaaaaacatcacctacgctttattgatggcctttatcatgaagatattttgtggacgacacaacttgcactggtcactcaacgtatcggctttgatgatcaacctctttattactattgcgctaatcctaactctattacgcgtaaacctaatccacaaaaagaagccaagcgcgcacaaagttatttgcaaattgttatacaactcttgcagcttgcagataaacaacatcaaccactattagccaacgcgttgcgccaacaagcactacgtgaacttggcagtttctttattctttttcgtaaacgctgtgatacaaaaaaccaagccatcattgcacagcaatttagtacttatcacctttttccagcccttaataaaggcgcccaaaattggcgtcaacgttggtttatttgccgtgtttattgcgttctttattggcatcgttggaaaaaaagataa

SEQ ID NO: 4163 - DNA, 315 bp, Proteus mirabilis
cggcttagcgtattggcttgctctttattaaatgggccagataaaacgcggatccagccgtcatttcctttggtcacacggctttcgataccggaaaatgctaaggttgcgcgtacagattcggcttgttcattggttttaaatgaaccgcattggactaaaaagcgcgcttcagtcgtcgctggttttggtgttgttatcgcaggtgcaggctcctgttttaccggtgctgaaggttgcgaaggttgtaccgaaggtgcggtggttgtcggtggggtaatgacaacctgtgaacgtggtacttcaccgttataa

SEQ ID NO: 4164 - DNA, 330 bp, Proteus mirabilis
aatacattagtgttgatatttacaagctcggccgatttcgaaaaattacctacggataatattcatacagttatgcttttagccgcaaaaattccatcttatatggatgaatataatcctcaagaatatttgaatgtaaatatttttggagcttttaatgtattagagtattgtaaaaaagtaaaagcagataggataatttatacacaaacagtttttgatatttcactgcattccagtgcaaacatcactttattacctgacttggaaaaaagtttgattataaaggcgatcatgctgtttatgttatttcaaaaaatacagctctag

SEQ ID NO: 4165 - DNA, 993 bp, Proteus mirabilis
gaatcagaggtaatcatggttaatgggatcaaaagaattggggttttaacaagtggtggtgatgcaccgggtatgaatgccgcgatccgtggtgttgtccgtgcagcactcagcgaaggtttagaagtgtacggtatttttgatggctatatgggcttatatgaaaaccgtatgaaaaaactcgatcgctttagtgtgtcagacatgatcaaccgtggtggtacctttttaggctcagcgcgtttcccagaattccgcgaagataatgtgcgtgccgttgctattgaaaatatgaagcaaaatgagctagatgcactggtggttatcgggggagatggttcttatctgggggcgaaaaaattaactgaagcgggtttcccatgtattggtttaccgggcaccattgataatgacgttgcgggtactgattacactattggttatttcacggcgttagaaacggcggtagaagcgattgaccgcttacgtgatacctctacatcccataaacgtatctctatcgttgaagtgatgggacgttattgtggtgatttaaccttatccgctgctattgcggggggttgtgagttcgtggtgttgcctgaatccgaattaccttttgatcgtgatgaattattagcagaaattaaagcgggtattgagcgtggtaaacgtcatgctatcgtggcaattaccgaacatgtgtgtgatgtacatgagctagcacgttttattgaagcagaaaccaaacatgaaacacgtgccactgtattaggccatattcaacgtggtggctctccggttgcttacgatcgtattttagcctctcgtatgggtgcttactcggtacaactgctactagaaggttatggtggtcgttgtgtagggatccaaaatgaaaaactggttcaccatgatattattgatgcggttatgaatatgaaacgtgtctttaaagccgattggtatgaaactgcgaaaaaactgtattaa

SEQ ID NO: 4166 - DNA, 1056 bp, Proteus mirabilis
ttaatattattaaatatgactataaataaactaattaatcccttatcagaagaagaaataataaaaaaatggaattctgaagaagtttttgtaagtgtgatatgttgtacatatacccaagaaaaatatatagaagatccaatccttggggtactctgccaagatacgccttatagatatgaatttattatacatgatgattgttctactgattctacatcagaaataataagaaaatatgcagataattatccgaaaataataaaacatattatccctgctaagaatatttattcacaaggattaaaaccatcaattaatgctttttctttttctattggtaactatattgctctatgcgaaggtgatgatttttgggttgatgataaaaaaattaaaaagcaagtggatatattagaagaaagaaaagatattgatatttgtttcagtgccgcatatacgttagagcctgatggcaaagaaaatataatagctcgttacaataaaaatattttcgttgcctccttatctgaagttatcaggcaaggaggagcgtatatgccaacagcatctcttttatttagaagaaatgttgcagtagaatttaagaaatattttgaaaaagcacctgttggagattattactatcaaatattaggtagtataagtaatggtgctgtatacttacctgatatcacatgcgtatatcgtatcaatgcattaggatcttggtcatcctcgagactaatcattgatgaaaataaattaataaaagaacttacttcacatgaagagcatcttttgaaattaataaaattaggtgcaaacaaagatgacataaattttgttatttctgacttatatagaataagatctaacgaatgttttttattaaaaaaatggcatatagcaaaaaaactcatagaaaaatcttggttattacataaaaaaattaatcgaaatcagcaaaaactgcatcaatatagaaaatttttatatattcttcactatagagaaaaaataaaaaaaatgataaagaaaataaaattaaggtga

SEQ ID NO: 4167 - DNA, 702 bp, Proteus mirabilis
attatgatattagctgttatgcaaccttacttatttccatatataggatattatcaattagcttatcatagcgatatatttatattttatgatgatgtaaattatattaaaggtggatatattaatagaaatcgaattcaaactagaaatggtccacaattatttactattccaatagtaaaatcatctagttttaagaaaatcaacgagctctattttcaagaagatatcagaaaaattttattatccatatctcaatcatattctaaagcaccttacttctcttctgtatatcctgtaattgaaaagatattaacagataagaatagaaatgtttctaacattgcatcaaaatcaataattgaagtatttaggtatttagatattgattttaaatataattactcatcaaaaatacattacaatcgtaataatgataaaaatgctaaagataaattaatagaattatgcaaaatatataaatgcgactactatataaatagtattggagggaaaaaactttataaaaaagaagagtttttatctaatagaatattccttaattttattaaaccaaaagaagtagtttatcaacaatttaataataaaaattatgagcctaatttatcaatgatagatattctaatgaacaattctaaaaacgaagttaagaaattattaaatgaatatatattggattaa

SEQ ID NO: 4168 - DNA, 597 bp, Proteus mirabilis
agaaaagtatttactatttataatccagtacgagaaagtgacattactatagcaagagataattatactagatttttgtatgtaggaagaataattgcttatgaacaaaaaaatattaatgaattattttatgcgctttccaaattgaatggcgattggactcttgatattgttggagatggagaggataccgattttttaaaaaatttagcactagaattagatatagaggctaagatcaactggcatggttggcaaaaaaatgtttggaaatatattaaagaaaatgttaaatatacttcagcattagtactgagctctacatatgaaggttttcccatggtattatgtgaagcttcttcttatggtattttttgtattagttctaattgcccaaccggtcctgaagatattataacgcctgaattgaatggattactgtacccagtaaaggatgtagctagtttagctaatcacttacaaagtattattgatggacgtttattgcctacgcataatgaaataaaaaatgctattactaaatttaatgatgaaaactttgcaaatcgtttattatctgcattaaagttgagttga

SEQ ID NO: 4169 - DNA, 225 bp, Proteus mirabilis
cagaggttttccatgaaaaaagatattcatcctaaatacgaagaaattactgcaacttgttcttgcggtaacgttatgaaaatcaactccacagcaggccacaacctgaatctggacgtttgtgataaatgccacccattctatactggtaaacaacgtgatgttgcaaccggtggtcgtgttgatctgttcaacaaacgtttcaaaatcccaggcagcaaataa

SEQ ID NO: 4170 - DNA, 1197 bp, Proteus mirabilis
gtccagaaattgaacatgaagaatactggacatcttcatgaggatctctacaatttcgctcgcttaactttattactgccaaaaacaaggcgagataccatgcaaaattcattaccaacgcaaacataccagtctcaactgaatgaaaagaccgaacgcctacaaaagatgatggcaccttttaatgcgcctaatgtggaagttttttcatcaccagaacaacattatcgtatgcgtgcagaatttcgcatctggcatgagcaggacgctctgtatcatattatgtttgatcaagagactaagcagcgtatccgcgttgaccaatttccagtggcgagtcaactgattaatcagatgatggtagctttattggcagaaataaaagataaaccaacactgcgccataaattatttcaaattgattatctttcaaccttaagcaataaaatcattgtatcgttgttatatcacaaaaaaattgatgagacttggcaacaagaagcgacagcattacgccaaacattgattgctcaggggtttgatgtgcaattaattggccgtgcatataaaactaaaattatgctcgataatgattttgtcgatgaagtattacctgttgctggtcaacagatgatctatcgtcaagtggaaaatagctttacccaacctaatgcacaggtcaatattaagatgttggaatgggcactatcagtcactgaaaactcaaccggtgatctgttagagctttattgcggtaacggcaatttctctctcgcccttgcgcgtaattttaagcgagtgctagccactgagatagcgaaaccttcagtgcatgcagcgcaatataatatcgcgatgaaccatattgataatgttaaaattattcgtatgtcagcagaagattttactcaagcaatgaatggcgtaagggaatttaaacgcttagaagggattaatctacaagattaccaatgtgaaactatttttgttgacccaccacgcagtggtttggatgagaaaactgttgagttggttaagaattactcgcgcattttatatatctcttgtaatccgcagactctgtgccagaatttagaaacgctgatcaaaactcacaaaatcagcaagttagcactttttgaccaattcccttacacccatcatatggaatgtggtgtgttattggagaaaagataa

SEQ ID NO: 4171 - DNA, 1212 bp, Proteus mirabilis
tttttaatttctgagcaaagaaaagaaatgagaaagttagaacatgcaaatctgttattactgattattgcactggttgctgtcggtcaaatgacacagacgatttatgttcctgtgattgctgatatggctgtctattttggtgagccaacaggtgctgtacagcaagtaatgggcgcatatctgttttcttatggtttttcacaattaatttatggccctatttctgaccgagtagggcgtcgtccggttattttagtggggatgagtattttctgtttagcgacgatcgtggctattttttcacagaacttaactaccttagtgatcgccagtaccttacaaggaatggggactggggtagcaggggtaatgacccgtactcagcctcgtgatctctataccggtactgcgttacgctatgccaatagcttattaaatatgggggtgttagtcagcccactattagcgccgatgatcggtggggtggtggcgcacttctttggctggcatgcctgttatatcttcctattattattaggaggaagtgttctgtttagtatgtatcactggatgccagaaacccgacctgtacaggctgaaagacgcagtatgttgtcatctttttatttattgctgtccaacagtacttttagtgcctttttgatcatgttgatttgtgcattatcaggtattgccgtatttgaagcttccagcggtgtgttgatgggaggcgtgttgggtttaaatagtattactatcagtattctatttattttacctattcccgcggccttctttggtgcgtggtacgcagggcgtgaaggtaaaacctttgtgcaattgatgtggcactccgtattttgctgtgtagcggcaggtattttaatgtggcttcccggctggctgaatattattaatatttggactttactggtgcctgctgccctgtttttctttggcgctgggatgttatttccgctggcaacgacaggggcgatggagccattcccttatttagccggagcggctggtgcgttggtgggcggattgcaaaatgttggctcagggatagcaacgtggttctctgcactattgccacaacataatcaatttagcttaggaatgattatgtttattatgtcagtggctattatgttgtgttggatcccgttatcacaccgttttagtcatcagcagaatacggtttaa

SEQ ID NO: 4172 - DNA, 186 bp, Proteus mirabilis
tctgtagtttcgttaatcgttaatacaaaatgtacatttatattgacaacgatggtgtttttcactgacatcgttgacgagataaaaatggctgactacttcgcaaattttgctagatttgttaccttagtctcattatttagcgcaagtgcattttgcagagtttattttatcaaagctctgtag

SEQ ID NO: 4173 - protein, 230 aa, Proteus mirabilis
TNRSINNTFFMHINSRLDNNVLRDILLVSLADGIVGISYGALAHTQGFDFWVPLSLSIFVLAGASEFLFIGVVAMGGSAIYAALAGLMVNARHIPFSMAVKELPGKGIKSLLGFHILNDESVVFGLSQSTAEQNRLAFWACGLGILLMWPLGTMLGVYLGSFIVDIKMLGLDAMFPAIILALSLPALKNKLTRKAAIIGSVIALATTLFLPAGIPVLLSLLGVLFVVRKI

SEQ ID NO: 4174 - protein, 71 aa, Proteus mirabilis
EFLSGVKMNVNDHVVVKTDGCEDRQGTILLIEEFNEGIMYLVSLPEYPNGIWFFNEKEGGEGTFVRPVQQK

SEQ ID NO: 4175 - protein, 272 aa, Proteus mirabilis
WCVSYMVRLQNAIEPLWENRPNYDVLADIAEKLGVKEKFTEGRTYQEWIEYCYNQVKANNPALPSFAETNDMGIVDRKLPPRSAYVALEAFRQDPIANPLKTASGKIEIYSEKLMQDTEGWILPEGDRIPAIPEYCKNEEGVENVTLKEKFPLQMTGFHDKGHVHSTYFNVAMLREAIPHQFWLNPVDAAQRGLKSGDIAEIYNERGRLHIRVKVTDRVLPGVIAVPQGAWRSLDTTGVDTGGCINTLTSWHPSPFAKGNPQHTNLVEVKRA

SEQ ID NO: 4176 - protein, 63 aa, Proteus mirabilis
LLLSFFDWLKVFKCVVYYLHMISVVMNCNTLIKSKYYFNKIKKGAHDIIFFHILLMMARTIIN

SEQ ID NO: 4177 - protein, 67 aa, Proteus mirabilis
LHKSPTLSVCFSCCIHLSPSYNPNYLEQIIVNMLTHNILAMWLAKFMMIPLTEFQRISLLLLFYGKS

SEQ ID NO: 4178 - protein, 119 aa, Proteus mirabilis
HRESNMRTFAINQHNDLVIDAKGDLQICDNDEAVKNLCQHFIKAVRGEMLHKKDKGIPYWSATFSRQVDIPLFEMAFRQRLAEIEEVVAISHFNAFLDNGVLKYQADIRTIYGGFTLHG

SEQ ID NO: 4179 - protein, 181 aa, Proteus mirabilis
TMTLKELVTGFGTQVRSIWMIGLHAFAKRETQMYPEEPVNVAPRYRGRIVLTRDPDGEERCVACNLCAAVCPVGCISLQKAEHEDGRWYPEFFRINFSRCIFCGLCEEACPTTALQLTPDFEMGEFKRQDLVYEKDDLLISGPGKYPEYNFYRKTGMAINGKDKGEADDEAKPIDVKSLLP

SEQ ID NO: 4180 - protein, 69 aa, Proteus mirabilis
SKKPPIDLVNSFFSIKNYTLSLKGLIVNFFILFFIIYCLIRKIFTHHVYTSLLFLVLFFQKIARLTIAK

SEQ ID NO: 4181 - protein, 751 aa, Proteus mirabilis
TETPRWWLWFNNSLCCGRIGCSDDFGGGIMATQQRIQTSSEKSPVFQFSVRPDKVGIITINVVDEKVNTLKAAFVEQFQNVLKQAQQHSGVKGLIITSGKPDNFIAGADISMIADCKTKEEATALAKAGQDLFTQLENYPLPVVAAINGACLGGGLELALACHGRICSDNSKTRLGLPEVQLGLLPGSGGTQRLPRLIGVTTALDMILTGRQINAKRAFKLGLVDDVVPQAILLDVAAQWILTAKKAAKKQTIMERFWANTTLGRNILFDQAKKRTLAKTKGHYPAAERILHVIERGLEKDIQTGFKEEANAFGELAMTPVSSALRHLFFASTALKNETGSSAKPDNLHHIGILGGGLMGGGIAFVTATKGNLPVRIKDISDKGIAQALNYSWKALSTKVKKKRLSVRERQRQMGLLSGTLDYSGFHQTNLIVEAVFEDLALKQKMVADIEALGEGKIIFASNTSSLPIHKIAEKAQYPEKIIGLHYFSPVEKMPLVEVIPHEKTDAKTIATTVAFAKKQGKVAIVVGDKPGFYVNRILAPYISEALTCLVEGETIENIDKALVQFGFPVGPIQLLDEVGIDIGTKITPILVNEFGERFASPPAVDAIIADDRKGRKNGRGFYLYNQHALPFSLGKNKKRADPMIYRLLQVKPKNQLSASEITERCLLLMLNEAVRCLDENIIQQPRDGDIGAVFGIGFPPFFGGPFRYIDSMGTTKIVDKLNQLTEKYGEKFQPCERLAAMAKLNERFYS

SEQ ID NO: 4182 - protein, 60 aa, Proteus mirabilis
KDKFEKSIKTPSRSTFVLLSRFYCYNHLSFLFRLSLLSIPNILIFHTVFLISYYYKLIYI

SEQ ID NO: 4183 - protein, 215 aa, Proteus mirabilis
SPFTSSVYPLTIISSITLLGDIMSYFFAHLSRLKLITRWPLMRNIRQENVSEHSLQVAFVAHALAVIKNRKFDGNVNAERIALQAMYHDASEVITGDMPTPIKYHNPQIAHEYKKIEKYAQQKLIEMLPEELQKDFRPLIDEQLHSEEETFIVKQADSLCAYLKCLEELAAGNSEFNLAKNRLEKTLAERHSPEMDYFMKVFVPGFSLSLDEISE

SEQ ID NO: 4184 - protein, 367 aa, Proteus mirabilis
IHLTCENQCSLNPRSNWPSVRDGWHFAITGGCIGSSTAGYCIMSWLSPEVTEILLTVLKAVVILLVVVTCGAFMSMGERRLLGLFQNRYGPNRVGYAGSAQLIADMIKMFFKEDWIPKFADRFIFTIAPVIAFSSLLLSFAIVPVSSTWVVADLNIGILFFLMVAGLAVYAVLFAGWSSNNKYSLLGAMRASAQTVSYEVFLGLSILGVVAQAGSFNLTDIVNSQAHMWNIIPQFFGFITFAIAGVAVCHRHPFDQPEAEQELADGYHIEYSGMKFGLFFVGEYIGIVAVSGLIVTLFFGGWQGPFLPSFVWFALKTGFFMMMFILIRASLPRPRYDQVMAFGWKICLPLTLINLLVTAAVILYNAQ

SEQ ID NO: 4185 - protein, 74 aa, Proteus mirabilis
HGITYLSCCRSVFYIIKTMVNKTSLIKAYRITMMTLMIRIMLRVKNLMLIIVANHQLDDFYSPQNFCPKIGEKG

SEQ ID NO: 4186 - protein, 903 aa, Proteus mirabilis
ENELSEMDKDYYSYWGKFKSENNHEYYHLLPYHSLDVAAVGMILFPENSKIIKDISTFLQIHPKEFSKLFLLLLSLHDVGKFSSSFQYINPNIIDKLKVPESRFSYDGNNYRHDRLGYYFWRKIKNTIFSSIIISNADYKERKISDGFWIIFETALGHHGKPINKNNIDESIENYIHKDNDKAAIDFTLDILKLFSPKLSVENFYDKGWKERLKQISWLLAGMVTLSDWIGSNRDYFPYYKKKIPLSEYWFLALNRAKKAVLSSGFNRNYQISPFISVEYHFGYKPTPLQQWAEKVTINEHPQLFILEDTTGSGKTEAALTLAHRLMEVDAADGFYFGLPTQATSNAMFLRIINHYKKIFDEKKEVPSIVLAHSASNMNEQFTKIIRDGNERYNISDNTASAQCYQWLSDSRKKALLATIGVGTLDQALLSMLPRRHQSLRLLGLNRKIIIFDEIHSADEFMFEIIEKLLSTHLHQGGSVILLTATLSLKQRKRIIDSWFNAFDQISPEIESKSFPLATHLTCFPKVIKKEYPLKSRNQVSRKVKVEIINKEEQCIDIIISAINNGNCVVWIRNTVNDAIKSYYDIKKRLSKDNNCLLFHSRFNLKDRKIREEQVLKYFGKNSTAQQRKGTVLIATQVFQESLDADADIMISDICPIDDLIQRSGRLHRHTRTKYGDYTSETIDKRRPPILYVHAPLFIETPSSCWLTEQFSSTEAVYRSPGRLWLTLRSLTRLGEINMPKDARKLIESVYSDNAYNEIPQSLIQKENNDIGEKKARVSKAKIQLLKITKGYSEESSEFWTEDHYDISTRYSDIEMVNILLLKKIKDNYVPWIEDSHFSIALSTVKISKKKYADKLVSVPQEVIDTINKQYPQARYLQLWIPDEDQYYQYDHLIGFCERQELS

SEQ ID NO: 4187 - protein, 586 aa, Proteus mirabilis
HRYTTLFVVKNVRVMSMSKIKNNVSITEMSRRGFIQSAAVLSGAAAVAGTVSLPFSANAQTPQGIRPDETSETIKYSACLVNCGSRCPLKVHVKDGVIRRISNETMFDDSTFGLHQIRPCLRGRSVRWKTYNPDRLKYPMKRVGKRGEGKFERISWDEATSIIADKLKYTIDTYGNEAIYYQYGTGSTGANLHGRTACKRLLSTVGGFLSDYGTYSYSQLTGIVPYVYGDMLESLLTEIENSDLVVMFGHNLAETRMSGGGQFYETLNALDKSKSKVIIIDPRRTDSVTTLGAEWIPIYPGTDAALVAALGYVMIQEGITDEAFLREYCIGWDKQTLPASAPENGSYKDYILGNGPDGIAKTPEWASQLTGISVARIIQLAREIGNARAAWISQGWGIQRTSNGEQACRAIMMLPLMSGHIGRPGTNTGCWGGSIEYPVASFAIPNPVKTQIPTFMWSEAVARGEELTSKNAGVRNKDKLDTGIKFMWCYSSNVIGNQHADLNKTHELLQDESKCEFILVWDNHMTPSAKYADILLPDVTTVETNDLINNSYASGAYHIWCVYKMPLSRYGKIVLTMMYWQISLKN

SEQ ID NO: 4188 - protein, 85 aa, Proteus mirabilis
LFDTDKNLTKLEQKKQALLFTLSRYYAVTEINQYIDMLNQQLSLLEQYWHTLIEQLIQLKRNLSEAKTVLSPHLVFLNHFSHHYQ

SEQ ID NO: 4189 - protein, 226 aa, Proteus mirabilis
RGDTSGDGMNIQQFDYHSDLLQAILWQYENADKLKSLAHFKADYFHQSTVLFWQNWYRDIFNIDTANDFGLAVWGRILDVPLGIDISPSEKTKIGFGFGKKKANFNANFRRNTDYTLSLTLDQKRMLIRMRYFNLTQSPTVTNINQFLKRFFWRGESKVFVLDPFDMTYMYYVFNFNPDERLRLLLENFDLMPRPSGVGVKYRIITKKAFGYGSYRKNFLKSNFGE

SEQ ID NO: 4190 - protein, 346 aa, Proteus mirabilis
TQSTCCNIKYDEYKLAKVRFRRKGPLMSWIEKILNKSNITSSRKANIPEGVWTKCDSCGQVLYRAELERNLEVCPKCDHHMRISARRRLETFLDTGSTTELGSELEPKDILKFRDSKKYKDRIAAAQKQTHEKDALVVMKGTLKEMPVVAASFEFAFMGGSMASVVGARFVRAVEQALEDNCPLICFSASGGARMQEALMSLMQMAKTSAALAKMQERGLPYISVMTDPTMGGVSASLAMLGDINVAEPKALIGFAGPRVIEQTVREKLPAGFQRSEFLLEKGAIDMIVRRPEMRDELAELLAKLTQYDLAKDEDELLGEEMIADDIESSDNEPEINIETNKKEDV

SEQ ID NO: 4191 - protein, 78 aa, Proteus mirabilis
LRATKYTPAVTMVAAWINAETGVGPAIASANQVCNGSCADLPTAPPKTINIAQLMMLDPAVSCSGASTAISRKLSVPN

SEQ ID NO: 4192 - protein, 68 aa, Proteus mirabilis
SNRTRSNFKHLLINLYKHKHLALEYLLNLNKFPIIIYYNLNYNFLYGLLFIYIFSCSLIKDNPNRKRP

SEQ ID NO: 4193 - protein, 257 aa, Proteus mirabilis
PLMTLACRQYNTHNEGPWLVWLHGLLGDSHEWETVIKACHEYPSLVIDLPRHGNSASIGVNNFVEMSALLHDTLKEYDINHYWLIGYSLGGRIAMYHACFGETSGLMGLIVEGGNPGLYDAIERQNRIAHDKRWAARFRNEPINDVLTQWYQQPVFADLSDEMRQLLVEKRSSNAGFCIAESLETLSLGHQPWLVAELQQLTLPFIWLCGEQDKKFQSIAQQYSLPLTTIPQAGHNAHQAQPDAYAAVINHVLSLFG

SEQ ID NO: 4194 - protein, 589 aa, Proteus mirabilis
IVMTIKQTIGIKKIASLSLLLLFFLLSSSAVAKEWTIGVLALRGDASTQRHWQPLIDTLDQQIPTDSFLLLPLNLSEMKQAVADKRVDFLLKTPAQFVQLDSAYPLRWLLSLRSGYEPDNTTRNVIGSLILVRKDSAITSIHELVGKRVGAIAPDAFGGYLLGYKALREEGIDPEQDFTLRFSGFPADALLYLLRDGDINAAIIPVCLLENMDNEGLINKEDYRPLLNYSTNTSCLTSTPLYPNWSFAALDTVPDTLVDKVARTLLNDESDAMKWGAPASHSQVENLLREVNQHPRQRQLWQDAKIWAIQHRFIIGLSLGAIILLVFNQIWISYLVRRRSHQLEQAHIHLREQKEALEQAQRLNILGEMASGFAHELNQPLSAIKSYAQGSAIRLEKENKNHPLLPALRQIDQQAQRGADIIRNLRLWVGKQSANSDTVPLSEQNIAQCIEHIWRLLRIDEKYPQVTLITKIDKHDTLYLPETLLEQILSNLITNSLQAGTKVLQISTHKAPDRLLIVIKDDAGGMSHSQLEQPFSPFQTTKTEGLGLGLVICQRLLNSQGADIHIENQKDKQNNVGLKITLIFPNNNN

SEQ ID NO: 4195 - protein, 491 aa, Proteus mirabilis
FAMTITPEQLIAMLPLLVVILTVVVVMLSIAWRRDHFTIATLTATGFIIALGSLYYVNALGVVDVTTLYHVDGYSSFFTALTIIAGLGTVAFAYPWLEGYQDNKEEFYMLVAIAVIGGILLSSAHHLASMFIGIELLTLPLFGLIGYAFQQRPSLEASIKYMLLSAAASSFLLFGMALLYAEAGNLSFTAMGQSLSDSNIHKPLVLAGLGMMLVGIGFKLSLFPFQLWTPDVYQGAPAPTGAFLATASKIGIFAVVMRLFLEAPAADSETLRMILGFMAIASILFGNIMALTQKNVKRLLGYSSVSHLGYLLVALIVLQYSPILAQETAEIYLAGYLFASLGAFGAIAVASSPYNKGELESLEDYRGLFWRRPVAAVVMSLMMLSLAGVPITLGFIGKLYVILAGIDSSLWWLTGMVVLGSAIGLFYYLRAAAIVFLRKLDNDNAPAVTTTSQNMATLITLVCAIIVIVLGVWPQPLIELTRFAIIAPAIN

SEQ ID NO: 4196 - protein, 600 aa, Proteus mirabilis
IEMTDQIAQNSARPAWETSDHIDDQVVNELRQKFGPDAFTFQPTRTGMPVVWVKREQLIEVMQYLKSLPKPYVMLYDLHGVDERVRTHRQGLPAADFSVFYHLISLDRNKDIMLKVALSEKDLNLPTLTSIFPNSNWYEREVWDMFGIVFNGHPNLRRIMMLPNWEGHPLRKDYPARATEFDPYVLTKQKEDLEMESLTFKPEEWGMKRGTENEDFMFLNLGPNHPSSHGAFRIILQLDGEEIVNCVPDVGYHHRGAEKMGERQSWHSYIPYTDRIEYLGGCVNEMPYVLAVEKLAGIEVPERVKVIRVMLSELFRINSHLLYISTFIQDVGAMTPVFFAFTDRQKVYDIVEAITGFRMHPAWFRIGGVAHDLPKGWERLLREFLDWMPKRLDSYVKAALQNSILKGRTIGVASYNAKEALDWGVTGAGLRATGVEFDVRKWRPYSGYENFEFEIPVASNGDCYDRVMLKVEELRQSLRILEQCYKNMPAGPFKADHPLTTPPPKERTLQHIETMINHFLQVSWGPVMPANESFQMVEATKGINSYYLTSDGSTMSYRTRIRTPSFAHLQQIPAVIRGSLVSDLIVYLGSIDFVMSDVDR

SEQ ID NO: 4197 - protein, 454 aa, Proteus mirabilis
SLMTSNLLTMSQKLTSKRIKKKMSNIITAPQATSPLSVWLSYLEHLHSSAIDMGLERVGKVGQLLNVLRPAPKVITVSGTNGKGTTCHMLESILMASGLKVGVYSSPHLVRYTERVRIQGKELSPADFCQVFAEIEQTRGDISLTFFEYGTLAALKLFQQAQLDVVILEVGLGGRLDATNIVDADIAAITSIALDHTDWLGADREHIGHEKAGIFRKNHYAVVGEPDMPLSIAQVAQQKQAKLFRRGVDWSFSIDGDHWHWRSADKQFEKLPIPNIPLANAGTAMAVIRCLLKSDDKVSQGITHQSIVEGMSKAQLPGRFQIISQHPLVIFDVAHNPHAAGYLAEKLAQLPRYSDTKVRIVVGMLGDKDIAGTLACLSPQADQWYVAPLNEFRGASAQVLAQHLDYPAVFDSVEQAWQQAISEAQKNDIVVVCGSFHTVAHVMELLEKESASGK

SEQ ID NO: 4198 - protein, 116 aa, Proteus mirabilis
LNFFTFMGIRLLYWRLYAVVHVFIGVFSMFFQDKNNILGIPKLPPRAMIFLVPFFLSFVMCGIVSFISTAKTMGLNSLMFAPWFSSWGVSWMIAFPTVLFVLPFARKLSLLLVKPH

SEQ ID NO: 4199 - protein, 66 aa, Proteus mirabilis
LCFAKINRDTRLFSVSIQAGAWIILVQAFARTKKTKAPNSIYIKFEAVSSHQQLDSVSFNKECQEK

SEQ ID NO: 4200 - protein, 945 aa, Proteus mirabilis
GGYLRYLSSFKTSLKISRYLFRALGIMLWAMGALLTMFYLINIFNDTKSDIRQEYSNNYTDLLGFFRQTSSTIRDLQYLAERHQEQLNLNPKMNNSFFYEGPFSLHKLSESADCELFKGQTNNYFRSFNSILYYWKDNTPALQGINQVFMVGSHSMCMINFPLRASPIDTELLKKMVYENTRNYINQRAQGKESNQYWIVPDAKGDSGILYVMSPVYASGKFIALIGIERAIRLEYFSPTKDRVISIHLLNNKNNPVLSYPEENNYRSVRDVPDVSAPYFGFDDDFSDLVAKRKLLPSSFSVVYSLPLKQILNEFKFTIFNAIILNIISAIVIFIFVWIFERKIFSPAENNASRLEEHEQFNHKIVASAPVGISILRIRDGMIILSNELAHNYFRLLSHSDKQNILSIIAEKSSNIVDVVTNNHNHLQISFVNSRYQNEDVAICVLVDISARVKMERSLQNMATAAEQANQAKSMFLATVSHELRTPLYGIIGNLELLQSLTQNEETARLLKTMDNSSSLLLKIISDILDFSKIESKQLKIDVKPFNCRQVVSFVISNYLPLIAKKDLAIYCFIEPDVPKIVNNDPVRVQQVISNLLNNSIKFTTTGCITLHLYRDEYYLYFDIHDTGRGINEKMLHQLFEPFFQVSQNTESASEGTGLGLAICEKLINLMDGDISVVSQENVGSRFTVRIPLYGALNSSDGQTKYNLYKESTIRCFISIKNLYLESFVERYLSYVGLHCQLFTEVTQVSENDFIITDHDECLDKSCQFIRIYEHYFEPAKKISENNWLCSTYKLNELIKIILQLPQTKLESDDSENNALMTDHDLQLLTVLIVDDHPINRLLLTDQLKKIGFNTATAEDGCDALAFMQENHVDIILTDVNMPNMNGYQLATTVRELSRTIPIIGVTANAIAEEKQRCIDAGMNDCVSKPVSLTVLKDVLLTYVA

SEQ ID NO: 4201 - protein, 362 aa, Proteus mirabilis
CICAAISWTRATRIMAGGSLMISSVSQIQEVIAIPQEYFWLPWAVQYFFFIGIACCATLYACWQCWKGRTGNPRLEAVAVFIAVTAGITAPLALTADLHQTARVWHFYAYPTPWSWMAWGSLLLPLFSAFSILYFIAMVVRLVWKREYKLTRWVALACALTSIGLLLYTGREASILKARPVLYTYWLPILLFFSAMQVLPTLLALGTRREPVYQRELAMWFIGSLMLLAVCTGFWIAGDTISGQAIRQQLAIGSLGWWSAIGVIALWIVSVAMGGLMAKQARSVAFITVMAFISMGLAWVLRWLMLMGSQYIPKYNIITNPYQFPLGNDGLLAIVGTFGLWIALTIIFRESIRWVVRRVQHG

SEQ ID NO: 4202 - protein, 298 aa, Proteus mirabilis
KISAGAVLLMNDQESADVIAQSISEPAIVAESTPLKIALGIEYDGSHYYGWQRQNEVRSVQERLEKALSQVANEPISVFCAGRTDAGVHATGQVVHFETTAHRKDAAWTMGVNTHLPQDIAVRWVKTVANDFHARFSATARRYRYVIFNHRYRPAILSSGVTHFHYPLDAQRMHQAAQCLLGENDFTSFRAVQCQSRTPWRNVMHVNVSRYGDYVVVDIKANAFVHHMVRNIVGSLLEIGCGNQAITWMAELLALKDRTKAAATAKANGLYLVSVDYPERFELPKPAMGPLFLADNPF

SEQ ID NO: 4203 - protein, 63 aa, Proteus mirabilis
LNYAPQIRHFYSNLGSFFIKLKYKCKVLYRDTPQILEIKKIGLTDYVLKVTIKNDIIEAKFTR

SEQ ID NO: 4204 - protein, 403 aa, Proteus mirabilis
MKRAVITGLGIVSSIGNNQQEVLDSLKEGRSGITFSEEFKEMGLRSHIWGNVKLDTEGLIDRKIRRFMSDASVYAYLSMQQAIEDSGLTEDQVSNIRSGLVVGSGGGSPRNQVQGSDGMRAKGLRGVGPYMVTRAMASGVSACLATPFKIKGVNYSISSACSTSAHCIGHAVELIQLGKQDVVFAGGGEELSWEMTCEFDAMGALSTKYNDTPAKASRTYDKNRDGFVIAGGGGIVVVEELEHALARGAHIYAEIVGYGATSDGADMVAPSGEGAVRCMQMAMQGIDHVDYINTHGTSTPVGDLKELEAIAEVFGTKTPAISATKAMTGHSLGAAGVHEAIYSLLMLEHGFIAPSINIEELDDKADGMNIITKPTEQKLDTVMSNSFGFGGTNASLVMSKYKK

SEQ ID NO: 4205 - protein, 226 aa, Proteus mirabilis
IMYLSRISIDYSADYLHSLLANKLPDGYTIHQLLWRLFTEEKERSFLYRLEIGKNGKPIFYILSSIAPTTKNNFFKIETKPFLPKLVKKMKLAFSLRANPTVCITDKEGKRQRHDVLMHAKKQAQLDGKDYSHDDIHHLMQQAALNWISSDDRLNKWGISLTQLPDIKAYTPERIKKPSGKIMSFSSVDYQGVLTIEEPHLFWQQYQQGFGRAKAFGCGLMLIRNI

SEQ ID NO: 4206 - protein, 476 aa, Proteus mirabilis
DSMATVVNFTQWPWHHWAQLNPNETAIIFGDSPITWQQLSCHINQLANHLAKQGVNTKSTVLLRGKNHIHVVFTLLAVFQCGAKVLPLDPQLPKSLLDDLLPHLNIDFYADLSGSTLELDARLLDLSGVEFNNKSHQDKNNMAGVAWTSSRMATLILTSGSSGLPKAAVHTFQAHLCSAEGVLELIPFEKSDSWLLSLPLFHVSGQGILWRWLLRGATLVVRNMHPFIAALQGCTHASLVPTQLWRLLQNTQQDSSQPITLKAVLLGGAMIPTELTQCAENKGIQCWCGYGMTEMASTVCAKRADGKAGVGTPLKGKAVRLVDNEIQIKSDSVALGYWFDGQLKPLSQTQDDWYATRDRGCFKEGEWCILGRLDNLFFSAGEGIQPEDIEKVLNSHPNVRQTFIVPIDDIEFGQRPVAVVDTDIETINQLPQWYHTRLAGFQRPIACLLLPEQLKSGGIKISRKQVQQWVKGQQVN

SEQ ID NO: 4207 - protein, 342 aa, Proteus mirabilis
YCLFLLSNADLSRSSWQTTDFLFRQIRQRTTVLDITAKEEAVADLSTILDMLRWAMSQFNSSDIYYGHGTDNAWDEALQLVLPTLALPLDIPDALLSTKLTTSEKMEIIQLIEVRIEQKIPVPYLTHRAWFCGHEFYVDERVLIPRSPIGELINNHFAGLIGQEPTRILDLCTGSGCIAIACAHEFQEAEVDAVDISADALEVAEFNIENHGLIHRVYPMQSDLFEAIVPTPYDIIVTNPPYVDAEDMGDLPDEYHIEPELALASGVDGLDITRQILLKAPDYLSEKGILVCEVGNSMVHLIEQFPEVPFTWLEFEKGGIGVFMLTREQLVEFSDSFASDKR

SEQ ID NO: 4208 - protein, 247 aa, Proteus mirabilis
SSNLIIHYSFTKRKSKMKKKFLYFTLLAAISTSALAVTPSAQLQINGDIKPPTCTINSSNNTEVVFDYGRISPSLIPQSSNYQYVDMKPETSISIECDAKTYLTFIPTDTYGDVDLDYNTSFDSAWFRLVDKANPDKAVGASFFNWKDATVDGKTAFISRATPKTAEVGVSVLVKNNIHGWTSEQQEDVSAASLKLVSGEIFTTKFIPGISSHTFILSRDKLAKKAIDISNGLDFIGEAVLTFSFGV

SEQ ID NO: 4209 - protein, 181 aa, Proteus mirabilis
ETNLQHSSFKVFTMNVLKDILERDLARINAAEKRDGKPHFNSQFLKNHIWLCVSMVLSYLLLAALLIYSPYFGVISLTLFTLMFIVMAGILLFDIKPIYKFDDIGVLDLRVCYNGEWYTFEKLSDEAINEIRQHPAIPAQIKEDINDIIRTKQEIHFYDVYLIAFDPITKPISSEKLSPQV

SEQ ID NO: 4210 - protein, 263 aa, Proteus mirabilis
IVTYALIIIGQLAENIMKYRLCGVALLVALLSGCASTPNNGDSRSDPLEGFNRQMFNFNYYVLDPYVLRPVAVVWRDYVPPPARNGLSNFLGNLEEPASMLNSILRGDFEKGAKHFGRFWINTVFGIGGLIDVAGMSRESMEKEVPVRFGSTLGHYGVGYGPYVVLPGYGSFTVREEGGDWADATYPVLSYLTFWMSAGKWALEGIETRAQLLDSDAILQNSSDPYLMMREAYFQKNDFDANGGKTGENPNAKAIEDDLDSID

SEQ ID NO: 4211 - protein, 503 aa, Proteus mirabilis
SISYLRINMSIKQTRYVDIASAVIGASTAPMRKLTARIFSTNPKIPAGKVLEFTSGQVDAFLGADSPEAQFARQYFSYVSPAPVSKPKELQIASYEPMGRAPTLFGGPVATLDKLKLIEEGELTLVIGDVTKKISKLSLQDVTSYSDIASLIQAKLNAESEPQFASCYVTFNAMDSAFLISGGVQEKAQISVNNSPLADALGLSQGQTSEGNASQTALEAFMAAEAISDSFGSATFLTELSIEQSVELAEYVAGENVKYQLYLSVPDQQAEMYSKALMNTASTGLNLKTEENFFVQALPMAIMAATDFERTNATTNYMYRQFGITFPSQVTTDMAADRLDKLRVNYYGETAVSGSEISFYQRGFLCGNGANPVDMSVHANEQWLKAYIAQQWLSLLLSTRGIPANKDGEARAMMIIAGAVTKALNNGTIQTGKALTEVQKIAITDAAGDDLAWHDVQNKGYWYNAEIVEQTGPGNLPEYTMKYVLIYGKGDWVRKVEGSHNLV

SEQ ID NO: 4212 - protein, 177 aa, Proteus mirabilis
CHALSNNFFGELMMEMTHAQRLILSNQYKMMTMMDPDNAERYRRYQTIIERGYGLQLRELDRDFDEMSEETCRTIINIMEMYHALQVSRENLKSPEMPDARRVAFMGFDAATESRYLSYVRFMVNTEGRYTHFDSGSHGFNSQTPMWEKYQRMLAVWLACPRQYHLSSVEIQQILNA

SEQ ID NO: 4213 - protein, 375 aa, Proteus mirabilis
FLSHCLYSRRLCMSLLFTPNKLGPHQLDNRIIVAPMCQYSAQDGIPTSWHTMHYGQLALSGAALVIIEATAVEPRGRISYKDLGLWSEEHGRALKQLISDIKQHTNAKIGIQLAHAGRKASTSLPWEGGKSLAPDDENGWQKVAPSSIAFGQYHQPQALTIDEIEKIKNAFVEAAKRAESAGIDVIEIHGAHGYLLHEFLSPLSNHRTDQYGGDFNNRSRLLIDVFTAVKKAVSDKMCVGVRISATDWVEGGWDLESSIALTQHLEDLGCHYIHVSSGGLSDKQAIKLGPNYQVPFAQAIYNETQLPVIAVGLITEPEQAEAILLTEQADFIALGRGILYDPRWPWHAAEKLKQTIKVAPQYLRCAPHGSKDFFK

SEQ ID NO: 4214 - protein, 201 aa, Proteus mirabilis
VKNQYTLEMIFLINLYKVVIAMVPYQPVLTFWFEECTPKQWFQKDSAFDKEIKDRFGELCISASRAELASWRESIEGRLGEIIILDQFSRNIWRDTPKAFAQDNMALILAQEAIRLPEYLTLTPVKRKFLIMPFMHSESQKIHQDAIALFSQLNDDDTYQYELRHKEIIDKYGRYPHRNEILGRTSTAEELAFLQQPSSSF

SEQ ID NO: 4215 - protein, 244 aa, Proteus mirabilis
KPCQINQRQTSAAVISEALKMDYTLTRIDPNGENDRYPLQSQEIVSDPLDAHVHRSVYMGKLEHALHDVVNWGRKNSLWPYNFGLSCCYVEMVTSFTAVHDVARFGSEVLRASPRQADFMVVAGTCFTKMAPVIQRLYDQMLEPKWVISMGACANSGGMYDIYSVVQGVDKFIPVDVYIPGCPPRPEAYMQALMLLQESIGKERRPLSWVVGDQGVYRVNMQSERERKHGERIAVKNLRTPDEI

SEQ ID NO: 4216 - protein, 345 aa, Proteus mirabilis
KMSQFIQLHILTSYAPSNLNRDDLGRPKTAIMGGFERLRISSQSLKRHWRTSELFNIALSGNIGIRTKKFGLQLYDALIEGGVSEKNAKKWVGLIIEQYGKIKKDSIETEQLVHISHLEKSLAFDLINLLIKEQREPTKQELESLKTINTSVDIALFGRMLASAPKYNIEAACQVAHAISVHSTVIEDDYFTAVDDLNNGETDTGSAHIGEAGFAAALFYSYICINKTQLIESLDGNEELANKAIQALTEVAIKVSPTGKQNSFASRAYASYVLAEKGSYQPRSLSVAFLKPIDDEDMENAAINALKFRMENFDKVYGTCAESRYQLNAVQGEGSLSGLLQFVAE

SEQ ID NO: 4217 - protein, 200 aa, Proteus mirabilis
LDCLSGKYRFCNVGCGSLIMQNELNHKEDAAKIEIVDVTHSKKNTFVLTQEERAEIEQEKHHYEDPRAASIEALKIVQKNRGWVEDGAIYAIADVLGIPASDVEGVATFYSQIFRQPVGRHIIRFCDSVVCHITGYQGIQAAIEKHLNILPGQTTPDGRFTLLPTCCLGNCDKGPTMMVDDDTHSFVKPEEIETLLEQYP

SEQ ID NO: 4218 - protein, 515 aa, Proteus mirabilis
PLRLADEDLFMCGIVGIAGVNPVNQSIYDALTVLQHRGQDAAGIATIDENNGFRLRKANGLVKDVFETRHMLRLKGTIGIGHVRYPTAGSSSASEAQPFYVNSPFGITLAHNGNLTNAHLLRRQLFETARRHINTTSDSEILLNVLAYELDRFDHFPLEPDNIFTAVAAMHKKLRGAYACVALIIGHGLLAFRDPYGIRPLVLGKRTLEDGRSEYMVASESVALDTLGFEFLRDVAPGEAVYITEQGQLFTRQCAENPQLVPCLFEYVYFARPDSFIDKISVYNARLRMGQKLGAKIAKEWEDLQIDVVIPIPETSCDIALEIAHILNKPYRQGFVKNRYVGRTFIMPGQQERRKSVRRKLNANRAEFRDKNVLLIDDSIVRGTTSEQIVELAREAGAKKVYFASAAPEVRFPNVYGIDMPNANELIAHGREVDEIRKLIGADGLIFQDLSDLIAAVQEENPDINQFECSVFDGVYITKDIDQGYLDYLENLRRDDEHKIRDQHEAENLEIYNEG

SEQ ID NO: 4219 - protein, 184 aa, Proteus mirabilis
MSAHHYQQLIDIFNQCFSDSYQTRLVKGDNEPIYLPKSEEIPYHQIIFAHGFYASALHEISHWCIAGDARRQQVDYGYWYCPDGRDQVTQEQFERVEIKPQALDWLFCQAANYPFNVSCDNLDGDFEPDRYQFRNKVREQVLAYLRDKNIPPRAQLFINALHLFYNTPELTPEQFPYQENPLVN

SEQ ID NO: 4220 - protein, 155 aa, Proteus mirabilis
FKEQTMNDISATGLSLIIQASKTFPAGIPITTFSDEGDPLDLPTVNITQTAVDINGNLVSWSSPTPQTVTINVLAGSEEDENLAILFDANTARRGRRPASDVITLVASYGDGSITTARNGRITGGCRGNSVAGVGRLKSKQYTFIFQDFDRVRAR

SEQ ID NO: 4221 - protein, 419 aa, Proteus mirabilis
FMQQQLLTWIRQFNEEYAQITSLLLVLLIIFVVALVLHFILHKLVLPKLSKAISKYDQKWQLSFEINKLFSRFAFLIQGVVINIQALLWMGPGKTQEILTTTAQAWCLLFGLLMIFSIMDLCLQIMRNSPSFGRLPLRGIFQSLKLVASVLIGIMIVSLLIGKSPLILLSGLGAMTAVLMLVFKDPIMGLVAGIQLSANNMISLGDWLEMPKYGADGAVVDISLTTVKVRNWDNTVTTIPTYSLISDSFKNWQAMTQSGGRRIKRSLSLDINSIYFLDQENIDKLEKAQLLEPYIKSKVGEISSYNASLCHEHQMPLNQRGMTNVGTFRAYVEAYLKNHPKIHKQMTIMVRQLAPTSEGLPIEIYAFTNTTVWVEYEAIQSDIFDHIFAILPQFGLRIHQSPTGSDVRALKFPANIDTP

SEQ ID NO: 4222 - protein, 206 aa, Proteus mirabilis
LMKQYGFYFDSTKCTGCKTCQVSCKDEKDLDLGPKFRRVYEYGGGSWAKQDGIWTQNIYSYYLSISCNHCSNPTCVAGCPTGAMHKREEDGLVVVNQDVCVGCRYCELRCPYGAPQFDEKKKLMSKCDGCYERVAQGMKPVCVESCPQRALDFDDIEVIRAKHGTECGIAPMPDPSLTNPNIVIKAHKDAKPSGDKTGSVQNAAEV

SEQ ID NO: 4223 - protein, 306 aa, Proteus mirabilis
TMINANRPIMNLDLDLLRTFVAVADLNTFAAAAAAVCRTQSAVSQQMQRLEQLVGRELFARHGRNKLLTEHGLQLLGYARQILRANDDATASLTYSDAEGELRIGASDDSVDTLLPFLLNRIASVYPRLAVDVRIKRSQFIETMLDNHEIDLALTTARIGHHPRTALRTAPVLWHCAPDFQLQMNEPIPLVVMDETNPFRQLATNTLDDAGIQWRIAYEAASLSAVRAAVNAEVGITARPLEMQNADLRILGESEGLPRLPETQYWLYRNFDEQNEAVLTVFNAIENKKTPYTVTSVEEAHSLDLE

SEQ ID NO: 4224 - protein, 73 aa, Proteus mirabilis
CGSNSSGVLFYPNSTKPTETTCQMPFLLLPHFSTAIVSLKRQYRERRNRKSQLSVISMKIIIKQRDRYKFKRS

SEQ ID NO: 4225 - protein, 562 aa, Proteus mirabilis
SMSNSSFNRQWAKVILETLTRHGLRHICIAPGSRSTPLTLAAAANHKLICHTHFDERGLGHLALGLAKATQQPVAVIVTSGTAVANLYPALIEAGLTGERVIFLTADRPPELINCGANQAIRQQGIFASHPSETLSLPRPTADIPARWLVSTLDNAMNNLVHGALHVNCPFAEPLYGDDIEHDTPWTQALGKWWQSDKPWLQETLSPSVTTHPQWDRLRQKKGVVIAGRISAKEGIAVAKWASQLGWPLLGDVLSQTGQPLPCADLWLNNPQVKAELNQAEIVIQFGSSLTGKRLLQWQANCSPQMYWVIDAIPGRLDPGHHQGEKFTLSPSQWLTAHPAIDNLPWALSLSHIATQTYQHVTEVTDYFGEAQVAHQLDHLLPHNGQLFVGNSLIVRLIDAFAQLPQGYPVMSNRGASGIDGLLSTSAGVHRATQKPTLTILGDLSALYDLNSLALHQQVYAPNVVIIVNNNGGQIFSMLPTPMAERERFYCMPHALNFKHAAAMFGLDYVAPNCWDDLFTTVTACWQGEAKTTLIELIVNETEGAETLNQLVKQVTAYDFSL

SEQ ID NO: 4226 - protein, 425 aa, Proteus mirabilis
ARYKEPSMDFFRFLMSDVLSEPAILVGLIALIGLIAQKKPATECIKGTVKTIMGFVILGAGAGLVINSLGDFSTIFQHAFGIQGVVPNNEAIVSIAQKSFGKEMALIMFFAMLINILIARLTPWKYIFLTGHHTLFMSMMVAVILATAGLEGAVLVAVGSLVVGVSMVFFPAIAHPYMKKITGSDDVALGHFSTISYVVSGFIGSKFGNKAHSTEEMNVPKSLLFLRDTPVAIAFTMGIIFIITCLFAGDTFVREVSGGKNWFMFSLMQSITFAAGVYIILQGVRMVIAEIVPAFKGISDKLVPNAKPALDCPVVFPYAPNAVLVGFLSSFAAGVIGMFILYALDWTVIIPGVVPHFFVGATAGVFGNATGGRRGAILGAFAQGLLITFLPVFLLPVLGDIGIANTTFSDADFGVIGILLGIIVR

SEQ ID NO: 4227 - protein, 63 aa, Proteus mirabilis
HSHKNHLIYLIICILANFLIKSLQSENRKSLIVEMSWDMLFIILRNINHTPHNILKEVTYINA

SEQ ID NO: 4228 - protein, 221 aa, Proteus mirabilis
ADCKIYAIEYHLIAEVFMIDLYYANTPNGQKITLFLEEVAMPYTLHHVDIGKGDQFKPEFLAISPNNKIPAIVDNAPADGGEPLSIFESGAILIYLAEKSGKLLSHDLREKMTQLQWLFWQVGGFGPILGQNHHFTRYAPEKVPYAINRYTKETERLYQVLESRLAQSPYLGGNDYSIADIATYTWARYHDTHHIDLADYPAVEKWLNTISQRPAAKKLFG

SEQ ID NO: 4229 - protein, 298 aa, Proteus mirabilis
KVIKVNTIYHGGKMSEIVYLNNQFVPKEQANISVFDRGFLFADAVYEVTAVINGQLIDFEGHFQRLQRSCKALSMPFSLTKEQLKEIHGQLIDKNHLHEGLIYLQVTRGADSSRFFDFPSSSVAPTLVLFVQHSTVVNHPNASKGISVVSVEDIRWQRCDIKTVALLAACLAKHHAHQQGADDAIFIKESYITEGSSSNFFIVNQQDEIITRPLSQDILPGITRQAIIQLAKEQKLTIIERLFTLEEAKQAKEAFISSATTLIWPVISIDNEKINQGKVGALSQRLREIYLEKAGVKP

SEQ ID NO: 4230 - protein, 90 aa, Proteus mirabilis
LKLNNRVIKRIVTMKLKTILPICAASFSLLLLAGCSSPQKIETVDGQTILTTDKPQEDESTGLIIYKDAETGAIKQINRDQIRRMVELDD

SEQ ID NO: 4231 - protein, 184 aa, Proteus mirabilis
RTLKMNKKFILPPSEIELFQEMIKGTKKLPQDKIRHQTPRKKVTHYPTERLQQEQIDASYYFSDEFQPNLATEGPMRYLREGANAYELKKLRRGDYVPEFFLDLHGLTQLIAKQEIGALIAACRREHVYCACIMHGHGKHILKQQTPLWLAQHPDIIAFHQAPKEWGGDAALLLLVENDDIARR

SEQ ID NO: 4232 - protein, 106 aa, Proteus mirabilis
FSIKPKGSLFILQNKFIYTKNKKAVTYYKQLPLSFIQGNLSITNYFLYLLITSEALVPPKPKLFDITVSSFCSVGLVMIFIPSALSSSSSILILGAIKPCSNISRL

SEQ ID NO: 4233 - protein, 355 aa, Proteus mirabilis
SRINLITMIKTRKRRNTGRVTLQEVAKHAGVGSMTVSRALRTPELVSDKLREKVNQAVAELGYIPNASAGALASAQSHIIAVLLPSFTDKASADFMQSLQQILSRHHYQILVGCYEYQLHKATDVINMLLQSNPAALVAFGSQLSDVQFLHISNANVPVVSVASQSNEQSAISIDCGYEKAAFDLTHYLIQQGKRCVGYVGALQGQRLHHQQITGWSRALLKNYLNAEQSVTTPDPASMAYGRQALTEILLRQPELDAVICSHESIALGMMFECQRRLIKIPQDLAIACLEGSENSAQIAPSLTSIHFNYHKIGKEAGKHLIALLQHLRDEVDNAMFENTVINYAYRLELGQSTP

SEQ ID NO: 4234 - protein, 207 aa, Proteus mirabilis
QGIKYSAPAVWKWLNGESVPDSTNILALSQWLDVRAEWLEYGRGAKKNDGISVNEIMPVNDWDNSTPIERDEVEIPFYSTIELAAGFGSCTTDNQKVELLRFSRSTFNQYGVQPSDAVAFKVHGDSMSPVIPDSSIVTISTGHTKIIDGGIYAIQQGDLLRVKILHRLPNNKIIIRSYNTIDYPDEESTLEEVKILGRVFNWSVMGW

SEQ ID NO: 4235 - protein, 63 aa, Proteus mirabilis
  UNSURE (41): Identity of amino acid at the above locations are unknown.
LNENIDSIKKVRGKIDLDYFILNKQEKFNIKVGNVCNGYLXYFIFYTLIFLPWFLFIKTRGAK

SEQ ID NO: 4236 - protein, 110 aa, Proteus mirabilis
EVEKMQEIPLQAIPNQRFSVAIASVNWQLTLKVANQTMFCDIEREGEILITGMRLVANTPIIPYRYLNQGINLMFLTEHDALPWYEEFTKTQSLVYWSEEDGSSTNKARN

SEQ ID NO: 4237 - protein, 101 aa, Proteus mirabilis
EIMKENPDLWEQICIVLYSMKEQGISALLAGGMAILRSLYNAGGWKKTFLDGLMCAMFAWFIKDILLLFSINHQFAYLASVFIGYVGIEPVSKLLIRKNRS

SEQ ID NO: 4238 - protein, 411 aa, Proteus mirabilis
GRKKMSLAIRYLALLPLFVITACQQPVNYNPPATQVAQAQPAIVNNSWIEISRSALDFNVKKVQSLLGKQSSLCAVLKGDAYGHDLSLVAPIMIENNVQCIGVTNNQELKEVRDLGFKGRLMRVRNATEQEMAQATNYNVEELIGDLDMAKRLDAIAKQQNKVIPIHLALNSGGMSRNGLEVDNKSGLEKAKQISQLANLKVVGIMSHYPEEDANKVREDLARFKQQSQQVLEVMGLERNNVTLHMANTFATITVPESWLDMVRVGGIFYGDTIASTDYKRVMTFKSNIASINYYPKGNTVGYDRTYTLKRDSVLANIPVGYADGYRRVFSNAGHALIAGQRVPVLGKTSMNTVMVDITSLNNIKPGDEVVFFGKQGNSEITAEEIEDISGALFTEMSILWGATNQRVLVD

SEQ ID NO: 4239 - protein, 382 aa, Proteus mirabilis
NLIEEAMSYTTFSQVRNDQLQEPMFFGQPVNVARYDQQKYPIFEKLIEKQLSFFWRPEEVDVSRDRIDYNALPDHEKHIFISNLKYQTLLDSIQGRSPNVAFLPLISIPELETWVETWSFSETIHSRSYTHIIRNIVNDPSVVFDDIVENEEILKRARDISSYYDELINLTNLYHMFGEGTHQIKGKTVEVTLRKLKKQLYLCLMSVNALEAIRFYVSFACSFAFAERELMEGNAKIIKLIARDEALHLTGTQHMLNLLRSGQDDPEMAEIAAECEQECYDLFVEAAEQEKEWAEYLFSEGSMIGLNKEILCQYVEYITNIRMQAVGLKLPFKARSNPIPWINAWLVSDNVQVAPQEVEVSSYLVGQIDSQVDTDDLSNFEL

SEQ ID NO: 4240 - protein, 111 aa, Proteus mirabilis
YFYEETMIYLHSGGGDSAKQQRVNQAATDKAQQIAQDQQSLLYTISSASDFPTTVENIGAILLIEPSIELALEVCRRYQSSIEIVMAESAITGAKLTVCQIEFEVIKICVI

SEQ ID NO: 4241 - protein, 307 aa, Proteus mirabilis
NIYDKDNNTMKNFFKISLIASTVLVLSACDQLDLDNKKDKFYYSNPSEKSMSFVVDDKTYQVEPGKSGYLTLSPGEHSLQDSAGNKSTFMVYENNNGGILNPDNFMYYRLSEVYAVQGKGDRFKPTEYKVVINGYQLEMPLQSTNATLIDGNVFKCTYTLGEPFPSEIKSHNKNEMGNIKTKCFDKPELIQYIMTDYGQDLKPLSPQDEYNDTVNLALDYSLPQPQFTDPDIQAEAENWVALLDQIKESNDPNIHKQLKTPLHEAINKLSKADSERAVKNSVEDNKYYNSFIHQASQYQSYGILPRD

SEQ ID NO: 4242 - protein, 259 aa, Proteus mirabilis
TMHELPLVFFTVLGSSAAGLFLIAYISKKLGQIDEQQLRNANILALILMLVGLGIGGLHVGQPLRFFNMLLGVGRSPMSNEAFLSGVFTGFAFATVALTIMKKWRGLREICNLFTVIFGLAFVWSIPQVYHIPTIANWNTDYTTLQFWMTLLIGGGVLAMVSGARRLGALSFIIGAIITFAARSGYVSFLSFNGPELSAEQSLFWGFQLAVLALGIVVVGFSALKAQTSKVTLATCAAAVVIAELSGRIAFYNLWHITM

SEQ ID NO: 4243 - protein, 139 aa, Proteus mirabilis
CDCLSNDTVSPCGNTGFIILVRRFICGEKNMISTTSLIAGIAILAVGTYAMRISGILLNNKTGMSERVKEMFSLSAIVILFSVAMTSTFFDGDQLADIAKIIGVGVAGVLTWKKKPFILVVLSAAIITAMLRWIATLWG

SEQ ID NO: 4244 - protein, 175 aa, Proteus mirabilis
NKGDEMNDNDINKAIREQLIKQLIKTDINAEVITGYQPEEITDNNIIMFFPIKEVSQGWQKRSYDVQGNNANHTEQQLVELTYQVQSFTKKQSDFTAGDLIRTTRMIIHSLPFIESMRKKGIGIQRATEIRRAPIINEGNSYEHNPSFDFNVTFPSSLSLNTAATHLLISNLSRI

SEQ ID NO: 4245 - protein, 252 aa, Proteus mirabilis
VILETNMDLGKRKFLQQLGVLTAGASLVPLSQAGIKLSPERREGSEDKRYGMLIDLRRCVGCQSCTVSCTIENQTPQGQFRTTVNQYQVAIKGQEGITNVLLPRLCNHCDEPPCVPVCPVQATFQRKDGIVVIDNERCVGCAYCVQACPYDARFINHSTQTADKCTFCAHRLEVGLLPACVESCVGGARIIGDMKDPHSTISKMIREHEHELKVLKPESGTLPQVFYLGLDDAFVQPLVGQGQPALWQEVHS

SEQ ID NO: 4246 - protein, 235 aa, Proteus mirabilis
GFMELLTQFADLIKFLIDFILHIDVHLAELVAQYGTWVYAILFLIIFCETGLVVTPFLPGDSLLFVAGALSALDTNDVNVHLMVLLLLFAAILGDAVNYSIGRIFGEKLFSNPNSRIFKREYLDKTHAFYEKHGGKAIILARFVPIVRTFAPFVAGMGKMSYRHFAFYNVTGAIAWVLLFTYAGYFFGDLDIVQKNLKLLIVAIIVISILPGVIEVIRHRRASAKAKKESDNQEV

SEQ ID NO: 4247 - protein, 192 aa, Proteus mirabilis
FLKETMMSSPSAPIEIISQSIARERKKAGLSLAEIARRAGIAKSTLSQLEAGQGNPSIETLWAICVALNIPFSQLISSPKPEVKVIRKGDGFKISAEKAYYHAFLLSSCPNGAKRDIYTVIAQPGKDRVSDPHSKNVTEHILIISGRAIVGTLDNQQELSPGDYICYPGDVTHVLRALEPDTTAVMIIEHHN

SEQ ID NO: 4248 - protein, 316 aa, Proteus mirabilis
PSGLKIDVRIMKSVIFPLLAVLIWSINAVVNKAATSVIDPAAISFYRWFLAFLLMTPFLLVPVWHHRKTVKQYWWKLFILGALGMGLYQSLAYYAAYYVTATFMGILNSLIPLLTVIISIFVLRVVPTVGIALGTILSISGLVWLVSHGDPSQLLSQGLGRGELMMFIASTAYAFYGVLTKRWSIPLPNWQSLYVQIGFGVLLLIPNFLTAESIALTKDNVGLVIFAGVGASILAPYLWILGVMKLGANTTSIFMNLIPLFTAMIAVAVLGEEMHSYHFIGGGVILLGIFLVQKLRAPLNFRRQSVTKKADCQQEM

SEQ ID NO: 4249 - protein, 897 aa, Proteus mirabilis
MRTLTQLKPNTLTRLYALFLLFMAISLFLYAYSYFDTWLESKKNAINNTTNKFASQVEDYRYHANQLFQLSNKINDPTLFLPLKINPVKLRSDVYWLEGRDQTVDAIVFGKSNEQTFQLTGYFANALEIIWGVRNNYSSLYYLNGKGNDLILITTHSILKPELRYKESYLTLTAENKRSELLMQSTALDEKESLSPIRKMPTENIYYYTYRTMFNVPGQLTSVIAFDLPINNFLPAELSPQYLRLLPTGQQSVYDKNNIEVSTDGTSLIFSQPIAGIPYSLSYEYPLKSIFNEIVYKNIWLLISLLIFISISVFGHIYIRNKYVFPYISMTRNLRIKEEMTNDIISNLPIGLLVYNFSSNHKIISNSHAEKLLPHIDLSKIRQMAIEHNGLIQTAIDNEIYEIRTSSNSNIDNTALFIFLNKDNEALINKKLQLAQQEYEKNTIARRKILSNMSLELIRPIKDINEMVYQFKDLLPNDTHQQLLSLLLEKTNYISEWIENITLINKLENQEWKIHQDEFELSTLVESILITASPFMIRKGLTLYFHNNIKPSLLLFNDGPALSKIILSLINYAISTTNYGKITVNLNLEKNNDKEEIVIDIIDSGSGLTAQDLANIKYPFLGQAMGDKYYSNSGIIFYLCHLLCNKIQGTLTITSQESIGSHFRIVLPYQHIDTEERSFDILLEGITAKLAIKNPEIEKIICQQLDKYGATYFDKNKENLYSEYDIILRDTPDNNPESATVLLVSSITGFEKIARNLIKCNYNFGDPLIEAITYLIEENEQLSLETTQTSIRNENNNLDHHEVILNNYRKKLNDSDYKELFINTVPIDVEKLHLEATNKDFHSLAQTAHRLKGVFAMLDLEYLRENCEYLEDDIKNHNELEIKERINQLDKWIRQLL

SEQ ID NO: 4250 - protein, 251 aa, Proteus mirabilis
LITLSFIFYYIAQTLFAFYTFLKHILIGVIMNILLVEDDLQLGKALCRGLEIAGFQPCWVRLLADARVQLNQKAFDLMLLDLGLPDGDGQDELIALRKSGEKIPIIILTARTQIDNLVQTLDSGADDFLPKPFAMPELISRVKAVSRRMAGFSSQIWSIGDLQLNPSNHQVTLNGELLLLSGKEYQLLYELMRNTDNVVRKSDLEQRLFGLDDKIESNSLEVHMHNLRRKIGKERIITVRGIGYLLKKEVN

SEQ ID NO: 4251 - protein, 106 aa, Proteus mirabilis
HFFCWETKMADAINRCNAEETAACCCVDVGTIIDNKNCTASYQHVFADKAQAEAMLNELTAKANATASEPCQIKHQFADVEGGVQLTADFTFSCEAENLIFQLGLR

SEQ ID NO: 4252 - protein, 267 aa, Proteus mirabilis
MILWLISFGLISGITTWLFGFGGGFVTVPLLYTLILTLWAGDSLAGEHAMQIAVATSALIMLFSAIITTLKHHKAKKIDWKLIMILFWGIAFGGIFGALLASSVQGEWIRWIFIGYLFLTILDCYFRPGFMAPRKEIQKVTNKKEALTGTIIGIIAAFLGVGGSVMTVPLLRRRGMSMTQSAAMANTLTFPLALTATLTYILLSFTTPLGDSAGFVGYIWIKAAVILICSTWIGLKIAERFLSRIPDKWHARVYPLLLILVLVVMLN

SEQ ID NO: 4253 - protein, 221 aa, Proteus mirabilis
WNYWKRRVRVASKFQNRLVGAVVLVAVGVIFLPTLFDGDKKYNEDQFASIPLVPKPGDEQDIESIAPIEQTTTPSTPSEGASEAMISEAVTGVEQPQVSTPEVSEPQVAPSTPVVEPPKVVNPPVEPPTTPPPAVSETTAPKGEAWVVQLGALKNAAKVEEIIAKMHLSGYPVYTVPVRPVSGKVTRIYIGPNASKAELQAMLPRLKELTGLQGEVRAYKP

SEQ ID NO: 4254 - protein, 100 aa, Proteus mirabilis
NRELALYIMASHKVTLHQQGLSTALEFSSETHPSLLETLERSKIQIEYQCREGYCGSCRLRLVKGKVCYRNEPLAFIQADEILPCSCHPVSDIEIEICTK

SEQ ID NO: 4255 - protein, 514 aa, Proteus mirabilis
GTHCAMLLPWLILIPFIGGLLSWQAERIGSQVPRWVALLTMGLTLVISVQLWLQGDYQLISVDGAPRWTEFYFVPWIPALGINIQFALDGMSLLMVVLTAILGILAVLSSWSENQPSQGAFHFNLLWILAGVMGVFLATDLFLFFFFWEMMLIPMYFLISLWGHKGSSDEKHVSAATKFFIYTQASGLLMLLAIIGLAVAFYSKTGIWTFNYDTLLQAHTLLGSELQFILMLGFFAAFAVKMPIVPVHGWLADAHAEAPTAGSVDLSGILLKTAAYGLLRFNLPLFPEASALLAPVAMWLGLITVFYAALLAFRQTDIKRLAAYSSISHMGFIVIAIYAGSVLAYQGAIIQMITNGLSAAGLFIMCGMLYERLGTRDMNQMGGLWKSIRFLPAFSLFFAVASLGMPGTGNFVGEFMILFGTYGHFKLITIISVFGLVFASVYALWMMQQAYYGSPKTAERTYKGLNLREFLILFILVVLLVILGFFPQPVLDTSISAMENLQTWYSASLSTVRL

SEQ ID NO: 4256 - protein, 345 aa, Proteus mirabilis
TFYCIGGYFMGEGWNIALVGATGAVGEAILELLQERDFPIGELTAIASEDSIGKTIRVKGKSVAVQGIHNIEWADIQLAFFAAPVEISAQYAQLAADSGCIVIDCSGLFAMEWDVPLVVPGVNTSMLAEYRNRNIIAIADSMVSQLLRAIYPLTEAAGLTRLNVTNLMSVSRFGKQAVDELAGQSARLLNGVPPELGRFNKQLAFNILPLLVDNEGSIQEERQMVDQIRKILQDDGLPISVTTLQAPVFYGHAQSVQLETSRPMGSEEARETLQEHDSLNISDENDFPTQVTDASGNVSLNLGCLRNDYGVPEALQFWSVADNVRFGGALMAVEVAEKLVQEQFY

SEQ ID NO: 4257 - protein, 356 aa, Proteus mirabilis
CCLWHFSGGIYPNEGNAMNKYLTENKSIVLTGDRITGPLHLGHYIGSLQQRVEFQNKATQYILMADMQGLTDNGSTPEKVSKFLFDVVADYLAVGIDPKLSTLCLQSALPALSELTMLYLNIVTVSRLERNPTVKHEILQKNLSRSLPAGFLTYPVSQAADITAFSADIVPAGEDQLPMIEQTNEIVTKINSLIGQPVLTSCKVVVGQVGRLPGTDGSGKMSKSLGNTINLSSTADEIKKAVYSMYTDPQHIDVASPGHIEGNVVFTYLDAFCQDKATVTAMKAHYQRGGLGDMKCKAMLNDILQELLQPIREKRAQLINDKAYLLQVIKEGSDKAKEVTQQKLDEVKRGLGLLIL

SEQ ID NO: 4258 - protein, 919 aa, Proteus mirabilis
RLQCRPLGSMLTMATIHVDGKEYEVNGADNLLEACLNLGLDIPYFCWHPALGSVGACRQCAVKQYQNAEDTRGRLVMSCMTPAADGTFISIDDEEAKKFRESVVEWYMTNHPHDCPVCEEGGNCHLQDMTVMTGHTMRRYRFTKRTHRNQELGPFISHEMNRCIACYRCVRYYKDYADGTDLGVFGAHNNVFFGRVEDGTLESEFSGNLVEICPTGVFTDKTHSSRYNRKWDMQFAPSICQGCSMGCNISPGERYGELRRIENRYNGTVNRYFLCDRGRFGYGYVNLASRPRQPKKRLGSNWLEISAAQATQAAAEMLKKGQRVVGIGSPRASIESNFALREVVGAENFYSGISAAEQARLTLMLDILQKGGVYTPSLREIEDYDAVLVLGEDLTQTGARMALSVRQAVKGKAREMAAAQKVADWQIAAIMNIGQRAKYPLFVTHVDETRLDDVAAWSYRAPVVEQARLGFAIAHHINGEAPAVDGLDEALNKQIDMIVQALSQAKKPLIISGSHAGSEEVIKAAANIAFALKAKGSEVGLSYVADDANSMGLAMMKAKPLDDALKVMRSGQADSAIVMENDLYRHFAADVIDDAIAKVDHLIVIDHQQTEIMEKAHLVLPASSFAESDGTMVSQEGRAQRYFQVFEPSFYNKEVVMHESWRWLSAVDSQWHEGNLDWTQLDHVIELCATRLPQFAGIVNAAPNASFRIRGQKLAREPHRYSGRTSMLANVSVHEQRQPKDIDSPFAFSMEGNNSPTAPRQQIPFAWAPGWNSPQAWNKFQSEVGGSLRFGDPGVRLIECSDNTLGYFTDIPPAFNLVENQWVVAPYYRLFGSEELSQRSQVIQQRMDNAYLTVSESDAIALALSQGQQAMFTYEGREFTLPVKISAHLTRGQIGLPLGMAGISPSLVGVSVRQLRGIA

SEQ ID NO: 4259 - protein, 63 aa, Proteus mirabilis
PERCIFAIISSTFAAFFKAPNCTTQASPFGAVVSDTAGGGVVGGSTGGLTTLGGSTTGVDGAT

SEQ ID NO: 4260 - protein, 211 aa, Proteus mirabilis
RSLLKTLKLLRKMENNMGSYKSKNITLYNYPELKINVLRWWESLFLSPNELSKKGILPAPNRYKSELKRCDSITAIMLTEGFRALWLSFPVDLINNATTEDIERWAIIVAILVYITQDSEKHFATIAGEKDESKKSCISESRFLQLQSSRTYDEFIRRLRRILIQIKGKSSVLSMCKDIEKWVLEKQRFSSIQTNKQIIIEWAMKYYQAAI

SEQ ID NO: 4261 - protein, 112 aa, Proteus mirabilis
RSRRKRKSRGAKMIPLQHGLILAAVLFVLGFTCLVLRRNLLFMLIGLEIMINSAALAFVVGGSYWGQTDGQIMYILAISLAAAEASIGLALLLQLHRHRQNLNIDTVSEMRG

SEQ ID NO: 4262 - protein, 467 aa, Proteus mirabilis
MKIRSFFIYTIFLQTISIVMLWGVWLAWIEFDYLADFETIYNKQQEIIAEGFANTLETVSSQPETVKQIAHHLQNMYIDTMLNGEDDDLHYLPWFIVLNKDNDLIYTNRPELSLPKRVLSLASEKISVAGEKWYLSYSWGKQHKIKVFIGESVEDRGHVIGNPISGTFVPFLFILATVILAILITAYFSLRPLRQAAELISNRKPRNLTPINVGQQFKEIRPIFKELNQLMARIDAANIREKQFMADAAHELRTPIAAVIAQLHILSLVDEKQEREEIIEDMKQSLDRAAALSHQLIDLARLECDDFPIKIESFDVYNIIGNAIAQRVPYALTKNIELSLNEGMSLKIETDKQALLSIFNNLLDNAIKYCPNNSQVEVTIEHKDTHHLNIILRDNGPGIAPEYISSLFSRFYRVPGSQGTGSGLGLSIAQNLAEKIQATISITEGLHNKGIGFIITLPLKIKPLDNE

SEQ ID NO: 4263 - protein, 413 aa, Proteus mirabilis
SHTRLGKRAMNQIKKSSKLDHVCYDIRGPVLQEAKRLEEEGNKVLKLNIGNPAPFGFEAPDEILVDVIRNLPSSQGYSDSKGLFSARKAIMQHYQARDMRDVTVEDIYIGNGVSELIVQAMQALLNDGDEMLVPAPDYPLWTAAVSLSGGNAVHYMCDEQQGWFPDLDDIRRKISPRTRGIVIINPNNPTGAVYSKEILLEIVEIARQHNLIIFADEIYDKILYDDAQHHSIAAMAPDLLTVTFNGLSKTYRVAGFRQGWMVLNGPKKQAKGYIEGLNMLASMRLCANVPMQHAIQTALGGYQSISEFILPGGRLYEQRNRAWELINQIPGVSCVKPMGALYMFPKIDLNRYSIKDDQKMILDLLLQEKVLLVQGTAFNWPHPDHFRIVTLPRENDLEMAIQKFGRFIVGYHQ

SEQ ID NO: 4264 - protein, 226 aa, Proteus mirabilis
YITRIDIKLCYLYFNNLKIDITRKLLVKILIIDECYFTRNGIRHFFLKKNVRHEIIDMSSIEEANHYINNSMPDIIFIDLTKYCREVAHCQHLQYFFSLTQECRLYLYIDANYPDKDRPIALTNNCFILAKRVLPWVLERTSTLTSRCQVFFPTYKHSLCSIFSIQEQKIINYWMGELPNYQIAKKLKISNSTVYSHKRHITEKINVKNRIELFFIYNILKYIYEK

SEQ ID NO: 4265 - protein, 454 aa, Proteus mirabilis
VMNRKNLFTRTALAAIVGTLSSYASAAGFQLNEYSTSALGRAFSGEGVIADDASVGSRNPAALTMFDRPEFSVGAIHINPSVDIKGKSPLSGASTNAGDIAPSALVPNIHFVAPINDKWAIGASGTTNFGLATDFKKDYPAGLIGGKTDLKTMNLNLSAGYRVNKQFSVGLGLNALYADAEITRHVGEAGKLLGGTLSQHPDTNYQGLGRYLSSLSPSDRFAQLKGDAWGFGWNAGLLYEFDEDNRISFTYRSKVKVKFKDGDYQSDIRSLPALEGMGVIGTNGDTIKGKLDLNLPEIWEFAAYHRVAPKWAVHYNLAYTSWSEFKELRATRKSDGQQLFNKEEGFRDAWRIALGTTYYHDDNWTFRTGIAFDDSPVPADKRSISIPDQDRFWLSAGATYAFNKDMSVDVGLAYMHGKKVTIKEKLSESLPLPAYEFESSGKAWLYGMNFNYRF

SEQ ID NO: 4266 - protein, 82 aa, Proteus mirabilis
PVNRIVIVVVLPCWQMFQYMNSVNRKISIAHLLSLWKETTAQRLLASKFHLHGHRVGTHHKHGISSSLKSGEAYVLVIRVYA

SEQ ID NO: 4267 - protein, 745 aa, Proteus mirabilis
PPDRLSFLMYCQCYAGSTVSHNEQPIFKEVSVSRTIMLVPTDTRVGLTSVSLGVIRSMEQKGVRLSVFKPIAQPRVKGALDQTTAIIRSHSTIQSAEPLNMDYVESLLSSNKKDVLMEEIVARYHENTADAEVVLIEGLVPMRKHPFAQSLNYEIAKTLGAEIVFVTALGNNTAEQLKERIEFARAEFGGVKNQNITGVIVNKLNAPVDDQGRTRPDLSEIFDDSSKAIISNVDLNTIEKNSPLPLLGCIPWNFDLIATRATDMAKHLNATIINKGDIETRRIKSVTFCARSIPHMLEHFRPGSLLVTSADRPDVLVSACLAAMNGVEIGAILLTGGYQIDAPIKQLCERAFETGLPIFMVNSNTWQTSLNLQSFSLEVPADDHERIEKIQNYVAQHINNQWIDSLTANSERPNRLSPPAFRYQLTELARKAKKRIVLPEGDEPRTVKAASICAERGIATCVLLGDPEEIRRVAAAQGVELGTGIELVNPKEVREIYVPRLVELRKNKGMTEVVAREQLEDNVVLGTLMLEKGVVDGLVSGAVHTTANTIRPPLQLIKTAPGSSLVSSVFFMLLPEQVYVYGDCAINPDPTAEQLAEIAIQSADSAKAFGIDPRVAMISYSTGNSGAGSDVEKVREATRLAQEKRPDLIIDGPLQYDAAVMADVAKSKAPNSPVAGKATVFIFPDLNTGNTTYKAVQRSADLVSIGPMLQGMRKPVNDLSRGALVDDIVYTVALTAIQASQQENA

SEQ ID NO: 4268 - protein, 406 aa, Proteus mirabilis
GCSLRFIHPCYFLMFTIPQIGEDVMEKKKLTTAAGAPVVDNNNVITAGPRGPMLLQDVWFLEKLAHFDREVIPERRMHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITY

SEQ ID NO: 4269 - protein, 325 aa, Proteus mirabilis
PIMRNAKLYSFSLPMEAGVVLRYQRLKTRDGFLVCLEQNGKQGWGEISPLPEFSHETLEQAQDAAQSWLAAWCLGENPTDSELPSVAFGISCALAELEGTLPEEANYRAAPLCNGDPDDLILSLNEMSGEKVAKVKVGLYEAVRDGIVVNLLLEAIPDLKLRLDANRSWTPAKAEGFAKYVNPQWRDRIAFLEEPCKTPEESLAFSQVTGINIAWDETVRDEDFEVKAQEGVTAIVIKPTLVGSLARCQSIVEQAHALGLEAIISSSIESSFGLTQLARVAQWLTPDSIPGLDTVDLIKQQLIRCWPDVDIPLITLEQLKTVWQQ

SEQ ID NO: 4270 - protein, 128 aa, Proteus mirabilis
YYIFSYIINDGPHYYKLDINQSEKREHIMSNKYPVAYAVGQKIKSLRKSQGYTVFQLAKEIDISEQQLFRYERGVNRIDIDCLVKVLDVLGINIGNFFEDVMGGMVDVPENNEQHIPAHFDNKALSIF

SEQ ID NO: 4271 - protein, 410 aa, Proteus mirabilis
NIRRIYAQYMEDLHYMADYRYINNKGVIVPDTAALRKEVEDEFRTVFGQSINLSPETPQGVLATMEIENRDAIVRNNAELANQINPDIAGGIFLDAIWALMGGERINATHSYLSDVEFMGVPGTIIPKGSQALTINGAVFETLTSLIIADTGKITGDMRAKEYGPITCGIGQLNKVASSVLGWEKVNNTTHAIIGRYAESDIKARRRRKQTLAKNTISVAQAITSSLYELAGVNSLSFRENFTDKTLTIDGISLLPHSIYVCVEGGDSHEIANVLLRTKTIGAAFNGDIEINLLEPASGQAYPIKFSRPKEVTIFCKVTVKKSSFDAQTIIPDALEKWSHGEIEGDNGLVVGRDVSPFEISAAVNAVEPHLFVTKVELSTDGKNWHVALIPIAINQIARLPKGAIQVVMV

SEQ ID NO: 4272 - protein, 777 aa, Proteus mirabilis
RGASGVQGEIMSLLPVFSQVLTLDAEVSDNALNNIRKSTNEILEEMKKIEQGASAGINRFFAFVQEIAASFNELSLEPEINLSVDNQEIIQASETVENSIQQIVKTALSSTQEFDTFLQNILTGLTSLSLDEPINIEINSGETQEKIHSITSSIDALKDAMSVLNYTRNLLSNDVDSDASHLANLNAEYQAMEDQLASLNNELTLLTEAEKKNKENKLVIDEVIKNLGADYDQFISTMQTQGIKAAIEEAQAQRRLSSSVDETGKSYQQTVDKMKDFILNAIGATDIMGTLQKVFSASLERSQEIESLDKLSKKMGVAAIDIDAFSGAMAAIGGTKEAAQADLAAMATAFDDTQDPIEQLLQVADNVKNMSFDDAQKELEKLGVVDDKTIELMMKGRQELERTMGVQKQFSGINDDSIESAIQLNATIHKFSQLAAQFKNNFLDMIIPTLAKGMEWFDKLVDFCVKNKDIVISFFSAIGAAVAIYYLPVMISAAASTLAMALPIIAIATVIGLLGVAFKLVYDDIMNFINGNDSMIGRILEKYPVLKSVIMTIWQAWQSFFEYLKEAVTVVADFVIAAWDLISNSFNQFIQTLEIGINNFIAWGQSIIDIFIFVSDSVVSLFEWMWGCVEKILDFVDEKINLIQDIWQSAKSFFGMDDEEKEIRVVQKVERRLTNEGELDYILPQSQTATRYYSPMQEVKSLNNGLAISSNNSLNPMTSQMISNQSSIKNESNVQIGEIKIETQATNGAEVVKEIKKSYTEQEAKNISQNHSSGWRV

SEQ ID NO: 4273 - protein, 110 aa, Proteus mirabilis
IYYRRPLPPIILVKTISYAYPHKVAIQRSIAVIIAALNTTKIKGFFFQVKTPATPTPIILAISASWSPSKKVDVIATENKITIAESENISLTRSDIPVLLFNKIPEMRMA

SEQ ID NO: 4274 - protein, 169 aa, Proteus mirabilis
QQNRFILIMQIFIMRHGEATFDAPSDALRSLTERGEYESLTMANWMTQQEHSIDYVLVSPYLRAQQTLNVVQQGLVLPAKIETDEGLIPGGNPDHIAHYLRALGEVGYHNILVISHLPLVGYVVAELCPTVSAPMFSTSTIACVNFDLSTGSGKLLWQVSPANLKQITE

SEQ ID NO: 4275 - protein, 684 aa, Proteus mirabilis
NTGSSVNNTAINTASLSWNELGTPISKQFDDIYFSNQDGLKETRHVFLHGNHFPSRFGTHVRSECVIAETGFGTGLNFLTLWQAFEQFRHHSPDASLKRLHYVSFEKFPLTKADLQTAHSHWPELAQYSTALCAQWPLPIAGCHRLILANGAITLDLWFGDINTLLPQTRQALHNKVDAWFLDGFAPSKNPQMWSETLFQAMADSMRENGTFATFTAAGIVKRGLQHVGFEIKKIKGFGQKREMLTGVFPHPPANAFVPYYARPCATQTKDIAIIGGGIASALTALACLKRGAKVTLYCEDTHPAANASGNRQGVLYPLLNGKSDELEHFFTSAFLYARRYYDELNHNGVNFSHQWSGVAQVIYNEKVRKKIARIIEHSTPFSQLAHYVHQDEMNSLCGLAINQDGLFYPQAGWLSPTELTTNALKYAQQQGLKLLFEHQVTQLTSQQQHWQLEVTHQATTYKTQHDCVILANGHRITDFIQSEKLPISAVRGQVSHISTTPDIAQLKAVLCYDGYFTPVDPQDNLHCVGASFRRDRLDLNVSIEEQQNNQWHLTHCLAQSPWAQQVDFSDNDARVGIRCTIRDHLPLLGEVPDFEKLVVAYTHLDRFKRRKQTPILAPSYHQLYIISALGSRGLCSAPLSAEILASQIFDEPFPVEDSVLNALHPNRFWVRPLLRGKAIELKS

SEQ ID NO: 4276 - protein, 266 aa, Proteus mirabilis
MDWLFSDGIYLLLFFVAVLAGFIDSIAGGGGLITIPALLSAGISPVQALATNKLQSVGGSFSATLYFIRRRVIDLKAQRFAIFMTFIGAVSGAMLVQFINPELLKQALPVLTIAIGLYFLLTPSIGAKDSKQRLGYYTFGVIIGGGIGFYDGVFGPGTGSFFALGYVMLLGYNLSKATAHAKLLNFTSNFGSLLFFMLGGQVIWTIGLVMLCGQFIGARLGAGLVLTKGQKLIRPMLVIISFLMSIKLIHDNHGDTIALWFSALFN

SEQ ID NO: 4277 - protein, 78 aa, Proteus mirabilis
KNCSNCTLILLKKQTKKKKFSTNVISNWCFFSIYFIIDRIFYLSNIQQAYNNFSCFTVAFATVSLFNTLTLFFKLYPF

SEQ ID NO: 4278 - protein, 317 aa, Proteus mirabilis
IDRLMIKSPPFKTSFLQPKYWLTWLGIGLLYLLVLLPYPVIYWLGTRLGRLSKVFLKKRVQIAERNLELCFPDMPKNEREALVNKNFESVGMGLFETGMAWFWPDWRVKRWFKISGRENIQKVQETGQGIIVVGIHFLTLELGARIFGMLNPGIGVYRPNDNPVMDWLQTWGRLRSNKFMLDRKDVKGMIRNLKAGEILWYAPDHDYGPRKSVFAPLFAVDKAATTTGTYILVKTSHPALIPFTPKRLPEAKGYELIISPAVADFPIDSEENTAIAMNKVVEQEILRAPDQYMWLHRRFKTRPPGEASLYNEIKKVH

SEQ ID NO: 4279 - protein, 200 aa, Proteus mirabilis
SGLRKKITMNSNSKQFVMLHDEKRCIGCQACTVACKVINDIPEGYSRLQVQIQGPHNDEAGDPHYQFFRVSCQHCEDAPCVSVCPTGASFIDENGIVQVKKELCIGCDYCVGACPYHVRYINPLTHIADKCNFCADTRLTEGELPACVTVCPTDALAFGRIDSPEIQAWIKQKSVYQYQLDNVGKPNLFRRKEIHQGDKA

SEQ ID NO: 4280 - protein, 64 aa, Proteus mirabilis
LQLSYKLIEISSHQHALSIIPENAKYALGSQRSNIKTSCNVDTFLTFTVSDFFVENKANIWKKL

SEQ ID NO: 4281 - protein, 68 aa, Proteus mirabilis
PVPRVKLTGCVVMLSVILSGCTSEPVVQKTTPIPPPAWMMQPAPDLLTPLSEIIGYSEKELLSQSPSS

SEQ ID NO: 4282 - protein, 256 aa, Proteus mirabilis
SMTSIWGAELYYTPDYWPVWLIAAGLIIVAMIAILVLHGFLRYALAPKQSGHYEEERVYLYSKAIRFWHWGNALLFILLLISGLLGHFSIGNVPSMVLLHKICGFILIAFWIGFVVINLTTNNGVHYKVRPQGLIGRCIKQARFYLYGIMKGEPHPFAATATDKFNPLQQLAYLGVMFGLVPLLLITGVLCLYPEVLGYGYWMLKVHFILGIVALMFICAHFYLCTLGDTFTQTFHSMIDGHHRHQKHGESTTTKN

SEQ ID NO: 4283 - protein, 442 aa, Proteus mirabilis
EFILSGVVMKSSASSTIKDRVAIVSGLRLPFAKQATAYRGIPAVELGRSVVQELVIRNEIPPEIIDQLVFGQVVQMPAAPNIAREIVLGAGLSVKTDAYSVTRACATSFQAIANVAESMLAGHVSVGIAGGADSSSVLPIGVSKKLADVLLSLSKAKTLGQRLSYLSQLRFGDLLPVAPAVAEYSTGLRMGDTAEQMAKTYHISRVAQDELAHRSHQLAAKAWEMGKLNDEVMTAFFPPYKSGFHQDNNIRKNSVLDSYAKLKPAFDRRHGSVTAANSTPLTDGAAAVLMMKESVAKSLGYQPLGYLRSYAFTAIDVWKDMLLGPSYATPLALSRAGLTLSDLTLIDMHEAFAAQTLSNLTLFASDKFAQEQLGLSKAIGEVDMDKFNVLGGSIAYGHPFAATGARMVTQTLHELKRRGGGFGLTTACAAGGLGAAMILEVE

SEQ ID NO: 4284 - protein, 218 aa, Proteus mirabilis
FIASHSMNTKHWSRVEYLHETVKNKNIIIKGQHSYYSDCWDNGFEASVVRYLYGDEFSLQWEPLWEIDKLYIGDYVCIGAEAVILMGGNHTHRMDWFSLYPFLDNIKEAYIGKGDTYIHDGVWIGMRAMIMPGVTIGEGAIIAANSVVTKDVAPYSIVGGIPAKHVKYRFEPKVIEQLLSLNIYSWSEKKFAALKPYLCQASIDKLLTAHTQYNQDMK

SEQ ID NO: 4285 - protein, 356 aa, Proteus mirabilis
DTRSRYMTTAQPITLTIRRPDDWHVHFRDDDMLKTVVPYTSRYFGRAIVMPNLVPPITTIEAARRYRDRIKAAIPSGDKFEPLMTCYLTDSTLPSEVEQGFLQGVFTACKLYPANATTNSSHGVSDINKIYPILSVMEKIGMPLLIHGEVTASDIDIFDREARFIDNVMAPVRKQFPALKIVFEHITTKEAAQYVLEGNEFLGATITPQHLMFNRNHMLVGGVKPHLYCLPILKRNVHQEALRQAVASGHSRFFLGTDSAPHLQHRKESSCGCAGVFNAPTALAAYASVFKELNALSHFEAFCSLNGPRFYGLPVNEGTITLTEKSVTAPAEIMSGDEALIPFLANEDIHWDISVN

SEQ ID NO: 4286 - protein, 461 aa, Proteus mirabilis
NVTGAVSMTAISGAKPIIRSAETHPLTWRLRDDRQPVWLDEYRAKNGYKAAEKALKSMAPDEVTSEVKDAGLKGRGGAGFSTGLKWSLMPKDESMNIRYILCNADEMEPGTYKDRLLMEELPHLLIEGMIIGAHALKAYRGYIFLRGEYIEAAKHLRHAIEEAKAAGFLGKNIFGSGIDFELFVHTGAGRYICGEETALINSLEGRRANPRSKPPFPATSGAWGKPTCVNNVETLCNVPAIIEHGKDWYIGLSAGKSPDAGTKLMGFSGRVKYPGLWELPFGTTAREILEDYAGGMRDGLKLKAWQPGGAGTDFLTEDHLDLPMDFGTIAKAGSRLGTALAMAVDNEINMVSLTRNLEEFFARESCGWCTPCRDGLPWSVEILRAIEKGQGRPGDIETLEHLCRSLSPGHTFCAHAPGAVEPLQSAIKYFREEFEAGIIQEDYTNANLIRGIQPNLLKSRW

SEQ ID NO: 4287 - protein, 765 aa, Proteus mirabilis
EETGGYMSISRRSFIKGMGIGCVGCTVGSLPPGALALNPVTSLKGQSKLTPSLCEMCSYRCPIEAQVVNNKTVFIQGNRNSPHQKTRVCARGGSGVSLIYDPKRIVKPMKRKGPRGAGEWEVISWEQAYTEIAEKMASIKQHYGAESIFFSSKSGSLSSHLFHLAAAFGSPNTFTHASTCPAGKAIAASVMMGGDLKMDLANSKYILSFGHNLYEGIEVAETYELMTAQERGAKLVSFDPRLSVVSSKANEWFAIRPGGDLPVLMAMCHIMVKENLYDKDFIEKFTVGFPQLVEVLQDTTPEWAQAHSDVPAKDIIRITREIAAKAPHALVMPGHRATFNKDEINMRRMIFTFNALLGNIEREGGMYQKKAAAKYNKLAGIDVAPELAKPTVKGMPKITAKRVDATAPQFKYINKGGGIVQSIIDSTLHGVPYQTKAWIMSRHNPFQTVSCRPDLEKTAQKLDLIVSCDVYLSESASYADYLLPESTYLERDEEISDVSGLNPAYALRQQVVEPIGDTKPSWLIWMELGKKLGLASYYPWENMGVRQLYQVKGDENLYKEIHQKGYLSYGIPLLLREPSYVKAFVEQYPDAIKHVDSNNMMEKSLSFKSPSGLIEIYSEELESLLENYGIPRFHNFPLKQKDELYFIQGKVAVHTNGATQYVPLLAELMWKNPVWLHPDTAKSHGIKHGDEIILENSVGKEKAHALITTGIRPDTVFVYMGSGSKTGEKTPATTNGIHCSSLLPHEISPVSGTDVHTSGVKISLA

SEQ ID NO: 4288 - protein, 63 aa, Proteus mirabilis
PINGQPEILYRKKALPMTNIAKESCGVKFKETQYIGVCSNGDNKIMVIEGLIKCTNLNVSVDK

SEQ ID NO: 4289 - protein, 101 aa, Proteus mirabilis
PNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 4290 - protein, 263 aa, Proteus mirabilis
ITKGNVMNSVTSQLQEFDCNQFFHTIKSIRKITSELFEHDNILNHNLITISINNNKIYDEIIIFSILLKSRLNQKLLTGIFKNINEINHAMADRELTQQLSEKLLQEKMFIEQLFKDELTESIEIIEKHISFINDKKQLLTTTTIISEIDKLIRNKEEISIEINEKIAKQKLSINEIKEQLDIITKSEDIIYNKNILDFFTSHLPSKQTISKLQLASSEKDILSVFIDLLKQFFTHLEKGFSYQKLVETRHTLIDNYLIQIKI

SEQ ID NO: 4291 - protein, 770 aa, Proteus mirabilis
SQKGASLMNHSLLVTKRDGHKERIDLDKIHRVITWAAEGLENVSVSQVELRSQIQFYDGIKTADIHETLVKAAADLISGETPDYQYLAARLAVFNLRKKAYGQFEPPALYDHVKHLVELGKYDRHLLEDYTKEEFEQMDKFIVHQRDMNFSYAAVKQLEGKYFVQNRITGDIYESAQFLYVLVAACLFSRYPKETRMDYIERFYNAVSTFKISLPTPIMAGVRTPTRQFSSCVLIECDDSLDSINATSSAIVKYVSQRAGIGINAGRIRALGSAIRNGEAFHTGCIPFYKHFQTAVKSCSQGGVRGGAATLFYPLWHLEVESLLVLKNNRGVEDNRVRHLDYGVQLNKLMYERLIKGQDITLFSPSDVPGLYDAFFADQDEFERLYVQYEKDKSIRQKQVKAVELFSLMMQERASTGRIYIQNVDHCNTHSPFDPAIAPIRQSNLCLEIALPTKPLNDIKDPNGEIALCTLSAFNLGAIENLDDLEELARLAVRALDALLDYQDYPILAAKKGAMGRRTLGIGVINFAYYLAKHGVRYSDGSANNLTHRAFEAIQYYLLKASNELAKEQGACPWFNETTYAEGILPIDTYKKSLDVLTNEPLHYDWESLRKEIKQYGLRNSTLSALMPSETSSQISNATNGIEPPRGYISIKASKDGILRQVVPEYERLKGAYELLWQMPSIEGYLQLVGIMQKFVDQAISANTNYDPTRFPSGKVPMNQLLKDLLLAYKYGVKTLYYHNTRDGAEDVQGDLEEVVETADSDCEGGACKI

SEQ ID NO: 4292 - protein, 362 aa, Proteus mirabilis
GMAGNSIGQLFRVTTFGESHGTALGCIVDGVPPGLPLTQADLQVDLDRRKPGTSRYTTQRREPDQVRILSGVFNGVTTGTSIGLLIENTDQRSQDYSEIKDVFRPGHADYTYEQKYGLRDYRGGGRSSARETAMRVAAGAIAKKYLKQKFGIEVKGYLSQLGPISCELVDWSIVETNPFFCPDPSRLDALDEYMRALKKEGNSIGAKVTVVAEGVPAGLGEPVFDRLDADLAHALMSINAVKGVEIGDGFDVVTLKGTENRDEITKEGFSSNHAGGVLGGISSGQPIIAHIALKPTSSITIAGKTLNRQGEEVDMITKGRHDPCVGIRAVPIAEAMMAIVLLDHALRQRGQCGDVIPPLMQW

SEQ ID NO: 4293 - protein, 101 aa, Proteus mirabilis
ITKGNMMKITVVCGNGLGSSLMMEMSIKSILKDLAVNADVDHVDLGSAKGTPSDIYVGTRDIAEQLNAQAVNGKIVSLDNMIDKVAMKEKLSTALRELGAL

SEQ ID NO: 4294 - protein, 170 aa, Proteus mirabilis
WLEGVVMITEVRIFDLASFTTLFDSVNPTQVTIDDSHQAITFTVENGESRSDHVVINPISISISLLLTGDIANAYATIKQLYDENTLVGIQTRVSTYQPMLLESLSHDEDPSKVDAIELKLKFIEWKSIEPEYNKKSAKSTKKPKQSSTINRGNVKSKKSMPIGKKRARR

SEQ ID NO: 4295 - protein, 80 aa, Proteus mirabilis
WYFLHFFYLLALFFPIGMDFLLFTFPRLIVEDCLGFLVDLADFLLYSGSMLFHSINFSFNSIASTFDGSSSWLRLSNSIG

SEQ ID NO: 4296 - protein, 143 aa, Proteus mirabilis
GFIMSTTDLSLELQDKIKHSITRVSKVIFPTTTNHHSTLFGGTALAWMDEVSFITATRFCRKRLVTVSTEKINFNHPIPSGTIIELVGEVIRVGRTSLTVNVSIFLEEMYAEGREEVIHGQFNFVAVDEHGKPTPLFDKPSLL

SEQ ID NO: 4297 - protein, 248 aa, Proteus mirabilis
GDIMAQYLVFRLYGPLASWGLPAVGGDRQTGIAPSRSAILGLLSASLGINRKDESKLLQLQQSVLVATKQLVPSMLLRDFHTAQVPSKRKNITHPTRRSELAEKDQNTILSSRDYRCDAIWIIAIKLTGHSQYTLEQLKNALLKPVYILSLGRKSCPLSLPMMPKIVEVEQLKEALDTQFPYITTSDKADSYWFHSDGWVTYFWEGNYQDIKGENIMTLYPWDDPINRQHWQFRQRKMYQMSVKRESE

SEQ ID NO: 4298 - protein, 412 aa, Proteus mirabilis
QIIIHKRGYMDTTTLDHIDKVIEQYQLPEVTLSLILGKNIDHGRSAGIFTPYDLNKIKSYIDKVLKLPYQKDTIIELLGYEDINISQISAETIQTLFLNMRTHAFEWQKIEYSVKQQAIDLEITGREITSTGEQLLAFINKMPIIKKINRKIEDITPEELSSIKYSTQDKKVSKQLVAILESMKNDINEQYNNTLKIKNMIYDFRIEIVGGENSKGNICHSIYYDIINKKKYINDFFDNSDDSLNEQRILLENEIEILKKEYQHFVKLAFTGLAFGIIGVIITGGIFGSKAEKIRKKRNETIEQLHNINKGIKQQSTISECLQRFQVDLDEIEQYIEDADMSVEHLLYMWQTILTEINASLINFKKIDNAMELIRFSIYLEKIIAPWYMVVGYSKEMMAVFDEALSSFYSSK

SEQ ID NO: 4299 - protein, 195 aa, Proteus mirabilis
EVVMLDINKNNLSQLTEKLVKKQCTLMSIIAMLGLLAGIICIINPFSSGVVVSVFLGVVFFACAITSIMAAFNSRISSGWSMLITLLAGFIYLFLGYIFITDPLNGMLSLAFIIGYLFIFAGILSLVLGFKQIKDSFYGWFNILVGFLDLVLAYFLLAFGPETSITLVMALIGIQLILSSITILSIASAIKRMTR

SEQ ID NO: 4300 - protein, 62 aa, Proteus mirabilis
RSTMSVIATIGIGYLIGAVLSFIITFFLTKDPSLAMRLLSAFLIAITWPLSFPMAIIFSIFG

SEQ ID NO: 4301 - protein, 201 aa, Proteus mirabilis
FWYIQDKNYDRLASIKKGLLRMEQENTAVVEWVDIVDEKNEVVAQATRQQMRAENLRHRATYIVVHDGMGKILAQRRTETKDFYPGWLDATAGGVVQQGENALESARREAEEELGIAGVPFAEHGQFYYDDESCRVWGSLFSCVSHGPFALQPEEIEEVCWLTPLEITERCDEFTPDSLKALSLWLTRNNSTRLDTKETTD

SEQ ID NO: 4302 - protein, 886 aa, Proteus mirabilis
IRSMRDSGSMSDIAREITPVNIEEELKSSYLDYAMSVIVGRALPDVRDGLKPVHRRVLFAMNVLGNDWNKPYKKSARVVGDVIGKYHPHGDSAVYETIVRLAQPFSMRYMLVDGQGNFGSVDGDSAAAMRYTEVRMAKIAHELLADLEKETVDFVPNYDGTENIPAVMPTRIPNLLVNGSSGIAVGMATNIPPHNLGEVIDGCLAYVDNEDITIEELMEYITGPDFPTAAIINGRRGILDAYRTGRGKIYIRAQADIETDEKTGRETIIVTEIPYQVNKARLIEKIAELVKDKRIEGISGLRDESDKDGMRIVVEIKRDAVGEVVLNHLFSQTQMQVSFGINMVALHQGQPKLLNLKEIIAAFIRHRREVVTRRTIFELRKARDRAHILEALAVALANIDPVIELIRQAPTPAEAKAALIAQPWDLGSVSAMLERAGDSNVARPEWLEPQFGVHDGKYYLTEQQAQAILDLRLQKLTGLEHEKLLDEYRELLLQIAELLHILRSPERLMDVIREELTAIKTQYNDPRRTEITENTADINIEDLINEENVVVTLSHQGYVKYQPLTDYEAQRRGGKGKSAARIKEEDFIDRLLVANTHDTILCFSSRGRLYWMKVYQLPEASRGARGRPIINLLPLEQDERITAILPVREYEEGKFVFMATASGTVKKTPLQDFSRPRSAGIIAVNLNDGDELIGVDLTDGSNEAMLFSADGKVVRFAEECVRPMGRTATGVRGMKLVDDDKVVSLIIPRGEGDILTVTENGYGKRTVQSEYPTKNRATQGVISIKVSERNGKVVGAIQVEETDQIMMITNAGTLVRTRVSEVSIVGRNTQGVTLIRTTEDELVVGLQRVEDEDDALDDDEVDEMISDNISDVPESEPTDDADSEEE

SEQ ID NO: 4303 - protein, 151 aa, Proteus mirabilis
AMSMSTTTEVIAHYWAFAVFLIGALGLCSLMLLGARYLGGRAQARAKHVPYESGLDSVGSARLRMSAKFYLVAMFFVIFDVEALFLYAWAVSVREVGWLGFIEAAVFIAILLAGLFYLVRIGALNWTPVRSRRETAGKSHVRLTSGKHPQQ

SEQ ID NO: 4304 - protein, 60 aa, Proteus mirabilis
RGGIYSSVIHGTTCILPKIMGYLNAVLKHLPPFEYAEIFHIICIFVKKILIGLVQRTSVR

SEQ ID NO: 4305 - protein, 88 aa, Proteus mirabilis
LGGIMSRKNEVIQTHPVVGWDISTVDIYDAMMLRLHYLPENEHHPDNAVVDKTLWLTTDVAKQLIYILQAGIDKIESSEDFVSDNTKH

SEQ ID NO: 4306 - protein, 306 aa, Proteus mirabilis
MAFIPLRPIPIKDRHSMIFIGMGRIDVKDGAFVVIDEINGERMLIPVGSLACILLEPGTRISHAAVKLAATVGTLLIWVGEAGVRLYSVGQPGGARSDKLLYQAKLALDNDLRLKVVRKMFELRFGESAPLKRSVDQLRGIEGARVRKQYQMLAKKFKIDWKGRRYDPKDWEAGDIINRCISAATACLYGVTEAAILAAGYAPAIGFVHTGKPLSFVYDIADIIKFDTVVPVAFKVASYKAIAPDREVRIACREAFRKYQTLNKLIPLIEEVLSAGEITPPEPPIDAQPPAIPQAHPFGDEGHREK

SEQ ID NO: 4307 - protein, 169 aa, Proteus mirabilis
SYFLSWRLRSPFLWSFYMLIKPKEITVIDSDRQQHTFIISRLPATIGREILAKYPLSNAPKIGDYEVSKEAMLKMMAYVAVEKEGQEIYLKTSTLIDNHVPDGEALIRLELEMLKYNTSFFGNGGSQNFLQYLLGKLSGSLPSIIKTLMASLPSSSQPASPLSQNSKQP

SEQ ID NO: 4308 - protein, 73 aa, Proteus mirabilis
ESHMSDKMKGQVKWFNESKGFGFITPADGSKDVFVHFSAIQGNGFKTLAEGQNVEFTIENGAKGPAAANVTAL

SEQ ID NO: 4309 - protein, 266 aa, Proteus mirabilis
KSNIKMTIEQQKEMQWLLSDPDTVRFRDEQLLAETEFRYHQHEFGQLLYVISGVMDLEAGGQRFLAPPEFSVWIPEKVGHASYNKKTLSFKVLDIAPSWCEGLLDKPCLIQLSPIFSTIFADFFRRGVCKPQTKEDLRLSQVLIDQLKVSPIHHTYLPSSKDKLLAPVLAALEQNPADNTSLELWAKKRYTSERTLSRRCQQELGMSFSEWRKRLRFLHAISLLEQGKSVNDVAFDVGYSSSSSFIAMFQQFAGTTPERFRRLPNG

SEQ ID NO: 4310 - protein, 221 aa, Proteus mirabilis
QLNMNNLNIIIADDHPIVLFGIRKSLEQIEWVNVVGEFEDSTSLINNLSKLNADALITDLSMPGDKYGDGITLIKYIKRHYPNLSIIVLTMNNNPAILSAVLDLEIEGIVLKQGAPADLPKALAALQKGKKFMPESVAKLLEKVNANGYGDKRLSPKESEVLRLFAEGFLVTEIAKKLNRSIKTISSQKKSAMMKLGVDNDIALLNYLSSVTIDKEINGES

SEQ ID NO: 4311 - protein, 405 aa, Proteus mirabilis
RSDMNLKPRNNSWKRNLYIVWFGCFLTGAGFSLIMPFLPLYVEELGIKDHESLNLWTGVAFSITFLFSAIAAPFWGKLSDRKGRKLMLLRSALGMAIVMVLIGFAQNIWQLLILRALLGVLGGFVPNANALIATQVPVKKSGWALGTLSTGAVSGALIGPLIGGILADLYGLRPVFFITAAVLFICFIVTLFFVSENFTPVSKKDALSTQQVFSSLKNKRLVICLFFTTMIIQVATGSVTPILTLYIRDLAGSISNLAFISGVIASVPGIAALISAPRFGKLGDRIGPDKVLIFTLGLSIFMLIPMALVSNYWELGALRFLLGAVNAAMLPAVQTLILYNITPAIAGRIFSYNQALRDVGNVTGPLMGAFVAANYGFRAVFYFTAAVVFFNLIYSWISFRTPQRK

SEQ ID NO: 4312 - protein, 803 aa, Proteus mirabilis
DDSIMKISHFYRWIVFIILTILALYFTVLGGYLVSLAGSPFYLFTGVMLLIIAACFLSRKKSTLLLFNFLFLITIVWSIWESGFDFWALAPRLDIIFILGLLLIPFTLNNNVYTCRTNKIGLFTLLATTLIIILGSSLTDPHAINGQFTQQQPTNSISPIGVNDNDWPAYGRTQAGIRYSPLTQINSDNVDKLVEKWTFHTGDEKRANDAVEITNEVTPIKIEDNLFLCTPHQYLISLDPATGKEKWRFDSKLQYNKSFQHMTCRGVAYYNQNNSAEFAKSLDVRQPSISDECPEKVFLPVNDGRLIAVNAQTGNACRDFGQNGEINLLASMPYAYLGGYNPTSPPIVTGNTIIIGGSVTDNLSTQEPSGVIRGYDVNSGKLIWVFDTGAEDPNAMPGKETQFVHNSPNAWAPLAYDAQTDVVYIPTGVGTPDIWGGDRHPLKERYANSVLALKGSTGELLWHFQTTHHDLWDMDVPSQPSLVDIKTDKNETIPAIYIVTKTGNVFVLDRRDGTPIVPVTEKPVPTSVKYGPQTQGEHYSPTQPFSALNLAPKNKLQGSDMWGGTMADQLLCRIAFHQLNYEGIYTPPSENGTLVFPGNLGIFEWGGISVNQDRQVAVMNFITLPFISKLYLKDPQDNQAIDAGHGEQGLQPMTGTPYSVDIHPFLSPLGLPCKQPPWGFVAGVDLTKNELVWQQRFGTIRDSLPNLVELPPLKIGVPGLGGAISTAGNVMFVAASQDNYIRAFNVTNGKMLWEARLPAGGQATPMTYSIGGKQYVVIMAGGHGSFGTKMGDSLVAYGLPDNL

SEQ ID NO: 4313 - protein, 201 aa, Proteus mirabilis
NCLINLLYNYKLGKLFAGVIIMKKFLLLGAMSALLISANANAISMNVQAGKHYTDVQAGLGDADSGLSFNGNWARSDHDGQLGSLGAKFALPLGPFSASVGGKALYLSPKNGDDGAALAGGVGLNWRVLPSLSVYGEAYASPEGLTSGSKSYYEADVGAKYTVFKPLHVNAGYRVIEIENAHNHSNNKLADGFYVGAGLSF

SEQ ID NO: 4314 - protein, 234 aa, Proteus mirabilis
TSLIMSKPNNDIASVGSLAGAFSSAFRHLMMNTDDMLPATVIDYDEKSNRAVIKPLVMMLTTDNQTISRAPVANIPVFRFGGGGFFIRAPIKAGDFGWLKANDRDISLIFQRGGLEDRPNTTRLHTFSDAMFFPDTLKGWVIDGKNIDALVIQSMDGSVCFSLHNDKVVLETPKYEINARETIFTGNVTVNGNYAVNGNSDSQGGVMRHNGKDIGSTHRHSGVQAGKDNTGSPI

SEQ ID NO: 4315 - protein, 289 aa, Proteus mirabilis
RNLIMLYPSEEKLYAPIEWQDCSEGFEDILYHKSVDGIAKITINRPQVRNAFRPLTVKEMIQALADARYDDSIGTIILTGAGEKAFCAGGDQKIRGDYGGYRDESGTHHLNVLDFQRQIRTCPKPVVAMVAGYSIGGGHVLHMMCDLTIAADNAIFGQTGPKVGSFDGGWGASYMARIVGQKKAREIWFLCRQYNAQEALDMGLVNTVVPYASLEKETVRWCREMLENSPMALRCLKAALNADCDGQAGLQELAGNATMLFYMTDEGQEGRNAFNEKRHPDFTKFKRNP

SEQ ID NO: 4316 - protein, 309 aa, Proteus mirabilis
DRVIRRMVMNILITGGTGLIGRALICQLALDKHNITVLSRSPQKVYSHFCNEMACWTHLDDKENLNQFDAVINLAGEPIADKRWTPEQKQTLVNSRCKLTQKLVDLIKASDSPPSVLISGSAVGFYGDQGENNVTEETPPKDEFTHQLCAKWENIALDAQTPLTRVCLLRTGIVLSTKGGALPKMSPPFKLGLGGKLGNGKQYMPWIHIDDMVNAIVFLLNNNNTQGAFNLTAPHPVQNKAFTTTLAHVLKRPAFMTIPATILKLMMGESATLVLGGQQAFPKKLLDAGFSFRYPQLEGALEDIIRHKK

SEQ ID NO: 4317 - protein, 164 aa, Proteus mirabilis
LLSLIQRSKKHLTEVINMLKTLLTPDVVQVIPQVKDWREAIKIACQPLIDKGCIEPRYVDAIYKSHEQIGPYYVLGPGIAMPHARPEEGVNQLSLALTIIEKGVEFGANENDPVKLLIVLAATDNDSHINAIVKLAELFDNQDDIDTLLQAKSKAEVLAVINHY

SEQ ID NO: 4318 - protein, 88 aa, Proteus mirabilis
MITIYLNLSSFKENIVITHSVFRRFLTNLTLIFNTQLLANAKTCQSTYKFSANTLSLTDNSILLHQYLRKNLTLYRQMCLIFLIKLTK

SEQ ID NO: 4319 - protein, 221 aa, Proteus mirabilis
NMTITCKGFLFDLDGTLVDSLPVVEYCWALFGERVGVSTQEINNYIHGKPAIESIRHFMPNATQAQIEETFRWLEKLEATQTEGLAPLPGAIELINRLNDLAIPWAIVTSGTVPIASTRQSVTGIPEPKHWVTAECITQGKPNPEPYLLGAKKLGLAPEECVVFEDAAAGIYSGLDAGCQVIAVHAPISLPRRNEIDLIIDSLNDLQIDKENQQVVIKHKC

SEQ ID NO: 4320 - protein, 414 aa, Proteus mirabilis
LGKIVWKNEDFVKNRTIGSVFIVAGTTIGAGMLAMPLAAVGIGFSTMVLLLVGLWLLMSYTALLLVEVYQYNDPHTGLGSIAKRYLGIGGQVVTGLALLLLMYALTTAYISGAGELLASTLSSWIGHKITITQGIIIFTVIGGAVVGIGTTSVDMINRLLFTAKVIFLIFMLVVMLPHVEKVNLTSMPIAQGLVLSAIPVIFTSFGFHGSVPSIVSYMDGNIKKLRLIFIVGSAIPLIAYILWQLATLGAIPTTTFMGILAQESGLNGLLTAIRDVVATPRVNIAVNLFAALALATSFLGVALGLFDYLADLFKRSNRASGRFQSGLLTFVPPLFCALFFPNFVQALAYAAIALSILALLLPALLVWKVRQQKQTTEHYKVKGGKPALAIVFICGLVVIGIQIAITFNILPQVG

SEQ ID NO: 4321 - protein, 137 aa, Proteus mirabilis
ELKMAKIARGERNNNPGNIRHGAKWQGLASTQTDKDFCQFISPEYGIRAIYKLIQTYQKKYGLNTIKTIIYRYAPPNENNTLGYIERVSKEIGIESNNPIDTQIKNVCISLSIAIINIELGYQPYAKKVFEDAWLLL

SEQ ID NO: 4322 - protein, 187 aa, Proteus mirabilis
EMKMSSKKLTPAEVNDAHKLQTRPLSTPTDLAPKATKEVSAAMNAILADVFALYLKTKNFHWHVSGPHFRDYHLMLDEQGDQLFAMTDPIAERVRKIGGMTLRSIGQISKMQRIKDNDAEFVEPLDMLAELCQDNQLLAAELRKAHVVCDENNDISTASLIENWIDETERRTWFLFEACRRAETSGH

SEQ ID NO: 4323 - protein, 541 aa, Proteus mirabilis
QNEIILYCLLLIFCSFYLQTTCKGFFWEFKMQSTHSKSSRTFFGHPYPLSSLFFTEMWERFSFYGIRPLLILFMAATVYEGGMDIPREQASAIVGNFAGGVYLTSLTGGWLADNWLDQRLAVWYGSIFIALGHLSIALSAFWSQNLFFIGLLLIVLGTGLFKTCVTVMVGTLYKKDDTRRDGGFSLFYMGINMGSFIAPLITGFLVRDYGWHWGFGIGGIGMLVALLIFRFYAVPTMRRFDKEVGLDSSWDRPTVVRRNVGQWVLALAVILIAIVGLIISGTIPFNPVIVANFMVYVISGSVIAYFIYLFLFAGLSSSDRSRLFVCFLLLVSAALFWSAFEQKPTSFNLFANDYTDLNFMGFEIPAVWFQSVNALFIIILAPVFSWLWPMLARNNMNLSSMSKFVIGILFAAGGFTVMMYASESVLATGSGVSPLWLISSILLLTLGELCLSPIGLATMTILAPARMRGQVMGLWFCASALGNLAAGLMGGNIRPDKLDVMPDFFSHVSIALVICAVVLAALIIPVRKLLQSADDKENAQA

SEQ ID NO: 4324 - protein, 215 aa, Proteus mirabilis
KSPLFSPITIIRGRKMPTIHLVDDDLAVTDACQFLLESLGYAAQVWNDSEYFLHNIDLYQQGVVLLDMRMPKADGRQVHQYLIEKHSTLAVIFLTGHGDIPMAVEEIKKGAIDFLQKPIDSNALLSALKSAFTETATRFTADDIRRRYASLTPREKDIAYYVIQGLMNREIAETACVSIRTVEVHRAKVMDKMAVKNIAELVTALQGIDIVAPNL

SEQ ID NO: 4325 - protein, 425 aa, Proteus mirabilis
FRRINPMTKIFKIPFATQGDKTVVPVEIQTDGSVSYTQGYGYDYERDQVTDPAAKDIEREKMNSLFHDITESIGEMQLQGFAKWSEAGKPYAIRSVVYHNNKVWQSKIENNNIEPIAGNAWAELKADITANEVGAYNKAEADKRFQPVGKYQAEGYSYAKAESDTKYQPKGNYAPAGNYANKGDSYTKAESDGKYQPKGNYQASGDYATNTNLKNELNKKFDKGNIAQATGTSTAHVISQKAATDAFQPKGNYQPKGNYALVGASYTKTESDNKYQPKGNYLATGYSYSKSESDGKYQPKGNYQPKGNYQPKGNYAVIGSSYTKAESDSRYSKQKVTGWKELYNGNWLSGEGVNINEDIRGKIVWVDLGGNQWSSFTMPPIDDIPMWCGHSDNNWCAFKTSNNGKKIHRAFGKGNTGIVRVCVIS

SEQ ID NO: 4326 - protein, 537 aa, Proteus mirabilis
KTGIVMNIINQPWLPFRFRDGEIKTLPISAISHPDIIDFSLNRADFKGAAYQFAIGLLQTIFAPEDEDEWEEYFETPPSSKKLQSAFDKVAHAFNIMGDGPLFMQDFSTLEEQKNIPIAQLLIDAPGENGIKQNTDHFIKQGIADVMSLEMAVLALFTLQINAPSGGKGHLVSLRGGGPLTTLVYPAEENSTLWQKLWLNVINREFWEYDEPNFDDGSVFPWLIPLNLKEGKGEKVSPDDVHPLYMYWAMPRRIRLKVENKSVTCQISDMKSNFSVKYYVTKNYGLDYQEGWLHPLTPYYWDPKKPEMFPNSIKGRQGGIHYNLWDRLFLSSNENGQKSATVVSHYLKLYQLLEFTRKPRLLIFGYDMDNMKPRGWYNLEMPIFHVKDEYNNKIINEIKIIQKLTIDCLRSVKEQVKKAWFSSPKDMKGDISFIDLTFWQRSENIFFEVVQNIIVQIQKNDFLTHEQAKKWLNSIRKISISIFDEYALSALGTQKSVSGCIKARNGLIKDLYSNKRIKKFAEDFKITKENGEQYGIL

SEQ ID NO: 4327 - protein, 158 aa, Proteus mirabilis
KKLIEVIMNEPTVTPPGFFKKLRLGNEYLKTWPVEKQLAPVFPENRMIKATRFGIRYMPPIAIFTLTWQIALGGDLGPAITTALFACSLPMQGLWWLGKRAATPLPAVLLNWFYEIREKFEQAGIALAPVEKTPTYLSLAHLLKRAFKQLDRSFLDDV

SEQ ID NO: 4328 - protein, 248 aa, Proteus mirabilis
YFLMNDKTTSLHANVDQHEIDKFESVASRWWDLEGEFKPLHRINPLRLNYIQERADGLFGKKVLDVGCGGGILSESMARVGAEVTGLDMGKEPLEVARLHSLETGIPVTYIQDTVENHAAEYPQRYDVVTCMEMLEHVPDPSSIVRSCAKLVKPGGHVFFSTINRNKKAWFMLVVGAEYILNMVPKGTHDANKFIRPSELLSWVDETNLRSKNMIGLHYNPITDKFRLAPNVDVNYMVHTQATDNSDL

SEQ ID NO: 4329 - protein, 203 aa, Proteus mirabilis
LTKIYILRIIMKKLIVGLTGASGAIYGIRLLEILKSVPTVETHLVISQAARRTISLETDYSLKDIHALADIIYDDRDIGATISSGSFRVNGMVILPCSIKSLSGIVHSYTDTLVTRAADVVLKEGRKLVLCVRETPLHLGHLRLMTQAAELGAIIMPPVPAFYFQPKTIDDIVNQTVNRVLDQFDIDLPDDLFQRWQGDKPAR

SEQ ID NO: 4330 - protein, 614 aa, Proteus mirabilis
DARMNILYLTFVLPLLGFLLLAFSGGRWSENVSAWIGTGAVGLSALVTLWVGIDFFAHGQETEVLTLWTWMSAGNFTIPFTLVLDGLSLTMLGVITGVGFLIHMYASWYMRGEEGYSRFFAYTNLFIASMVVLVLADNMMLMYMGWEGVGLCSYLLIGFYYNNPANGAAAMKAFIVTRIGDVFLAIGMFILFDQLGTLSFREMAVLAPEQLTAGSSIINWAMLMVLGGAVGKSAQLPLQTWLADAMAGPTPVSALIHAATMVTAGVYLVARSHALFLMAPDILELVGIVGAVTLVLAGFAALVQTDIKRILAYSTMSQIGYMFLALGAQAWDGAIFHLMTHAFFKALLFLSAGSVIIACHHEQNIFKMGGLRKKIPFVYACFLIGGGALAALPLLTAGFFSKDEILWGAYANGHFNLMLAGLIGAFFTSLYTFRLIFIVFHGETKTEAHQVKGFTHTFPLAVLALLSTFIGALITQPLGDVFPESTVTHESKYVLEILSGVVAIVGVAIAAWLYLKQRQLVSQVANTKTGRFFSTWWFHAWGFDALYEVLFVKPYKGAAWLIQNDPVNQFFNLFGCLFKGANKGLSFSENGLARWYAASLGLGAVLVIALLLLV

SEQ ID NO: 4331 - protein, 87 aa, Proteus mirabilis
IRNVKVQHQFFRQRREPKFPSIPIRQAQRFSPVDYKNADGFFAVIISAGFASFTELKTTIDLEEAFDLWEIAITNRYNEALAASKER

SEQ ID NO: 4332 - protein, 102 aa, Proteus mirabilis
IFFVLATDLTGFTASAFSGVKIKTILLHELTPYARFTSTRLVCCGFPLANGDGCQLVNVLIHPPVSTPVVSSERHAPCGTAITPGNTRSVTLTRICKRPRSL

SEQ ID NO: 4333 - protein, 378 aa, Proteus mirabilis
DNTVKILVDENMPYAQQLFCQLGEVKAVSGRPLPIEELDDTDALMVRSITKVNASLLAGKPVKFVGTATAGFDHVDTAWLEQQKIAFSSAPGCNAIAVVEYVFSALMVFAEQEGFQLTDKTVGIVGVGNVGGRLAKRLRALGVNVLLCDPPRADRGDDEQFHSLETLLKQADILTFHTPLNKSGRYNSYHLINESNLDILPEGRILINASRGEVIDNAALLSALNQGKKLRVVLDVWEPEPDLSLELLNKVDIATPHIAGYTLEGKARGTTQVYEAYCDFIGQPQHVELSTLLPKPLISTISVQGELTQTLLKQLIHLVYDVRRDDAPLRKVAGIKGEFDKLRKFYPVRREWSSLQVVCDNPITASLLNAIGFNATHK

SEQ ID NO: 4334 - protein, 102 aa, Proteus mirabilis
RKIVMSMIVVVTEAVPPRLRGRLAVWLLEVRAGVYVGNVSARIREMIWQQINEFAEDGNVVMAWGTNTESGFDFQTYGENRREPIDFDGLRLVLFKPYKEDV

SEQ ID NO: 4335 - protein, 62 aa, Proteus mirabilis
RNSVSASNCSSRKRTVSGSESNHCISFCCSIVILMLLFYRFVFIGLSVVCFSLYISNQTGLQ

SEQ ID NO: 4336 - protein, 281 aa, Proteus mirabilis
VVTVNQREYCMRLADLPKYFSPKSVVLSDVRTPKAVDSLSITDVMASISLATRKGRMGIELFLAKHHINRPEEAIESLYQCALTQVNQYKMIDKLAEHDKAKVLHIIAEYAFQDYARSAASKRACPDCDDGFIEVEVFTTKCHGRKTTQQVTQNAKPHLKTTSSNKPSFREVREVTRVICPTCKGKAEIRLACRCHGRGKIVDKKQTELQGVAVFKPCRQCAGRGYPRLKFSEVLQQLQHVVSISKTAAYSHYKPLFDFLVAECFKEESLSDKFLQEVTVK

SEQ ID NO: 4337 - protein, 445 aa, Proteus mirabilis
VFRVEKVNPVFSTLYEKVKNINLTAQDDLLHLKVILPSEVSFSLLSWLAAQTYYPQFYWQHRDESEEVAACGQVKCFNHIRDAHRFLATHRHSLHADDVRIWGLNAWDTIIPGRIDKEKGDDAYLFLPRIEIRRQQQLSIHINLLAEEDKQSALAFIRSLNNALNIAPLSVKVTSVEHSLTQQQWTDYLNIALEEINQGVFEKVVPARATCLSLDNPLKAIQFMKASRDVNHHCYHYMLAFSPTDAFMGSSPERLYKRDEFVLYTEALAGTVASSDNEQQARAFADWLMNDKKNQHENLVVVDDICQRLQGGIEGIDVSSADVIRLRKVQHLRRYIHGKLIHADDVDCLQRLQPTAAVCGLPRSIARTFIRQHEPFERRWYAGSAGYLSLPHAEFAVSLRCGELHDDALTLYAGAGVVAGSDPLQEWAEIENKAAGLRTLLEKEC

SEQ ID NO: 4338 - protein, 276 aa, Proteus mirabilis
CIGVRKMDLRRIRLGIEVGERLQWYEGLRISASGTKYANPLQNECNVTISGLNAQTRDYLLTETSPYNNNKQTRRLYLEVGRVNTGLLSLFIGDIVSAEIDSPPDVTLTLSAKTSHQSAGKIISSSGGTMRRLSEIALAIADDCGVKLDFQATDKNIANWYYCGSALHQIERLQEAGDVKAFIDDDTLFVKDDDKALKSRLRILNMNSGMIGIPKATESGLTVSYLIDSTSELGGMLRLESKLNPSLNGDYIIEQLAFSVASHEADFNYTAICKRA

SEQ ID NO: 4339 - protein, 155 aa, Proteus mirabilis
RCLVVIMNYLTKIIIIIMLCLIAGLFWVIDRNKILKQKYVKINETLTQQIVENKNYQLRIKQLYQMDTQRLQELASAKSEINRLRSYAERDPERVYIRASCAKNDANSTPRVDDATRARPTDAAIRNYWILRERIAQSESIILGLQDYIRQECIN

SEQ ID NO: 4340 - protein, 165 aa, Proteus mirabilis
RFMVWIDYAIIAIIGFSALVSLIRGFVREALSLITWGCGFFVASQFYPYLAVYFTRFEDELVRNGIAIVTLFIATLIVGAVINYVISSLVQRTGLSGTDRVLGICFGALRGVLIVSALLFVLGAFTPMADSADWQRSELIPQFNHIIRWFFDYLQNASSFVSEKM

SEQ ID NO: 4341 - protein, 186 aa, Proteus mirabilis
KRLFMTNASNKIATHEITIRPTQLADANQLPKIEQSAGELFSSIKELSWISESGVQSVEAHIQFIHQHAHWVAVNHDNHPVGFIMTQQLPESVFIHELSVSKDWQNKGIGKLLIQTVKNEAKLQQFNAVTLTTFRDVPWNAPYYQRLGFHILLEHQIPYSLQQILDNEVEHGGFAREMRCAMKCEI

SEQ ID NO: 4342 - protein, 181 aa, Proteus mirabilis
GAIFMEFAFYIAGLISILATLRVITHTNPVHALLYLIVSLIGLSVVFFSLGAYFAGALEIIVYAGAIMVLFVFVVMMLNLGKSVVEQERKWLQPRFWIGPAILSLVLLIVLVYAISSVTHGEISGEIIGAKEVGISLFGPYILAVELASVLLLSGLIVAYHIGRDQSHDDLVENEKVGEPK

SEQ ID NO: 4343 - protein, 624 aa, Proteus mirabilis
IDVLICFHLLLIEAILNSELLWVLSLLLIAIVLFTTNKIRMDVVALLVIVAFVLSGTLSLNEATVGFSDPNVLLIAALFVIGEGLVRTGVAYQMGDWLVRVAGSSEVKMLVLLMICVASLGAFMSSTGVVAIFIPVVLSVAARMKTSPSRLMMPLGFAGLISGLMTLVATPPNMVVNSELVREGLPSFQFFSITPIGIAVLVAGVLYMLVVRRWLGSSEGGKQKEVYRRTFRDLIRDYQLAGRARRLAIRKGSPLIGHSLDELHLRSRYGANVVGIERWRRFRRVMVSATGGTELRERDVLLVDMSASEVDLREFCREQMLEPMVLRGEYFSEQSRDVGLAEVSMNPDSELLGKSLREIKFRTRYGLNVVAIRREGSALPGKIVDEPLRLGDVLLVIGDWKLIRILSTKPRNFIVLNLAAEIDTVAPASSQAPHALFSLALMVALMVTNEVPNFIAALIACLLMGKFRCIDMESAYRSIHWPSIILIVGMMPFAAALQKTGGIELIVNGLMDVAGNAGPQVMLVCLFVLCATIGLFISNTATAVLMAPIAIAAAHQMDVSPLPFAMVIGVAASAAFMTPVSSPVNTLILEPGGYKFADFIKIGVPFTIIVMLISVFLIPLLFPF

SEQ ID NO: 4344 - protein, 67 aa, Proteus mirabilis
CTPLFVVRLITTKPIQKAMRIKPQILCSSTIDGTLPIEKWPNNPLINRRMNSKALPQCQKRMALEYK

SEQ ID NO: 4345 - protein, 91 aa, Proteus mirabilis
IMLSEYETYLLDKIDSRVEHATDDELFAGGYLQGHITLAIAELEQENNTQLSALKSRVEESIQKAIKAGELSPPDQILVLSTWHDLVNSIN

SEQ ID NO: 4346 - protein, 271 aa, Proteus mirabilis
IVSSSSFRLRYFMNTLPIYYVNAFTSTPFSGNPAAVILLDKWLPDDTLLKLANEIGLPETAFLVANHIRWFTPKVEVPLCGHATLATAFVLKTINKAPATSFKFHSLSGELTVSCHSSSFTLDFPQVPASLNPTIKPSLETALNIDIEEVWQSHDRYTCFVADPNRVIDYQPDFNAITQLPLPGVILTAKGHAPFDFISRFFAPRKGVNEDPVTGTSHCVLAPIWAKKLNKDKLNARQVSARGGNIQCELKQERLLLTGDAVLFLTGEITF

SEQ ID NO: 4347 - protein, 1042 aa, Proteus mirabilis
PLYSEKVFVGLSGEYSMAKFTRRQWLKGGLVIGGIAAFAASYRDVAKRAVDGLVDGTSGKVTLDRINGNSLLPEGKITAKANWQPNTNQAVCMTQCFGCWTQCGVRARVDRNNNQVLRIAGNPYHPLSQDIHFGYNMPIKEAFEKMGGESGLANRSTACARGATMMESLDSPTRILEPMKRVGKRGEGKWQRISFEQLIKEVVEGGDLFGEGHVDGLRAIRDLATPIDPKQPALGPKANQLLVTNAGDDGRDSFIRRFAQNAFGSKNFGAHGSYCGLAYRAGSGALMNDLDKNAHVKPDWDHVEFALFLGTSPAQSGNPFKRQGRQLANARIRGSFNYVVVAPALPLTTTLANDHGHWVPVQPGTDAALVMGMIRWIIENKRYNAEYLSVPSEVSMNNVGERSWTNATHLVISDENHPLSGQMLTAAHLEDIADGEAQNMVIALNGQLTAATQVDKAQLFVTQKVTLKTGIEVTVKSSFQLLTEAANRMSLAEYSERCKVPESTIIALAREFTDYGRKAAVISHGGMMGGNGFYTAWSVIMLNALIGNLNLKGGVSVGGGKFNGAIDGPRYNMDSFKGKIKPKGMVLSRSKAAYEQSDEYRERIAKGESPYPAKAPWYPFAAGQLTEQLGSALAGYPYSLKAWITNMTNPLYGIAGIRQVMEARLKDPQHLPLIIGIDAFMNETTALADYIVPDTHNFESWGFSAPWSGVQVKASTARWPIVEPRVAKTADGQPISMETFCIAVAKALDLPGFGENALEDKDGHFHAINSAEDYYLRVAANIAFMGEQPVAPASHEDILLSGVDRILPAITATLKEEEVLRVANIYTRGGRFAPYDKAWNGDATGPQWKKPLQIWNENVAKNHHAITGERYSGCPTYYPPRLSDGSDIHQHFPQEQWPLKLMSFKSHVVSSSTGMIQRLRMVKPSNLVAINPLDGEKWGIKHGDKVRIVTPGGEVEAEISLLEGVMPGVLAIEHGYGHKELGSRQHYLDGQPLAMDKAIGSGINLNDLGFADPTREITNTWLDWVSGASVRQGLPAKIERIA

SEQ ID NO: 4348 - protein, 404 aa, Proteus mirabilis
IGNSMSSKLVLVLNCGSSSLKFAIINPENGEEFLSGLAECFNLPEARLKWKMDGQKHEAALGAGAAHSEALNFIVNTILAEKPELSQQIAAIGHRIVHGGEKFTKSVVITDEVIKGIEAAIPFAPLHNPAHLIGIEEARKAFPHLINKMVAVFDTAFHQTMPEEAYLYALPYSLYKDHSIRRYGAHGTSHFFVSREAAKMLNKPVDELNVITCHLGNGGSVSAIVNGKCVDTSMGLTPLEGLVMGTRSGDIDPAIVFHLHDTLGMSVEDINKLLTKESGLLGLTEVTSDCRYVEDNYETKADAKRAMDVYCHRLAKYIGSYCALMEGRLDAIIFTGGIGENAAMVRELSLKKLALLGFEVDHQRNLDARFGKSGTITTDNSRLAVVIPTNEELVIAQDASRLTA

SEQ ID NO: 4349 - protein, 185 aa, Proteus mirabilis
KVSSLTFYIGPIMSKLNKSLCALGVTLSIFSAPAALASGTINFTGEITDQACTVDGSSKNLTVDLGKVSSKSLATKGEVAGLKDFTIKLIDCPVDTTVAVRFGGTRDASDRDILAIEQVSGGATNVGIALFEKDAVSQIKLYDDSQDVQITGTEINLDYVARYKATDAATPGPANGSAVYSIQYK

SEQ ID NO: 4350 - protein, 316 aa, Proteus mirabilis
VINSLDRKTMSQIIDVPETLSLAIDSFLSYIEVERRLSPVTVENYQRQLMTIAQMMVAIKINQWSLLESQHVRMLLAKSHRSGLQPASLALRFSALRSFLDWQVSQGMLAVNPAKGVRTPKSGRHLPKNMDVDEVSQLMNIDLKDPLSVRDRTMLEVMYGAGLRLSELTNLNINDIDLQEGEVRVLGKGSKERKVPLGRKAVEWLQHWFAMRELYSPEDTAVFISTKSGKRLSVRSVQKRFELWGVKQGLSSHVNPHKLRHSFATHLLESSGDLRAVQELLGHANLSTTQVYTHLDFQHLAKVYDAAHPRAKREKS

SEQ ID NO: 4351 - protein, 97 aa, Proteus mirabilis
SFTLYNIQTNMEVYIMSIKSELIATKVDIELKEAFVAIARNKHRPASQILRDLIRVYVESNQTQPNEKTLNTFAKTDKGDDVFYAEDAHDLFKKLDI

SEQ ID NO: 4352 - protein, 194 aa, Proteus mirabilis
NIMSHSKKQLGYIMSKSENNLIWIDLEMTGLDPERDRIIEIATIVTDPQLNILAEGPVIAVHQSDKLLASMDEWNTTTHTASGLVQRVKESQYDDAAAQQATIEFLEKWVPQGASPICGNSVGQDRRFLFRYMPELEKYFHYRYLDVSTLKELARRWKPEILEGFKKNNTHQALDDIRESIAELAYYRQTFIKE

SEQ ID NO: 4353 - protein, 370 aa, Proteus mirabilis
PSYPKMDCRYKRSMALRRILVTGGAGFIGSAVVRHIIDNTNDSVVVVDKLTYAGNLESLAPVANSERYAFEQVDICDRATLDSLFAQYQPDIVMHLAAESHVDRSIDGPAAFIETNIVGTYTLLEAARHFWSVLPEDKKAAFRFHHISTDEVYGDLEGTDDFFTETTPYAPSSPYSASKASSDHLVRAWLRTYGLPTLITNCSNNYGPYHFPEKLIPLIILNAISGKPLPVYGKGEQIRDWLYVEDHARALYLVATTAQPGKTYNIGGHNERRNIDVVTTICELLEELHPNKPAGVAKYVDLITHVKDRPGHDLRYAIDAAKIAAELGWKPQETFESGIRKTVLWYLNNQTWWQRVLDGSYAGERLGLGD

SEQ ID NO: 4354 - protein, 233 aa, Proteus mirabilis
SPLPSHLSSNLWPLMKKNISLILFLLFSLITASQAAGISVGGTRFVYDDNLREISIPIMNTDKEKPYLIQSWVSAYQGDEKTPFIATPPLFRIEPDSSGTARISYTGAPLASNQEVVYWLNIKSIPPMEKSPENQLQLVINSQFKLFLRAHDIEPLDFDKVKLSKQNKGLVINNDTPYHLTIKHILVGDKRYPFNDFVNPHQEVVLLKENHIPQKVTVQFINDYGATVDKVLN

SEQ ID NO: 4355 - protein, 326 aa, Proteus mirabilis
KNMPNDTLDNVIGYDNPVTYFISINTRDSMSQKNTLKGVLCALGAYLIWGIAPVYFKSIQEVPAEEILTHRILWSFFFMLLLMSITRHWPYLRQLVRQPKKVLMLALTAVIIASNWLIYIWAVNHGFMLEASLGYFINPLVNVLFGMIFLGERFRRMQWFAVSLAFTGVFIQLWQFGSVPVIGLSLAVTFGLYGLLRKKLGVDAQTGMTIETLWLFPVALVYILFFTHSPTSNMLENSWSLNTLLIAAGVITTVPLLLFTEAAQHLRLSTLGFFQYIGPTLMFILATMVYGEQIDAERLVTFGFIWVALILFTLDALYTQQRLRRS

SEQ ID NO: 4356 - protein, 130 aa, Proteus mirabilis
LPNTPRHKYDDRELGVCQMAESFITTNRFFDNKHYPRGFSRHGDFTIKEAQILERHGQAFNELDLGKREPATEAEKLFVAMCRGEREAATVEEKIWKKYTSRISRPKRFHTLSGGKPQLDPSDDYTDSDD

SEQ ID NO: 4357 - protein, 683 aa, Proteus mirabilis
YSWLMKFGKSMRLNPGQQKAVEYVSGPCLVLAGAGSGKTRVITNKIAYLIRQCRYSAKQIAAVTFTNKAAREMKERVAQTLGKQEAKGLMISTFHTLGLEIIKREYKALGIKSNFSLFDDQDQSALLKELTVDLLEEDKDLLSQLKSQISNWKNDMLTPEQVIGRAQSQQDHTFAECFRRYEQHLLSCNVLDFDDLISKPTLLLRTNEEVRARWQQRIRYLLVDEYQDTNTSQYELVKWLVGERARFTVVGDDDQSIYSWRGARPQNLVLLQKDFPQLNVIKLEQNYRSSGRILKSANILIENNPHVFEKRLFSELGYGDELRVLTANNEEHEAERVAGELIAHHFINKTNYKDYAILYRGNHQSRIFEKYLMQNRIPYRISGETSFFSREEIKDILAYLRVITNPDDDAAFLRIVNKPRREIGPMTIQKLGEWAKVRDKSLFNACFDLGLSQTLTGRGLSALQAFSQWMARIVQQSEREPLLAVRDLLHEMDYESWLYETSSSAKAAEMRMKNINQLFSWMSEMLEGDELHEPMTLSQVVNRFTLRDMMERGETDEELDQVQLMTLHASKGLEFPHVFLVGMEEGILPHQSSIDEDNVEEERRLAYVGITRAQKTLTFTLCKERRQYGELIRPEPSRFLYELPQDDLHWDTNKKKVLSAQEKQEKGQKGVAGLKAMLARHKP

SEQ ID NO: 4358 - protein, 67 aa, Proteus mirabilis
RILTKLMIGRFRMKTYLRCTLAIITLISLSGCGLKGPLYFPPEDTQANMTQSSQPTQQVETSSTQNN

SEQ ID NO: 4359 - protein, 641 aa, Proteus mirabilis
GSITRQVVMAPLYWCLFFYSSLSFLPAFQRNGVSTAEVLNSMPSAQVILRETFGYQQFRPGQQEIIDTIITGRDCLVVMPTGGGKSLCYQIPALLLDGLTVVVSPLISLMKDQVDQLCLHGIDAAFLNSTQSRDEQLQVQMRCQRGEIKLLYIAPERLMMESFLHHLVQWQPALLAVDEAHCISQWGHDFRPEYRGIGLLRQYLPDVPIIALTATADNTTRHDIINQLALRTPLVHISSFDRPNIRYTLVEKYKPLDQLWLFIRGQKGKSGIIYCNSRSKVEETAERLGKRGLSIAAYHAGMDIATRAKVQDAFQRDDLQIVVATVAFGMGINKPNVRFVVHFDIPRNIESYYQETGRAGRDGLPAQAVLFYDPADMAWLRRCLDEKPESEQKAIESHKLNAMGAFAEAQTCRRLVLLNYFGEHRQQACGNCDICLDPPKQYDGLVDAQKALSCIYRTGQRFGIGYIVEILRGANNQRIRDNGHDKLPVYGIGKAHSHEYWMSVIRQLIHLGMVAQNIVHRSALQLTEIARPILRGEVSLPLAVPRLLSPTKSRYQQTKNSHRQYDRKLFAKLRKLRKSIADEENIPPFVVFNDVTLIEMAEQCPVCPDELLLINGVGQRKLERFGPAFMTLIRDHIEGFE

SEQ ID NO: 4360 - protein, 74 aa, Proteus mirabilis
PHETYSYFYLSITHQNITLLNNYIAVVNTERKTINLLFILLIEIIKFKNKKFRINNNFLSNNYFLTLFIFYIFQ

SEQ ID NO: 4361 - protein, 100 aa, Proteus mirabilis
HNETILSIYNYTILEYEHHKMLLSFLFTYRDLFYYQRSFLLSKELRNNSDHLSCLLFSLILMFINFCNIKSHLCSVFFKNLCKHAYLFLLLKITKIRFYT

SEQ ID NO: 4362 - protein, 354 aa, Proteus mirabilis
GSVTKRKLSKGQQRRVQENHKKRLQSKEKKNHVELDDTQLGEATEGLVISRFGQHADIEAVDGSITRCNIRRTISSLVTGDRVVWRPALQTQENVRVNGIVEAVHERTSVLTRPDYYDGIKPIAANIDQIIIVSAILPELSLNIIDRYLVACETLNIDPLIVLNKVDMLDAESRAMVSEWMQIYKDIGYRVLEVSSYTKEGLEALTQALIGRISIFAGQSGVGKSSLLNTLLPPMEESILVNQVSDNSGLGQHTTTASRLYHFPLGGDVIDSPGVREFGLWHLTPEQVTKGFIEFRPFLGGCKFRDCKHNDDPGCLITEAVDKGEIAPTRFENYHRILESMSQVKVRKNINLDS

SEQ ID NO: 4363 - protein, 80 aa, Proteus mirabilis
IDNADYVLDELLKVTNTQANFPMKGSIPKELQSLGIREYQQIFFKPYRVIYHTIAKQVVIFIIADGRRDMQALLTRRLLG

SEQ ID NO: 4364 - protein, 525 aa, Proteus mirabilis
LMAAFRPLTSAPSSAEYLKAALSAPVYEAAVVTPLQEMAKISQRLENTILVKREDRQPVHSFKLRGAYNMIAGLTPEQKAKGVVTASAGNHAQGVALSANRMGVKALIVMPIATADIKVDAVRQFGGEALLYGANFDEAKAKAIALAKEMGYTFVPPFDHPAVIAGQATLAMELLQQDVHLDRIFVPVGGGGLIAGVAVLIKQLMPEIKIIGVEAEDAACLKAALEAGHPVELPRVGLFAEGVAVKRIGDETFRLCQKYVDDVITVDSDAICAAVKDLFEDVRAIAEPSGALALAGLKKYVEEHQIKGERLAHVLSGANVNFHGLRYVSERCELGEKREALFAVTIPEQKGSFLRFCQILGQRVVTEFNYRYSDADPENARIFVGVRLSQGLQERKEIVQQLTEAGYQVSDLSDDEMAKLHVRYMVGGRPNQPLKERLFSFEFPEAPGALMKFLKTLGTYWNITLFHYRSHGTDYGRVLVAFELPETEGRFERHLDALGYEYHDETGNPSFQLFLSPQTASLVVE

SEQ ID NO: 4365 - protein, 845 aa, Proteus mirabilis
EYTAMTFSMIAVSTKRLPINMADNLYRRGVLAIAITTVLFPYTVLAEDIFNPEALNLGIENHVADINSLNYLSYAGGQLPGVYSVDIYLNDKLIDNRQIRFIFDDDKKVLAPEISKQDLLNWGVKGSVTDAFSQQPDSSKITDIARVIPNATYKYDFSRARLSFSIPQIALYNYGQGYISPTEWNDGINAAFINYTYRQNKYWYRDQKDSDNIFLGLRSGINLGAWRVRNHSTYNKNSDNAAEWNSLQTYVERDIRRLKSRLTLGETASSNDVLESVPYRGIKLASDESMLPQSQRGFAPVVRGIAQSNAMVTIRQNNSVIYQTSVPPGEFEISDLYPTSYSGDLQVTVEEADGSKRTFSQPFSAVPMMQRAGNLKYSLDLGKYNADSAERKPTFLQASAIYGLPYNFSLYGGTLLSADYQAYAIGAGVNMGYLGAISADITHANTTLIDNHKAQGQSYRVQYSKYLPDTKTGFSLASYRYSTKDYYDFSTTNERFSQLYRKKKQFQISVSQALGELGYLSLNGYQQYYWYQDRVDRNINLSFNSNYRSLSYSISYAYNKRQESELTDQILSINFNLPFNMTSNNNWLSYRYNTSKQGDSISSVSLSGTRLEDNNLQYDISQNYNHTRQEYSGAINGSYSASGGEISAGYNYDKRFQSVNWGATGALLIHQDGITPSRTIYDSAILIKAEDIDHLKISSAQSLYTNAQGYAVIPNVSRYERNRVTVDPASLKGNNDVELTSTTVIPTKGAIVLADFKARKGARVLVNLSYNGKPLPFGSQVEISQDGQVISSGIVANDGEVFLNGVPASSQLQAKWGNSATEQCQATLNADLSLEKIQFLQLDCR

SEQ ID NO: 4366 - protein, 308 aa, Proteus mirabilis
MQRYFYYLPRRLTMDIRDLKLFLHLAESCHFTKTAQAMHVSPSTLSRQIQRLEEQLGHPLFLRDNRQVTLTDAGEQLKRYAQHTLLQYKQLKHTLNQNSPSLSGELRLFCSVTATYSHLPPILDRFRAENPLVEIKLTTGDAADAVDKVISDEADLGIAGKPEKLPENICFEKIGEIPLVLIAPALPGNVRHLATQEKPDWLNIPFIIPEHGPSRQRIALWFKRHRIQNPLIYATVSGHEAIVSMVALGCGIALIPQVVVDNCPEPVRNRISLLDNISLVEPFELGVCGLHKRLQEPVISAFWRLLHH

SEQ ID NO: 4367 - protein, 438 aa, Proteus mirabilis
LIFYYIMSKTYLTEKKFSDFALHPKVIEALEKKGFSNCTQIQALTLPITVKGHDIAGQAQTGTGKTLAFLTSTFHYLLTHPAKEGHEKNQPRALIMAPTRELAVQIYTDAQPLAQSTGIKMGLAYGGDGYDEQLKVLNNGVDIVIGTTGRLIDYVKQGHINLNAIQVVVLDEADRMYDLGFIKDIRWLFRRMPNAAERMNMLFSATLSYRVRELAFEQMNNPEYVEVEPEQKTGFSIKEELFYPSNEEKMRLLQTLIEEEWPERCIIFANTKHRCDDIWAHLAADGHRVGLLTGDVPQKKRLRILEDFTQGNIDILVATDVAARGLHIPSVTHVFNYDLPDDCEDYVHRIGRTGRAGKSGNSISLACEEYALNLPAIETYIQHAIPVSKYNSDALLTDLPEPKRRHRPRQGQPRRNNSAPRRGNNTQRNNRNKRPSHS

SEQ ID NO: 4368 - protein, 160 aa, Proteus mirabilis
PLGLNWNLKACRRFILPIILWSMKNETNIRRGKHCVFLIHVHLVFVTKYRQKIFDQDAIEKWRGYFASVCADFDVERVEMDGERDQVHLLINYPPKLAISNLVNSLKGVSSRLLRRDRPDIAQRDYYKGVLWSPSYFAGSCGGAPISIICQYIEQQETPS

SEQ ID NO: 4369 - protein, 335 aa, Proteus mirabilis
TLKHRFTDNPIKGGYNRPLLSIFYRSIPEVAILDKLKIKLQYLLPKLWLTQLAGWFANKKAGSVTQFAIKMFARAYKVDMNEAKESQFQAYATFNEFFIRALKDGARPIVEGDNQLALPADGAVSQLGQIQDDQILQAKGHSYTLEALLAGNFTLADQFRHGQFITTYLSPRDYHRVHMPCDGLLKEMIYVPGDLFSVNPLTAANVPNLFARNERIICLFDTQFGPMIQILVGATIVGSIETVWCGMVTPPREGIIKRWTYPQADKVGAIFLKKGEEMGRFKLGSTVINLFPENSVQLNKDLMNGSVTLMGELLGSIINATGTDHKACDNNTINE

SEQ ID NO: 4370 - protein, 72 aa, Proteus mirabilis
NYFKNNHCQHENIMVTLKGQSEREHNTDYFLLQKKNFNIMNTIVLVISLIIVSVVVIINPLCGAALGRRKAN

SEQ ID NO: 4371 - protein, 562 aa, Proteus mirabilis
INIKQEVKTQGERMNGAQWLVQALRKQRVETVFGYPGGAIMPVYDALYDGGVEHVLCRHEQGAAIAAIGFARSTGTTGVCIATSGPGATNVITGLADALLDSVPVVAITGQVASNLIGTDAFQEVDVLGLSLACTKHSFLVSDVNELPRVVSEAFSIAKQGRPGPVLIDITKDVQLADASHLADYPLPQEQEFPYPEHEIAQALQMLAQAKKPILYVGGGVAMSQGVEALRSFVKQTQIPVVSTLKGLGCANAFDANYLGMLGMHGTKAANYAVQRSDLLIAVGARFDDRVTGRLNTFAPNAKVIHIDIDYAELNKLKQAHIALLGDAKVLLPKLSQPLAIEAWQEEVQQLIAEYAWRYDHPGEAIYAPLLLKQLSDAKPENSIVTTDVGQHQMWSAQHMTFDAPENFITSSGLGTMGFGIPAAIGAQIARPDACVICVSGDGSFMMNVQELGTIKRKQLPIKLVLLDNQRLGMVRQWQELFFEQRYSETILTDNPDFVALAKAFDIPGQRITEKAQVAEAIKCLLTSDGPYLLQVSIDDAENVWPLVPPGASNDEMMEKSK

SEQ ID NO: 4372 - protein, 617 aa, Proteus mirabilis
KMPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQLIKLDLVDAMIQGANPNVSDADSEQIERSACPTCGSCSGMFTANSMNCLTEALGLSQPGNGSLLATHADRKTLFINAGKRIVELTKRYYEQDDLSALPRNIAKKEAFENAMILDIAMGGSTNTVLHLLAAAQEGDVDFKMEDIDRLSRQVPHLCKVAPSTQKYHMEDVHRAGGVMGILGELDRAGLLNRNVNNILGLSLPETLAQYDVMLSQDEQVKSMYQAGPAGIRTTKAFSQDCRWPTLDTDREQGCIRSKAHAYSQDGGLAVLSGNLAQDGCIVKTAGVDEDNLVFSGPAKVYESQDDAVEAILGGKVVAGDVVIIRYEGPKGGPGMQEMLYPTSYLKSMGLGKACALITDGRFSGGTSGLSIGHVSPEAANGGIIGLVEEGDIVDINIPNREINLRVDEKTLAARREAQLARGDKAWTPKDRQRQVSFALRAYASLATSADKGAVRDKSKLGG

SEQ ID NO: 4373 - protein, 165 aa, Proteus mirabilis
PNNKMSRNFKMEKILTLEEAQALIGHVFVYQMPFNQLIGLELIRFEQDYAEIQFRYQDKLVGNIAQRILHGGMIASVLDVSAGLVCVGNALTRLAPISQEQLEQKLAKMGTIDLRVDYLRPGRGECFTASSHILRSGNKVSVARVELHNEKQVHIASGTATYIVG

SEQ ID NO: 4374 - protein, 527 aa, Proteus mirabilis
HLNKNKLKREKIMENKKMALAVIYTRASLGISAPLITIEAHISQGLPGLTLVGLPETVVKEAKDRVRSALINSGYSYPAKRITINLSPADLPKEGARYDLPIALAILIASEQLISDKLNSYEFIGELALSGKLQKVNAVIPSILSANKDNRISIISIEHQSEVSLLPNKSALLASHLLDICHHLENNTPLIEAKNNINHKTIENQNNKDISDIIGQNNAKRAAEITAAGNHNILFLGPPGTGKTMLAQRINTLLPPLTAKEALDVLIISSLSNTIHHDGKWPLRPFRAPHHTASAVALTGGGSIPKPGEITLAHHGILFLDELPEFDRRVLDALREPLDARKITISRAKAKISYPANVLLIGALNPSPTGHYQGTHNRTPVKQVLRYLSKVSGPFLDRFDLSVEMPLLPQGALLQSTHTNESSSIIRARVLQARERQFQRSGKLNTYLSSKEIEHFCQLHTEDALFLEETLNKLGLSIRAWHKILRVSRTIADLENEQKIQRNHLIEALSFRAMDRLMIYLQKQLEG

SEQ ID NO: 4375 - protein, 362 aa, Proteus mirabilis
ALNKQRSFNVMNSENNVSRQGFSPDNELDIRGLCCALWSGKRWIIGFALLFALIALGASYLMQPKWSAIAMTERPTVNNLGSYYSQSQFLRNLDTQINPSVTVSQLSIPDEAYQEFVTQISAFDTRREFWLQTDYYKQRKENDAQADAALLDELINNIQFTPADEKKLVNDQLKLIAETANDSSQLLNEYIAFANKRAAEHLNEEVIAAWATRTQSMKALVKRQEMAAQAAYQRQINLLKQSIKVAEKQGISQKQTSIAIDELPDSKLFLLGVPLLQSQLETLMATGPDFDSDYDQNTAMLSTLAVGAKLQDNFQTYRFLRTPEDPVKRDSPRRAFMMVLWGAIGVLVGAGVALVRRSSLKK

SEQ ID NO: 4376 - protein, 296 aa, Proteus mirabilis
DFLNTKQLVNIRNGTPVSGRVKMQFSKMHGLGNDFMVVDAVTQNVYFSPELICRLANRHTGVGFDQLLVVEAPYDPELDFHYRIFNADGSEVAQCGNGARCFARFVRLKGLTNKREIKVSTQSGRMTLHVMDNEDVCVNMGEPEFEPQKVPFRAQKVEKTYIIRAMERTVLCGVVSMGNPHCVIQVEDIKTAEVESLGSVLEQHERFPERANIGFMQVVDRNTLHLRVFERGAGETQACGSGACAAVAVGISQGLLDRKVKVNLPGGSLSIEWKGTGNPLYMTGPAVHIYDGTIQL

SEQ ID NO: 4377 - protein, 262 aa, Proteus mirabilis
LTNKSEKAQNHSPKQVMAAIYWIYYMSVLANINYLEWESDFFSLNTGRLEFSAQAPVLTQDRLEQFTVVHAKVASYDLLLIDNLTQLGFQFAEGEIDFKLPIGTENACENIAEIHFRTANETDIPLLMTTASAAFVQSRFRAPWYQEGDSSRFYALWVKKAVLGTFDDSCLLTMDRENKVTGFVTLRRISESEARVGLLAVMPNRTGQGIGKQLMSVAKYWCQQQGLSTLYVATQISNIAASRLYTQSGALIDSTTYWLYRG

SEQ ID NO: 4378 - protein, 141 aa, Proteus mirabilis
QGCNVNTFSFEICLSLIWLISSIIAVRSRKANRKMKMNDSEFHQLADELMSEIEQTIDNYEGDADIDCEINGGVMTLTFENHSKIIINRQEAFHQVWLATRSGGYHFDWKGTQWVCDRSGGEFLTMLAQAISEQSGEAFSF

SEQ ID NO: 4379 - protein, 1116 aa, Proteus mirabilis
FGVNLVRLIISLLFSFFLTISFNTSVFAADVDKLRQDIKQLEGSTNPQDIETVQALQGTINWINDGEKAQVNADNYQKTIDEYPQITQELRAKLLEESHSVPTIPEKITIPELEQKIIQVSSQLMEQARLQQQEQDKSREISESLNLLPQQLSEARRLLSDATARLAAIGASNTPLAEAQNKLTQAEVTARKAMVNELEMAQLSANNRQEITRLRLELFKKRYQRLDVQLQQLRSLLNIKRQEVADLALEKTEMLAEQGGELPEFLTKQIETNRQLSQILNKQTQEMSELTEKQRLTTQQTQQVRQTLTTIREQAQWLSGSTALGEALRTQLARLPEMPRSQELDRDIVQLRVERLGYEEMLENLGKIQPPETADGSKLPEAQQYIFDSLIQARQELLNSLLSGYDSQILELTKLKVATTQLADALKETKDATNRYMFWVADISPMKLNYPVLLIKDITRLLSLDTFSQLGHAAVNMLKNQDTFIYLLVTLSIVGFSLRTRKHYNAFLERVSNRIGKVTQDHFSLTVRTVFWSILIALPLPLLWSAVGYGLQSVEWRYPMAGAIGYGVTAAAPVLWLFMISATFARPNGLFIAQFKWKESRVKKAMRFYQLSIFVIVPLMMSLITFEYYSDREFAPTVGRFCFLLLCIALSFITSSLKKAHVPLYLDKHGSGDNVINTILWWFLLVAPVLAALAAILGYLSTSIVLLGRLEMSVAIWFALLIIYHIIQRWMLIQRRKLAFERAKQKRAEILAQRAKGEDENTIVGSSGESTANLELEDQAIDLDAISAQSIGLVRSILTMIALVSMILLWSELNTAFSFVDNIRLWDVTSSVNGVNTIQPITMGSILVAILVIIITAQLVRNLPALLELAILQHLDLTPGTGYAITTLTKYSITLIGSIVGFSLLGIEWSKLQWLIAAMGVGLGFGLQEIFANIISGLMILFEKPIRIGDTVTIRNLTGNISKINTRATTLTDWDRKEIIVPNKAFITEQFINWSLSDSITRIVMTIPAPADCNSEQVTNVLLEASKRSTMILDNPAPEVYLVDLQQGIQIFELRVYAAEMGHRMPARHEIHQNILLAFAEHGIPLPFPPFQARVDMVGNTISTSMRATPREVGGL

SEQ ID NO: 4380 - protein, 383 aa, Proteus mirabilis
QRKKRATVKVLTVFGTRPEAIKMAPLVHALANDNSFEAKVCVTAQHREMLDQVLNLFEIKPDYDLNIMKPGQDLTDITCRILEGLKPVLASFQPDVVLVHGDTTTTMAASLAAFYQQIPVGHVEAGLRTGNLYSPWPEEANRTIAGHLAMYHFAPTETAKLNLVREAVADKNIFVTGNTVIDALFWVSERVMGNQTLLDELAVQYPFIQPERKMILVTGHRRESFGGGFERICQALAEIALAHPDVEVVYPVHLNPNVSEPVKRILHGINNIKLIQPQDYLPFVYLMNHAYLILTDSGGIQEEAPSLGKPVLVMRDTTERPEAVEAGSVRLVGTDTKRIVSEVTSLLTDENAYHQMSKATNPYGDGHACQRILEALKNNQVTL

SEQ ID NO: 4381 - protein, 503 aa, Proteus mirabilis
IMLKSSSLYAAIDLGSNSFHMLVVREIAGSIQVLSRVKRKVRLAAGLNKENELSEQAMERGWQCLRLFSEYLRDIPAEQIRVVATATLRIAKNADIFVAKASEILGNTVHVISGEEEARLIYRGVAHTTGGAEQRLVVDIGGGSTELVTGTGAKTTQLMSLSMGCVTWLERYFSDRSLTEENFAQAQQAAKAILAPVAEKLIQQGWQVCVGASGTVQALQEIMIAQGMDELITLPKLERLKQKAIECGKLEELEIEGLTFERALVFPSGLAILIAIFETLHIENMILAGGALREGLVYGMLHLPIEQDIRQRTLRNIQRRFQIDIEQAHRVQQLAEHFFIQVSKSWQLDNRCRELLSSACALHEIGLSVDFRQAPSHASYLVSHLDLPGYTPAQRRLIASFLRNQKGIIDLAPLNQQNALPINQAYRLVRLLRLAIIFASRRRDDTLPALRLRTEDEKLIITLPHQWIAEHPLRAENLHEEIQLQSYVHWPLMLEEQNNSRIG

SEQ ID NO: 4382 - protein, 67 aa, Proteus mirabilis
SAALRRQRSQVRILSGAPLKRAKSYGEERCCRSSKIAVMVAIAQLVEPWIVIPVVVGSSPISHPILS

SEQ ID NO: 4383 - protein, 90 aa, Proteus mirabilis
TIHLFKHITHRCKCTFQPELINRIQPLLQCFNIKIQEFRLNNTKKIVESEFINYRALIIQLLIDKTLLTKSRKRDQFNTLQARRKEDLKI

SEQ ID NO: 4384 - protein, 72 aa, Proteus mirabilis
DLCLRRAALYPAELRALHAVAGEDSTDLRTVCLVLFEKKSLFDDSLCISSINGAFLPTQRPISIIIKQSRYQ

SEQ ID NO: 4385 - protein, 98 aa, Proteus mirabilis
DDGEIKMNQHNITIEARFCPEILERILRVIRHRGFHICSMNMNITESNYINLALTVSSQRPVDLLCSQLTKLADVAGIQVLHQQQKEKLQFISALSAM

SEQ ID NO: 4386 - protein, 416 aa, Proteus mirabilis
HHKENKFMFKILLLFVVLIAGIIFGPVLAGHQGYVFIQTDNWDIETSVTSLVIMFVLLQLILLLLGWCYRRFIGTGSKAYSWFSLRKRSRARKQTRLALMKLAEGDFKQVEKLMSRNADYAEQPVVNYLLAAEAAQQRGDEFRVQQHLERASELADTNQLPVDITRVRILLAQNENHAARTGVDELLNQVPRHPEVLRLAETAYIRTEAWQALLDIIPSMQKIALHTDDELEQLRQQAYIGLMGQKMSENGCDGLKNWWKAQPRKIQHDNGLRFVLAEHLIECNDPQTAQTIILDGIKRHYDERLILLLPRLKNSDPDSILKVLNSLIKQHGPTPLLNSTVGQIAMQQGQWAQAETAFRNALKQRPDVHDFAWLADVLDKQNKSVESAKVRKDALLMTLKKDSVIFDEPKTNKALQ

SEQ ID NO: 4387 - protein, 388 aa, Proteus mirabilis
LIALLIGYTGDNMIPFNKPPVVGTELEYMKQAMESGKLCGDGNFTKKCEKWLEEQFHCHKTLLTPSCTASLEMAAILLDIKPGDEVIMPSFTFVSTSNAFVLRGATIVFVDIRPDTMNLDETKIEAAITEKTRAIVPVHYAGVACEMDTIMAIAKKHNLFVVEDAAQGVMSTYKGKALGTIGHIGCYSFHETKNYSSGGEGGATLINDPALINRAEVIREKGTNRSQFFRGQVDKYTWRDIGSSYLLSDLQAAYLWAQLEQADKINERRLAFWQIYYDALTPLAEQGLLTLPVVPDGLEHNAHMFYIKLNDIEQRTAFNEYMKAQGVLTVFHYVSLHTSPAGMKFGRFDGKDIFTTQESERLVRLPMFYNMTEEEQQTVIHHIRHFFA

SEQ ID NO: 4388 - protein, 270 aa, Proteus mirabilis
SGMCMYSIVASDLDGTLLSPNHLLTPYTKETLHLLIEKGIHFVFATGRHHIDVAQIRDGLGIDAYMITSNGARVHNTQGTLIFSQDLEPEIVYDLALMVFDHPDIATNIYSSDDWYINKETPELKEFFKESVFNYRLFEKTGFPTTQVCKVFFTSEDHELLVELEKKINQRWGNKINASFSLRNCLEIMAGGVSKGEALQKVAKLMQHSVKDAIAFGDGMNDKEMLQMAGKGCIMQNAHQLLKDLLPDMEVIGSNVDDAVAHYLRKLYQV

SEQ ID NO: 4389 - protein, 371 aa, Proteus mirabilis
FCFRDLLQAQMTTLIYVLGSDIVHHNNTMLRFFNDHLVTEAALTYKPRFIVASKDNSLSSLYPHLEIECLADKKQVAQRVVALAKADRKQRFLFLGQFNAPIWLALLMGKIKRHQFWWHIWGADLYQDAKQLKFRLFYLLRKLAQKRVGRVFGTRGDLNYFAQSNVNIPANLLYFPTRMDPALTLTEKKAVDPQHITIVLGNSGDKSNRHIDALNAIAEQFGHKAKVIIPMGYPANNEDYIQQVSDAATNLFPTEHVEILRHNLAFDDYLALLKTCDLGYFIFQRQQGIGTLCLLIQFGIPFVISRQNPFWQDLTEQSVPVFFSGDKLDVALIEEAQRQLLLLDRKNITFFAPNFIQGWKQLIEMSTGDTQ

SEQ ID NO: 4390 - protein, 293 aa, Proteus mirabilis
LTMRYIRSLLTVILTYPVWGVAAEISPVSSPTPLVQGSIISGLLQEYDSPFVLYPYESNYIIYTKTSDMNKEAIASYDWGHKAKKDEVKFQISLAFPLWRGIAGENSVLAASYTQRSWWQLSNKKESAPFRETNYEPQLFLGWATDYQFAGWTLREIETGFNHESNGRAEPTSRSWNRVYARFMAQKGNFQLDLKPWYRFNESAKNDDNPDINRYMGYYRLKAGYRLGESTFTLTGRYNWSSGYGAAELGWSYPITKHVRFYTQLFSGYGESMIDYNFRQTRIGVGVMLNDML

SEQ ID NO: 4391 - protein, 442 aa, Proteus mirabilis
SNIFCRYFVTKTKWTCIRNTQCLPRRILVSFFIDQSIIGNMKRLQAFKFQLRPNGQQEREMRRFAGACRFVFNRALARQNENYEAGNKYIPYTKMASWLIEWKSDTETQWLKEAPSQPLQQSLKDLERAYKNFFQKRTAFPRFKKRGKNDAFRYPQGVKLDQSNSRISLPKLGWMRYRNSREVVGEVRNVTVSQSCGKWYVSIQTEYEATEPQHESTSIVGLDAGVTKLATLSDGTVYPPVSSFKVNQRKLARLQRKLSRKIKFSANWQKQKRKIQRLHSHIANIRKDSLHKVTSEISKNHAMIVIEDLKVSNMSKSAKGTTERHGRNVKAKSGLNRAILEQGWYEMRRQFEYKQLWRGGQVLAIPPAYTSQKCACCGHTAKENRQSQSQFECLECGYTANADINGARNILAAGHAVLACGGRVQSDRPSKQEPAEVIQTSV

SEQ ID NO: 4392 - protein, 254 aa, Proteus mirabilis
TSFRTKGKVMDTNSIPKYSIRGHNIWGFKDMAHFLDYLYQGAQIKSGSLIAINAEKILTAETDKGLNQLLDEADYLYADGISVVRGIRRKYPDAQVSRIAGADLWEALMERAGKEGTPVFLVGGKPQVLAQTESKLKAQWNVNIVGSQDGYFTPQDRDALFERIKASGAKIVTIAMGSPKQELFIRACRQVHPDALYMGVGGTYDVFTGHVKRAPKAWQNLGLEWLYRLLSQPSRIKRQFKLLKFVGYYYSNKL

SEQ ID NO: 4393 - protein, 111 aa, Proteus mirabilis
IGGSITMINNSKAYLAQERLFLIDKFGPLLFFLIPLIMLIIGGKSWAKYVAFLCQGIALIYIVVFYQARKYYLSFQHENNKGIPYRFYRIAWVYLFLILCLEVVLLVQHAF

SEQ ID NO: 4394 - protein, 461 aa, Proteus mirabilis
DEHRRHPMTLAQLGGLTLVYFISLGFILLLTYQEFRRVRFNFNVFFSMLYLLTFYFGFPLTCLLVFQFDVAVVPVDALLHALLAATSFYAIYYVTYKVRLRKASSEPSRPLFTMNRVETNLTWILLALIAIVTVGIFFLQNGFLLFKLKTYSQIFSSQVSGVALKRFFYFFIPAMLVVYFLKPTQQRWLFFLCATVGFGILTYVIVGGTRANIIIAFALFLFIGIVRGWITLWMLIAAGVMSIVGMFWLALKRYGLDVSGAEAFYTFLYLTRDTFSPWENLALLLNNYDKIEFQGLAPIIRDFYVFIPSWVWPQRPDVVLNSANYFTWEVLNYHAGLAISPTLIGSLVVMGGVVFIPLGAVVVGLIIKWFDWLYQQGLNEHNRYKSAILQAFCFGAIFNMIVLAREGVDSFVSRVVFFCLVFGACLIAAKLLYWLFESAGLVRHYVINQVRNKPRLEQKEK

SEQ ID NO: 4395 - protein, 436 aa, Proteus mirabilis
LKKSSKPLFIIFAISLLDMSLAKASIWTAGSTLIKIGAGLLVVKLLAVSFGPSGVGLAGNFRQLITVLGVLSGAGIFNGVTKLIAQYQDDAVQRKNVLGTSSSMILLFSTLLAILFLIFTTPISRVLFGDDYLQYLDIVRMVAFIQMGIAYANYFLAILKGYRDASGNALAIIAGSLIGVIAYYLCYLVAGYHGALIGLALVPALILLPAMVILIKRKRFALSELKPSWDKAIASHLGKFTIMALLTSITLPVAYIMMRNLLAEHYSWDDVGIWQGVSSISDAYLQFITASFSVYLLPTLSRLTQKSEIAKEITKSLKFVLPAVAVASFMVWLLRDFAIWLLFSEKFIAMRELFAWQLVGDVLKVGAYVFGYLVIAKAALRFYILTEVSQFALLTLFSRWLIPEHGALGAAQAYMATYIIYFLLCSSVFVIYCRRK

SEQ ID NO: 4396 - protein, 240 aa, Proteus mirabilis
EVLGMTDKNEQFCYPEKNELNDQTIIDYLKEHPGFFIRNASYIEQMQVPHPVRGSISLVEWIMSRQRTRIHYLEEDMRLLIEQAAENESLFSQLLRLISELSRCNSLKEMLERLNLWAKELGLYSVQLRLFTDRWQLQPPLDAQTLALSRQTFEHFRIQRMGDNNHYLGPLNGQEMMLLMPNVRRSGSVALSLLGHYGDLGVIIFNSRDSQHFQEGMGTAMLDKLAQILPELLTRWIARQ

SEQ ID NO: 4397 - protein, 122 aa, Proteus mirabilis
CYTGTVNIILWSRTMSDKILHLSDNTFDVDVLQATGPVLVDFWAEWCGPCKMIAPILDEVATEYAGKLTVAKLNIDENPATAPKYGIRGIPTLILFKNGAVAATKVGALSKTQLKEFLDENI

SEQ ID NO: 4398 - protein, 69 aa, Proteus mirabilis
RISGAVVQLVRIPACHAGGRGFESRPFRQLFRGVVQLVEHRSPKPGVGSSSLSAPASYQLSNNKIYTTL

SEQ ID NO: 4399 - protein, 294 aa, Proteus mirabilis
MMKGIILAGGSGTRLHPITKGVSKQLLPIYDKPMIYYPLSVLMLAGIRDILIITTPDDLTSFQRLLGDGSAFGVHLQYKVQPSPDGLAQAFILGDEFIGDEHCCLVLGDNIYFGQGFSPKLKQVAQRQRGATVFGYQVMDPERFGVVEFDDDFKVLSIEEKPQQPKSNWAVTGLYFYDNRVVDFAKKVKPSVRGELEITSINQMYLECGELNVELLGRGFAWLDTGTHDSLIEASTFVQTVEKRQGFKVACLEEIAWRNGWLTDEQVRESAKSLAKTGYGRYLLDLLHVRPRQY

SEQ ID NO: 4400 - protein, 282 aa, Proteus mirabilis
RQIFLEIDVDTELLKTFLEVSKTRHFGRAAESLYLTQSAVSFRIRQLETQLGTNLFTRHRNNIRLTLAGERLIPYAESLMNTWLQAKKEISHASQHSELSIGATASLWDAYLTSWLQEAYLKRNELRIESRVSTRQSLVKQLHARELDLLFTTEAPKMDELESKVIGNITFQLMKRASHLNQQSAQFIKIEWSADLSPLSQNSSAPKTEPILTTNSAMIAYQLMKTTNAVAFLPTHWLDLYPDLSPAAVEIIQKPLFAVWLNTSDQQVLIQQLLSQPVSNHQ

SEQ ID NO: 4401 - protein, 721 aa, Proteus mirabilis
LVIMDVSYLLEGLNDKQREAVAAPRVNMLVLAGAGSGKTRVLVHRIAWLLSVEQASPFSIMAVTFTNKAAAEMRHRIEDLIGTSQGGMWIGTFHSLAHRLLRAHYLDAGLPQDFQIIDSDDQYRLIRRIVKSMALDDKQWPPRQGMWYINGKKDEGLRPQHIQTYGNPVETTWLKVYQAYQEACDRAGLVDFAELLLRAHELWLNKPQILEHYQHRFTNILVDEFQDTNRIQYAWIRMLAGQTGKVMIVGDDDQSIYGWRGAQVENIQNFLNEFPGAETIRLEQNYRSTSNILKAANALIANNSDRLGKNLWTEGAEGEPISLYCAFNALDEARYVVGRIKRWHEEGGALADCAILYRSNAQSRIMEEALLQANMPYRIYGGQRFFERQEIKDALSYMRLTANRHDDASFERVVNTPTRGIGDRTLDVVRQVARDNQITLWESALQVIEHKMLAGRAIAAIARFLELIETLANETADMPLHVQTDRIIRDSGLKAMYEQEKGEKAQARIENLEELVTATRQFSYQDEDEDLMPLQAFLSHAALESGEGQADAYQDAVQLMTLHSAKGLEFSQVFIVGVEEGMFPSQMSLDEGGRLEEERRLAYVGVTRAMKKLTLTYAENRRLYGKEVSHRPSRFIGELPKECVEEVRLRATVSRPVNHHRLGTPIVSNDTGYSLGQRVKHPKFGEGTIINIEGSGEHCRLQIAFNGEGIKWLVAAFARLE

SEQ ID NO: 4402 - protein, 342 aa, Proteus mirabilis
VINMNKYITLGCLSALLYTSTAFAEYRADTTTRTVSYNNPIYVSRTAPILTELATIDLGTMYGWTWWNITGPVQAGIYLPGYISASSPKVGSAYVRELGTSGIGYTLHGTITVGCTGSAYVDGLYNVDGNYSNRLICTSNLNRSSYTASLKMTLYKLRNNIKSQTIPSTWVAMLILYHNGGFITSDNTGRTEPKVYLNPLNIVSSGCEVINNNINVPLGSVAKSSFNGVGSVSPDSLQDVNIDLDCDPVSPIKIKFDGTPDASQTAGTISLNNANDSNTAKGYGIQVKYQNQPIELGKLITVSEKNNSGNFSIPLEAGYIQTSETTTAGKADGTLQFTLQYH

SEQ ID NO: 4403 - protein, 419 aa, Proteus mirabilis
DADMTEQKNTNENDLQNGTSKADDDIRYQEVKPVNNKRSGLIGSAVAILVILAIGGGLYYYTTQQATKLSTENQSLKSQLAQLQQLQDTYQQRFDNIDSQFNSQKLTIDKLQNERQVTERQIQNLQTQFAAISSADVKSWLLAQADFMVKMAGRKLWNDQDVVTAVSLLKGADSSLAEMNDPSLLAIRRAINEDIGNLAALSKIDNDGTILQLNQLANQVDNLRLSGFERDGSPMDKNDEAISGSLSDWKQNLSKSWKSFMDDFITIRRRDSTAIPLLAPNQDIYLRENIRSRLLIASQAVPRHQTEIYQQSLEAVSTWVRAYFDTTDPNTTAFLDSINELEKQPITLAMPTELKSLSLLEKRVEKQIRNLLTQNETSQPEAVEAKDAEATQAPYAVDAAQDSATSGTTTSTTVAPQGE

SEQ ID NO: 4404 - protein, 248 aa, Proteus mirabilis
YSDMSILITRPSPAGEQLTQRLIDAGKHAFHAPLIEIAAGKELSILENKLNKLSTGDYLFLLSKNAVWYANWQLNQLQQSWPDTLFYYGIGQSTAEEFQQLTGHSIRYPEFGETSEDLLALSSLQQIENKRVLLLRGNGGRELLATTLRQRGAIVDECECYQRLFIDYVSEEFALKWKNAQVDTFVVTSGEMLQQLFYLVAGSEKAWLLDSHLVVVSKRLATIASTLGFKKITVAESANNDALFHALI

SEQ ID NO: 4405 - protein, 423 aa, Proteus mirabilis
EPTIMNLTELKNTPVSELIALGENMGLENLARMRKQDIIFSILKQHAKSGEDIFGDGVLEILQDGFGFLRSSDSSYLAGPDDIYVSPSQIRRFNLRTGDTIAGKIRPPKEGERYFALLKVNEVNFDKPENARSKILFENLTPLHANNRLRMERGNGSTEDLTARVLDLAAPIGRGQRGLIVAPPKAGKTMLLQNIAANIAHNYPDCVLMVLLIDERPEEVTEMQRLVKGEVIASTFDEPASRHVQVAEMVIEKAKRLVEHKKDVIILLDSITRLARAYNTVVPSSGKVLTGGVDANALHRPKRFFGAARNVEEGGSLTIIATALVDTGSKMDEVIYEEFKGTGNMELHLSRKIAEKRVFPAIDYNRSGTRKEELLTSQDELQKMWILRKIIHPMGEIDAMEFLINKLAMTKTNEEFFDFMKRS

SEQ ID NO: 4406 - protein, 424 aa, Proteus mirabilis
SGDIMSFETISVIGLGYIGLPTAAAFASRKKSVIGVDVNQHAVDTINKGQIHIVEPDLDKVVKQAVEEGHLKAYTTPQPADAYLIAVPTPFKGEHEPDLAYVEAAARSIAPVLKKGDLIILESTSPVGTTEQMSQWLAQAREDLTFPHQQGENADIDIAYCPERVLPGQVMVELIRNDRVVGGMNRKSSERASELYKIFLEGECVITNARTAEMCKLTENSFRDVNIAFANELSLICADQDINVWELISLANRHPRVNILQPGPGVGGHCIAVDPWFIVSQNPKQSRLIHTARLVNDGKPVWVIDQVKAAVADCLTETGKRANEIKIACFGLAFKPNIDDLRESPAMNITQQVANWHSGKTFAVEPNIHELPTKLKGITELVSTEQALKEADIVLMLVDHQQFKAIPGSQVTQKWIVDTKGVWR

SEQ ID NO: 4407 - protein, 885 aa, Proteus mirabilis
SSVIYKLRFYYFLSIVQAKLLYLYIETLKQRLDAINQLRLERAFASMSDVFKQVYGLIPVLLHYHHPQLPGYIQGNVPHGTCFFEPDDVQRQWVNKLTNASCDEPMNGYTSGELPITGIYSMGSTSSIGQSHCSDIDIWVCHQSWLDQDERARLQRKCLLIEQWAGELGIDVTFFLIDENRFRHHASGSLGGEDCGSTQHILLLDEFYRTAVRLAGKRLLWTMVPVEEEYHYDEYVNSLYAQGVLTPNEWLDLGGLGELSAEEYFGASLWQLYKSVDSPYKAVLKSILLEAYSADYPNGKLLALEMKQHLHRGEIVNYGLDAYCMMLERVTRYLVSINDLTRLDLIRRCFYLKVCEKLSNEKNENEPAGWRRQVLSQLVTQWQWDHERLAILDNRDSWKIERVRNAHNELLDTMMQSYRNLIRFARRNNLSVSASPQDIGVLTRKLYAAFEALPGKVTLVNPQISPDLSEPHLTFIYVPPGRANRSGWYLYNRAPDFAHIVGHQPLEYNRYLNKLVAWSYFNGLLTKDSQVYIHQGDSSCDEIKLHELVRDISSHFPIRLPAPTPKALYSPCEIRHLAIIVNLEVDPTERFSDQVVHFDFRKLDVFSFGEEEQCLIGSIDLLYRNSWNEVRTLHFNGTQSMLESLKTILGKMHQDAAPPASVEVFCYSQHLRGLIRTRVQQLVSECIELRLSTNRLEPGRFKALRIAGQTWGLFFERLNVSVQKLENAIEFYGAISYNKLHGLPVKLGKDARYLPAVIDGFACEGIIQFFFETTEDNNVFNIYILDEANRVEIYSHCEGSKEELVKDVSRFYSSSHDRFTYGSSFINFNLPQFYQIVKVDGATQVLPFAGGSFGKLSDLGKTAPKEEMSTKPIQGFNDYQAVHHH

SEQ ID NO: 4408 - protein, 243 aa, Proteus mirabilis
ERKIIMHFYRTLMPIAAMTFDLDDTLYDNVPVMDKTEEETLAFIRQYDERFHHFTEHDVDAYKQPLLENNPDIFHDITQWRWLAAKNMLLDYGYSETKAQQGADEIMAHFAYWRSRINVPNNTHHVLTQLAEKIPLIAITNGNANPLSCGLGQYFTHILKAGPDGRSKPYPDMFDKAASLLKLPHQNILHVGDHLVTDVEGAVKSGLQACWINLDNRSLFTEGETRVMPHIEITELAKLVELI

SEQ ID NO: 4409 - protein, 135 aa, Proteus mirabilis
LMKITSVLFDTYYSIKPVTKIAEDFSVDKMPPVEPIYEQRFDTYHPSAPANPFEEDLYCRLLRHQRDFVPRMNLYLSGVIGAIRIATNSTSTFFRRSQRRIEAIAMGCNTKEEHSSPARKGYLSGAFISIDNLAQ

SEQ ID NO: 4410 - protein, 345 aa, Proteus mirabilis
GVRIAPTRRSRMTTTLFQHMWLSREKQFSAFTNGILLDFWNQRQEGEFTGVDGVSIRYVHWRSSSHKKALVICSGRSESYVKYPEVAFDFYHLGYDIFLLDHRGQGLSGRLLDDPQKGHVEKFSDYVDDLSTFIDTIVLPYHYQHYFALAHSMGGAILASYLLRKPDTFQAAALCAPMFGINLPIPRWVANFLVNRAEQSVSERNNYAVSTGKWFPLPFILNVLTHSHERYRRYLRYYADFPQLRLGGPTYHWMKESLETGDWLIEHAKEINTPLLVLEAELDKVVDNRGVRAFCDGYSQSRTREEKQKLPLVIEGAHHEILFEIDKLRSQALIEICEFYDKHLF

SEQ ID NO: 4411 - protein, 333 aa, Proteus mirabilis
NKALFINRNYANSLGRDNNIMPKSTIRIATRQSPLAMWQALYVKEQLQIAHPSLVVELVPMVTKGDIILDTPLAKVGGKGLFVKELELALLSSRADIAVHSMKDVPIDFPEGLGLVTICEREDPRDAFVSNHYDSLEQLPAGSVVGTSSLRRQCQLKALRPDLIIRDLRGNVGTRLSKLDNGDYDAIILAVAGLKRLKLTERIRSSLSAEQSLPAVGQGAVGIECRLDDHDTQALLAALNHADTATCVKAERAMNTRLEGGCQVPIGSYAIWQNDKIWLRALVGSPDGKTILRGERLVSPEDAEQAGISLAEELLDKGAREILTAVYQGNTAI

SEQ ID NO: 4412 - protein, 80 aa, Proteus mirabilis
KTFVLIFSISTVLFSIINIAGYLPIHVFFILSPACTTTSLLSNPPPFINNKFSLTIFIDVIAIFIKTINMQYTYQIIILR

SEQ ID NO: 4413 - protein, 63 aa, Proteus mirabilis
KASVPIKFEATCPVIATTGTESNNASARPVMTLVAPGPDVAIQTPVVPVERANPIAAIAAPCS

SEQ ID NO: 4414 - protein, 318 aa, Proteus mirabilis
VHLVPCKDRRMTKQADYIWFNGEMVPWAEAKVHVMSHALHYGTSVFEGVRCYDSHKGPVVFRHREHMQRLHDSAKIYRMPVAQSVDELMEACRETLRKNQLVSAYIRPLVFIGDVGMGVNPPEGYKTDIIIAAFPWGAYLGEEALDKGIDAMVSSWHRAAPNTIPTAAKAGGNYLSSLLVGSEARRHGYQEGIALDVHGYLSEGAGENLFEVKDGVIFTPPFTSSALPGITRDAIIKLAKDLGYEIREQVLSRESLYLADEVFMSGTAAEITPVRSVDGIQVGIGRCGPVTKAIQKAFFGLFTGETEDKYGWLDPVNP

SEQ ID NO: 4415 - protein, 89 aa, Proteus mirabilis
TRKVSYSGQFKKDLKLAEKRGKDINKLKEIILLLVQGKRLPAQLKDHPLTGNWKPRRDLHIEPDWLLIYKIDNDTVHFDRTGSHSDLFK

SEQ ID NO: 4416 - protein, 300 aa, Proteus mirabilis
NALLINNNKKDSIMEKSRTTLDQWITLQAVVDYGGFAQAADVLHRTQSSISYTINKLEQTLGIEILSLEKRRAVLTTEGELLLTLSREVTEKALSLEKKAKNIKINNKLKINVLIDPMYVADLFLNKISQFIKQNKQYDINIYRNSLSKSEILAQKEYDLIVSPYYIKSLQPIVLESITTTLVSHPDSPLQKLQDEELLQELQRHSCISLSPDSPDTDNQAQVIQVGSVETAISLIQHGLGYARLSLIFIQDELNKKTIKQLITHKKEKEYKFYLYLNKNSFINENLQSLLSTISYSTNI

SEQ ID NO: 4417 - protein, 373 aa, Proteus mirabilis
PAIFIIENSTVDILKMSTNVFYVFLFSFAFLFVARKVAKKIGLVDKPNYRKRHHGLIPLVGGISVYFGIVFAFYVSDIYIPHKELYLICAGILVFIGALDDRYDISVKIRATIQALVGIAMMVFGGLKLESLGHAFGPWDMHLGPFGYIVTLFAVWAAINAFNMVDGIDGLLGGLSCVSFGALGILLYQSGSSALAFWCFSFIAAILPYIMLNLGVCGKKFKVFMGDAGSTLIGFTIIWLLISSTQVDPHPINAVTALWIIAIPLMDMVAIMYRRLRKGMSPFSPDRQHIHHLIMRAGFTPRQAFVLITLAAAVLAAIGIIGENLSFVPEWVMLALFLLAFVMYGYCIKRAWRVARFIKRYKRRLRKATQLKH

SEQ ID NO: 4418 - protein, 528 aa, Proteus mirabilis
IYQFKQWLSSPIVKSCNTSPRVGITIANIYTTIWESLMANYFNTLNLRQQLSQLGKCRFMSRDEFADEANYLKGKKVVIVGCGAQGLNQGLNMRDSGLDIAYALRQEAIDEKRASWRRATENGFEVGTYEALIPQADLVVNLTPDKQHSAVVQAVQPLMKSGAALGYSHGFNIVEVGEKIRDDITVVMVAPKCPGTEVREEYKRGFGVPTLIAVHPENDAKGEGMAIAKAWAAATGGHRAGVLESSFVAEVKSDLMGEQTILCGMLQAGSLLCYDKMVAEGVGPGYAGKLIQFGWETITEALKQGGITLMMDRLSNPAKMRAYALSEQLKEIMAPLFAKHMDDIISGKFSETMMADWANDDKNLLTWREETGASAFENYPEYEGKISEQEYFDHGVLMVAMVKAGVELAFDTMIEAGIIAESAYYESLHELPLIANTIARKRLYEMNVVISDTAEYGNYLFSFAAVPMLKEFMTTLQSGDLAKHVPDSGTDNAQLRDINEAIRQHPIEIVGKKLRGYMTDMKKIAVAN

SEQ ID NO: 4419 - protein, 196 aa, Proteus mirabilis
GFFSVFSLRLLIMVLFSAIPFLNNLTQELPLFAKNLTLLANKLSLDLDAYQTDHISLRCHDLALAEQWRNGLSQCGECISDNMINGRPIYLFKLASPLTLLGQQISIVELPYPTDKKYQYQGWEHIEQVINVAPEKLVEKVMTLLPHPLPEGIKIKISEPKAEKERLPNPTVAITDGIVTIKYHPYSLLKIVESEC

SEQ ID NO: 4420 - protein, 336 aa, Proteus mirabilis
FWLSVSHQRRIIMINFSSFYQHIAQDERLFHWLDTLPAQLSEWRAHALHGHFASWERMLENLPEITPTELNLKQGVIANKTPALSTGEQLGLTNILKALMPWRKGPFSLYGVNIDTEWRSDWKWDRVLPHLSPLKGRLVLDVGCGSGYHMWRMLGEGADFVVGIDPTQLFLCQFEAVRKLLGNDQRAHLIPVGIEQMPELNAFDTVFSMGVLYHRRSPLDHLWQLKNQLVSGGELVLESLVIDGDEFQCLIPGERYAQMRNVYFIPSAKMLKVWLEKCGFKDVRIVDENVTSLEEQRKTDWMVTDSLEAFLDPLDHTKTVEGYPAPKRAILIATKP

SEQ ID NO: 4421 - protein, 616 aa, Proteus mirabilis
AIISSRDFLMNARKSNSDKRKSMNGKRIIKWMPGLGLLFNYQREYLGYDIKAGLSVAAVALPVAIAYTELLGINAIVGLYACILPMIMYALFGTSRQLITGPDAATCAVIAAVVIPLSAGDENTRWQLAIIMTAMTGFWCILASHFRFGAFTDFLSRPILQGLLNGVAITIMVGQLSKVFGFTTSPEYLIEKLLEVPFRLKEAHWPTLLMSALTLALLLGIRHFRQRWPAPLIAMVVMTYLSWQFDLVNYGIAIVDKEADNGDLFLPIVSMSGFHLGSLRELIVPSINLAVISFVSFMMTARSFASKNGYDVDADQELKALGIANIASALSQGFAVSAASSRTAVNDSVGGKTQLVSIVAALVILVVLLFMTDFIAYIPLSSLGVVLIVSSWSLLSIRHIWSYRKRNRQAFTLATFTLLAVLLAGLINGIGFAVLLGLLQFLRIVFRPSDQLLGVDEQGMIHSINQGNGIESISGLMMYRFNSPLTYFNVGYFKKRVLQLVDSAPQRPAWLAVDATVSFTYDDVSVFAVIDELIRELRIKGVKLVLAGRRTELNRWIARNKITINDDDLIIAPDLYFVIRLYQSRQQIKEKHKQQQQEPFAEDNQATFIRDTETRG

SEQ ID NO: 4422 - protein, 243 aa, Proteus mirabilis
TLISVIFRKPDLSVITEVNYMLTRLFVTGTDTNIGKTVVTRALLQSINRGGTTAVGFKPIATELHETVEGNRNRDAQIIHNSSPIDARYDEINPILLENCYVSENAIDFHQISSELNNLGQKAECVVIEGNGGWRYLLDDNTFYSDWVAKEKIPVVLVVGIQPGCVNHSILTAQSIINDGLELVGWVANRINPGLPHYAKIVERLSQHIPAPLIGEIPYLLRPEERDLSCYLDLSQLEIAQPA

SEQ ID NO: 4423 - protein, 395 aa, Proteus mirabilis
FYYSQKRALCVLLGNFKSIVDNLSACLDIIVFIMESTLSAQNIRRLLANETPIIDVRAPIEFNQGAMPNAINLPLMNNEERAAVGTCYKQHGSQKAVELGHQLVKGEIKAHRVAAWREACERFPSGFICCARGGMRSHIVQKWLAEIGIDYPLIEGGYKALRQATIEMTNELVQRPIILIGGCTGNGKTTLVRSLPEGIDLEGFAHHRGSSFGRTVEAQFAQATFENYLAVDMLKKSPYHSRWVLEDEGRAIGANGLPESLRIQMATAHLVVVDDPFERRMARLKEEYFDRMTHDFIEAYGEEKGWQEYSDYLHHGLYAIRRRLGAQRAAELTQLLDNALAAQKISANTEVHFSWLSPLLKEYYDPMYRYQLSKKQDKIIYTGSYEEVEQWFANH

SEQ ID NO: 4424 - protein, 84 aa, Proteus mirabilis
YAFLQQRTNVRNISAMRSRIFPTKSLLRLLPLAALLLSACNLNNIQTQGSASDNDVQWQSRQQALNKISQYETRGAFAYIEAHL

SEQ ID NO: 4425 - protein, 275 aa, Proteus mirabilis
KDSSMKKWLLLILCSLMTFTSLAKQRIVTIGGDITEIVFALGAGDQVIARDSTSLVPEQVKSLPDVGYMRMLNPEGILSVKPTLIIASELARPSFALRRIEKAGVPVETITGTRSLEAINEKIDAIATLLQKETESQQLKEKLTQSINQIATTPIDKKIIYIMSHGGVAPMAAGQNTAADTIITLVGGKNAMQGFSSYRLLSQEGVIASQPDILLVTKEGIKGIGGIEKLWDLPGIKYTPAGKNKRYIVVDDMGLLGFTLSTPKVMQQIRQALEQ

SEQ ID NO: 4426 - protein, 308 aa, Proteus mirabilis
IKGSYMKKLFGVTVAMVTPFDSNDHVDINALSALTNMLITKGVDCLYPCGTTGEMLRLSASERKSVAQTVVETANKRLPVFIHVGAMTVTETIELAKHAVEIGADGIGVVTPQFFAATDRELEHYFVTIANSVPENFPIYLYNIPQCAANNIKPELAAKIQQQCKNVIGIKYSFADNNTTLGYLAVADNFSVLHGYDKLFLGLLDAGCDGTVSGCACVFPEPFVNMYQAYITGNYQEAKHWQQFCVKFSDALKSGANMAIFKSALTMRGLNGGHMRLPQLDLLPEENQQLKEDLTQLCKEAGIAFSIN

SEQ ID NO: 4427 - protein, 143 aa, Proteus mirabilis
HNLSYVIFLLVELSMLKLNKIHHVAIICSDYTVSKHFYCQILGLTLLNEKYREEIQSWKAELALGTVYQIELFSFPDAPARLSYPEARGLRHVAFAVDDLDASVAYLQQNNIQCEPIRIDPSSQKRFTFFQDPDGLPLELYSI

SEQ ID NO: 4428 - protein, 218 aa, Proteus mirabilis
NLLSKILCSPFLHKANVIYSGTGFIYNEDDNDIIINIKNKNSATDYLIQSWITKDENDKNTPFMITPPLFKLNKEQSAILRIAKITSIAQTDRESLFYINSKAIPIAESKHNSIHISIKSVFKLFYRPHGLTETVEEATKKIIFSINNKKEMIIKNNSEYYFTIINIFSNGEKKEISVMLSPFSEINIGKNHFGTAKVGWSYINDFGNEVNINIKNSE

SEQ ID NO: 4429 - protein, 238 aa, Proteus mirabilis
INLSFEVNMHLISKHFIALFFLFSFSSLSYAGGVALAATRIVYPMDAKQTSITLNNTDKRLRFLVQSWIDDSQDQKSNEFIVTPPLFVSKPESENKLRIIYAGKALPNDRESLFWLNTKAIPEIEREEIKDKNILQLAVLSRIKIFIRPQGLNFNIEDVPNSLEFKKSQGNIIVNNPSPYYATLINLEADNEQLNSIMVPPMGTVMIKVSKPNYSQISYQTINDYGASTPKVTKQIGK

SEQ ID NO: 4430 - protein, 338 aa, Proteus mirabilis
IKISGVFMKKILNKPENYVDETLAGLCLAHNDIYRQPQPRLITRANSSDKAKVGIVTGGGSGHLPVFTGYVGEGLLDAAAVGDVFASPSADLMADAIRAADNGQGVLLLYGNYGGDIMNFDMASETVDFEDNIRCTTVLATDDIASATPEEAHKRRGVAGMIYGFKMAGAKAQEGATLDEVTRIAQKTMENTRTIGCALTSCTLPAVGHPTFEIADDEMEMGMGIHGEPGIWRDKLRSADDIAEEMFQRLQTELSLKKGDKVSVLVNSLGATPLEELYILYNKVVQLIDNTGVTIIHPLVGRYATSMEMTGASLTFCKLDDELEALLNAPAHCAFWRV

SEQ ID NO: 4431 - protein, 108 aa, Proteus mirabilis
GLVSGQILYRRQLVLSMHQHHRKAKVLCSLVRYLSFPLFSFIHSGVITYSEEKPIMKKAITDPNPETKPSLLKKWGWLITIWFCSVLALFAVSSLFRFLMTAAGMKVK

SEQ ID NO: 4432 - protein, 150 aa, Proteus mirabilis
VKTSTTGAFGDYAMIWKRKTTLGQLNHISPNNMVGHLGIELTALGEDYLEGTMPVDQRTKQPFGLLHGGASVVLAETLGSIAGYLCTEGEQKVVGLEINANHMRAVKEGFVKGVCKPIHLGRTHQVWSIEIFDDADRKVCISRLTTAVIV

SEQ ID NO: 4433 - protein, 279 aa, Proteus mirabilis
FRASTRNHSMARIIVVTSGKGGVGKTTSSAAISTGLAQKGHKTVVIDFDIGLRNLDLIMGCERRVVYDFVNVIQGDATLNQALIKDKRTENLYILPASQTRDKDALTRDGVEQVLDELDEMGFDFIICDSPAGIESGALMALYFADEAIITTNPEVSSVRDSDRILGILASKSRRAERGEDPIKEHLLLTRYNPGRVSRGDMLSMEDVLEILCIPLLGVIPEDQSVLRSSNQGEPVILDSESDAGKAYLDTVNRLLGEEHPFRFIEEEKKGFLKRLFGG

SEQ ID NO: 4434 - protein, 407 aa, Proteus mirabilis
LYQSALSFLASCLKTRLVYAGEYMSTSCVEEGRKTSNDPYQRIASELLAQADIHINGSEPYDIQVHNKDFYKRVLQQGSLGLGESYMDGWWDCERLDIFFHKVLRAGLENKLPSNWRDILKIAMARIFNLQTQKRAWMVGKEHYDLGNDLFTAMLDPYMQYSCGYWKDADSLEVAQQHKLDLICRKLELKPGMTLLDIGCGWGGLAAYAAKNYGVSVTGVTISVEQQKLAQERCKGLDVNIILEDYRDLNEQFDRIVSVGMFEHVGPKNYATYFDVARRNIKEDGLFLLHTIGSNHNKVNVDSWISKYIFPNGCLPSIQKTAEAMENKFVMEDWHNFGADYDKTLMAWYERFLASWPEIESNYTPRFKRMFSYYLNACAGAFRARDIQLWQIMLSPKGRIGGLRTPR

SEQ ID NO: 4435 - protein, 327 aa, Proteus mirabilis
MDKSSPKEDIAMEKYQNLLVVIDPNQDDQPALRRAVYIVQRNGGRIKAFLPVYDLSYDMTTLLSPDERNAMRKGVINQKTAWIKQQARYYLEAGIQIDIKVIWHNRPYEAIIEEVITDKHDLLIKMAHQHDKLGSLIFTPLDWQLLRKCPAPVWMVKDKEWPEYGTIVVAANLSNEESYHDALNLKLIELTNDLSHRIQKDPDVHLLSAYPVAPINIAIELPDFDPNLYNNALRGQHLIAMKELRQKFSIPEEKTHVKEGLPEQVIPQVCEELNAGIVVLGILGRTGLSAAFLGNTAEQLIDHIKCDLLAIKPDGFTCPITVDSDNE

SEQ ID NO: 4436 - protein, 310 aa, Proteus mirabilis
HTGSTMKKWLTLLGASLLGMSSHLTYAHEYLLPTDGSRIIGENVSYTVPDDKRSLETIAAQYQVGLLNMMEANPGIDPLLPEAGKTLQIPLQMILPDTVRKGIVINLAELRLYYYPKEGGTVDVYPIGIGQLGRETPEMVTSVSQLIKDPTWTPTANIRKNYAAKGITLPAVVPAGPDNPMGAYALRLAHSRGEYLIHGTNADFGIGLRVSSGCIRLRPDDIETLFNVVPKGSRVQVINKPIKFTETADGKQFIEVHQPLSQNEDDDPQTMPLTFTKQFTAWYESGKVDKAKVDAEIIRRSGIPVDVTAY

SEQ ID NO: 4437 - protein, 157 aa, Proteus mirabilis
SLMSIKLDKIDKHILQVLQRDGKIQNIELAKEVGLSPSPCLRRVRLLEESGVITRYVAVLDGSKVDAGLSLFARIWFRAQDAETIEEFVKAIKVLPEVVECHLMAGECDALIRIVTKDLATYRRFHADYLTQIPSIQSIKTEVPMETVKVSFALPLQ

SEQ ID NO: 4438 - protein, 72 aa, Proteus mirabilis
FNVSQLMGSGHGHATHIRSSQQISSNTKERYNQCQNINCGATFVSHETVTRFILKPKLIERVEPHCQQILGI

SEQ ID NO: 4439 - protein, 222 aa, Proteus mirabilis
LYPSSGLWTLMEIMMIEILKRHGLTLAIFAACTTGLTAVVYHLTANTIAEQAALEKQKLLDQVIPTSLYNNHLAQDCYILTDKALGNEKPHKLYVARFNGKPVAAALESTAPDGYSGAIELLVGADFSGKVLGVRVTTHNETPGLGDKIETRISDWIYSLSNKFITSAHDSHWAVKKDGGDFDQFTGATITPRAVVNASKRTAWLIQSLPEKLDTLSACEAN

SEQ ID NO: 4440 - protein, 190 aa, Proteus mirabilis
KEKSMLKKKMLVKALFTVSVLSLSGVASAATIVNGGKINFTGEIVNAACVVSTKSIDQTVNIGQYRTAQFDSVGKTVGNTDFYINLEACDTTVAQNASVSFSGVSDSNDKTVLAVSNITTGGAGAATGVGIEITDHTGKVLPPDGSVFSTAKQLIDGSNTLNFVARYKSTLDTVTPGHADADVTFKMQYE

SEQ ID NO: 4441 - protein, 205 aa, Proteus mirabilis
NYESKIMKLRRIAEAKLPTPFGEFLMVGFEEIATGKDHVALVFGDISGTKPVLSRIHSECLTGDALFSLRCDCGFQLEAALSQISKEGRGVLLYHRQEGRNIGLLNKIRAYALQDQGLDTVEANLKLGFKADERDFTLCADMYNLLGIHEVRLLTNNPKKIEIMKEAGINVVERVPLIVGRNPSNAHYLDTKADKMGHMLFKKAQ

SEQ ID NO: 4442 - protein, 194 aa, Proteus mirabilis
NQTLWGKNRMNEFSIVCRLLGTLFQRAPSDAILAPIITMIAEDKLSQLWPLEQDELFKTLKSSVADLAAVEADYQSLFADPIPAVSLYAHDYGDIKEQDIRQFLVTRGMPVTGSATDSFGALLLAASWLEDNAAQDEVLAQTQLFDNYLLPWAGTFLGKVEAHAKTNFYRTLAAITRGALSALREELSDEENEK

SEQ ID NO: 4443 - protein, 71 aa, Proteus mirabilis
ILLLAIEKKGYAFNINSKDVFSLKLILLINKFLWGCNDSLLILIDSLPMYFFIFNIFSYFFIFYTVIFKWR

SEQ ID NO: 4444 - protein, 287 aa, Proteus mirabilis
RIYPYMQHQNTQKKILRTICPDAKGLIAKITNICYKHQLNIVQNNEFVDHRTGRFFMRTELEGIFNDETFLADLDDALPQGSQRELNTAGRRRIVIMVTKEAHCIGDLLMKSAFGDLDVEIAAVIGNHDTLKHLVEQFGIPFHLISHEGLTRDQHDEKLIAQIDQYKPDYVVLAKYMRVLTPAFVQHYPNQIINIHHSFLPAFIGARPYHQAYERGVKIIGATAHYVNDNLDEGPIITQNVINVDHTFSAEDMMRAGRDVEKNVLSHALYWVLSQRVFVYGNRTIIL

SEQ ID NO: 4445 - protein, 409 aa, Proteus mirabilis
KKHPVKTEAPDIEDKQLQLPASSEESAEKALKQRFSLRRLFSYSIREGMELRRDPVRLTLALLGTVILMFIMGYGISMDVENLRFAIMDRDQTGLSQAYSQNLSGSRYFIEKAPITDYNQLERRLRSGDITVAIEIPPNFARDVAKGHKVKIGVWIDGAMPNRAETVRGYIQAMHLTWMLDMAMRQPTNMVDQFSPIDIETRYRYNPDVKSLPAIVPAVIPLLLMMIPAMLSALSVVREKELGSIINLYVTPVTKAEFLLGKQIPYILLGMFNFFMLCALSVFVFGVSFKGSMLTLSLGALLYITIATGMGLLISCFMKSQIAAIFGTSIITLIPATQFSGMIDPVSSLEGIGKWIGHIYPTSHFLTITRGTFSKGLNLFDLPWSFIPLLITIPIVIGLSVFFLKKQEA

SEQ ID NO: 4446 - protein, 303 aa, Proteus mirabilis
NLIPYWVYNGTWQNKIGIDMQHKVVSIGDIKVANNLPFVLFGGMNVLESRDLAMRICEHYVTVTQKLDIPYVFKASFDKANRSSIHSYRGPGLDEGMKIFQELKETFGVKIITDVHEPSQAQPVSEVVDVIQLPAFLARQTDLVEAMAKTGAVINVKKPQFVSPGQMGNIVEKFKEGGNDQVILCDRGSNFGYDNLVVDMLGFHVMMQASEGAPVIFDVTHSLQCRDPFGAASGGRRGQVAELARAGMAVGLAGLFLEAHPDPDHARCDGPSALPLAKLEPFLAQIKAIDSLVKSFPELDTSK

SEQ ID NO: 4447 - protein, 1019 aa, Proteus mirabilis
QMIPRISQAPQVSELTTEFLNTLRQNGFTGDISSTYADRLTMATDNSIYQLLPQAVIFPRSTADVTIVARLVDEPRFHSLSLTPRGGGTGTNGQALTEGIVVDLSRYMKRIIEINPEQRWVKVEAGVIKDELNLFLKPYGFFFAPELSTSNRATLGGMINTDASGQGSMVYGKTSDHVLGVRAVLLGGELLETRAMDSALAETIAKEDSAVGRIYQTVLSRCKAQRQLILEKFPKLNRFLTGYDLRHVFSDDMKHFDLTRILTGSEGTLAFITEATLDITPIPKQRSLVNVKYDSFDSALRNAPFLVKAKALSVETVDSKVLNLAREDIVWHSVNALITDVPDKDMQGLNIVEFAGDDKTLIASQVEDLCQRLDKLMNNGEGGVIGYQVCDNLADINRIYAMRKKAVGLLGNAKGHAKPIPFVEDTCVPPEHLADYITEFRALLDSYQLNYGMFGHVDAGVLHVRPALDMCDPQQEQLMKTISDEIVALTAKYGGLLWGEHGKGFRAQYSPEFFGETLYHELRQIKTVFDPRNRLNPGKICPPLEVEAPMKQVDAIKRGTFDRTIPVSVREDFRGALECNGNGLCFNFDVKSPMCPSMKITGQRIHSPKGRATLVREWLRLLTEQGVSPQQLETSLTNNKPSLRGLIEKTRNTWKAKRGEYDFSHEVKIAMNGCLACKACSTQCPIKIDVPSFRAKFTQLYHQRYLRPLKDHIVANVELTTPLMAKVPSLFNFFIKQPLVQSLSKRTIGMIDLPLLSSPTLKQQLAGHSALTMTLEELEQLSEKQRSHYVIVVQDPFTSYYDAKVVADFIKLIEKIGFKPVLLPFSPNGKAQHIKGFLQQFSKTAQKTATMLNRVAQLSIPMVGVDPALVLCYRDEYREILGDKRGNFKVQLVHEWLNQLVSEPIEICEDAEKWYLFSHCTESTALPQSMQQWQAIFQRYGQPLEVVTTGCCGMAGTYGHEVNNYKNSLGIYQLSWGNALKTLPTARCLCTGYSCRSQVKRIDNIELKHPLQALLEIMQ

SEQ ID NO: 4448 - protein, 109 aa, Proteus mirabilis
FISPMKKHLTPIIMLLILLPVFSVNAYYIYETSCEYIMDNNKSKENQEVILKISNCPSIIKNANSILNIKKNTAISIKNSVKTSFILDSNKVVLADNINDQFTISVHYQ

SEQ ID NO: 4449 - protein, 180 aa, Proteus mirabilis
IGNPWRSTLGTFPSPWLVVATGFSSPLLLGVALGLRFFISFPLFSANGCCCGRSTGGFGFSTGFGLGFGLGSGFFSIGFSITGFTSGIGSGSGSGSGSTTGSGSGGVTSSTTGSGSPTGSSAAKASICIEIGSGAIGLSSTTYSMAAATSEACKHSDINTQSLKRITDLISPKQKIMPLV

SEQ ID NO: 4450 - protein, 663 aa, Proteus mirabilis
NYCPLLLLKLPTFRKNMFQDNPLLAQLKQQLHAQTPRVEGLVKGTDKGFGFLEVDGQKSYFIPPPQMKKVMHGDRIIAAVHTNNDKESAEPEELVEPFLTRFVGRVQKKEGDNRLWIIPDHPLLKDAIPCRPIKSLTHPFADQDWAVAEMRRHPLKGDKHFQAELTDFITDKDDHFAPWWVTLMRHQLERNAPEVDSETLTLHDDLPREDLTALSFVTIDSASTEDMDDALYIRKEENGQLSLYIAIADPTAYIQPNSKLDTIAAQRALTNYLPGFNIPMLPRELSDNLCSLRPNEKRPALVCQVGIMEDGALTDEIHFYSAWVESKAKLVYDNISDWLEGEETPWAPENEIVHEQVMLLKEMSEKRHIWREQHALVFKERPDYRFILDDSGNVLDIVAEKRRTANRIVEEAMITANICAAKVLSRNLGFGIYNVHTGFDPLYIDQVSQTLKEHGIETNADELLTLEGFCRLRRELDNQPNQFLDSRIRRFQNFAEIKTEPGPHFGLGLEAYATWTSPIRKYSDILNHRLLKAIISKSAAEKPQDEDCVRIAERRRANRMAERDVGDWLYARFLKPFAGTESTFNAEIIDITRGGIRVRLVENGAIAFIPAPFLHAVRDEIQCSQETGSVIIKGETAYKLNDIIPVRIEDVKLETRNIVARPI

SEQ ID NO: 4451 - protein, 67 aa, Proteus mirabilis
RSRPIKLSCSFRCISCSDSNNSDVTGGLLQGILLLSIGSAGGATLVIKVPNVLLLFIATNEPSCAAG

SEQ ID NO: 4452 - protein, 64 aa, Proteus mirabilis
QRIPKSDNHKAALSSILLDVILNTRKKNKLRDKGIRTLLLSIDRQNKTSLVAGFIVKQSSKIEG

SEQ ID NO: 4453 - protein, 641 aa, Proteus mirabilis
NIPPLSLDLGLVSIFILFLHPSERFYQHLYTSFSSFTQSKSQKDSSNVDIRCCGISYCAHCLSYLCVVSCRGILKMATTTLIYIAVFLTVLLIMGKVIGNYLARLIEGDLPHWVTKTEQVIWRSCGFKPAGKAIQSMSWYHYMFALLIFNSMGALLLLVILLNQGYLPLNPQFAPNMSWDLALNTTISFITNTNWQAYSGETAVSYLSQMMGLTVQNFLSATTGIAVAFVLIRALTQSSCHSIGNAWVDIGRITLYLLLPLAIIWSLLFVSQGVIQNFHPALLSQGLENQQWLPMGPVASQEAIKLLGTNGGGYFAANSAHPYENPTSFSNFLQILAIFLLPTALCFAFGRLSGTQRQGYTLLWVMTLIFIVAVSVIVWAEWRGNPQFTLMGADSSLNMEGKESRFGLIGSALFVAVTTAASCGAVNAMHDSLTALGGMVPMWLMQTGEVIFGGVGSGFYGMILYVLLAVFIAGLMVGRAPEYLGKKIGVAEMKWVAVAILISPAITLLGTTLALFSEVGREAILNPGPHGFSEVLYAFTSAANNNGSAFAGLNANSVFYNLLLGITMLVGRFGVMLPVLAIAGSLAIKKRQAESLATLSTTSPLFIFLLFLTVIMIGALTFVPALALGPIAEHLQLLWAK

SEQ ID NO: 4454 - protein, 300 aa, Proteus mirabilis
VTPPGIWLTQRRFKMGMGLHEWPLMFFTVIGQSVAGAFIIMGCAILSGKLPEALNRKVHYSMFGLWLLMGIGFLLSMIHMGTPMRAFNSFIRFGHSSLSNEIASGATFFALGGLYWLISVLNKMPAALGKLWLVVVMILAVLFITAISRVYQIDTVPTWYNGYTTVNFVLTAFIGGPILAALLMRIAGFNLNCISALPLLSVIAIIISAIVATSQGFELGSIQTSVQKAVDLVPDYGFLMGIKLIALTLGLACWIAPLLRKNNPSVSLMVLGFILVFVGEFIGRGVFYGLHMTVGMAVVG

SEQ ID NO: 4455 - protein, 63 aa, Proteus mirabilis
TSAPLQKTKGSTFSSKILKAQGLKSSTAFSIVIIYIPRLLASNQTLDKMNITQLYVFNEKKVV

SEQ ID NO: 4456 - protein, 205 aa, Proteus mirabilis
GTKPENDRIKEYAMSFELPKLPYALDALEPHISKETLEYHYGKHHQTYVTNLNNLVKGTDLENKSLEELIKTTEGGIFNNAAQVWNHTFYWNCLAPNAGGAPTGKIAEAINKAFGSFEEFKKQFNDAAAKNFGSGWTWLVKKADGSLAIVNTSNAATPVSGEDKPLLTVDVWEHAYYIDYRNARVKYLEEFWALVNWSFVEANLA

SEQ ID NO: 4457 - protein, 421 aa, Proteus mirabilis
DMTLLALGINHKTAPVALREKVSFSPDTMGDALNNLLQQPAVRGGVVLSTCNRTELYLSLEDKENSHEQLISWLCQYHQIEPHELKNSVYWHQDNQAVSHLMRVASGLDSLVLGEPQILGQVKKAFADSQNYHSLSSELERLFQKSFSVAKRVRTETQIGANAVSVAFAACTLARQIFESLSSLTILLVGAGETIELVARHLREHQVKKIIIANRTKERAQRLANEVDAEVITLSDIDESLSQADIVISSTASPLPIIGKGMVERALKKRRNQPMLLVDIAVPRDIEQDIEKLSNVYLYSVDDLEAIIQHNREQRQAAAIEAEHIVQQESGQFMDWLRAQGAVGAIREYRDSAEMLRAEMAEKAIALIQNGADAEKVIQQLSHQLMNRLIHTPTKSLQQAASDGDIERLNLLRESLGITHN

SEQ ID NO: 4458 - protein, 475 aa, Proteus mirabilis
HVTFFPPFRLIIMNKGVCVQKYIKEARSLLALGIPVIIAQFSQTAMGVVDTVMAGAVNATEMSAVAVGTSIWLPTILLGQGILMALTPIVAQLNGSGQRKHIANRTQQGFWLATFLSIMVIAILYNSRFIIEAQHDIEPELAEKAIGFIHAIMWGAPGCLYYQVLRSQCEGLSKTKPGMIIGFIGLLINIPVNYAFIYGKFGAPQLGGIGCGVATASVFWAMFLMMRYYVRRAPTQRDVMPKKRLVLPEFHTIKRITLLGLPVGLALFFEVTLFAVVALLVSPLGVTAVASHQIALNFSSLMFMFPLSLGIAATIRVGYNLGQRSTEQARTSAITALAVGLMLASCTAIFSIIFREKIALMYNDNIEVVTLASHLMLFAALYQLSDSVQVIGSGVLRGYKDTRSIFFITFIAYWVIGLPSGYLLGRTDYIVEAMGPAGFWIGFILGLTASAIMMGTRIWWIQRQSDEVVLLRSER

SEQ ID NO: 4459 - protein, 90 aa, Proteus mirabilis
KMALLDFFLSRKKSTANIAKERLQIIVAERRRGDTEPAYLPDMKRDLLGVICKYVQIDPDMLSVQFEQKGDDISVLELNVTLPENEESPK

SEQ ID NO: 4460 - protein, 281 aa, Proteus mirabilis
SEVTLMSLSFLTKIARSPSAFIGLSLLLLLLLIAIFAPWLAPYDPNWQHAAQRLLAPNAAHWLGTDSYGRDILSRLIYGTRPMLGLVGLVALITLPLGLFIGILSGYYGGWTERILMRFTDIIMSMPSLILAFAFVAMLGPGLLNGALALALTAWPAYARQARSEIQHLRNSDYLAAAEMMGINGIRLLWGHILPLCLPSAIVRLALNLAVIILAAAGLGFLGLGARPPMAEWGAMIAEGMPVIFDQWWVAAIPGTAILISSLAFNLLGDGLRDVLGESHE

SEQ ID NO: 4461 - protein, 389 aa, Proteus mirabilis
MLELLFLLLPVAAAYGWYMGRRGAQQDKQQNADRLSREYVAGVNFLLSDQQDKAVDLFLEMLKEDSSAFEAHLTLGNLFRSRGEVERAIRIHQSLMESAALSFEQRLLAIQQLGRDYVAAGVYDRAEHMFLQLIDEQDFRQSALQSLLAIYQLTSDWGKAIETAEKLVKLGQHELKEQIAHFYCELALQEMSSDNLDNALSFLQKAGQMDPLCARVSIMYGRIYIARDEKNKAIDVLMKVIEQDKEMVSETLPMLFECFQSQGDPARWESYLRQCVESNCGAIAELYLADIIEEKEGIEAAQLYINRQLERHPTMRLFYRLMRYHLAEAEEGRAKESLILLRYMVGEQIRTKPDYRCHKCGFTSHALYWHCPSCRSWDTVKPIRGLDGQ

SEQ ID NO: 4462 - protein, 551 aa, Proteus mirabilis
NPPTAGFFICQFCAYQHQKKENRAIIMNTSLAFPLTTKVTALPYHSEPALLFNTLCEHRHHTLLLESAQIDTKANLKSLLIVDSALRISANKNQVTVDALSLNGQHILALLKNALKEKSTLSVERAEQCVFTFASSSFPQDEESKLKAASVFDVLRFFLANSAAKEANAIFVGGLFAYDLVNGFESLPDLEAVFSCPDYCFYLAEQLIVIDHQHHHSQLISVAFTDNPQECQRLDNRQAQLVALAQQPLKQPQRQPLTPQQAVVSSNMNDEEYGAIVEAMKTYIRRGDIFQVVPSRRFQINCPSPLAAYQVLKQKNPSPYLFYMQDALFTVFGASPESALKYQASDRQIEIYPIAGTRPRGRNADGSINADLDSRIELEMRTDTKELSEHLMLVDLARNDLARICQAGSRYVAELTKVDRYAFVMHLVSRVVGTLRHDLDIFHAYQACMNMGTLSGAPKVSAMQLIAQYEKTKRGSYGGAIGYFTGNGDFDTCIVIRSAYVEKDIATIQVGAGIVLDSDPKMEAEETRNKSQAVINAILQAHAETHMQEAC

SEQ ID NO: 4463 - protein, 115 aa, Proteus mirabilis
NKATNMKKFLTIPLFLLLAGCNTATGTNTQVMNDSTKTLLIDSQLYDCVGVAPMKCMKVKELPAGEWSLFYQNIEGFDYQAGTQYKVKVKVTDIPNPPADAPSIKYTLVEILDKK

SEQ ID NO: 4464 - protein, 296 aa, Proteus mirabilis
LGYTAMTLSWPSPAKLNLFLYITGKRPDGYHNLQTLFQFLDYGDTLTFTPRNDTQLTILTPVEGVADEDNLIIKAAKLLRQYCHQHHIPLRYQGADISIDKKLPMGGGLGGGSSNAATTLIALNYHWQAGLSDETLATLGVTLGADVPVFVKGHAAFAEGVGEILTPASPKECWYLVAHPGISIPTPTIFTDPELKRNSPIRSLGALLQAPFANDCEMIARKRFREVEYLLSWLLEYAPSRLTGTGACVFGEFESQEAASEVLINAPEWVHGFVAQGVNISPVHLFRSRIPVLLHP

SEQ ID NO: 4465 - protein, 375 aa, Proteus mirabilis
MWHTVQNIFNLGIKELRSLSRDKAMLALIVFAFTVSIYSSATVTPGSLHHAPIAVADQDKSQLSARIVNSFYMPYFLPPADITPEQIDGLLDRGTYTFALDIPPNFQRDLLAGRKPEIQVNIDATRMSQAFLGNSYIQNIVMGEAKTFLAKERTNDPLPVDLEVRMSFNPNLTQSWFGSVMAIINNITMLSIVLTGAALIREREHGTIEHLLVMPVTPFEIMLSKIWSMGLVVLLASAMSLVLVVKSLLHVPIEGSVLLFMCGVALSLFATTSIGIFLGTMARSMPQFGLLMIMVLLPLNMLSGGMTSRESMPQFVQDVMQTMPTTHFVSLAQAILYRGADFSIVWPQFIVLIIIGSVFFALALLRFRKTISAMA

SEQ ID NO: 4466 - protein, 178 aa, Proteus mirabilis
EEDTMKLIPLLLSGLLFTSVASAASLDVTLKEALPTGAGDDIGVVTITETDYGLLFTPKLTGLTPGVHGFHIHANGSCEPDMKDGKPVPALKAGGHLDPENKGVHLGPYNKEGHLGDLPGLVANSKGDADYAVLAPRLTKLDQIKDKALMVHVGGDNYSDNPEALGGGGARMACGVIK

SEQ ID NO: 4467 - protein, 171 aa, Proteus mirabilis
NTCTNRGPMEYLNTKIIIGSSIIALATLYFAIYLILYLIKCVRTQTPFTLRKIWKQWLLSSVIGLIGAYIVQLGDNQRRSEFTKEEVSFMNENKAYSQFTSADKDLASKITHKCTYNSDAVFEQCLPKILTWEAKIYQSYNAHRKISDSEAIKYTEEELRDKHNYWINKKR

SEQ ID NO: 4468 - protein, 71 aa, Proteus mirabilis
QNCTIAGDTPQRAVVQDTRFDTDFTFTVNILNECLVLIPDSEDTRAIKQQNQQQQAQLSEIKLRLQALVIE

SEQ ID NO: 4469 - protein, 133 aa, Proteus mirabilis
CIITDYWPYPWWCISSCQWLGMASATMNALRQTGMTMGIALLGTLMIQQAINYMMIQSQALGIVAEPINIITLVTENKTASLDNQLVALLPEAFNSGFAYAMLTAGLSCFITLFIMLFPCKEKQGALSQQIAD

SEQ ID NO: 4470 - protein, 245 aa, Proteus mirabilis
NKYTANSTLNHVSSDIKHSDLPNKENIMYQHRDWEGSLLDFPVNKVICVGSNYANHIKEMGSVRSEEPVIFIKPETAMCDIRQPIAIPKEMGAVHHEIELAVLIGQPLKQANEDRVDRAIAGFGVGLDLTLRDLQSQLKKAGQPWEKSKAFDGSAPLSGFIPVNSFGDPQNVDLMLKVNGEIRQQGNSRDMLTPVLPLISYMSRFFTLRPGDVILTGTPEGVGPLASGDMLVLSVNEHQLTTRVI

SEQ ID NO: 4471 - protein, 233 aa, Proteus mirabilis
MSNTPIELKGSNFTLSVLHLNDGSPKVIRQAISDKIAQAPQFLKNAPVVINVSAIADQTIDFKKLRRIVEDAGLRVVGISGSHDAQQKEAIIAAQLPILNEGKITKPAAQANNDKTNEVPINVRQKTKIIHTPVRSGQRIYAPNSDLVVLSNVSAGAELIADGNVHIYGVLRGRVLAGASGDQESHIFCTHLSAELVSIAGQYWLSDQIPTDFVGKSVQLSLQENELTIENLI

SEQ ID NO: 4472 - protein, 581 aa, Proteus mirabilis
AMSTLLSTQNLSFHNNHGILLSNISLALTKGEKIGLIGYNGCGKSTLLKLLSHQLIPTDGSITIANQVIMAYVEQQLPSELQSMRLIDAVLHKLPEELRISESWRSELLLSEMGFKTNEINLLVSQLSGGQHTRLLLARALILQPDLLLLDEPSNHLDLPTILWLETFLTQWRGSFILVSHDNRLLDKVTNCTWIIRDKTLSVFRLPCSQARQEQEAQDISAQHRCDAQQKEIDRIAQSAKQLAIWGKVYDNESLSRKAKQMEKQIVRLKDEQVDVTEGNQWTLQLSGTILRADRLLELHQLSVIPAPDAPILYTIDNQRIKSGDRVAIVGANGTGKSSLLKMIWSSFHGSTTSTENVIRLHPRVELGYYDQSLAQLNDNDTLADALKPFAPLLDEQRKMALINAGFVYSRHNQQVKSLSGGERARLLFIGLSLAKYSLLMLDEPTNHLDMEGKQALAEQIQQFSGGILLVSHDRELIEKSCNRFWYIHNGILSEHHDIETIYQLISQQDMSSVSNEQNGHHAPSVEIVKHHNEDELLMKLIALEDKLNADLARKSAHQKPILQAQWQAEIEILKQQLDLA

SEQ ID NO: 4473 - protein, 253 aa, Proteus mirabilis
MGLTMLMTMIKSLIFIPYLLLSGCGEYINIYLNNKFPVNMNNDGKKITVYSTISPETAVEVIGTYTSNKCERSHFNASYTKVTYSSLTKKVEIERKITEDNKTATYTVPIDGGGWCNWKLVEIKLAPVSNIHKIYTRISEIIPITDDKHSKIELFITLAPVIVEKYNGKSIYYSSSIMEGEQNLSNKSNGEIYFNYKVEPKLTTIISKDNKAIFPNGNIKTLSGSTYSKMIGFNEIIENSDEKAFTSFVRYID

SEQ ID NO: 4474 - protein, 266 aa, Proteus mirabilis
RWLTINQILGIKIPKAYIMLDIKNLHVSVEGNEILKGLDLQVRAGEVHAIMGPNGSGKSTLSATLAGREEYEVDEGSVTFKNKDLLELEPEERAGEGIFMAFQYPVEIPGVSNQFFLQSSVNAVREYRGQEPLDRFDFEDFIEDKIKLLDMPQDLLTRSVNVGFSGGEKKRNDILQMAALEPELCILDETDSGLDIDALKIVANGVNSLRDGKRAFIVVTHYQRILDYIKPDYVHVLYQGKIIKSGDFSLAQKLEEQGYGWLIDPQ

SEQ ID NO: 4475 - protein, 75 aa, Proteus mirabilis
YELTFDGDHLLCMYITLNMILLLLTVYCTFQRLLGNSTVVLTANRISKLLLSQYNQDHPETARFLPIFIAYNYSI

SEQ ID NO: 4476 - protein, 1665 aa, Proteus mirabilis
AFGFQQKQKELVVMADKHVGDGENQFKVVATTPDVCQVGCSAIPFDSFQSLDAQKQYALSVKARGYCTLNVGSIIKGTQSNTGAGVLSGTSLGGGDCQIITGSPSVRIEGQPAAQDGSLVAMNNNNTLGTLITNVAPPAEPIESNKIPCNNPPVTSELLESLQEMQRKEQESFIGRLRQQKQQADKKRDDSLNDIDKELTGYIDNIRVDHINTDYSWWNSLYNTSMDGITGLTRGGLGFVESITKSAVEAYHYINPTVLVQNVALNASKKTIEGLIEAENWRLGNNCIEGVKEDVKAKYRALGKLIDEEKEKLENKWKKSDSDKVEIVTRGGLEIATIAAAFLKVGKVAEGANAINKVAEGTKITEISEGTSAVNKATDVIKATETSNISKGSEAIKGAEISATEKGSNAAKGTEVIQSPETPKITSSDNGIKIEGKTESVSTETPPNKVNNSQTENKSTSSSKESDGNSTSSATCKGEPVNVATGDFIQQWPIIQIPGLLPLSLHRTYKSTSNAKGLFGPKWADEWSRCLHILDGNIIYQDSDGANFTFITPTEEIRARNAHAPHFLLTGQRDGDLTLFDSTQQQFLHFNHRQGKYRRLSAITDLNQHRIDFIYNEQSQLVSVKRHDGIALILEYQQDKLVRICSESTTSSPRDFVRCEYDTHGYLSQCHAYQQNHLWHRYSPEGLMVAWGDTDSTELTIDYDEQGRVVATHSPSGFWNDRFIYDDYQRMTTYIDAEGGFSRYYYNDDNLVTRTIDPLWRETYTEWEQRKKIAEINEIGERTEYGYHYNGLLAYIYLPDGKAIYYDYNDYGQLTHFTSAFGDEWQLSYDENGNLTIVTDPQGRQQVYEYSQHGELLKAITPNGAQWQYHYNPAHQLIKTTNPYQHSTEYHSDELGRLLHYTDALNHTTRYQYSTEHASTNGSLSKILLPDGVEQQIDYDSERRVIAVTDGEGKTTRYRYGPFDVLLAMIRPDGSEIRFEYDSLTRLKKVVNANGEVYLYERDKAGQIIREVDFTGREICYRYDRLGRRIATRYPDNHELRWRYNESGLVVEQSEWFEDEQESRCLSTAQYSYNARQQLIKATNPDSVVEFEYDDQGRLCSERINEQEIVHQWNEADNTLALTRFGERELHYAFGALGELTSLQVNQHAPLQFSYNAVGQEYLRRSRAGFVNSSHYTATGLLAHQRAGRGTEQFLQSIQAHPQQPPFCTDVHRSYQYDRAYNVVGIEDDRWRQTRYHYNANDQITETQYSPQWGNQDEKFQYDNNLNITEHLTTPSSSMVPSDAQGAMLQLFQQQQAGRVTRRYTAKGYQDYHYDVNGRLAKKIVHTRGFRPREWRYLWNTQNQLTACFTPKGDCWHYTYDAFGRRLSKTKTVDSDLAHIDPLFPQIKPKITTWRYLWSGDQLIEETPIYADGTLANAQQVQWLYQPGEITPTARYQQGKLHYVVTDHQGTPREIFSEGGQASWAGRLNTWGQMQFWRYRDGKAENDPNYTECPFRFAGQYEDEESGLYYNRFRYYDRETGQYLSPDPIGLLGGLNPYGYVHCPTGWVDPFGLAGDCCDELLVLATNPRSKTVQEMAEDLANRINRNTVTFSTPTSMGHIDLRGRSHFDKVTQADIPTPHVQVSPINVAPNGNRFPLKKLEAARPATKQDIRTAEKLAERQGLLK

SEQ ID NO: 4477 - protein, 185 aa, Proteus mirabilis
FSSTLTFIIPNRYFSDGDRCIKMDQDITLSNLCPCNSQLPYSECCEPYLLGTKNAPTAQALMRSRYSAFVTHNADHLIKTWHPSCRTPSLRDELIATFPNTQWLGLHIISAQENPRDNEAFVEFSACFIEINADDKQYLHERSRFLKIDDCWFYIDGVQPKVGRNDPCPCGSGRKYKKCCEHNRK

SEQ ID NO: 4478 - protein, 142 aa, Proteus mirabilis
VESTLGADLARLVRLWRALIDHRLKPLKLTQTHWVTLYNISQLPPEQSQIQLAKAIGIEQPSLVRTLDQLEEKKLICRHTCSSDRRAKRITLTKESEPFISEVYAVIEKTRQEILSGIKKEEIDNLIYLIKKLEKNIIRLHD

SEQ ID NO: 4479 - protein, 193 aa, Proteus mirabilis
HNETYVITELNCMKKLQTERLLLRPWRISDAESLYYYARDKRVGPIAGWPAHKSVAESTEIIQTIFMRDEVYAVTLLDDDKAIGLIGLSFCHESNFPIGDNDAEISYWIGTPFWGKGLIPEAVKALICHSFETLQLDNLWCGYFADNVNSKRVQEKCGFKYHHIIKDQYVEYLDEIRTEVICRLTKSEWQKQQ

SEQ ID NO: 4480 - protein, 473 aa, Proteus mirabilis
VNMTRYEQLAAQIRQQIEDNIWQSGDRLPSLRDTVKQSGLSLMTVLQSYQLLESQGWITARPQSGYYVAHRNTGFAQVTASKGLHMSENVEISASIFNVLQACKDPNIIPFGSAFPDPSLFIQPKLSRALASAARHLAPQSSVINLPPGNEKLRRNIAQRYALQGIHVSPDDIVITAGAMESLSFSLQAVTEPGDWVVIESPAFYGALQAIERLRLKAIAIKTDPVTGICLDELEKVVEQYDIKACWLMSHCQNPLGGTMPDENKIRLVEILAAKQITLIEDDVYGELYNSPKAPMPVKGFDKSNSVLHCASFSKCLAPGFRVGWVAAGKHATKIQQLQMMSTVSASMPTQQAIADYLSQGGYDGHLRRLRLLLEQRRYRMLQAIQTHLPKDVKVNIPVGGYFLWLEFEPSFDANSLYHFALERGVSIAPGAMFSTSSQFNHAFRLNSSFQWNGQTEKGMQIIGEGCRKLRRK

SEQ ID NO: 4481 - protein, 205 aa, Proteus mirabilis
EKMTSTILNYKSVFILIGSLLLTACDNESTHNKSEEIINYPVRTMSGFNIAYPTSFSLNRDDTEHYFQLLPDHVQDVTSQMLVYQAKPVCQLSEVRLVYFKLDDMMSYDIDSGAQGIVDNISTIDGMKETSTTIKPFTVSEMPARQIFFEGKLSNQKVSYEGVLIADTNTNRVWQLQFIAENKSNNNQEVIDCTNRYVNSISINQ

SEQ ID NO: 4482 - protein, 685 aa, Proteus mirabilis
RRSTCMSQSSRCIKVSVLVVATAISSAFAENKNQIYGEKNSGERNTQIITVYATGNERDSFTLPMMSTIIKNNSALTETAGSATELLRHIPGISISGAGRTNGETISMRGYSSNGVLTLVDGIRQGTDTGHIDSIFVDPLLIKQVEVVRGPSALLYGSGALGGVVAYDTVDASDLLAKNEHGGVRVTALGNTAQQSQGFGITAFGQQDNFDGLLALSARDKGTTRYGGGYRAQNDETIINLLSKGRWFIDDSNTLSGQLRYYHNNAQQPKDPQLANNPTPANVATNRTTTQKDAQLTYQYHPSDMSWINLKTQAYYSEVDINAKTQQKGFEGREQKTYGIKIENRTQLATYPFAAHALTYGGEIYKQKQSPSANAESFPKADIRFMSGWLQDEMTLRDVPISFIVGTRFDKYSSQNDRYDDISADKWSSKGAVSITPTDWLMLYTSYAQAFRAPTIGEMYNDAKHFDAPFPGAPTNYWRPNPNLKPETNSTTEYGFGFQFDDLLSNNDNLKIKAAHFNTRAKDYIDTDVAIFQGYTQSTNIPRATIWGWDIEMNYQSKFFSWDLAYNHTKGKDNASNASITSIEPDTLTSRLDIPVPNSDFSVGWVGQFTKKTDFTKHDRFNRPTNRQQAGYGVNDFYLRYEGSASLTGLTTSLVLGNAFDKKYYSSAGIPQEGRNAKVLVSYQW

SEQ ID NO: 4483 - protein, 83 aa, Proteus mirabilis
MMSTQTTPISAEMLLEKANKIIREHEDYLQGMYADSVEQKGNVLVFKGEFFLDEQGLPTAKSTAAFNMFKHLAHVLSEKYHLA

SEQ ID NO: 4484 - protein, 63 aa, Proteus mirabilis
VLIAMRHSRNEVARWRMMRQALRRRRRWLEGQSRRNLRIYQMRKLDTSRKHRALLFVQYTELN

SEQ ID NO: 4485 - protein, 904 aa, Proteus mirabilis
FVIAVSIKIRRRGAMSLRLKKESLSTLSVGTHQYEYYRLSEVARQLGDITRLPKSLKVLLENLVRYLDDDTVVEDDIKALVDWQKNAHASREIAYRPARVLMQDFTGVPAVVDLAAMREAVKSLGGNVEKVNPLSPVDLVIDHSVMVDKYASDDAFEKNVEIEMQRNYERYLFLRWGQQSFERFRVVPPGTGICHQVNLEYLGKAIWSEQQNGRHIAYPDTLVGTDSHTTMINGLGVLGWGVGGIEAEAAMLGQPISMLIPDVVGFKLTGKLREGITATDLVLTVTQMLRQHGVVGKFVEFYGDGLASLPLADRATIANMSPEYGATCGFFPIDEITLDYLRLTGREEQEIALVEAYSKEQGLWRHAGDEPIFTSTLSLDMGTVEASLAGPKRPQDRVNLLNVPKAFKAAVELETNKKPLAQYPQVTIDNQPPFTLTDGAVVIAAITSCTNTSNPNVLMAAGLLAKNAVEKGLQRKPWVKSSLAPGSKVVTDYLALAGLTPYLDKLGFNLVGYGCTTCIGNSGPLLAPIEEAIKDNDLTIAAVLSGNRNFEGRIHPLVKTNWLASPPLVVAYALSGNMNIDLTKEPLGEDKQGNPVYLKDIWPDSKAIADAVEKVKTQMFHKEYSAVFDGDETWQSLKIQDTPVYAWQPDSTYIRHPPFFEGMTKTPEAIKDIHQASILAILGDSVTTDHISPAGNIKADSPAGRYLREHGVEPKDFNSYGSRRGNHEVMMRGTFANIRIRNEMVPGIEGGFTKHIPTGETLAIYDAAMRYQQENTPLAIIAGNEYGSGSSRDWAAKGTRLLGVRVVIAGSFERIHRSNLIGMGVLPLEFPNGVSRQTLGLKGDEKIEITGLNSLTPGQDVAVNITFADGRQETIMACCRIDTQTELAYFEHGGILHYVIRNML

SEQ ID NO: 4486 - protein, 65 aa, Proteus mirabilis
NYVALKEKVHIQSNDKIFFFLKYIQNSMRNYLFPKFTSSTVFAFNLLYEINKINYSKISNELKTS

SEQ ID NO: 4487 - protein, 250 aa, Proteus mirabilis
FTYLSLNISLLFYKKINIDMIAHIYSILFFKKRRHMLESIGISNIWTYLLGVIFITLVPGPNSIFVLTSSAKHGVKGGYKAALGVFTGDALLIFLAFLGVASLVKTSPVFFIVIKYAGALYLTYLGLKTLYATFHKKKEQPEQVAVEVVKAKNGLYIKALFLSLLNPKMIIFYVSFFIQFIDPKYENAGVPFFVLGVILEICSMLYLSVLIFGGVAITNKVKHNKRLASLSNSCIGAVFLLFGAKLALTA

SEQ ID NO: 4488 - protein, 205 aa, Proteus mirabilis
NSHAGGLLMATLLLLDNIDSFTYNLVDLLRSQHHQVIIYRNDVSASFIEKQLNLLDNPILMLSPGPGTPSQAGCMPELLNRMLGKLPIIGICLGHQAIIEAYGGKVSSCGEILHGKATLATHDGQAMFEHLPNPLPVARYHSLSGEIVPEQLIVNAWCDNTVMAVRHRQHRTCGFQFHPESILTTKGAQLLQQTIAWAQAPRGDA

SEQ ID NO: 4489 - protein, 326 aa, Proteus mirabilis
ACYFIWYSDFFLASLSAGLSITEKQFLISRFFQGSGSGFCYVVTFAILRDTLTEQQRAKVLSMINGITCIIPVLAPVLGFIILLYCEWSMMFYLMGAYSLLVFIFCFLGIKETYHKKEIKNKKVNLSVIKPTTDSFFTRYFLSRLLISCLGMAVILTYVNISPIVVMQQMNYSTGEYSILMTSLAMISMTISFLMPKILMKYRYKHILSVGFICFGIGIIFLFIGKKSDIRWFFITFALCGSGFALLFGIIMSQALSPFSQRAGVASSVLGISQLSFSSLYIWVMGWIEVSSINMLVVILFISCIVGTLFLCFPRFTEQKKVKYNV

SEQ ID NO: 4490 - protein, 538 aa, Proteus mirabilis
RSYLSGVSAPDFIEGAKMLDNNLKAQLKAYLERLTQPVELVATLDDSKHSADIQALLKEIEPLSDKVTYREDNSANVRKPSFLITNPGKTTGVRFAGSPLGHEFTSLVLALLQTGGHPSKEAPELLEQIRQLDGEFHFETYYSLSCHNCPDVVQALNLMAILNPNITHTAIDGGMFQNEIQERNIMGVPAVFLNGNEFGQGRMTLAEIVSKVDSNAEKRTVELLNKKDAFDVLIVGSGPAGASAAVYAARKGLNTGLIGERFGGQVLDTVDIENYISVPKTEGAKLAGALKAHVDDYQVDVIDSQTVSRLIPGAAEGDLHQIETASGAILKTRSLIIATGARWRNMNVPGENEYRTRGVTYCPHCDGPLFKGKRVAVIGGGNSGVEAAIDLAGLVEHVTVLEFASEMRADAVLQKKLRSLSNVDVILNAQTTEVYGDGTKLTGLKYKDRTNDSMHDIALAGIFVQIGLLPNTQWLEGTVERNKIGEIVVDPRGETNIKGVFAAGDCTTVPYKQIIIAAGEGAKASLSAFDYLIRTTAK

SEQ ID NO: 4491 - protein, 329 aa, Proteus mirabilis
RDRASMKLQQLRYIVEVVNNDLNVSTTAERLYTSQPGISKQIRMLEDELGIQIFSRSGKHLTHVTPAGEEIVRLSREILSKTEAIRSAAGEHTYPDRGSLSIATTHTQARYVLPPVIKGFIERYPEVSLHMNQGSPTQIAEDVCRGKSDFAIATESLHLYNDLVMLPCYRWNRIVVVTKDHPLAQKREVTLQELATYDIVTYTHGFTGRSDLDEAFGKVGLKPKIVFTATDADVIKTYVRLHLGIGVIASMAFDPMLDSDLVAIDMRDKFSYSTTKIAFRRSGFLRGYMYDFMWRFAPHLTRNLVEQATALRTNEEIEELFKDIELPLV

SEQ ID NO: 4492 - protein, 358 aa, Proteus mirabilis
VVYFLRFQGCCRMNTLTISTRLKSQLFTLVQGILTLALTLLGLLVITFTLSAFSPVDPVLQIVGDHASIETYNQVKHELGLDLPIYMQFFHYVEALLQGNLGTATSTGQPVFDDLIATFPATLELATVALVIGASLGVLFGVLCARFVGTPFDFILRFLTLLGSSVPIFWLGLILLLIFYATLQWTAGPGRLDDIYQFTIEPVTGFALIDTLLAGDKDAFLNALSHLILPVSLLAYFALASITRLTRSACLNEMNKEYVTLARAKGIGELRLLFTHVLPNIRGVLMTIIALSYTGMLEGAVLTETVFSWPGIGRYLTTALFAGDTTAIMGGTLVIGLCFVLINNMTDIVIRLTDPRLR

SEQ ID NO: 4493 - protein, 346 aa, Proteus mirabilis
NLSAKVRRRFKMGIDLPVIWFIIIVFSTLMYIVMDGFDLGIGMLYPFIKEREDRDLMMNTVAPVWDGNETWLVLGGAALFGAFPLAYSVILDALAMPLTIMLVALIFRGVAFEFRFKADDTHKVFWDNAFIVGSLLTTFMQGIVVGSIVQGLPIIDRTFAGSYFDWLSPFALFCGFGLVIAYSLLGCSWLIMKTQGHLQQSLYKVILPLTFVMLAVIAVVSLWTPLAQPAIAERWFSLPNIFFFLPVPLLVLYSAWLIIRAVKKKGHYLPFFASLAIIFLGFTGLGISIWPNIIPPAISFIDASAPPESQGFMLVGALFIIPIILVYTFWSYYVFRGKTNYEEGYH

SEQ ID NO: 4494 - protein, 77 aa, Proteus mirabilis
SDYFLIMKHLQLATQTDQPTPSDNAHTHMDSAHPIALWGLGKDTVLSPYHNSESDYNTSHFLHLHIAPQSEKDIRYN

SEQ ID NO: 4495 - protein, 328 aa, Proteus mirabilis
PDLAKRQIMSIIHLEFEKPIVELDEKIDALLAFKQSQDETTAVDIDEEIAKLRQKSLSLTRSIFSDLGDWEIVQLARHPMRPYTLDYIKAIFTDFQELAGDRAYADDKAIVAGLARLDRKPVMIIGQQKGRDTKEKVKRNFGMPSPEGYRKALRLMKMAERFHLPVIIFIDSAGAYPGVGAEERGQSEAIARNILEMSRLKTPIICTITGEGFSGGALAIGVGDRVNMLQYSTYAAISPEGCASILWKNADKAPIAAQTMGMTAPKLQALGIIDSIIPEPLGGAHRHYQQAAEFVKKQLLADLTELNSYSKEELLEKRYQKLMSYGYC

SEQ ID NO: 4496 - protein, 64 aa, Proteus mirabilis
VWSAFLYFFYIRQSAFINIFTPLSVALLNLNRKRIVQMLIFGAVALVIVLTAYLIYVLFHAEAF

SEQ ID NO: 4497 - protein, 111 aa, Proteus mirabilis
ILYFLITVPYLLVASYKMLLVPLNKLIIEVVTMKAKIVLGAVILASGLLAGCSSSNNAQLDQISSDVNRLNTQVQQLSSDVQSANAQAKAAYDEAARANQRLDNQVTTYKK

SEQ ID NO: 4498 - protein, 69 aa, Proteus mirabilis
VYRAINECLPVTENGYQNGIERIFWQNLVHCREVPLGEKKDKIMKNYNDKKTLINTQIKFIVYRHGDFI

SEQ ID NO: 4499 - protein, 141 aa, Proteus mirabilis
PKYLTNKVALRNSNQQQKAKKILVAARPKKLVTPSQRELQTIQELIAPGPAINGNAKGTTATLLRTADSFFSWLFCLSSPKRPFIMVIAIVTISIPPAIRNESIEMPKILSIESPINREITKIIATEPLAIKFVLLRPASV

SEQ ID NO: 4500 - protein, 111 aa, Proteus mirabilis
NKMASTAIVPTDITFFERLIPSILAGIKVITIRDEAESHYKPNTIVDLLSNEHGTYYGKLQIISVSPLNFNEINEFHAQQEGMNLPTLKALIKDIYPTTENLYLIEYKLIQ

SEQ ID NO: 4501 - protein, 1300 aa, Proteus mirabilis
QKVALSSAMLYKEVEQLSLRDQQRLRKRLRGVDKISKETSKHAVLSEIEQDIIVAKQRILNRQAHCPKIVYPENLPVSQKKEAIYNAIKDNQVVIIAGETGSGKTTQIPKICLELGRGVKGYIGHTQPRRLAARSVAERIAHELNTTLGESVGYKVRFSDHVGDNTLVKLMTDGILLAELQQDKLLLQYDTIIIDEAHERSLNIDFILGYLKQLLPKRPDLKVIITSATIDPERFSKHFNQAPIIEVSGRTYPVEVRYRPIGGDALDSDKDMTEGIIDAIDELSRESAGDILIFMSGEREIRDTAEALNKLQLRHTEVLPLFARLSNSEQNRIFQPHTGRRIILATNVAETSLTVPGIKYVIDTGYARISRYSYRTKVQRLPIEPISQASADQRKGRCGRVSDGICIRLYSEDDFISRAQFTDPEILRTNLASVILQMTSIGLGDISGFPFVQAPDKRNIQDGVRLLEELGALQEGTDNKGAYRLTPMGKQLAQLPIDPRLARMVLEARKYGAVRELMVITSALSIQDPRERPMDKQQASDEKHRRFQDKDSDFLSLLNLWDYLKTQQKELSHSQFRKHCRQEFLNFMRVREWQDVYTQLRQVVKELGFPINSQPADFKSIHVALLSGLLSHIGQKDSDKQEFTGARNARFAIYPGSGLFKKPPKWTMVAELVETSRLWGRIAARIEAEWIEPIATHLVKYHYSEPHWSKAQGAVMANEKVTLYGLPIVASRLVNYGKIDPLLCRELFIRHALVEGDWQTRHAFFRENLKLRTEVEELEHKSRRRDILVDDETLFTFYDQRIPQDVISTRHFDKWWKIAQKNLPDLLSFEKSMLIKEDAKRVSALDYPNYWHQANLKLRLTYQFEPGTAADGVTVHIPLPILNQVKDEGFDWQIPGIRHELVVALIKSLPKPIRRNFVPAPNYASAFLERVVTPEGELLDKLEKELRRMTGVTVERDSWQLEQVADHLKMTFRVVGDNNKTLAEGKDLNQLKARLKDKVQETLSAVADDGIEQQDLHIWSFGDLPQRYEQKRGSYSVKAYPALVDEKNSVGIKLFETETEQQAAMWQGIRRLLLLNIPSPIKYLHEKLPNKAKLGLYFNPYGKVLDLIDDCIACGVDKLIASYGGLIWQEEQYQKLQDYVRAELNDVVVEIAKQVESILTQVFAINKRLKGRVDISVAFALSDIKAQLNQLVFPGFVTSHGWKRLADIPRYLSAIEKRMEKLAIDPNRDRAQMSRVENVILQWQQWLAKLTEKQKQQEEVQNIRWMIEELRVSLFAQQIGTPYPISDKRILQAIESISLS

SEQ ID NO: 4502 - protein, 107 aa, Proteus mirabilis
RYLFNSFFDGFTKTIQMKSARKRRYSCHCVKTSLLWFKDWYFNGIDKMNENMLNLMNELVEITKKHANNEDVKAHANLESENKLRIQIIISGKNELDITLNSLQHAV

SEQ ID NO: 4503 - protein, 325 aa, Proteus mirabilis
LRKAEGFCMKLKTSVIAAAVLSLTNITVAQAAQELSPEQAAELKPFERITVIGRFNAIYEAADAVSRRADKIGADSFYIQGLDDISDSGNMSVTADLYRKDAPKATEEEYRVFHGVKELPKPEAILLQPFDTVTIHGYYPTTPDINNEIGKEAAKKGAASFFIVRNISVNDGGNQEVTAYIYKKDAPKRAIQSSEAVVPYDSDAGRALIAEGGSAANKVEKPGLASNSDFDRNVGVFAETQSSGKSGRYTVTLPDGTEIQEVNKAAAALMEPFDTITFSGYFVNSPEVSYQVAKRAAEKGAKYYHITREWQSNGGTVTITADLFK

SEQ ID NO: 4504 - protein, 355 aa, Proteus mirabilis
PLKAHNFYNKPLHGHKHQEETHNMDTIFNKLFAGQQLSLEESQTLFSAIIRGELTESQLAAVLISMKMRGEHPQEIAGAARALLDNASPFPRPDYLFCDIVGTGGDGANSINISTASAFVAAEIGLKVAKHGNRSVSSRSGSSDLLAAFGIPLDKSANDARQLLDEIGLCFLFAPLYHSGFRFAAPVRQQLRTRTLFNVLGPLINPARPPLALIGVYSPELLMPIADTLNVLGYKRAAVVHSGGMDEVSLHAPTQVAELHNGEITRYQLTPSDFGLRPCAISDLEGGTPEVNRQLLANLLQGQGKRAHTESVAANVALLMRLHGQEDLKANTEVAMHAIYSGKTINRVNALAARG

SEQ ID NO: 4505 - protein, 98 aa, Proteus mirabilis
YYFYNVLSVSITPDTLRIIHLLVNYFSMVILLFSSLLHSTLFEDGNNNAITYPNNKIKRTITIVSEEISNGYGVRTMVPMVKISAIVIGYLKPKSLTR

SEQ ID NO: 4506 - protein, 147 aa, Proteus mirabilis
KMIYWIFLVLAIICEVIGTLSMKYASVSGGYTGMIVMWLMIATSYIFLAIAVKKVALGVAYALWEGIGIVIITTFSVLWFGESLSALKLGGLAMLIAGITLIKSGTKKSAVAKKTTDSVKNIAGKAKQVATVVKGVNKPISSNVKEA

SEQ ID NO: 4507 - protein, 349 aa, Proteus mirabilis
EKVYMKNINYKLATLTLCTLFASSALANNTQAPIRLVIHGGAGTITKDTITPEQEKEYKAKLTEALNAGYAVLNSGGTSIEAVQKSINVMEDSPLFNAGKGAVFTHDGRNELDASIMDGKTRKAGAVAGVTTVKNPINAAIAVMEKSPHVMMVSQGADLFAKEQGLTIVDPSYFRTEYRWQQLQKALEKEQVVLDHDGKTAALFADPMMYDYKYGTVGAVALDQHGNLAAGTSTGGMTNKRYGRVGDSPIIGAGNYADNETVAVSATGSGEMFIRTLTAFNIAAQVKYQKLPLEQAAQNALDEVKAINGSGGVIVLDKSGNYTMSFNSEGMYRGTIGNDGKPLVAIYKD

SEQ ID NO: 4508 - protein, 668 aa, Proteus mirabilis
IFSYYSQGEIVMDGLVFTCQFKGIPEETFTVTEFQLTEHLSELFTLSLTAVSSLPSICFDDMLGFACSLTVTRNGKPIRTVRGLLASAEQQNTDGNQTWYHFIIRPEIWVMSLGQNSRIFRQITVPDLLQQLLFESHIKADCKLYAEDAYPKRDYITQKRESDYQFFCRLAAEEGISFWFEDAGIEPRMFYSDSHLGMTADIDLIYNPQYETDTKDHTAYHWRYRESLLSDKILYKDYNSKRPSYPLESKIEGEIHNQHPFYESYGRFQTQDDADRYTKIRMEEIQQQRCVGNALTNCFALMPGKIFSLSSHPCSNMNRRWQVIAITHHGTQPLADNREGQGTTLSNNLTFIPDNLNWRPPFIHKPTADGDELATVVGPEGEEIYTNEEGAVQVYFHWDRMREPELGSSCWVRVAQGWNGNGYGFMVIPRIGQEVLISYLNGDIDRPIISGCTYNGRNTPPLNLPYEMTRTTFKTKTHKGEGFNELRFDDKAGREEIYLHAQHDMNAHIEHNAHFHIQHDAKKRINNDQFTEIAGNDHFILKGSQKNHIAGNVSLHIEGDEKTKVNGNAVHESTLQTYFVSGGKIVLDAGTEITLKVGESFIRITPNMIFTSNNLVVGGGSAGSGTSIDLELPQGVPPLELSPYPVKKYCAVAAQHSGGIIIKPNEDE

SEQ ID NO: 4509 - protein, 180 aa, Proteus mirabilis
YYYYFTIKVIKLMSYTKRLSLICAICLGTFMATLDISIVNVALPTIQNDINANMATLQWIVDAYALCLSACILSSGPLSDRFGRKKVWLWGVIIFTLGSLICAIAQQHEILILGRIIQGVAAAALIPGALSLITHAFPVDIERIRIIGIWSSVSALSLIIGPILGGALVHASGWAWRLQP

SEQ ID NO: 4510 - protein, 512 aa, Proteus mirabilis
TMNLLKSLAAVSSMTMFSRVLGFIRDAIIARIFGAGMATDAFFVAFKLPNLLRRIFAEGAFSQAFVPILAEYKSQQGEEATRTFIAYVSGMLTLILAIVTVIGIVAAPWVIYITAPGFADSADKFQLTTDLLKITFPYILLISLASLTGSILNTWNRFSVPAFAPTLLNVSMIFFALVIAPYCDPPIMALAWAVLAGGILQLGYQLPHLKKIGMLVLPRISFKNSGVWRVIKLMGPAILGVSVSQISLIINTIFASFLVSGSVSWMYYADRLMELPTGVLGVALGTILLPSLSKSFASGNTQEYQKLMDWGLRLCFLLALPCTLGLALLSGPLTISLFQYGNFNGHDALMTQQALVAYCIGLMGLIIIKILAPGFYSRQDIKTPVKIAIATLILTQLMNLAFVGSLKHVGLALSIGLAACFNAGMLFWQIRKQDIYQPLAGWPIFLLKLAIALAVMSAVLVGMLWVMPDWQQGNMLMRILRLLLVVVAGAASYFVTLYAVGFRPKHFSLRAL

SEQ ID NO: 4511 - protein, 62 aa, Proteus mirabilis
ILNYIKVIFYKIKQHKPSISLVEFMLLLLVFKREENRIILNNNKAIYYTLNKKFITSPSCTI

SEQ ID NO: 4512 - protein, 111 aa, Proteus mirabilis
IMNYKKYLFSFALITALISSNAVALTLDEARAQGLVGETFSGYVELVQPNHKQAQILVNEINQARKAKYAEIAKTNQVTPESVARLAGEKLVARANSGEFVKGINGQWVKK

SEQ ID NO: 4513 - protein, 86 aa, Proteus mirabilis
SLDYFGRRAAQGSFWWFKKRYPTNRNIIPFAHREDNDDVACWDKNSRHQVIIIHDFASEGYEYVGKFDSFWDWLRTALEATIEYNE

SEQ ID NO: 4514 - protein, 221 aa, Proteus mirabilis
NFVYINITDIYRENKMNKLLVLKSSILENYSHSNKMADYLIENWQKHHQNDLITLRDLAKDPIPVLDQATLFAFGKDTAMLSEQQKAARALSDTLINELKTHDIIVITAPMYNFSIPSQLKHYIDFIARAGETFKYTETGSVGLLEDKQVIVLTSRGGIHKGQPSDLIIPYLTQFLSFIGINNVQFILTEGTALGEEYAQQSHAQAQKEIDLIINKEIMIK

SEQ ID NO: 4515 - protein, 499 aa, Proteus mirabilis
FTHYKGENMQNPPLHKLYIHGGYVDCAQPECEQFAAINPATGEVIAHLQSACEEDINWAVESAKQGQKIWAAMPAMARSRILRRAVDILRERNDELAHLETLDTGKPLSETRYVDIVTGADVLEYYAGLIPALEGEQIPLRDSAFVYTRREPLGVVAGIGAWNYPIQIALWKSAPALAAGNAMIFKPSEMTSLTALKLAEIYTEAGLPQGVFNVVTGDATVGQWLTQHPDIAKVSFTGGIDTGKKVMASASSSSLKDVTMELGGKSPLIIFDDADLDTAADIAMMANFYSSGQVCTNGTRVFVPEKLKQAFEAKIIERVSRIRVGSPLEMDTNFGPLVSFPHLEKVLSYIELGKAQGAKLLCGGERLFAGALAKGAYVAPTVFTDCTDDMKITQDEIFGPVMSILSYQTEDEVILRANNSVYGLAAGLVTRDLTTAHRVIHQLEAGICWINTWGESAAEMPVGGYKHSGVGRENGLVTLQNYTQIKSIQVELGEFSSVF

SEQ ID NO: 4516 - protein, 69 aa, Proteus mirabilis
SIDFVLTTHAALTISPVKLILPPLTIVAAEATPLSDKTDTVNRALTNIFFLSIDFSFYITGKYTQQLHL

SEQ ID NO: 4517 - protein, 327 aa, Proteus mirabilis
YCIYWSENMNGKSNNSLINNDSNKQIAKPIIPPPSANPTLSSQMETGDGNVALDLVVVIDTSGSMADESSDLSQQIDDAVQKALGRCPSSLRVTFLGIEGTWDNTKFDRSVTDYLMTQGVSAHKLQARAPFKEADGRDHAGNKEDLCRAVIDVCKYFDWRDGARRAIFVLGDEGMEGGGGVLTQAAVLKNNEAIVVARSEKVKVYTYQGTPNDDPSNVDRFPTIADRDNITKEYVRLAQMTGGRSYIYTTGIANFSLVLQEILCDSLTLPKLPDLNKDNSTCRHVCEELSTIISTVNTLAEIMHKAIDSCCKEDWGTREVFKPHCDC

SEQ ID NO: 4518 - protein, 752 aa, Proteus mirabilis
FTPYTRTFMDINGMSMLKRNFKYSTLATAICLLYAPTTFAHIEKVETDTLTVIGQQDNQITDFQSVVDTRSAQAQTASTTGQLLKQIPGITVSGTGIANGGNIMMRGYDQRGVKIFVDGIHQPIDNTMNKLGGLFIEPSLISRVKVKHGGSSVKHGSGALGGVVSFSTLHPNELLDANKNLGAKLFSSFSSADKHFSYGGVIAGRHQLVEGLLAYSQRERGPIRIADDSILNNHERIKNYFAKAYVYPTEEQTVIFSARQYNNAGEQREVLNRMGGFGKRDSNNMYRATKQNDISLTYHLNPNNYDWLDLSTQLYYSQFKIAHTFLTDTRKEIYPDIESVLGNSEKRTQYTYGMKVENAFNLNYFQDRLTQSVIIGIDAEKQKMVSNNKAKNFPLSHMDNASGWVHNTFNTPLLPITLIAGLRYNYYQNVPDNSKTLDYYKDLNKKGDMTSADKYQETYQNISKNIALRLTLTKWLQIYSSYSVAFRAPTLSEMYNDSVHFTIISPFNKKSYDARWVPNSTLEPETNRTWEHGINLQKNALLFTNDQLNIKASYYSTESIDHITYQQWYHSRKPIQLKNSHIALSPIKDAREPLLFQSVNLPKALIHGFDLRLLYSHPYIAMGVNYNQTKTLELSSLETISMVRPETLTTFINVPIIKTPFSVAWSGKFAGPTAKKGTHKYPGSEEVTTRLKEDLQQYPGYGVHSFAVNYQSNNKDIQASLVLDNAFNKVYYSTVGVPQEARNIKMSVSYRW

SEQ ID NO: 4519 - protein, 61 aa, Proteus mirabilis
TITYLLGSVFLIIYKLAEYKCANSAIYCCYFKHSLIISWSCYLLDDRRMIETHIGFEKISG

SEQ ID NO: 4520 - protein, 375 aa, Proteus mirabilis
MFKYSFIAVIVSTVLLSACADSHQKSAEKKPVTSEIANIATSAPARWKQIDVASLEQAFPKQSRTPAQFPAYVDALKQKAAELGYKPETINFAFSEIHFIDRVVKSDRNQPEKKITLDVYLPRVVTKGRIAEGAKLYQANQQTLAQISNQYGVPANYIVALWGLESGFGRVQGKEDVISALATLAFEGRREALFSRQLMAALEIIENGHLPVGQRLKGSWAGAMGQTQFMPSSFLTYAADGNGDGNIDIWNSREDAFASAANYLATEGWQRDLPWGEQVSLPANFNQQLEGIKTEQQKTVAQWKALGVQLPANSQLSDDMKVWLIIPDDDLHRSYLVTQNFRTIMHWNSSYFFALSIVTMADGVANKINTLPTQH

SEQ ID NO: 4521 - protein, 82 aa, Proteus mirabilis
YNKYEILECDFKYYRIDKNGGLLHYKTIKLTKSSIIRIKNTHPNSLLKNEYYPTKTISLRYESITVNHIVASTSGYSISNNI

SEQ ID NO: 4522 - protein, 123 aa, Proteus mirabilis
YMKYYAEVVSLNPNVEEEVTISLGDITLTCFICNLNNPIKLNEIYLVELELEIFDEVRAKLATDILPKQIGDSFAYELNGYLLENKIIISNIILQDDLLYEISFYENKYVCIYIDRINISFFN

SEQ ID NO: 4523 - protein, 145 aa, Proteus mirabilis
MMKYKHPVCVLVVIYAKQTKRVLMLKRRDDPDFWQSVTGSLEEGETPYQAALREVQEEVGIDIIKENLELVDCHRSIIFEIFAHFRHRYAPNVTHCQEHWFMLALPSEREIELTEHTQYQWLDAPLAAKLTKSASNQQAIEEFVI

SEQ ID NO: 4524 - protein, 599 aa, Proteus mirabilis
VKGYCMRTNYCGQLNSAHVGQKVTLCGWVNRRRDLGGLIFIDMRDREGIVQVFFDPEQKEAFSQASELRNEFCIQVTGTVRARPDSQVNKNMATGEIELAAESLSIFNRSEALPLDSNQTNTEERRLTYRYLDLRRPEMSQRLKTRAKITSFVRRFMDGEGFLDVETPMLTKATPEGARDYLVPSRVHKGKFYALPQSPQLFKQLLMMSGFDRYYQIVKCFRDEDLRADRQPEFTQIDVETSFMTAEQVREVMERMIHALWLDILNVDLGAFPVMTFAEAMRRYGSDKPDLRNPMELIDIADLVKNVEFSVFAQAANDEKCRVIALRVPGGASLTRKNIDEYTQFVSIYGAKGLAWMKVNEKAKGIEGVQSPIAKFLTNDVVNSILATTNATDGDLIFFGAGRQGTMSDAMGALRLKVGRDLELTDLNAWKPLWVIDFPMFEEDEDTGSLSAMHHPFTSPKDLTPAELTAHPVGAVANAYDMVINGYEVGGGSVRIHRNEMQQAVFSILGITPDEQREKFGFLLDALKFGTPPHAGLAFGLDRLVMLLTGTDNIRDVIAFPKTTAAACLMTNAPSFANEDALKELAIQVTEKEVSTDNE

SEQ ID NO: 4525 - protein, 486 aa, Proteus mirabilis
NVMYLGLDLGTSSVKAIIMNEQGDVVASHSIPLTLSRPHPQWSEQDPQAWWQATDEAIKQLSRTQPMEQIQAIGLSGQMHGAVLLDAQQNILRPAILWNDGRSVKQCLRLAKQYPQFKEITGNLVMPGFTAPKLQWVAENEAEIFCQIAHVLLPKDFLRWKMSGNFASDMSDAAGTLWLDMQKRDWSDELLAATGLSRCQMPTLFEGNQITGYLLPEIAKKWQMKQVPIIAGGGDNAAGAIGVGVYQPGQGMLSLGTSGVYFVVSEKFLQNSDNAVHSFCHALPQTWHLMSVILSAASCLDWVCQLTGISDVGAMFKEIEQHAHSDSSLLFLPYLSGERTPYNNADAKGVFWGLTHQHQRADLCRAVLEGVSFALRQGIEVADKAGQHADNITLIGGGARSEYWRQLLADITGKTLDYRQGGDVGPALGAARLAQLAINPAHLSQIILSQPKLETRHVPNLEKHKAYQDKYNAFKKLYTLIETMKI

SEQ ID NO: 4526 - protein, 281 aa, Proteus mirabilis
RIMYMNNQQAEQLKKIMMADSYFAQPITPPFPQPLAIKSLQQTLNIKDTEGLVQFIIASPKRFNESEKMIMTQLKDIQIALISIMSNHLSVLKKEDSEAYYQPEHWLETLNHLPLLSRNKVESKRLDKQTFDFSIAQAFVQLLLGAAINAASPSLAEFIDFLRNQGQQIELGIRQSFDSYKTITIAGVTEILNHNNQLIFVPKLKIMSLRFSHRTAKMLLASCSGRKFTISVEYTTITSIFDIGALNDPLINRQFYAFLNKFRQLSITQSDSFFSGDFLLQ

SEQ ID NO: 4527 - protein, 277 aa, Proteus mirabilis
TYEYLVMEMILLFLIVGCITGFFAGLLGIGGGAIIVPIVMYVVSQQAIPADMVMKIALSTSFSVIIFSTASSAYSHNKHKAILWSQFPLLAVGTLLGMLVGTFLVQKLSNTLLQIIFCIFMAYTIYGLLTKKKEAERVENAQDPVVSKPALTTGGSLVGFISSFIGIAGGTITIPLLSHWGFNTRKCIATSSMLGVIIATIGTVMGIVYGWQQTELADYYLGFVYLPAFIGISITSILTAPIGVKVAYKLPIARVRQIFALFLLIVMAKMLYTLILG

SEQ ID NO: 4528 - protein, 244 aa, Proteus mirabilis
IPFQLVRRIKMSMIKELFSQGLWKNNSALVQLLGLCPLLAVSSTATNALGLGLATTLVLVCTNVAVSSLRRWVPSEIRIPIYVMIIASVVSAVQLLINAYAYGLYQSLGIFIPLIVTNCIVIGRAEAFAAKNEVFPSAIDGFAMGLGATAALFVLGAMREILGNGTLFDGADLLLGEWAQVLRVEIVHLDSPFLLAILPPGAFIGLGFMLAIKYLIDEKQKKRVPSTTKTYEKEQGCGSHIVKN

SEQ ID NO: 4529 - protein, 68 aa, Proteus mirabilis
IRFHNMRHVAHSLTLKRTYKTYARFYWQDKDTDRYRLLLTNPLGTTELDLNVMPGVIEVTDNGGKKVL

SEQ ID NO: 4530 - protein, 61 aa, Proteus mirabilis
PPIHFTRPKNLTHSIGIKILCKRFRTLFMIINGIGDRKKLIYLTSILMLWLFYLSHSTYLK

SEQ ID NO: 4531 - protein, 347 aa, Proteus mirabilis
RRNQLIGLFEYNMKILVTGAAGFIGYHLSQRLIEMGYHVVGIDNLNDYYDVRLKEARLAKLNQLDNFQFDKIDITDSVSIAQLFADHRFDRVIHLAAQPGVRYSIENPMAYIDANIVGHINILEGCRHHNVGHLIYSSSSSVYGLNQKQPFSTEDSVDHPVSLYAATKKANELMSHSYSHLYQLPTTGLRFFTVYGPWGRPDMALFKFTKAMLAGEPIDVYNGGNMTRDFTYVDDIVSSVVRLINIIPEPNPNWTVEQGETSSSSAPYKIYNVGNGQPTKLMDFITAIEKSLNIKAKLNLMPMQDGDVLSTCADCSDLAQTTGFSPNTAVEYGVKQFVDWYVDYYQQ

SEQ ID NO: 4532 - protein, 480 aa, Proteus mirabilis
TYCHYYSLLSYGLLIHTIYLLFTDQRDLYIKIMRLFMFGLSAFDLARIQFAFTVSFHIIFPAITIGLASFLAVLEGLWLKTRNKDYLALFHFWSKIFAVNFAMGVVSGLVMAYQFGTNWSFFSDFAGSITGPLLTYEVLTAFFLEAGFLGVMLFGWNKVGEKLHFFATCMVALGTLMSTFWILASNSWMQTPQGFEIVNNQVVPVDWLAVIFNPSFPYRLAHMGVAAFLASAFFIAASASWHLLKGNKTSAMKKMLSMSIWIILILAPIQALIGDMHGLNTLKHQPAKIAAIEGHWQNNPGEATPLILFGIPDMNEEKTKYALQIPYLGSLILTHSLDKQVPALKEFPKDDRPNSLIVFWSFRIMVGLGMLMILVGVWGTWLRYKKKLYQSNLFLRFTFLMAPSGLIAILAGWFTTEVGRQPWVVYGIQRTRDAVSAHGEMHMSISLLIFFIVYGSVFGIGYAYMLKLIRKGAPEVQDGN

SEQ ID NO: 4533 - protein, 218 aa, Proteus mirabilis
IWRQYFCGGVRVIGRIRGVILEKQPPVVLIEAGNGVGYEINMPMTCFYELPDIGQEAIIYTQFIVREDAQLLYGFNQKQERALFRELIKVNGVGPKLALAILSGMSARQFVTAIENESISSLVKLPGVGKKTAERLVVEMKDRFKGLNGDLFEQNGDIELPASASSKAPSAADIEAEASAALIALGYKPQEAAKMISRVATAGADSETLIKEALRAAI

SEQ ID NO: 4534 - protein, 67 aa, Proteus mirabilis
KIIQPSKSKFVLKCQYPIFDERYEKQVDYDNARQRLSICYSFCRFEHAASHISFIMSSFFSTHCFFK

SEQ ID NO: 4535 - protein, 192 aa, Proteus mirabilis
RVYHQGVCMKAIFLTALFVLTSLVTGCDQIRQFDVSEKVINDYLSQKSGLQKHIGEDGVVSADITLSDLAIQIGRTEPGKVSFSGSASLKIDSLFGKTGANVNLTLSGQPFYQAELGAIYIKSMKIDSYKVSPEKMEPVVMALKPYLDTTIATYFDNQPVYVLNPEKNSAEAAAFKLAKGIEVKPGKFVIQL

SEQ ID NO: 4536 - protein, 169 aa, Proteus mirabilis
RLYQYHQYSSTSRGKIMSDKQFIQQAISLATENVKVGGRPFGAVIVKNGQVIAHAVNQITATNDPTAHAELLALREAGKVLGRAKLDDCVVYASGQPCPMCLAAMRMAGISQIFYAYSNDDAQPYGLSTANIAKALRVAPEQQEGLQFVQIKPEDEKQPALYQLWSQQS

SEQ ID NO: 4537 - protein, 148 aa, Proteus mirabilis
SHHQTISIFISVLFYYAEMAHQLFFNIFSHATNAIALFDHINIISHYYLVYLIVITPVFVFLNGKMNSLYKCLFYFIFPYFLSLFAWYTHIYFDLPKNSNLGSGTLLGEFGYITVTIYIIYGSFLIPLIACLCEIFIRLLYRYLYRFY

SEQ ID NO: 4538 - protein, 293 aa, Proteus mirabilis
KSCHEGAFRKKGLVMAEKKSCAQALNEAGLSVIKACLLTSLPRSTFYRKTQNWREKDKIVIDAIQTVLAKSPQAGFWKCYFRLRFQGYLFNHKRVYRVYCRLGLNLKRRVKKVLSKREKRPLKIENVPNIQWALDFMHDSLYCGKRFRTLNIIDEGTRECLAIEVDTSLPAERVIRVLERLRMERGLPKQIRVDNGPELISINLLNYCKTHHVELCHIQPGKPQQNGFIERFNGSFRREFLNTYLFESLSQVREMVWFWQQDYNQNRTHESLNHLPPEAYRKQLENSNLTCLN

SEQ ID NO: 4539 - protein, 198 aa, Proteus mirabilis
KYRHLQQIRYAIMKKNLILFISFILPFSPSLHAFENNQAIYGGYIYGKIKNHKANGAIISYHYGSDIHWGMLLSLLHIKSTHQSHFIDASSLKLGTKDEHAKVSALLIDPTYRITPSLAIYAQMGPKKLKYRVDKSYSGVAVTDTIIVDTTNVMFQAGIDYSLRKNVGINLGYLHSDTESNKHNIRLNSIQLSLGYRF

SEQ ID NO: 4540 - protein, 345 aa, Proteus mirabilis
IGVHVYRFQNDYNEIAHPAVMKAITDTVGQRYDGYGMDTLCHQAKELIKQRIKQPEAQIHFFNGGTITNLTAISHFLRPHQAVISVSTGHIATHETGAIEATGHKVITTFSADGKLTPDLLKPILAEHNDEHWVQPKLVYITNATEIGTVYRKAELQALREFCDAHNLWLYLDGARLATGLMSDNSDLTIEDIAHLTDAFYIGGTKIGAMSAEALVICHPALNSDFRFSLKQKGGLQAKGWLLGAQFAALFSDDLYFKLGKHLNEMASQLAAFFTEHGFDFLAPAESNQVFVILPNDIAEKLTQQFVFHRILLDDPQLSCLRLCTSWATTQQDIDDFKVKFLKLI

SEQ ID NO: 4541 - protein, 88 aa, Proteus mirabilis
EQPHWTIEPSTAIFCPSSIIPCSPVTIVPSSLHTGQRVVLSPSLNMLIPSLVTVNMLARQVAPVVVLSLCNPILFPKTVALIIVSLHI

SEQ ID NO: 4542 - protein, 525 aa, Proteus mirabilis
RLKHASVFTAYTQKSTLIRNYVTKLQNLIMRRRTMAAISTAQACDLVIFGTKGDLARRKLIPSLYQLEKAGYIHPDTRIIGVGRADWDVAAYTNVAHEALQTFLKEEINPEIWQRLSARLDFCNLDVNETDHFIELAKHLKQDKLPAIYYFAMPPSTFSAMCKGLGHAKLNKEPNRVVMEKPLGTDLASSVSINDSVAKYFKESQIYRIDHYLGKETVLNLLALRFANSLFVNNWDNKTIDHVQITVAEEVGIEGRWGYFDQAGQMRDMVQNHLLQILTMIAMSPPADLTADSIRQEKVKVLRSLRRIDMTNVREKTVRGQYTAGFVQGKKVPGYLDEEGANKASNTETFVAIRADIDNWRWAGVPFYLRTGKRMPSKCSEVVVYFKKPALNIFSETYQELPQNKLTIRLQPDEGIDIEVLNKAPGLDHKHRLQTTKLDLSFSETFNQTHLADAYERLLLEAMRGIQALFVRRDEVEEAWKWVDSIINAWECDNELPKPYQAGTWGPVASVAMITRDGRSWNEIE

SEQ ID NO: 4543 - protein, 319 aa, Proteus mirabilis
EKVHIMKKTLLALTLCSSVFTVPAFAQWPEKPITIIVPWAAGGNTDTVARLAAKGLQEELGVTVNVVNKTGGSGVVGHDAIKNAKSDGYTLGIATVEIAMMHHQGMTNLTYQDYTPITRLAVIYGGLQVAKSSPFNNAQEIIDYAKANPGKLKASGSGLNSIWHLNNIGMLRAAGLPDNAIRFIPSQGASAALQELASGGVDIVTSSLGEADSMVKAGLVKHMAIMSNEKSAFYPDVPLFKEATGYDWDLQAWNMLVAPKGLDKEAQDKLTAAMKKVYASGELAEFANKQGFEVIELYGDDATQFMANEDKKFGEIIKK

SEQ ID NO: 4544 - protein, 566 aa, Proteus mirabilis
MKTHKVNRVRPFSAFIDACVKEPYSFARLLKDIIAGITVGIIAIPLAMALAIGSGVPPQYGLYTAAIAGIIIAVTGGSRYSVSGPTAAFVVILYPVSQQFGLSGLLIATLMSGIILVVMGLARFGKLIEYIPVSVTLGFTSGIAITIATMQIKDFFGLEMSHVPETYIDKVIALGAALPTIHLGDTLIGVTTLLVLIYWPKLNLRLPGHLPALIAGTAVMGIVNLFGHDVATIGSQFSYLLPDGSTGQGIPPILPQFVLPWNLPSSGESIALNWSTVSALLPAAFSMAMLGAIESLLCAVVLDGMTGKKHHSNGELVGQGIGNIVAPFFGGITATAAIARSAANVRAGATSPVSAIVHSLLVLVTLLVLAPFLSYLPLAAMSALLLIVAWNMSEARKVIDLIRHAPKDDIIVLVLCLSLTVLFDMVIAITIGIVLASLLFMRRIANMTKITESTYTDDDKQLLVVRVNGPLFFAAAERIFNELRERSKGYKTLIMQWDAVPVLDAGGLHAFQHFVADVQHDTHIIVCDIPFQPLKTLARARVTPIDGTLNFYPSLQKALDDMELIQ

SEQ ID NO: 4545 - protein, 220 aa, Proteus mirabilis
IAQQKRYFLQLLNQVKKMEFNTLLFFALTVLPLICTPGPDILFISSQGLAGGIKSAWFANIGVISGYITHAILSALGLATIMATSPIFFYLLKWLGVIYITYLAIKMLISACQKGQLTLHADKKTHLFRKGFLTSFLNPKGLLVYLAILPNFINNQNDIAMQSLLLSGIFITICLFIYGFLGTIFAYIGLKGGLSDKGRRYNDGIAGSLLTFAAVNLALN

SEQ ID NO: 4546 - protein, 66 aa, Proteus mirabilis
YRKQLENNDISQQLLSVIVNNSCRISLLIQFQYQNFVLIQAIYFLKMLFNTHFLQFSVRNMGDTLW

SEQ ID NO: 4547 - protein, 307 aa, Proteus mirabilis
RLEHVMLSMKENSEALGNFSEQLDVEGRSLWQDARRRFMHNKAAITSLVLLFCILLFVIFAPMLSPFVYDDTDWEMMSMPPDFASAHYFGTDSSGRDLLVRVAIGGRISLMVGIAAAFVAVIVGTLYGAMAGYIGGRVDSVMMRLLEILNSFPFMFFVILLVTFFGQNILLIFVAIGMVSWLDMARIVRGQTLSLKRKEFIEAALVCGVSSRNIVLKHIVPNVLGVVVVYASLLVPSMILFESFLSFLGLGTQEPLSSWGALLSDGANSMEVSPWLLLFPAAFLVVTLFCFNFIGDGLRDALDPKDR

SEQ ID NO: 4548 - protein, 279 aa, Proteus mirabilis
IIFNRNSIMPLHFSGRIFASLLLAGTLLTGCDNNDNNRYAIKVGVINGAEQDVAEVAKKVAKEKYGLEVELVGFSGSLLPNDPTANKELDANVFQHRPFLEQDNRSRGYNLVAVGNTFVFPMAGYSTKIKHPQELKPGDTIALPNDPTNLGRALLLLQKEKLITLNPDSGLLPTTLDIIDNPLKLNIMQLEGAQLPRVLNDPQVTVAIISTTYIQQINLSPTKDSIFIEDKSSPYTNIIVTREDNKEAENVRDFIKAYQSPEVATAAETIFKGGAIQGW

SEQ ID NO: 4549 - protein, 184 aa, Proteus mirabilis
MDFKMKKSLFSLLILSTLALSTQAIAQQIHLGGYNIDIQGRVIDEKLTCVVQDVAPIQLDDAYVDSLLLTPEKQFSVDFSGCTNQERARKVKIVVARQNTTHLMNTSSTANDTNARVALLGSTGELVPLNGEREQRTFYSDVAGDSGRLVFSLKYDRPESIDAVTAGAFKATLSLDAYITDNIQ

SEQ ID NO: 4550 - protein, 185 aa, Proteus mirabilis
MDFKMKKSLFSLLILSTLSLSTQAIAQQIHLGGYNIDIQGRVIDEKLTCVVQDIAPIQLDDAYVDSLLLTPEKRFSVDFSGCTNQARDRKVKVVVGQQNATHLMNTGSTENDTNARVALLRSTGELVPLNGEREQRTFSSEVAGERGSLEFLLKYDRPESIDDAVTAGAFNAALSLDAYVTDDIQ

SEQ ID NO: 4551 - protein, 93 aa, Proteus mirabilis
LKFKQLINNQNNKLAYITIITSAATAVLKPNFRSVSIYFSLKMIIILRLNHNLVMVNYYYISSFAKIATRAQFITLINTFTFELDHTKFTANR

SEQ ID NO: 4552 - protein, 101 aa, Proteus mirabilis
CYIKDSFLNTGCDCMKKLTLQEMTDAQQMRVRTRIGQERKKLGRELTNAEMNKVKDAIITEISLEVEKASKKALSQKKKQKLVSSDETYSWSAQNHRRGYR

SEQ ID NO: 4553 - protein, 366 aa, Proteus mirabilis
QDINLRMKPSIVAKLEALQERYEEIQALLAEADVIASQERFRALSKEYAQLTDVTSCYRQWRKVQDDMEAAEMMLDDPEMKEMAQEELKEAQSVNEELEQQLQVLLLPKDPDDEFNCFLEIRAGTGGDEAALFAGDLFRMYSRYAEARRWRIEVMNANEGEHGGYKEIIAKVIGDGAYGVLKFESGGHRVQRVPETESQGRIHTSACTVAVLPEVPEAELPEISPSDLRIDTFRSSGAGGQHVNTTDSAIRITHIPTGIVVECQDERSQHKNKAKAMSVLGARIRAAEVQKRQEAEASERRNLLGSGDRSDRIRTYNFPQGRVTDHRINLTLYRLDEVMEGKLDALIQPIVTEYQADQLSALSEQD

SEQ ID NO: 4554 - protein, 110 aa, Proteus mirabilis
WLIKKHMIKKYIVYIISFVFTFSCYASIQINKDRFFYKEQDKEILFDIRNKSEQKTYIIQSWVSHYNKEDNSEAPFIISPSLIRLAPNENFTLKNIKTDDIKEINPESVY

SEQ ID NO: 4555 - protein, 227 aa, Proteus mirabilis
EKINMVSFLRTKSAVLLSIVIFPIFFLLSGCFSFGLMLSTKNDNGYHRSHWKGDSITALSLAKDSNGTSGWVFIGDHFDYLLIRGGDNAVNILRDPLIHHDKLSVENPVEFIIDNQKKQFNGKIKINYNWVTQTDKEAALTYGFICKKDINTCSLKIDNLLGTVHQKNKEQKNEYLLPFNHPFNVEFYQYKENLIGASTPRILLPVTLALDIVTSPLQLLMIPILSK

SEQ ID NO: 4556 - protein, 582 aa, Proteus mirabilis
YFVKKKHNINQEVRLIRSTTLEKVWLKRYPADVPAEIDPDRFASLAEMLENAVANYADQPAFINMGEVMTYRKLEERSRAFAAYLQNGLGLKKGDRVALMMPNLLQYPIALFGILRAGMVVVNVNPLYTPRELEHQLNDSGATAIVIVSNFAHTLEKIVFNTSIKHVILTRMGDQLSRPKATLVDFVVKYIKRLVPKYNLPDAISFRRAMHLGYRMQYIKPEITGDDLAFLQYTGGTTGIAKGAMLTHRNMLANLEQAKAAYVPALNVGKELVVTALPLYHVFALTVNCLLFIEVGGKNLLITNPRDVKGTIKELSRYPVTAITGVNTLFNAWLHNPEFRQLDFSKLNLSVGGGMPVQSSVAKEWEELTGKHLLEGYGLTECSPLVTGNPYNLKKYSGSIGLPVPSTEVKFMDDEGNEVSRTEGGEMWVRGPQVMKGYWNRPDATAEVLHDGWVATGDIATMDDEGFIRIIDRKKDMILVSGFNVYPNEVEEVVTAHPKVLESAAIGVPSKSSGETVKIFVVKKDPSLTEDELKTHCRRYLTGYKVPKIIEFREELPKSNVGKILRRELRNEEKQLKTSTGS

SEQ ID NO: 4557 - protein, 479 aa, Proteus mirabilis
FGTNQLFCVLKEIEMAATRIEKDSMGQIEVPADQLWGAQTQRSLEHFRISVEKMPVALIHALALTKKAAAGVNMDLGLLPKERADAIIAAADEVLAGKHPTEFPLAIWQTGSGTQSNMNMNEVLANRGSEILGGIRGMERKIHPNDDVNKSQSSNDVFPTAMHVAAVIALRQDLLPELKSLLKVFKEKAEAFHDIVKIGRTHLQDATPLTLGQEISGWAAMLEHNIKHIEDSVPHVCELALGGTAVGTGLNTHPEYAVRVAKRIAELSGQPFVTAPNKFEALATCDALVHSHGALKGLAASLMKIANDVRWLASGPRCGIGEISIPENEPGSSIMPGKVNPTQCEALTMLCAQVMGNDVAINIGGASGNFELNVYRPMIIDNFLQSVRLLADGMRSFNEHCAIGIEPNRERINKLLHESLMLVTALNTHIGYDKAAEIAKKAHKEGLTLKESALKLNYLTAEEFDSWVRPEDMVGSMKK

SEQ ID NO: 4558 - protein, 636 aa, Proteus mirabilis
KETNYLRKINSILIKIDNKNLYIGAMMANHKETCLSAAERVFDTRTVDTLTCYHREMVKMLMDSESFYSSPNNSQINTNERLENKIKSNTIENKAVKGSYGDILNNLNQQLMNNKPEIEPYFSHYNSPVMRLAKLGYLSALAYNADNVFNKHSPIQKQQEQKITHDLCKLIGFEPDKAFGHITTSHVFACYEILWALRNLKTLPMAIARHPKSRDLVADKKAFELFNMSITDILSISEQLYERDIFDDVSHLTCRGTGMTRTMHLGKLLVPIYRFEFWKKAMDILGLGYDNLIALPIDEEFKTDIAKTRHIVLRLIEQGEPILGIIGVLGSSTYGSIDKLKPLFELREECEKQHNNSFYIHIDASQLGYMKSLFLDENNSIIPYNILCDKLKQEAPLLELTSDIYDSFTQLSRADSVSFEPFQAGFSPYPTGIVCIKDARLSRFLANPPKLCPEEGNIPDEIDGIQSAPAVASMWGIHQLYAFNHFGYGQCAQNQWEARVKLEQQLKQENEFEKSGISYAIHILPVSDFNKLTFAIALKGNQCLKIQNQLNNAIYKNLEIKSQYKPDLNLLVLCARNSDDIPAQFCQQCHLGKDEWKQVNHLSLLQLTIKNTDKWSEEHIKAGYDYIKKVVLSALK

SEQ ID NO: 4559 - protein, 83 aa, Proteus mirabilis
PSYKGYVMGYIFLGIPLTIFVLFILPIWLWLHYNSQKGGGKVQLTQQEMQRLSALVDKAQQMQERIKTLEDILDAEHPNWRQS

SEQ ID NO: 4560 - protein, 149 aa, Proteus mirabilis
SPYKKGCLSNNKAIETFVIFEIARTIIHYGLHFLAPIALAYLFWGKNWRLAALLMMSTMAIDIDHLFATPIFDPNRCSVGFHPLHTLWAAIVYIVLWFIPSWKWKAIAVGCLFHLLTDSVDCYLGGLKPDMAITISCNKLYSPETPFEY

SEQ ID NO: 4561 - protein, 237 aa, Proteus mirabilis
SRYKMNNYKTKTEYEHTLESAIAAVGAAIADISRVKILCALMDGRAWTATELSIAADISASTTSSHLSKLLSSGLISVSSRGKYRYFRLASDDIAKVIENLMSFSTVHVSQAKITTPEHLRKARTCYNHLAGEIAVKIYQVLCQEEWITKDGTEITEFGDKRFKLMGLNFQAKHSRNICCPCLDWSERRFHLGGQIGSALLNHAQTQGWIKRHQGYREVTINEKGNKAFAQYFNITI

SEQ ID NO: 4562 - protein, 68 aa, Proteus mirabilis
FCCLITRRSLLSGINTKHLFKIFTIKVKTVSNLHLLTTDSKVYRGGGTVLLSLLRVTERGAIYGRETN

SEQ ID NO: 4563 - protein, 326 aa, Proteus mirabilis
VCNNIWVSVLCKLNKISFQEIIMSSQFNGLIPSNSLSSFNIEVIKELLLWIEVNLEKPLLLDDVAIKSGYTKWHLQRVFKQATGLTLASYIRGRRLTKAATELRLTKLPVLTIALRYQFDSQQSFTRRFKAVFGVTPSEYRKVDVLCSDNFQPPINFEVTDLPIPNIIELPESFLYVIQYQYFCSIEDIGKLHEDIRHQFWNDFLLYTDKNFTESSVLISYQPNTLRKDKIQIDYEIGLNNLDHFTRPRGFRKKAIAGGRYVRFQFKGTLEEYKQFAIKIYFYTLPALGLCRRLGPDIENYICIETDSDIMELPKTLEIDYYVPIH

SEQ ID NO: 4564 - protein, 904 aa, Proteus mirabilis
AGNKMEQAPQWQRPSPDDLLALTRAPHRGRLKIFFGACAGVGKTYAMLQEAQRLHQQGIDVLAGVVETHQRQETAQQLEGLPLLPPLKLHYRGRKLSAFNLDGALARHPAVILMDELAFSNPHKCRHPKRWQDVEELLDAGIDVLTTINVQHIESLNDIVGSITGIRVQETIPDYIFDNADEVVMVDLPPDDLQQRLNEGKVYLAGQAERAIEHFFRKGNLIALRELALRRMADRVDSQVKEFRDSQGGTPVWHTTDSLMVCLGAHGRNDKLVRTAARYAAAFGCQWHAIYVETPKLHQIGEHKRRAILHSLKLAQHLGARTAILSDNQAEKAVIRYAREHNLGKVIIGQRPYQKWQWLKRWVRMRFAERLARYAPDLHVISVALNEEEPRYKTKTFVPQNDKWRQNLKGYLTAIGLCLAITLFSRTFLLALDKANLVTLYLLGVVLIALFFGRRPSIFAALINVISFDLFFVQPHFSLAVLDMQYLVTFSVMLIVGLVVGNLTAGMRYQTRVARYREQRTRHLFEMTRELSRALTLQEVVRTSYHFLSSAFDAKVCLLMPNHHGELTPYNAEGMGQLPIDSGIARWCWDKDQIAGAGTDTLPSVPYQLHPISASQQVLAILAIEPNNLRQVLIPEQQQLLQTFNGLIANALERLQQAEMAEQSRINIEREQLRNALLAALSHDLKTPLTVLFGQSEILLLDLSAEGSAHTEQVSQIRQQILTTSRLVNNLLDMARIQSGGIQVNLQWNLLQEIAGSAVRSLSYLLDKHPLQIDIPADLLLYCDSLLIERVLTNLLENAVKYTVSQTKLGIKATVEEDQIHVEVWDEGAGIPTEQLQLIFNKFSRAVKESAIPGVGLGLAICSAIIHLHEGKIWAENNKKGGASFHFVLPLKSLPNIDEIEIKQ

SEQ ID NO: 4565 - protein, 109 aa, Proteus mirabilis
KGNNVKKVLLFILVVLVLAIVVIAMTLGSNNDQVITFNYLIAQGEYRISTLLATLFGVGFVLGWIVSGVFYLRVRLSLVRAKRKIKRLESEQTKQESQENRSTAVSTVK

SEQ ID NO: 4566 - protein, 62 aa, Proteus mirabilis
IRNNEMVLILLSQKKDFVTALSTLTFYDQYNFYLYILIVPPNCLWRLSEPLKGDKWGFHAKM

SEQ ID NO: 4567 - protein, 139 aa, Proteus mirabilis
LRDNNMLNNNNFTIMSVDQFPIITMQVFPETLEHANNWIAEMDLVLAQKQNFVLVYPPINKKNEQEDMEGMKAVRRWLKTGKMPLSQYCAGMIMTVNQQTNDKEQLMQLSPVVSAVYGVPIFVEETLDGAYLKANSLLA

SEQ ID NO: 4568 - protein, 347 aa, Proteus mirabilis
TMDKKIKKSLARVITIIVFLITLILLWQSIHISALNPLSEDAIIDANKINISASVPGRIAAVYVKENSKVKKGDLLFTLDPTMYALRVEQAKEQLQIAQATLSNKQRIIIAETSNSEVAQEQIKRAQVNLSLATQSLNRLEPLLAKGFVTAQQVDDARTLKHDAEVTLKQAQKQNVASEALINNTDSEEALVKSLKTSLAMAEWELSNTEVRAPSNGYIAGVVLSPGEFILSGQSVFTLIDSDTWFASAYFKETDLNNIKIGSCVVIYSMIDNQHPIKGKVEGISRGVMSTDLINIPRDLPYVPKSLNWVRVEQRFPVKVIITEPPEALMRIGATATVNIVPNDDDC

SEQ ID NO: 4569 - protein, 565 aa, Proteus mirabilis
FICKLSNPAIDDYLLGEVPMKKKVMLKMMFPVSIISLALTSFLSHAVIPPEGTLLAKQQDIVINNGTEVSSLDPHKVEGVPESNIILNLLEGLTYMGPNGESMPGVAAKWESSEDNKTWTFYLRDDAKWSDGTPVTADDFVYSWRRLTDPQTGSPYASYLEYAYVENVADILTGKKSPESLGVKAIDPHTLQVTLTQPVPYLVDMLNHTSLKPVKKEIVEKYGVNWTRPENFVGNGAYLIDNWVVNEKITLKRNPLYWDNKNTIIERATFLPISSETSDINRYRSGEVQITNSAIPPTLYRKMKQEQPEALHITPYLCTFFYELNNKRPPFDDPRVREAVKLSLDREIIAEKIMGQGQIPAYSFTPPFINNGKFKPPKWAGWTQQQRHERARELLKEAGYDSQNPLSFTLLYNTSDQNKQQAIAAASMWKKNIGANVTLQNQEWKTTLENRNQGNYQVARATWCADYNEPTSFLNSFLSTSSLNTILYENSDYDAALKNALLATDNEARHQLYQRAEALLDKDSAIVPVYYRVSVRMVSPKVGGFTGKDPFDYTDLKRYFIKADK

SEQ ID NO: 4570 - protein, 68 aa, Proteus mirabilis
NIRNISSFSKKYLTDVSIFKPKQHKRVYLKKDNLSKRKLLENSVYFFTLCKILLKVHNLSKPITFKIC

SEQ ID NO: 4571 - protein, 367 aa, Proteus mirabilis
KMSKLRVAIIFGGKSTEHQVSLQSAKNIINELDRTKFDLCLIGINEQGQWHEYAEDNYLINSDNPSTISLSQPLRPVAIIPGSTRQQFISLTDGQPLAQIDVVFPIVHGAYGEDGTLQGLLHMIDMPYVGPNIMSSAACMDKDITKRLLDDAGLAVAPFITLMAHQLNDISYNEVVEQLGLPLFIKPANLGSSVGISKVNNEAEFNAALSMAFEYDLKVIIESAIVGREIECAVLGNEEPEVSPCGEIVLNDAFYAYNTKYIDDDGAKVVVPADLDNAISLHIRQTALKAYQVLNCLGMSRVDVFLTEDNQVIINEINTLPGFTNISMYPKLWQSTGLDYQSLITKLIELALEHHKKTAVLKTKCEL

SEQ ID NO: 4572 - protein, 308 aa, Proteus mirabilis
KKFKGINIMWSEYSLEVVDAVARTGSFSSAAQELHRVPSAVSYTVRQLEEWLAVPLFERRHRDVELTDAGKIFIKEARSVIKKMNDTRHMCQQVSNGWRGQFSIAVDGIVKPARTQQLILDFYRHFPDIELYVYPEVFNGVWDSLVNGRVDLAIGATRASPIGERYSFKDMGFMPWRCVCHADHPLASAAHPLTDDELRPYPSLCLEDTSRSLPKRDTWALNNQRRMIVPSWDMGLECLLAGLCVGMVPWHRAEPLIEQGKLVTLTLAQPLPDSPCCLTWVDKSESPALTWLLDYLGDSQTLNEEWLR

SEQ ID NO: 4573 - protein, 358 aa, Proteus mirabilis
EVIKRKRYLFYFFHMPILKTSIFTDFIMIRIVLFTIIAIISNNAVAVSCVSGCNANEYSTLSGQLSKTENKVGVTKDASDITLSNRITLRWNAGQAQTWATYSNGNIPSANTSNNDWIYSKIDDYISVALRMTNNCRTIYVPYNVPTLSSTCGSRTYTENEESVVSVRKYQTRIKIDKAIISGTYVKNIFVGEFGFCQPQNCATKQTIITKLFLNLSMTVPQSCVINSGQVLNIDFDNIPASSFKVAGKKAEGVNTVSRNLSIQCDNIDASADLTMRLQADSVQGNAIVSNNKSVGFVVANSSGSELTPNDLSSFIPFRLNQNADANVTINVYPVSIDGKTPTEGAVTSSGFLRVDFP

SEQ ID NO: 4574 - protein, 60 aa, Proteus mirabilis
RLINSLLSFYLLSFYNEKPMVISPSVFLDKYNGLITFYRQFQYLKSLSLALRFLLLNVLA

SEQ ID NO: 4575 - protein, 116 aa, Proteus mirabilis
YSINNVIIRSLIMKLWAKISTVLAALLMAMTLSACSPTATSEGTGGYFDDSVITTKVKTALIGEKNLNSTQISVETFKGKVQLSGFVSSQADANRAIETARKVTGVKGVINSMVIR

SEQ ID NO: 4576 - protein, 295 aa, Proteus mirabilis
PFAKAQPVTLHELGLLDAQLGELYAKAIMELLAKARLSAADITAIGCHGQTIWHEPESDIPFTMQIGDNNRVAALTGITTVGDFRRRDMAYGGQGAPLVPAFHLAVLGHPTEKRIVLNIGGIANISLLLPGVAVKGYDTGPGNMLLDSWNWVHNQTAYDDNGQWAATGNVNTQLLQEMLADPYFSRSAPKSTGREYFNTQWLHYHLAKVPNVFPEDVQATLVELTAISIAQQVQLNGGCERLLVCGGGAKNGQIMHRLASLLLGTEVSLTDKYGLSGDDMEALAFAWLGRTNNGK

SEQ ID NO: 4577 - protein, 434 aa, Proteus mirabilis
TKNNKPMESLMSSKNLITQLQERGLIAQVTDEAALVERLEQGPIALYCGFDPTADSLHLGHLVPLLCLKRFQLAGHKPVALVGGATGLIGDPSFKATERKLNTQDTVHEWVEKIRKQVSPFLDFDRGENSAELANNYDWFGQMDVLTFLRDIGKHFSVNQMINKEAVKQRLNRDDVGISFTEFAYNLLQAYDFASLNKNLGVELQIGGSDQWGNITSGIDLTRRFNQKQVFGMTVPLITKSDGTKFGKTEGGAVWLDPKKTSPYKFYQFWINTADADVYRFLKFFTFMSIEEINALEEEDKNSGQAPRAQRVLAEQVTRLVHGEEGLTAAKRITDSLFSGAIADLTQADLEQLAQDGMPTIELEKGNDLQQALVNAELVPSRGQARTMIGSNAVSINGEKQDNPEYVFEEKDFLFGHYSILRRGKKHYCLVIWK

SEQ ID NO: 4578 - protein, 86 aa, Proteus mirabilis
KSSKERNVMKKYLFAVLATLFAFAPLAANAGCDEVVQDIQQKIENNGVPAANFTLTVVENDQVAQTEGKVVGTCENDSKKIIYTRH

SEQ ID NO: 4579 - protein, 225 aa, Proteus mirabilis
FACLLAKKGLFMGALLDLSGYIKFFVGLFAIVNPIGILPVFISMTSYQTDAGRNKTNLIANGSVAIILVISLLIGDSILSIFGISIDSFRIAGGMLIVTIAMTMINGRLGEDKQNNQEKNESAVRSSVAVVPLALPLMAGPGAISSCIVWSSRWEGVTNFLGLAATSIFFAFCCWLLFRSATLLVKYLGQTGINVVTRIMGLLLMSLGIEFIVTGLRSIFPGLLV

SEQ ID NO: 4580 - protein, 350 aa, Proteus mirabilis
IMLKTDELRTKALASLVTPETLANELPISQEIISNITSARQRIEAILTGEDKRLLVIIGPCSIHDPKAAKEYATKLNQQKARFHDRLEIVMRTYFEKPRTVIGWKGLISDPFLDNSCNVNEGIRIARKLLIEINALGLPTATEFLDMVTGQYIADLISWGAIGARTTESQVHREMASALSCPVGFKNGTDGNIRIAIDAIRAARASHTFLSPDKTGRMTIYQTSGNPYGHIIMRGGKKPNYHASDVADAVDALKQLDLPEHLVIDFSHGNCEKIHRRQLEVARNVAQQITDGSQAIVGVMAESFLQEGSQKVTADKVLTYGQSITDPCLSWEDTEQLLELLAQAVESRFK

SEQ ID NO: 4581 - protein, 188 aa, Proteus mirabilis
STLNYKVAIKNRRYDMNIMTKLGAAVLLTSLSTIAISADIKLTYGINLIDFNGDGVKDIVVKSKRILNDASSINMVTVYIKDADEQVYIVPSIYDNALSLFDNKAENSDIKISNFKFIEKKNQVILVSGEKIGNDMLQSTPIRFSSYTITKQDKQYKWAFSAYCVTNSTYLNVDDAFVDPCINKLIRD

SEQ ID NO: 4582 - protein, 555 aa, Proteus mirabilis
PQLNRLFYLVIGWRNRLFFSSLDYLHTIISLHTRRRMSMATSATSSASKQLTLLGFFAITASMVMAVYEYPTFATSGFSLVFFLLLGGLLWFIPVALCAAEMATVEGWQEGGVFAWVSNTLGERWGFAAISFGYLQIAIGFIPMLYFVLGALSYILDWPELNTDPLTKTIAALVILWGLALTQFGGTKYTATIAKLGFFAGILLPAIILVLLAISYLVSGAPLAIEISSKTFFPDFTQIGTLVVFVAFILSYMGVEASATHVNEMKNPGRDYPLAMFLLMIVAICLSSIGGLSVAAVIPHNEINLSAGVVETFSVLVSHFSSGLAWAVKIIAALLLLGVLAEIASWIVGPSRGMFVAAQQGILPPTLAKVNKNGVPVALVITQLIITTIAIVVLTNTGGGGNMSFLIALALTVVIYLCSYFMLFIGYMHLVCKQADKKRAFNIPGGKGVKLLVAVVGLIVSILAFVVSFFPPSSLPGGSSDTTYVSLLVVSFIIIFALPFIIYACSRKGNKANVSMIHIKSHNAPKGHFFIHPRARSTHYLVPIDKTDHDSQQQK

SEQ ID NO: 4583 - protein, 69 aa, Proteus mirabilis
SIINLNRNRWILSCTINSGREKLAGLNVRNEIGGLIKKEQDYFCSLDSALNHLRQSMDYFFCSCKTESI

SEQ ID NO: 4584 - protein, 70 aa, Proteus mirabilis
YGIKGDRDNAISLLIKLEYLVFDNKLFYRYYLLSIGIISNCKGDVTISSAKVTGNNILGVLAPIRFSLYW

SEQ ID NO: 4585 - protein, 354 aa, Proteus mirabilis
AQIKIRLLVGYLIINLIRFNKREYKVDSTLRKILHYIVLALGLFIITLNVSAQAPENFTKAKQLARERIYYDQNQNNQGTLYCGCHWEWVGKSGGRVNLASCGYQVRAQATRASRIEWEHIVPAWVFGHQRQCWQNGGRANCVKNDPIFGKIEADLHNLAPSIGEVNGDRSNFSFGQLSSQAPYQYGQCSSRVDFASRTFEPRNEVKGQVARVYFYLHDRYNLSMSRQQQQLFMAWDKAYPPTPWERERDNRIANIVGHHNPFVTGQMKWQLGHKNSGAGLTATYRPTTDKIEMPKAPTVSQDEQIKGNLNSKIYHFSHCTGYRTMSDKNAVYFKTENEATKAGYRLANNCKAL

SEQ ID NO: 4586 - protein, 95 aa, Proteus mirabilis
MEINKDLYLLVVLLMIQIGNRYQNNHSDEILVYSTDYDISRHQNISHAPFVFEKANDKSSALLLSSITNMKFWNVILNIIVSIKTEGYYTIKRSN

SEQ ID NO: 4587 - protein, 400 aa, Proteus mirabilis
PLINSPVYTGVFVFTKKSLDIKTQEKPVLNYQFITTNTALEDVCKAASEVSQIALDTEFVRIRTYYPHLGLIQMYDGKQISLIDPLTITEWTPFVELLTNPAVLKYLHAGSEDLEVFSHQFGCVPTPMIDTQVVAAFLGYPISCGFATLVEKYEHIALDKSESRTDWLARPLTEKQCQYASGDVFYLLPLAKKLIAQAQEAGYMDAIVDECEMIAERRQETVSPELAYRDIGNAWQLRGQQLACLKMLAEWRLNQARARDMALNFVVREEHLWSVARYLPTSLAELDALSLSGQEIRCHGRRLLDFVAKAKQIKDEDCPEPIGNLIEQPNYKKAFKAIKTVIQEVSEGQRYNPELLASRRQINQLLNIHWKIKTGEPELLSRWRKALLAEKITAILAQYP

SEQ ID NO: 4588 - protein, 491 aa, Proteus mirabilis
MMIKSAINHKKYILSSWLSLLLVGCIDTSDYGKYSAQQPMPYNNTNYMAASEQYLATPQQEQTTKTSYGLAELIDLGQQNNPETRIAWLLAKKSATDIGMVESTYLPIITATALAGYQRGKVDLPANPIVDDIKTSNSAFIPALTFRWLIFDFGKRGALADAAKHASLATNLNFNLMHQKIIHDVSVAYFSYGAALKKVTLTQEALQRSKDILYAIEQKRARGLATVLDVALAKQQVAQVELQHVLAKGHEKDQYQLLLSAIGVSPFEKIKVNYDNDARLPDDISPLTHDVIKKALSQRPDILAHYELEQAALKTARSVESDYFPKVYLAGALAGGSGHFDVQGLPEISQRTSSSNILIGVSIPLYEGGMRQSRMSNAQSDIQLAQENLRKSQDTAIKEISLSENALRSALEANKAAKNLVDTAQLSYTASVDFFNNGLGTVTEINTAEIALLNAQLSHIDAYTGSLIAAVDLAFALGDIDQGLPNIHLDK

SEQ ID NO: 4589 - protein, 69 aa, Proteus mirabilis
SVVNRLHGSWYEVLAYKPLVFVKYDTRQYKLMVLYYNALQPYSSIYALFISIVVNGQIISLFTILYSNK

SEQ ID NO: 4590 - protein, 316 aa, Proteus mirabilis
IPVNKLVMQLHTVVNMFGADLQRRYHEKIHKITLHGGFSCPNRDGTLGRGGCTFCNVSSFADEQTQYHSIEEQIAYQAKHITRARRYLAYFQAYTSTYAEVEHLRKMYESALLQANMVGLCVGTRPDCVPVSVLDLLQGYCEQGYEVWLELGLQTAHNKTLKHINRGHDFQCYQATTKEARRRGLKVCTHLIIGLPREDHQLNMQTLEQVVETGVDGLKLHPLHIVEGSTIAKAWKAGRISALTQQQYVYTAGEIIRHTPAEVIYHRVCASARKPTLLAPEWCENHWLGMNALYQYLLEKGVQGSGINKPFVANCK

SEQ ID NO: 4591 - protein, 236 aa, Proteus mirabilis
YMVKPKCYPCIYMNKMIDKINKMTDKINSTYMPYKHYKNSIAILFLASALLPRFSVAESLTHLPQKDRISYFAQAEKMAITGVAIKTKPVLARPAKEGEVITTYIKGEGVETISEPAKAGDWVVQNICPATGNEEILVRKDKFAQRYNLADADKAKSITPIRQGYQVFIPKGIEMNYFIVPKQTAEFAMEAPWGELQRFQAGDAVVQSTTDKQDIYRIQQAAFKCTYTILKTAKEI

SEQ ID NO: 4592 - protein, 253 aa, Proteus mirabilis
KGSNMLMTIIKSLIFIPYLLLSGCGEYINIYLDNKFPVNMNNDGKKITVYSTIYPEMVVQVRGTYTSNKCERSHFNSDYTEVSYSSLTQKVEVERKIAEDNKTATYIVPIDGGGWCNWKLVKIELSPVSTIHKRYMRISEVIPITDDKHSKIELFTTLAPIIVEGKNEQSIYYSPSSTEGERKLSNKSDGEIYFNYKVEPKLTTTISKDEKVIYPNGSIKDPTFSIYTGMISFNEIIENSDEKAFTSFVRYID

SEQ ID NO: 4593 - protein, 535 aa, Proteus mirabilis
YLTNIQKNQSCIFCWNMIMFKNISIEKTVKVMLAILFVLIMSIIYFSYDASTRSYHNFVSSNNLSQQMLLMGKARYQMAVIRANINGLDGQLRVNEKPSAKYLHQTQEYIKITREEIHRWADAEKLTMEGRQVADDMTKRFDELLDIFTDALAKLRKGQLTTHSASQKMDELNEITMTYYAVANGIENNYIDIAKTSQQRIMLMALVTAIIVIMLFIIILRWFSHSFIGNIKVLINIFSKMSQGDLSMRVENHGNNEFGKLFNEMNKMKVSLSQMIASVKNAVNTISVSASEIATGNTDLSSRTEEQASALQQTVASMEQIKTTVEKNADNSRQASQLALRATTSAQNGEKVMDNVIETMSSISESAKKISDINDIINSIANQTNILSLNAAVEAARAGEQGRGFTVVAAEVRNLASRSAEAAKEINELITHSVNKVQVGSQQVSEAGRSMSEIVTTISQVNDFMQQIALASNEQSMGINQIAMAVSEMDTVTQQNAALVEESATITANMDDEAHQLANLVSQFKVDEKENTRQA

SEQ ID NO: 4594 - protein, 99 aa, Proteus mirabilis
ICTKEVAMAQALVENSERVSIRITTEDKSLLVRAASLENTNLTEFVLRNIVPVARQVIENNERLKLSEKDTLRVMELLDNPPKPNAKLLAAAFALPDNA

SEQ ID NO: 4595 - protein, 244 aa, Proteus mirabilis
IRTNRLNKQISVLMLLGSGLLLIVPIVVLILGWQWQPSAHPLGGESTLWIANSAAKPWGALTILLCLVLLFFILKLPKKAFIQLAIIMVATLVLGQLIKVVVKNSVKEPRPYVVWVSNQLSISPEHFYQVSRPEREQLLHNGLSHSSLIPQWQLSHWRAETGYAFPSGHSLFSATLALFVFVLCMLRRHYFLASLGILWGIDVTVGRIILGMHWASDVIVGILISAVLVWCAFWMIERRLLLKP

SEQ ID NO: 4596 - protein, 885 aa, Proteus mirabilis
CDQKENEVLLKKTIKWTGMILLGVGAVSTTLWLTIPRWLPVVAKTYLPEGVSLSLTQPRLQQWGVFIDDIALKSDSCTLANVQQFTFNYQKQQIDSLSFNSQQLTINEGCFSQLSFADKKETATVPLDIHALLATIPHLSVDINHVSLMDNQRYNGHFQLKSDTNGRLISYQGDNTQIQALIRDNQWLDIKQLKINLPDDNQIELAAEIALPLNVDSLPENGSISTTLLTSHYAYPLVFIAQWQGNSGTISIAEQGGGQALAVLPWNVTAENITIEKGRWEWFGFDQPLRGGVNINIAQWQQGLTGLRLTARLNVMTQGHAGKGNLVITIPETAINWLDADIPIQLTGIVNKDLMQASAQLPVKVTGMLTDPTIEFQPGSLLRFKGQLTETLTVKDARLPLAGSTLSSKGFNGHLNAIVLAEDTIWGDYRVHFAGRSTDFLPDQGNWQWRYWGEGNLLPLKARWDIAGTGSWVDNMVSFETLNTGFDVLTYQHTSMLAPRLTLLTPFRWLRDDKNPLFEGKLKLTSQRIDFPAGGFLDRADFIASVKGQSPFRFNMKGELNAKPTIGPITINTRWDGERLRGQMRWPAQPINAFQSLLPEKLGITLDNGEFYTQADFSIAPQQGLVAGGHLVVKQGSMWLKDGVLEGLDFILPWRLNGDEWQLGVKQPVQLRIKRVNNLFEMTDITADLQGFYPITEAKPLVLSNVKVAMLDGTISMAKLALPQHEAAIISLDNLELSRLFTLLKVTQFAASGKVSGELPFFINNNQWIVKDGWLANSSYLTLRLDKDFVDSIDDSNMTAGVAMAWLRYLEISRSWTRVNLSNLGELVLEAEIQGKNPLEDKRRQVNLNYRHQENIFQLWRSLRFGSQLEEWLEKSLSDLGSESE

SEQ ID NO: 4597 - protein, 156 aa, Proteus mirabilis
LIKKHKIKIWQKHHQNDLITLRDLAKDPIPVLDQAILFDFGKDTAIYNFSIFSQLKHSIDFIARAGETFKYTETGSVGLLEDKQVIVLTSRGGIHKGQPSDLIIPYLTQFLSFIGINNVQFILTEDTALGEEYAQQSHVQAQKEINLIINKEIMIK

SEQ ID NO: 4598 - protein, 149 aa, Proteus mirabilis
QLKKRLFMAIAALPDEAKLLRNFSRCQDWEQRYLYMMELGERLPPLTDEQRTAANFIEGCQSQVWIAVELDEHKQLILAGDSDAGIVKGLVALVIILFQGKTVEQALATDVNHYFSTLALESHLTPSRTQGLHAMVTRLMKRFSEYTVA

SEQ ID NO: 4599 - protein, 816 aa, Proteus mirabilis
CMKNIKEMTLLSTPLSRRRFVKVGAAGGLVATAGGLSLPFSQAMASEQTAPTSSTNKEKVVWSACTVNCGSRCPLRMHVVDGEIKYVETDNTGNDVYDEFHQVRACLRGRSMRRRVYNPDRLRYPMKRVGKRGEGKFERISWDEAFDTISDTMKRLIKDYGNESIYLNYGTGTLGGTMTKSWPPGATLIARLMNCCGGYLNHYGDYSTAQIAAGLNYTYGGWADGNSPSDIENTKLVVMFGNNPGETRMSGGGVTYYVEQTREKSDARMIIIDPRYTDTGAGREDEWIPIRPGTDAALVNALAYVMIKEDLVDKPFLDKYCVGYDETTMPEGAPKNAHYKAYILGDGADGQPKTPEWAAQITGIPAARIVKLAREIAGAKPAYITQGWGPQRRSNGELASRAIAMLAILTGNVGINGGNTGAREGSYSIPFVRMPTLTNPVTTSISMFMWTDAILRGPEMTATRDGVRGKDKLDVPIKMVWNYAGNCLVNQHSEINRTHEILQDDKKCEMIVVIDNHMTASAKYADILLPDCTASEQMDFCMDASAGNMAYVIFADQAIKPRFESRNIYEMTSEIAKRMGVGEKFTENRTQEEWLRHLYEQSRQNLPELPTFEEFRAQGIFKKRDPQGHHVAYREFRADPLNNPLTTPSGKIEIYSSQLAEIKATWELAADDVIDPLPIYSAGFESYGDPAMDKYPLQMTGFHYKARTHSTYGNVDVLKAACPQEIWINPVDATKRGIKHGDLVRIYNDRGEVRINAKVTPRILPGVVGLSEGAWYNPDSNRIDHAGCINVLTTQRPSPLAKGNPSHSNLVEVVKA

SEQ ID NO: 4600 - protein, 214 aa, Proteus mirabilis
IMKKLSALILAAATLAPSISFAHQAGDFLFRAGTATVRPNTGSDTILGGHFDANNNTQLGLTFGYMVTDNIGVELLAATPFEHKVSLTGVGEIAKVKHLPPTLMAQYYFGGAEDKLRPYLGAGLNFTTFFDEKFNNNPAVGKLGLNDLDLKNSWGFAAQAGLDYNLDKNWMLNASVWWMNIETDVKFKDGDGNHYKVDTRLDPFVFMFGVGYRF

SEQ ID NO: 4601 - protein, 500 aa, Proteus mirabilis
IEKNSMDIFISALAYIDYTTILVVIGACLFGLFVGAIPGLTSTMAIALMVPFTFFLDPIPALALMISVGASSIFAGDIPGALLNIPGTPASAAYTNDAHTLVKEGKTNRVLGMSLTSSVIGGVIGTIILASTAPLLAEFALKFSSYEYMWLTLIGLSCATIVSGAQIRKSLLALFFGIALATIGYDEFTGQARFTFGEVSLMQGVSFIPAMIGLFAISGAIKYYVDRWKEKQIKLAVNTDNSSYNIFKGVGKVVCQRKGGIFRSGIIGTLIGALPGAGADIAAWISYAVSKKLSKKPQKYGQGSEEGIVDASASNNASLAGSWIPSLVFGIPGDSAAAIIIGVLYMKDMQPGPTLFLFNPDKLYAVFIIFFIANLILLPIAFIVVNFLKKIVAIDNAILYPAIILFSIVGSFAITNTMSSIVVMMVMGVIGYFLQQRNFPISPIILGMILGPMLEKNLLSSLMKSDGELINFVNRPISIVLASVFLLIVAMQIRSAFKTK

SEQ ID NO: 4602 - protein, 366 aa, Proteus mirabilis
VEENPFQKEEKAGLVYSRFNQPNSEIVEDRLAVYENTASCVLFSSGMSAITTTLMAFTQPGDVILHSQPLYGGTETLIAKTFAKFGIQATPFTDGLNLADIQSQAEIASQKGRVAVIFAETPANPTNSLVDIQALKIVADKLETSQGYRPIIICDNTLLGPVYQHPIEQGADISLYSLTKYVGGHSDLVAGAAMGSRELINQVRLLRGAIGTQLDAHSCWMLGRSLETLQIRMEKANQNALLVAQFLRDHEKVKVIHYLPFVDENSIEGQVFARQCTGAGSTFSFDIVGGEAEAFRFLNAMKIFKLAVSLGGTESLACHPGSTTHSGVPMELRHNIGIQETTIRLSIGIENPYDLIADLSQALDHV

SEQ ID NO: 4603 - protein, 63 aa, Proteus mirabilis
KPRNSSRFSFFMNKLYCSQIYKSLFYLPDLRLLNSYNALLSNVSEDISYLHGYHHSLIGSYLR

SEQ ID NO: 4604 - protein, 378 aa, Proteus mirabilis
LTPLSGCTDLWRKALTFPLCIYSAQGYLCYCTRNYDVYKPYVDKHVLYRSTISLSGRKPEVFLVPDMKLFAGNATPELAQRVANRLYTSLGDAAVGRFSDGEVSVQINENVRGGDVFIIQSTCAPTNDNLMELVVMVDALRRASAGRITAVIPYFGYARQDRRVRSARVPITAKVVADFLSSVGVDRVLTCDLHAEQIQGFFDVPVDNVFGSPILLEDMLQKELDNPIVVSPDIGGVVRARAIAKLLNDTDMAIIDKRRPRANVSQVMHIIGDVANRDCILVDDMIDTGGTLCKAAEALKERGAKRVFAYATHPIFSGNAVENIRSSVIDEVVVCDTIPLSAEIKALNKVRSLTLSGMLAEAIRRISNEESISAMFEH

SEQ ID NO: 4605 - protein, 139 aa, Proteus mirabilis
YKRNQPRICILSKYKVVPGIDDEMADKNLLLISLNSIYNLFYTPSNIINKSDNKDINFFINDENFIKINNPTPYFITIAEAKVDNIDILNERITLSPFKNYSIKNKKITKNIKDKKVHWKRVDEYEQTIIATPKELIYE

SEQ ID NO: 4606 - protein, 642 aa, Proteus mirabilis
QGRKMTFRYDKYNDPYCPDCAKHNAWIEILLVDELNNPISDMPYTLTVSGGEKRTGKTDRNGIVRETDLPPTGGRFSINAQMLADEMEKRPLRVRRNCSSKIRYDATQRNDNYRYLTIGDLCDAAPKILKWDQPELPKYHFKKQQLNGYMVIFRNQRWVFEVCSFRAWSFLLHHQKDYSITNACNLSILSVLSYASFKANNDKEPNAGNYLGSIEDVFFNQLFDLSKIPQQFETKSFTPIIYDVPFSERYTDVEFIDSAKNLDTQMFYIANNKEVIVVWRGTAGKTDIFTDIKFKPVKLQQDMGIEGYVHSGFYNSFRIMDNDYDLRPKINVNNNLGDNNPLSLIKGLASERKLFIAGHSLGGALALLHTIKLREYNPVLYTIGMPRVLTLSITEQLGDIIHHRHVNEDDPVPALPFEKDMNNIAFISDHDWLGYSIEIAITYIDLKHQGMASKAIDQLKTNFNIKSDTFIHHGDAVHFYKPTSKTSMYKYVLASVGYAPSLLVNMEIDKKRYLVSDTDEKLYLVSELLPDHRLKQEFFELYKLPKTASPGVTGGGDHSSGKYTNFIISKIISLVKYKGLTESAYNIRAELINQKRLSQAKYDESSYLLDLDLMVADTLLPTLLMPEGITALKRFKYANDNN

SEQ ID NO: 4607 - protein, 360 aa, Proteus mirabilis
RKRKIMKVHYAVGKYIISIFILLLLVITTLLFFTSHIQDFDYENKDQEELSFLSQGNRLSGTLLTPQHKTLSAVIVVIHGDGPQDRYSNGGYNPLFNTFLDANIAIFSWDKAGIGDSQGNWLHQSMEARAEEAVAALKLMQLRYPEVQVGFLGFSQAGWVIPIAASQSQPAFSVIIGGAVNWREQGQYYQKLRYEQQGKTPDEIIQLLAKEQKENDDIFGLHGTKDRTRRNDMSEDRFNFVVKNYLSDSSSYLRKMNGRILAVWGNNDLNVNAQLNACRYRAILNTHHQADIVVFPHASHGLLRVPEFNYQLESDWPIYRQLQFLWAGRKAYTEGSLPLIIDWIKNKNPDFSPYNMDCNL

SEQ ID NO: 4608 - protein, 172 aa, Proteus mirabilis
QRRNNMAHQVTLQGNAVTLAGNFPTVGQKAADFSLVGKDLNDVSLAQFAGKRKVLNIFPSVDTGVCAASVRQFNKVANELNNTVVLCISADLPFAQARFCGAEGLDNVVTLSTMRGAEFKENYGVAITSGPLAGLTSRAVIVLDESNNVIYTQLVDEITTEPNYDAALAVLK

SEQ ID NO: 4609 - protein, 108 aa, Proteus mirabilis
NSGKTSRKTRAFKMNDELIFQLQNWYKSKCNGLWEHEYGLDISTLDNPGWKVHINGENKKKKSNIIINNNDDDWLNIITSDIEFKGYGSPQNLNTILNHAIKWLNDPQ

SEQ ID NO: 4610 - protein, 262 aa, Proteus mirabilis
VILKSWHANCINYSNWALLLITLFNQHSRLLFIIAIKDNIMGIFSRFADIINANIASLLDKAEDPEKMIRLMIQEMEDMLVEIRTTSARTLAEKKSLERRIEQAEKQIKDWQDKAELALIKDKEDLARAALIEKQRVASMCDTLKHELIIIDETLDRLKGEISELENKLTETRAKQQSLVVRHQAANSSRQVRRQLDSGKMDAAMARFEQFERRIDHMEGEAQSYGLGKEKSLEQQFAELKADDEISAQLAALKAKINTNKE

SEQ ID NO: 4611 - protein, 79 aa, Proteus mirabilis
RVLKMVVGEGFEPSKSVTADLQSAPFGRLGIPPTLNCLAVRDSGRNNTKYLRCVKCYFKKKRSTAVKISALLNCCAISY

SEQ ID NO: 4612 - protein, 164 aa, Proteus mirabilis
KGLNMKTKIVYQWKEKRRDRLSFLGAEVVFSVLFGIVNGLIYMLFMTLLPDSVENDPDKLFFYQFSFSSYGIVEFILLIAQIYVFALILTQRVRDFGFKYPITIALIFTIGTMVLTPYPLLISSDTMVIVRFILLLGYVIALLLPSSNNVECNNDENNKITILK

SEQ ID NO: 4613 - protein, 258 aa, Proteus mirabilis
IIMNEHTISNESLIFSLLLVLVAIFISRKEKLSLEKDIIWSTARAIIQLFIVGYVLTYIFDVDHIILTFLMVLFICYNAAYNAKKRSKYVKDIFIISFVAITTGALLTLSILLFTHAIAFTPIQIIPITGMIAGNAMIATGLCYNQLGQRFENHQQQIQEMLSLGATPKIASMAIIRDSIKSSLIPTVDAAKTVGIVSLPGMMSGLIFAGVDPLQAVKYQIMVTFMLMATASISTIIACYLTYKKFFNQRHQLMTFNQ

SEQ ID NO: 4614 - protein, 391 aa, Proteus mirabilis
SNMKKDKYFRIVLLFNANKVYDRQVVEGVGEYLQASQCHWDVFIEEDFRTRLDNINHWVCDGIIADFDDPIITQHLSQSPLSVIGVGGSYHQAKDYPSVPYIATDNYQLIHQAFLHLKQKGLKHFAFYGLPAKNYPHWSNEREYAFRQLVTREKYPGIIYNGMDITQENWQHAQNRLSDWIQTLPPQTGIIAVTDARARHLLQVCDNLNINVPEEISIIGIDDEDMTRYLSRIALSSVVQGSRQMGYLAAKLLHQILEGHPTEQLPRILVPPVKIIERRSTDFHSFSDPTVVQAMHYIYYNACKGIKTEQVLDAVNMSRSNLEQRFKKEVGKTIHAVIYEEKLKRAKNLLATTTLSIQEISLMCGYPSLQYFYSIFKKEFGMTPKDFRDEN

SEQ ID NO: 4615 - protein, 472 aa, Proteus mirabilis
TAMKKTKIVCTIGPKTESEEKLTQLLDAGMNVMRLNFSHGDYEEHGNRIKNLRNVCAKTGKKAAILLDTKGPEIRTIKLEGGNDVSLVAGQTFTFTTDTSVVGNKDRVAVTYDGFARDLTVGNTVLVDDGLIGMKVIKVTDTEVVCEVLNNGDLGENKGVNLPGVSIGLPALAEKDKQDLIFGCEQGVDFVAASFIRKRSDVEEMRAHLKAHGGENIMIISKIENQEGLNNFDEILEASDGIMVARGDLGVEIPVEEVIFAQKMMIEKCNAARKVVITATQMLDSMIKNPRPTRAEAGDVANAILDGTDAVMLSGESAKGKYPVEAVTIMATICDRTDRIMKSRLESYQLGAKLRVTEAVCRGAVEMAEKLDAPLIVVATYGGKSARSIRKYFPTAPILALTNNEETARQLLLVKGVTTQLVNKIASTDDFYRIGKDAALSSGLAHAGDRVVMVTGALVDSGTTNTSSVHVL

SEQ ID NO: 4616 - protein, 99 aa, Proteus mirabilis
SLMKMICAIYRSTKRDQTYLYIEKKDDFSRIPEELLQSFGEPQFAMLLDLAQRQRLANADIEKVKQALTDQGFYLQVPPPVESMLNAYLDELKNSEKTE

SEQ ID NO: 4617 - protein, 493 aa, Proteus mirabilis
ITMKTQTINNPRTPTLIESLFPIFTMVVLLGGGYAAFDLPPEPLMVLSTVVAALLVKRLGYRYDEILTAISQKIAKTMPALLILISVGLLIGTWMVGGTIPLMIYYGLKMISPEMLYVTALLVTSLVSVCTGTSWGSAGTIGVAFMGVAVGMEANLAATAGAVVAGAYFGDKLSPLSGDTNLAAMAARIDLYQHICHLLYTTLPSLILTAIIMTVYGMNGDLAGQGVPEKVTLITNGLENIYHFNLILLIPVLVILYGSVTKKPTIPVMLASAAIAMLNAYLIQGFGLHDIVKSAVDGFNVSMIQGKEVPELLGNLLNRGGMNSMMSTLLICFCALSFAGTLSLSGALEVIVHALLKMVHSTGSMILATIACGLTMIGVTCNGQISILIPIEMLRGAYIERGLHPKNLARTVEDSATIFEPILPWTAAGAYMAGTLGVATLSYLPWAVLCWSGIFFAMLWGFTGFGIAKLTPEEQEEMTAELGSHSELQLDTK

SEQ ID NO: 4618 - protein, 350 aa, Proteus mirabilis
TKMNEPLKSRIDFKQSTLQNEEISLKKGLDFNQDEQFVPYNPQLEAQENEGRLEGEIQSALKPRKSLWKRLITVASTILGVSVIAQAGQWIYQSWINSDWIALGAASAGGLIVIAGMGSVITEWRRIYRLRQRADERDKARELLYSHAIGNGRPFCEDLAKQAGINSQHPAYIRWQSTLHDTHNDREILELYSQLVQPILDKQARAEISRSAAESTLMIAVSPLAMVDMAFIGWRNIRLINRIAQIYGIELGYYSRLKLFRLVLVNIAFAGATELVREVGMDWLSQDLAARLSTRAAQGIGAGLLTARLGIKAMELCRPLPWIDNKPKLSDFRKELIGQLKNTLGNKKKE

SEQ ID NO: 4619 - protein, 333 aa, Proteus mirabilis
GVTKTMSWWQKLKIDSFLMIMILVVILATLLPAQGEIKVIFQHLTTAAIALLFFLHGAKLSREAILSGLGHWRLHLVVFASTFVLFPLLGLGLQFMVPDWMSPTVYMGFLYLCALPATVQSAIAFTSVAGGNVAAAICSASASSILGVFLSPVLVGFLMETQGSAEHFDTAGAIQSILLQLMVPFIIGHLSRPLIGRWVDNHKMLVNRTDRSSILLVVYVAFSEAVVEGIWHKIDGWSLLTITIVSCVLLAIVLVINIYSARWLGFNKADEITIVFCGSKKSLANGVPMANVLFPAATVGIMLLPLMLFHQIQLMVCAILAQRYANQAKKHHQ

SEQ ID NO: 4620 - protein, 446 aa, Proteus mirabilis
GIKNVQQKTRSIAQVYLNLPLPHKIMLGSLTAATLAVAIWRPVVLHTEQSREVPISIQTPLTTQGENTDDIITDSSDQLTDEGLVGADDGVDTSTAVAQVPHTYIVSSGDSLSSILTQFGIDSADIATLSNQNKDLRNLKIGQPISWKLDDDGLLQELSWGVSRRETRVYTRTETGFTEAKEFQKGEWKNSVTTGVIRGSFSASATNAGLTNAEARAVTKALQWQLDFRKLQSGDKFSALFSREVLDGRTEQSELIGVRLRSGGKDYYAVLAEDGRYYDSQAGGLERGFMRFPTVKQFRVSSQFNPRRINPVTGRVAPHKGVDFAMPVGTPVLATGDGEVIVSKYSGAAGNFIAIRHGSQYTTRYMHLRQLLVKPGQRVKRGDRIALSGNTGRSTGPHLHYELWINQQAVNPLTAKLPRADGLTGKEKREYLAKVKEIMPQLTLDN

SEQ ID NO: 4621 - protein, 67 aa, Proteus mirabilis
RDKKQVFISHLIIYTWNYFIFTQYTDSGLISFISSVLIFFNVKFSLGANLIKLGEMINGASLLSSLL

SEQ ID NO: 4622 - protein, 294 aa, Proteus mirabilis
LKKKGVEMKRILVAGATGYLGGFLIQELKKQGYWVRVLVRNHQQATKFADVDDIFIGEITKPEQLSLIAQNIDCVISTVGITRQKEGLTYMDVDYQANANLLEEAIKSKVNKFIYISAIDGETHRNLKIFQAKERFVDKLKQANLAYCIVRPNGYFSDMGDFLQMAASGKVYLFGDGEQKINPISGKDLAQFIVEKMTTNINEFTVGGPDILSLNQICELAGSALDKKIKIIHLPDTLRKITIFTLRHFTSQKFYGPLEFFLTFMANSHIGMCYGHDHLSNYYIELADPTYKRK

SEQ ID NO: 4623 - protein, 803 aa, Proteus mirabilis
LCENDMSIKKQEKRLANQEGMPLTRRHFVQASAALVSMPFFAQNAQANLDKSLPIANIDEKPATVVATCSTFDCGGKCDIRAHVKEGIVTRITTRPDADLDEQMPIMRACVRGRGYRKFTYHADRLKYPMKRVGKRGEGKFERISWDEATSLIAENVTRLTQQHGAASRFLTVNTAVTGGIFSGDTMMKKLFNLTGGYLPYYHSVSLGNTAKVTPYTYGVSKTGSSLDTLADTPLVILWGHNPNETIFGHTNHYFQKMKNNGTKFIVVDPRYSDTAQSLADQWIPLLPTTDNALMDAMMYVIVTENLHDKAFIDKYVVGFDEDHMPEGVPANESLMAYLLGKKDGIAKTPEWATKITRVPANTIRQLAREYAMTKPAALIQGWGPQRHICGERTARGSTLLAAITGNVGKKGAWAAGYGGIGNRQSIRGPNIGKNPVTAQISIMNWMQAVEDASKVTPEDGLIGVDKLDSNIKMIFSLAGNYLVNQNPDVNAAAKLLEDESKVEFIVVSDLYMSPSAKYADLVLPETSFLERWNIGNTWGTGNYFLLSEKVVEPAFERRSDYEWISDVAEKMGVKEAFTEGRTEKEWIAYLVNTNKERFKDRPDFPTFDELLKTRRYLFKDAPFVAFEENIRDLENHPFPTPSGKIEIFSKRLYDMNNVDIPALSHYVPAIEGPEDKLTEKYPLQMLTWKGKNRANSTQYANPWLQEVQRQEMWINPIDAQNRGIKNGDMVRIYNDRGITQIPALVTERIIPGVVGLQAGAWWSPDKDGVDHGGCPNVLTSTRMTPLAHGNSHLTVLVEVTKA

SEQ ID NO: 4624 - protein, 104 aa, Proteus mirabilis
SIRKLIDMVLKKRCFRQIAPALIFSLLTIGTFSANANIDVRDETLFEAHQRFKTQIINDSFDNTEAPWEAPAEIFNVVKYPAKLGDMYAYLTPPPANKKINYLR

SEQ ID NO: 4625 - protein, 470 aa, Proteus mirabilis
SCRNLSLNKKLGLMSLTALVLSSMVGAGVFSLPQNMAEVASPAALIIGWIITGVGILFLALSLLLLSRLRPDLDGGIFTYAKEGFGEFIGFCSAWGYWVCAVVANVSYLVIVFAAVSFFTDSPNNIIFGDGNTWQALLGESILLWVVHFLVLRGVQTAASINLMATMAKLIPLGLFIIVALLAFNMDIFTFDFEGIKMGVPVWEQVKNTMLITLWVFIGIEGAVVVSARAKNRRDVGLATIFAVVIALIIYILVTLLSQGLVSQPELAMIKNPSMAPLLVQLIGNIGEIVIAAGLILSVCGAYLSWTIMAAEVPYIAALHHSFPKQLSKQNHNDAPSSSLWFTNLAVQLSLVLIWLTGSNYNTLLTIASEMILVPYFLVGAFLFKVAIERSSRGLLLIAIPASLYGLWLLYASGVINLLLSVVLYAPGVLIFLYSRKQYKDKQSLNTSEKILLMMVLIGAIPACGYLVFN

SEQ ID NO: 4626 - protein, 66 aa, Proteus mirabilis
LLGKESGRILLTLVLLGMSKLQLIGAGKLPLLLSDKAIKGKYSNSRGIKNVIFIDFIETPYINIQE

SEQ ID NO: 4627 - protein, 623 aa, Proteus mirabilis
ILYLTMMTVKSSLIAKQVKQDLLPFDYRFATTWRIALLCALMAVIAMVYEIPESAISCYLIIYLIKADAVQNILLSLGVIILCSIVVGVALVLFNLTIQNIILRFFFMAFFSAIFMYLASASSLGDIGNLVALVIAFLMTLIEDIPFGDAATRGLLYALLMAVSPMLLVIIFNYFFGISPRKLLLNKISTRFMAAHDFFLGKKTNQITLSEILGTQAECQRYLMVMKILYLLGKEDIQWLENMVDNSYAILVMSITMDDNTSTSLRFMLAKRCKYIADCFANHSLDNIKDSVQRLQPINRIALLAKFNTILLTKRTTKPIKKATPFFVSDAFSNPNHKYFAIKTTLAAILCYLFYDYFKWQGIHTAMITCYVVALTSVGETVHKLTLRIIGCLIGALIGMISLLYIIPNISDIFQLMVLIFFCLLPAAWVAAGNERISYAGVQVGLAFLLTTLHGFKPSFDMDVVSDRILGILLGNIVMYVIFTRVWPASIVNTIYKQLATILDDYTKLRCSANKSECLDLVASINETIAQSKDNIDLLLFERKDKERNKVFTLFFKQSLSKISYISRHSYADRFIFDDNGEYSDTLPLSPDDFKKNVLTEEIKMLPINEREQVFKQLIRENR

SEQ ID NO: 4628 - protein, 209 aa, Proteus mirabilis
QGHLMKNTIVKDLKTLEEIYGQPAEPSVLKEVDFIHPLYRPYIEATPFVALATYSADGMDVSPRGDEPGFIHIEDDHTLLLPDRRGNNRIDSMRNLLINPAIALLVLVPGINETLRINGHAEILIDEETLARFKYNNALPRSVLRIHVERVFFQCGRALIRSGLWENKYLADKSTIPAPGQILKSISHQQFDGDKYDAQLPERIMKTLY

SEQ ID NO: 4629 - protein, 63 aa, Proteus mirabilis
DHFDDVFANFLLDSPPFYCCVSNFLKYWILVQEACSFYSLGKYLLCLYRQNFILSEKFHTIIV

SEQ ID NO: 4630 - protein, 218 aa, Proteus mirabilis
SFIECTCSLCILESVMMTNITLDNIKLAVQRIAIACEQSQNRLCEADSQLGDGDLGVTMQKGWRQIANDAQDWPDDLSKALFQCSKSLQKACASSFGTLQATAFMAMAKYCKENHLQEIALTDISPLLTVAYQSMMARGKGELGQKSVLDILYHLSEDLASISSLTELKPTALKSINNTLNEFRPKPNLLGRARMFPEKSIGLDDPGMLAINVIVEAI

SEQ ID NO: 4631 - protein, 304 aa, Proteus mirabilis
KFIDNGLHPAYINVGTKMEKRHYQLIEQACRFIEENQGDVSLADIAAHIQSSPYYFHRRFKSIMGITPKEYANAYRHKLIKKALAGDKTITDAIYQSGFNANSRFYENATAILGMTPTHWRNGGQNIVIFFAVGICSLGHILVAQSEKGICAITLGDDPACLLEELQKQFPQAELVGANQEFEKLVAQVIGFVELPTQPLALPLDIQGTVFQQKVWRALLDIPFGCTMTYQEIAQKIGSPKSYRAVANACASNKLAVAIPCHRVIRQNGEISGYRWGIERKEKLLQREKSLHHQHDRLAISKSD

SEQ ID NO: 4632 - protein, 334 aa, Proteus mirabilis
HVIDTQLPLTDLHRHLDGNIRPETILDLAQQHNIALPAYELETLRPHVQITKNEPSLVSFLQKLDWGVAVLADLDACRRVAYENVVDVANAGIDYAELRFSPYYMAMKHQLPIEGVVEAIIDGVQSALHTYDVEIRLIGILSRTFGENACQQELNGLLKHQDKITALDLAGDELGFPGHLFQPHFNRARDTGWKITVHAGEAAGAESIWHAIKELGASRIGHGVKAIEDPRLMDYLAEHQIGIESCLTSNIQTSTIASLAQHPLKKFLEHGIIASLNTDDPAVEGIELKHEYTVAAPAAGLTAAQIRQAQINGLTMAFISQAERDALIKKVSLG

SEQ ID NO: 4633 - protein, 111 aa, Proteus mirabilis
QVLLKISLLNKDTNFISTLHSVQSNISIGIETFIIFLVILLILNKENKMIAVIFEVQIATSKQGQYLSLASQLRPLLNNIDGFISIERFQSLATEGKLLSLSWWKNEDAIL

SEQ ID NO: 4634 - protein, 124 aa, Proteus mirabilis
PGTERLIISGNTSATFSSKRQSPRLAIGVANKLSCGADFELDITKIDLKNKRSGYSTRSDVAHKVALFRNKLEKQVNLFDTLPLLDSTARMSIVIMDDHIFLVVLIVEGKNLYPRKEVNISKDH

SEQ ID NO: 4635 - protein, 144 aa, Proteus mirabilis
IRRFFSFGNGEKMVSSLYIVLGALLLIKLSLNVVKLRTQYRVAYGDGGFYELQTAIRVHGNAVEYIPISMILLLIMEMNGAFVWMVHICGSILIAGRLLHSYGLKHREIRWRRSGMAATYLSMVLMILANIYFLPWIQIFSFYY

SEQ ID NO: 4636 - protein, 134 aa, Proteus mirabilis
SADLLHAVKIHWKLYSKLIVLYKVLCNMDNNSRLVYSTDIGRIKEEEQKPTRPAGDGIVRIQRQTSGRKGKGVCVISGIDLDDAALAKLAAELKKKCGCGGSVKEGLIEIQGDKRDLIKSLLEAKGMKVKLAGG

SEQ ID NO: 4637 - protein, 817 aa, Proteus mirabilis
NNNELYKIKFKKIEGEYNLSDDATDNTNINFIIEYEKYEIEDSLKHDLSNINNIIEKEEGNVLKINREGMPITINLQDNKLFTYGLPPTLMPKEDDVDGKSKKNQIKLPLKSKDKILAIKPVLNKIQLVVDKGNKIKIYYFDPLHIFALKDYHYEITRLTQEPPLSFYSMVGENNYKNYHSGQPFSTQKIGNFSAKNIPFFSSAIDNARVHFDRAKQQYALKKYGAMVKDIAKSFDPGFRGMFSTIKSIVNSATLPRTIKTDALNGVKKVIKHDYNLLNKYITGINNGKSQGEVVYSLVEQLNDKESITISQYNDIRAFFGISAFHLSQNIGVSAFLLANFAKTHALTISKNKQDEVVFSFVNKMDAGIATGLSAGIMNNEQKWREGAFNYGFVTPLMATVILDYHYEKKSNFSFKIQPKDLIEFINQGVSLTESELKDNATLEFNRTQNASLGVELRSEVSFDVGVSANENIELNLPRNAVGANLSLKIINVIHNINKFIGHGETKAKQLEKNVDVEYFSGSFELYRDLKFTPSATKASHNIHWYPLTSLKNFEVMLEKRVNSLFKHRIYDGKIKQDKKEFEAHKNNLKGLYKRVLKINNLFDKYPVQYDVKRSINKLDHVYLQLDANKKLKNKLNPQLMENDLSLKSDVIDNSIDLVHNNNRVQQFLADLTEKKKILSSQKKNNMNEKFKPYFISKYQLNSEGRVRYSVLETQLEELINEVKTDENLTVNDIKDKLDNFYNNAKQELNNIEYQLNSIDVMSISELADKAKSFPLAFLRLESKKSIMHHQVKGEINFLYDKYEKQLEKITTNYYFH

SEQ ID NO: 4638 - protein, 89 aa, Proteus mirabilis
MNNESRCIFSEGSVLLPDGYKEQTINILISPTGHAVNISRDDKAKDLSFEEYILNQKALLQRSLKEWQLLEENPSMLGQDLIQHGGVFF

SEQ ID NO: 4639 - protein, 251 aa, Proteus mirabilis
RFNDSASANFMSDLIRLKSVGVSFGESVILKDISFNLKAGRILTLLGPNGAGKSTIIRLVLGLLAPSSGKIERQHSLRIGYVPQKLYLDPTMPLTVKRFMTLKPGVKDKDILPALERVNAAKLINAPMQKLSGGESQRVLLARALLNQPQLLVLDEPTQGVDVNGQLALYDLINQLRNELGCAILMVSHDLHLVMAKTDEVLCLNGHICCSGTPDVVSSHPEFIAMFGSRGAEQLGIYRHHHQHNKECHHD

SEQ ID NO: 4640 - protein, 279 aa, Proteus mirabilis
SNNDCSDDFLRLTKVNTIMSRQKVATRLRRENKRTLRKEQRNAAHRDNVMVLPGFGDLETIGMAREKRDQRTLSPRNEVQRQYMNAIKHQNLVFATGEAGCGKTFLSAAMAADALINKEIERIIVTRPVLQADEDLGFLPGDIAEKFAPYFRPVYDVLVKRLGASFLQYCLRPEIGKVEIAPFAYMRGRTFENAFVILDEAQNVTINQMKLFLTRMGENVTVIVNGDITQCDLPANVNSGLADALSRFQANERVGVIKFNEEDCVRSSLCQHVLAAYSD

SEQ ID NO: 4641 - protein, 355 aa, Proteus mirabilis
GNSDMKVSNTTPFPYLLYQKVGKKDELFNVIALRQTFRLKTGGHYSDLNEQQYPLNMADRYYHAPETSSLIEETDLVWTRPCTNIHILGVARPKGNQPTAQWRAGIRIENFSKTWSLFGPHYWEYQEDRWSLSESIPVDGVSLRHELAYGGTWQSPQQEQQQVIENPIGIGFYPDVEALDKQKRYPAPQIMEDIRKRPLDTLSIDTRQISEGMGPISRWWAGRVEYAGTYGKEWQENQFPFYPDDFDERFFNSAHPSLRYPGYLLGNEPILLEGLLPESSRVVTALPDYRVKIILQDIEGELFSLKPDLDTLTIDLDRRLISVVKRLVIPAKYPIVEALIGVWVPAETKGACCNG

SEQ ID NO: 4642 - protein, 266 aa, Proteus mirabilis
MVSDDVTFNSLLINKGLKMSFDCDKKSPSSTCAPVIVALDYEDQKSALDFAQRIDPSSCRLKIGKEMFTRFGPQFVTQLQQQGFDIFLDLKFHDIPNTVARAVAAAADLGVWMVNVHASGGSRMMRAAKESLSSFGKEAPLLTAVTVLTSMDQSDLTELGINLTPAEQAERLALLAKACGLDGVVCSAHEATRFKQVCGDDFLLVTPGIRPAGSEVGDQRRVMTPEQAIVAGVDYMVIGRPITRSENPLETLQQINRSIQGVVQHG

SEQ ID NO: 4643 - protein, 367 aa, Proteus mirabilis
RRSDIGLIQMKFRPIQNNNSKLKIASSPFTHNQQSTSQVMLWVILAAIPGILCQLYFFGLGTLYQIILAIIVALLAETICVKLRKEDPLLYLKDNSALLTGILLAISIPPLAPWWIIVLGTFFAVVIAKHIYGGLGQNPFNPAMVGYVVLLISFPVQMTSWMPPIELQAVSYNFIDSLSIFFTGHTPSGLTLEDLRRSVDGITQATPLDSFKTGLLTHSIDEVLATPILQGGFAGMGWQWVNVAYLVGGVILLYKRIISWQIPVAMLTLLGVCSLISWGIDATRYSQPLLQLFSGATMLGAFFIATDPVSASTTPKGRLIYGAIIGLLVWIIRVYGGYPDAVAFSVLLANIAVPLIDSYTRPRVYGH

SEQ ID NO: 4644 - protein, 214 aa, Proteus mirabilis
WFGETVMNSLWIAIGVLGVLGLLFGLILGYSARRFKVEEDPIVEKIDAILPQSQCGQCGHPGCRPYAEAVANNGEMINRCAPGGEQVMLKIAELMGVDPQPLDGDEEALNPVRKVALIDEDNCIGCTKCIQACPVDAIVGATRAMHTIIEDLCTGCDLCVPPCPTDCITLVPVKMTTSNWKWDLNTIPVRNIPAEPEETPEDEPSLKAEDNAHV

SEQ ID NO: 4645 - protein, 332 aa, Proteus mirabilis
SHGDQGANFMNKLALPTYQDVVEAHQRILPYLNKTPILTSRTINELTGAQFYFKCENFQRIGAFKFRGAMNALSQFTDEQRKNGVITFSSGNHAQAIALSAKLLGIPATIIMPEDAPTAKMQATKGYGGRVILYNRYTQDREEIGQKLAQEEGLTLIPPYDHPHVIAGQGTAAKELFEEVGELDMLFVPLGGGGLLSGSLLSTKALSPHCRIFGVEPLAGNDGQQSLRKGEIIYIDTPKTIADGAQTQHLGDYTFEIIRNNVDDILTATDEELISAMQFYAQRMKIIVEPTGCLSLAAARQFGDKLKGKKIGIIISGGNVDIMQYGHFLSQK

SEQ ID NO: 4646 - protein, 532 aa, Proteus mirabilis
FRGEITTMSQLMRTQSHSHIIELTHVSQHYGDTKALDDVTLTIPAGKMVGLIGPDGVGKSSLISLISGAREIQQGQVIVLNGDMNDVNHRRAVCPKIAYMPQGLGKNLYHTLSVFENVDFFGRLFGQSKQEREERINDLLESTGLAPFKDRPAGKLSGGMKQKLGLCCALIHDPQLLILDEPTTGVDPLSRAQFWELINRIRKRQTNMSVLVATAYMEEAERFDWLVAMDAGKVLATGHAEELKAQTATDELEAAFIELLPEEKRKNHQKVIIPPRDKSDDDIIAIEAKELTMRFGQFVAVDHVSFRIPKGEIFGFLGSNGCGKSTTMKMLTGLLEASEGRAWLFGQEVDPKDIETRKRVGYMSQAFSLYSELTVRQNLELHAKLFHIPEQDIPQRIKEMSERFNLTDVEDMMPDGLPLGIRQRLSLAVAVIHKPEMLILDEPTSGVDPIARDMFWKLMVDLSRRDGVTIFISTHFMNEAARCDRMSLMHAGKVLVTDTPANLVKNSQFDTLEEVFIDYLKKASGENRSTRY

SEQ ID NO: 4647 - protein, 130 aa, Proteus mirabilis
SPFEMRSVMTNNVETFSLNDTAWQGIVLTDSAAKHICQLVEKNPESQGLSLSIKPSGCTGYGYVIELAAGPTEDDLVYEHNGAKLFVALKAMPFIDGLVVDYVREGLNQMFKFNNPKAQNVCGCGESFGV

SEQ ID NO: 4648 - protein, 93 aa, Proteus mirabilis
CQYDYDSSNFIMFFILELIKMNITFKKIGTMCVASVLLFSLTGCSSMTKRDRNTAIGAGAGAICGAILTDGSPLGTIGGGVLGGVIGHQVGKK

SEQ ID NO: 4649 - protein, 338 aa, Proteus mirabilis
FLRLFRGVSSASYLMNKEKDTDSKAGYVPTFHRAYLHPRHWGTWFGAGVLCALAYMPVKWRDPLLASIGRFVGRKAKSARRRADINLRYCFPHWDKAQREDVLDKMFETAPQSFVMLADLCLRGAKHTLQRTSWEGIEIIERLKAQGRNVIFMVPHGWAVDVPAMLLAAKGQKMAAMFHHQKDPVTDYLWNKARYHFGGRLHSREAGIKPFISTVRQGFWGYYLPDQDHGAEHSQFVDFFGTYKATLPAIGRLMKVCRAAIVPLFPVYCHKTHQLKIIIREPMDDIEGQDDRYIARRMNEELEALVSPTPEQYTWILKLLKTRKEGEIEPYARENILD

SEQ ID NO: 4650 - protein, 158 aa, Proteus mirabilis
GYCDTIKANGELRGVIMYKTILVPIDIVEEELTSKAVRHAVYLAKETGANLHLIHVLPISSAIINAYSLGYPEIKDKATVKAENDMQMLVDSVDLPAEKVAYTVTFGSPRDEILTTAKDIQADLIVIGSRRPNISTHLLGSTAAGVVRYADISVLVVR

SEQ ID NO: 4651 - protein, 320 aa, Proteus mirabilis
GIRDNMHRYIYLTTVLCMNFLSLGCDEATTSTTQTGIFYISNNNNVPLQFKIDTNHFSINKGEVKKITLTNGEHILESNSGEKKVFMVYPGNNGGIINPSQEIYYSFTSVFTSEENKEHFYLDTRSVWINGQLIHGAINSTDAVFIDNNIFRCDIPLNEPIPPYLPDWKNSGVGNVLTKCFSQEEFQTFLAKYPYGIHFDNNHDLLTKQAKKEQFSWINEKDTRTEDFNPTLSEINFNNKELVQEANTIYEIVYSYLASRDPDKKQELYNIYHLHIMSMAWIYSQQIQNDILDDKEAYFQLIKETGRIFGAGILGEPVLI

SEQ ID NO: 4652 - protein, 71 aa, Proteus mirabilis
PNGEPAKRTPVVFPGLVIRKDGLRTLALLSSRYVTLSDNGSISFNKAWISAECLLSSNVATNSTGWVNRSR

SEQ ID NO: 4653 - protein, 454 aa, Proteus mirabilis
LGGDMFIGFDYGTSNCSVAIMKEGKPTLLPLEGENVYIPSTLCAPTRESVSEHLFRHLNIKPTNSIGEQLLRKSIAFNRDEDIELVPEDIVFGQAALSLYLKDPRDVYYVKSPKSFLGASGLHEIQISFFEDLVCAMMANIKQQAEKSTQATITDAMIGKPINFNGLGGEAANKQAERILINAAKRAGFKQVLFEFEPVAAGLEYESTLTKDQTVLVVDIGGGTTDCSLIQMGPSYRGKTDRASTLLAHSGQRVGGNDLDIYLAFKQLMPLFGMTGLTSSGIKLPLKQFWDPIAINNVEAQKDFYSQQNLAALNQLRRDAQEPEKIKRLIEVYNETLGYGIVRKAEEAKMALSDCHTYLASIALLSETLETNITRQQMVEAIGSPKDKMIDLVNDAVQQGGVVPDVVFMTGGSARSPILCQAIEQQLPNVPIVKGNDFGSVTAGLARWGEVCFK

SEQ ID NO: 4654 - protein, 224 aa, Proteus mirabilis
LIIDDIFLLMIMLEIVGLLQNKINQKYNRTDMFGYRSGIPKVRFETKRMIVRLAYERDAEKLANYYTLNRHFLIPWEPVRDKSHYLPSGWEHRLLYINELHRQESAFHFLLLTPKEDEVIGVANYSNVMRGAFNACFLGYSVGEKWQGQGYMSEALHETLRFMQRQQGMHRIMANYMPHNLRSGNLLAKHGFEREGYAKNYLQINQEWRDHVLTALTTRPFPKG

SEQ ID NO: 4655 - protein, 73 aa, Proteus mirabilis
LKSEDSSAIEPLVSITTTKSKATLPSPVSICELKVGLADGGGIIGLAICLLLSLFIKLLFDFPFIFSLQYMQY

SEQ ID NO: 4656 - protein, 62 aa, Proteus mirabilis
RYTERTLNSSSLFLSKGNSTIIRPSVRSLRSGIPPKENIALNLSLYSLANNALVPPVLCPTT

SEQ ID NO: 4657 - protein, 95 aa, Proteus mirabilis
TMTEARSKDPLHGITLEMQVNALVAKYGWVKLSQRIKINCFRNEPSVKSSLKFLRRTPWARSEVEALYLNLVEENLDDTINYSESDPWANSRYKK

SEQ ID NO: 4658 - protein, 218 aa, Proteus mirabilis
KMTDLDLIDVLILRREYMKGGLRRHELTEQPLVLFEKWLKQACEARLSDPTAMCVATVDENGQPYQRIVLLKHFDEKGLVFYTNLGSRKASHLEHNQRVSLLFPWYPLERQVCFLGKAEKLSAFEVVKYFHSRPKDSQIAAWASKQSSRISARGVLESKFLELKQKFQHGEVPLPSFWGGYRVTFDSVEFWQGRENRLHDRFIYQKSPEGWSIERLAP

SEQ ID NO: 4659 - protein, 62 aa, Proteus mirabilis
YIQETEPDTKNEAKIVLMISEIWLTETPKIAGPINLITRHTPLFLNEIRGNTNIPIFFRCGS

SEQ ID NO: 4660 - protein, 80 aa, Proteus mirabilis
SMQEQLEFFDIPSPCIGRCESNLQGYCIGCYRSRQERFSWSTMSQQEKRNVLRLCRQRYLRAQQKTVSETEKENEQLDLF

SEQ ID NO: 4661 - protein, 335 aa, Proteus mirabilis
PMQENLETIIGVDSHFIDVLEQTSALAQLKKPVLIIGERGTGKELIAHRLHYLSPWWQGPFISINCSALNDNLLDSELFGHEAGAFTGAKNRHQGRFERADGGSLFLDELATAPMLVQEKLLRVIEYGHLERVGGSQSLHVDVRLICATNADLPAMADEGKFRADLLDRLAFDVIRLPPLRERKADIMLLAENFAIAMCQELGLPFFPGFSDNARQILLDYRWPGNIRELKNVVERSVYRHGTSERELDNIIIDPFARFSSSTIAEQPQPQKEMIFSLPPLPLDLRQWQHSTEKNLLEQALKESRYNQKMAAEKLALSYDQLRGLIKKHHIKLSV

SEQ ID NO: 4662 - protein, 97 aa, Proteus mirabilis
VMKEITLDGNKQKTPIEVYQLFSEEFDFGPYFGNNPDALYDFMVPIDAEDKPVIILWYNSSIFKEKYPKEFAQLVSVLNSISEFGKFDQDTFQFKIL

SEQ ID NO: 4663 - protein, 141 aa, Proteus mirabilis
QTREVYMRVLHTMIRVGDLQRSIDFYTKVLGMQLLRTSENEEYKYSLAFVGYGDESSGAVIELTYNWGVTSYEMGTAFGHVALGVDDVAATCEAIRQAGGNVTREAGPVKGGTTIIAFVEDPDGYKIELIENKSASQALGN

SEQ ID NO: 4664 - protein, 533 aa, Proteus mirabilis
RKRDYFRERPMKVKTKLLSLLVMGALSAPVLAATPANTLIVVQGLDDIVSLDPAESNELSSIQTVPSLYQRIVQPNRDNPEINEPILVESWQAHPEQKSIVFKIKQDAKFASGNSVRPEDIIFSYQRAVTMNKSPAFILNVLGWKADNINTLLKKVSDKEIEVRWTADVSPDVVLNILSTPIASIVDEKLIAAHIKNNDFGNNWLKMNSAGSGAYKMRAYKPRQAIVLEANPLSPTGAPKIANIIIKNVPDPASRRLLIEKGDADIARDLGTDQTAALAGKPGIQILNIPSAEQVYMAFNTGSGNPLLSNPAFWQAARYLVDYKGITNDLMRGQYFIHQSFLPVGLPGALEDNPFSFDPQKAKDILAKAGITHARFTLDVENKVPYITVAQSIQASFAQAGVQVDLLPAAGSQVYSRVRARQHQAAIRFWIPDYFDAHSNASAFAYNDGQSNTVAWLNNWNIPELSKQTLVALNEADKAKRQSLYTEMQKELQRSSPYVFIDQGKNQIVLRDNVKGYAQGLNADMVYYDKVTK

SEQ ID NO: 4665 - protein, 296 aa, Proteus mirabilis
MNREQLLQAISHYPALAQRNMGNTHKGTFGTLAIIGSSEGMSGAIVLAGKSALKAGCGKVFLGFAQPQLPLPFIDSAPELMLQTAITLLEQPQISAWAIGCGLGLSSDSEQLLTTVLAQRNEKIPYVFDADALVLLAQLNLSHINTKLTANCVLTPHPKEAATLLHCDVADIQNNRQQAAIEITRQYHCWAIVKGQGTVIASPQGDITVNTTGNSGLSTAGSGDVLTGVMASFLAQGMPIAEAVPSAVWIHGIAADQLIKQGIGPIGLTASELIDTIRAVRNQMWATHQQHSTDLF

SEQ ID NO: 4666 - protein, 535 aa, Proteus mirabilis
LNGENFMLKHYLLAIIIGCSIFPAFSATMPSKQDNSPAPAAKWNCWGRKEVNMSNRNINNKSVSLKLSTDICDRKDLRPLFIDVYLHKISFKGAKYDGITIDIIANATHKLTGKTQEIRSTENINNIDEHVQRLQFSAVRSGDYNVDIKQIWLIFREHGKAVGSFQITGDNARNGEAYIESHITYNAMLSLIENAKSETLTTGKPSHIVFGGHYEIPMNAGSGTYTLANNGNLLIIPRIHEKEKYLIPHLLGDTHQGEAARCEGNTNAKTQDGTSQTAELYTPEQAWNKLDKPLVALNANYFDVRPQLNNTTWQSNLCSVPLGIYYDNIAQGPTHGTHNEPNQFFAGPNYFINNNNEQIALDALFWVLDQTSRIDIYYSKKVSDPAIELYANELSLSGYHFIAISGSGLPVRGLTPLPTPDSGDSETTRLAMGADDNNSLIYIFQGGSYREGISRNDLHHLYYGLSIAQSMELDGGGSAALALKADEFTVRGDTRPDSSCNEAGLWCSLITQPDGKHRPVPSWIGLAINNLAIGQ

SEQ ID NO: 4667 - protein, 120 aa, Proteus mirabilis
YKGEFIVTIKRIDPEDRWSEAVIYNDTVYYTAVPENLSGDIIEQTADTLAAIDVLLQRVGSDKSKILDATLFLADKADFAGMNQAWDAWVAKGSAPVRCTVQAQLMHPEYKVEIKIIAAL

SEQ ID NO: 4668 - protein, 110 aa, Proteus mirabilis
YKGDNMRLVYFVYQDKNAYERQSDGVEFCKIPEFHNDKIYFYCDEYSMFWNSIDKVGNPNDCCNFSLKSSIVPATLLEISNNDLISYIDTVKEYVIENNKLSKLTYIHIK

SEQ ID NO: 4669 - protein, 336 aa, Proteus mirabilis
FNKEIAVDFHHDDQEITPETSLVLAEKQPLLDLNATFTSPTQTNPALAYLRSLGSKRSRQTMGSFLTIVAKMIGFSSIKHCQWGALRRHHIQAIIDMLSDADKAPATINTYLAALKGVALEAWAMKLMDTESYQHIRQVKSVRGSRLPKGRALTGHEIRALFRCCEKDHSSKGLRDAAILSVLLGCGLRRSEIVALNYEHIQFRDQAFIVRGKGNKERISYMPEDTWERVQLWIDEIRGSQDGALFTRIRRFDDVTDERITDQAIYYILETRQQESGIDKFAPHDLRRTFASAMLDNGEDIVTVKDAMGHASIMTTQRYDRRGNDRLRKAARHLRF

SEQ ID NO: 4670 - protein, 357 aa, Proteus mirabilis
FNKEQKKMIENNRHPFACTTLAITDKKKRVYHGRTMEFSSDEPTSILAYYPQGHTFQQNAPDGTPGLKYSVKYPFMAITAPINLSGTKDVLEGVNSQGLSFSLNMLPNSKLDDLDPQYYASSVPIAAIGEWALGQYATVKELKEIIPQTHFWSQKLLLLRNLPSPFHYAFYDKTGDCIVVEVSDGKLHIYDNPTYCMTNGPIFPWHLTNLNNYTHLSNINVSSSTLGRIKINQPDSGIALATLPSSDTSVDRFIRAVYYSTYYHKVSDPDKQLIELAHIMNRFDRPKDATIDPLLGNDTLTKLHTSEFSVWTALTDLERGIFFFRGYNNLNFQKFTLESFKNESSAVFIKVNLEEAL

SEQ ID NO: 4671 - protein, 468 aa, Proteus mirabilis
RIRETIMSSGVVTAAYIVAAILFIFSLAGLSKHETSKQGNYFGIAGMAIALFATIFGPYADNVGWIIVAMVIGAVIGIRLAKKVEMTQMPELVAILHSFVGLAAVLVGFNSYLDHNPAIDPVMANIHLTEVFLGIFIGAVTFTGSIVAYGKLSGKMSSKPMMLPNRHKLNLAALVISFLLMIWFVKTDSVGLQVFLMIVMTVIALAFGWHLVASIGGADMPVVVSMLNSYSGWAAAAAGFMLSNDLLIVTGALVGSSGAILSYIMCKAMNRSFISVIAGGFGTDGSSSSDEGEMGEYRETTAEEVAELLKNSTSVIITPGYGLAVAQAQYPVHDITEKLRQRGIKVRFGIHPVAGRLPGHMNVLLAEAKVPYDIVLEMDEINDDFADTDTVLVIGANDTVNPAAQDDPNSPIAGMPVLEVWKAQNVIVFKRSMNTGYAGVQNPLFFKENTQMLFGDAKASVDAILKAL

SEQ ID NO: 4672 - protein, 296 aa, Proteus mirabilis
KRREPSMSEWPLVTFTLLVQSSVGVTIFTALYFCWLEKEIGNQRATRTLRPVLLTSAILGCLGLLASTLHMGYPWNAFHALRHISSSWLSREIIFAALYLGALCLYTLLVLIKGHMNKTLLAIIGLLGLVDIFCMASLYYSTSMITWMHVNTYFMFIGSVFSAGAVITLLITSIRVKAFADGELAKKIVLSALVGIFLAVTIRMAEQPLYLSWMSEIQLTNDAITFPHTPIIAYNETFGLRISAWILSIISILMMGYSLYKYRIAVFTSGLSLIWGSGIVLLIAEILNRFAFFIVK

SEQ ID NO: 4673 - protein, 393 aa, Proteus mirabilis
NNLLGKHHMNRRSFLTSSSLVIGGLSLSSFVSAAYAAETSNPKQLFNAENPLLLNFNENSLGMSSNAKQAIIDALPHAFRYPDDARSALISALGEEFKLSDKHITLGNGSSETIQAAVQYVANKAQKAGKAAQLIVPDPTFNYAELYAEPLGVNIVKVPVDNTLAFDLTAMQKKAQAFDGISMVYLCNPNNPTAMLTPTAALTNWITSAKENVFFIIDEAYAEFVTTPEFTSAIALVAQGYKNLIVTRTFSKIYALAGLRVGYGVAVPEVISEVDSFVSIDNTNTAGAVSALASLKDHAFVAYSRKSIDVSRQMVVDTLNALNIEYAPSHANFIFHKVKGDVKTYQERMKAANIMVGREFPPALGWSRLTLGTPEEMSYFVATLKEFRTKGWI

SEQ ID NO: 4674 - protein, 385 aa, Proteus mirabilis
KILLFCGYSSRGAQCKSTGELSMVINNKINETIGVSVTKPLYESYLQAKNEKKASYARDLATYLNVSEAELTHARVGHDAKRLHGDVRDILTALATVGEVKAITRNEIAVHEHLGEYTNARFNDHAGLILNPRALDLRFFFSHWASIFALTEETARGIRHSIQFFDLHGDSLHKVYTTDNTHMDAWNTLIDTYLSPENPVLEITPAKSFTDAPVTTALAQQLEQQWRSMTDVHQFFKILQENNLSRQQAFKAVSDDLAYQVDNSALKTLLALAKEVQNEIMIFVGNRGCVQIFTGKIDRLVPHQFENSEQVWINIFNPAFTLHLIESEIVESWITRKPTQDGFVTSLELFDSKGQQIAQLYGQRTEGTKEQQQWREQLNALAKIA

SEQ ID NO: 4675 - protein, 262 aa, Proteus mirabilis
IMSLTWTSWLTNTIQSDVYFLINTLSQPNPIKQFYINDWIEEAFPIYRGTALSHLSSVSPWLVKVKPSQYSHLGQVLDTMPLGDNSWGWAYHSQLDWRTQITHWQKHQLVIMNDKKVIFRFFDARIARTLLPKLSLGDWAVLMMPVDDCLIEGDEVNENHTRPQYADPFISPVDYELREHLITAWRDSEQAYVNVINNFYIQFWEKQSELAYQLDEVDGRLIGFIRDWMDECQKNRLDTAYLYDDLFLRYLNKNNLLPDMTI

SEQ ID NO: 4676 - protein, 268 aa, Proteus mirabilis
DVTLYLFFNKQDINMLQYQPDHTVLRDKIILVTGAGDGIGKEAALTYARYGATLILLGRTLSKLEDVQNEIITSGGQQPMLYPLDLLTASENDYQEFADTIVKRFPHLDGVLQNAGLLGVVEPIINQPSTLWHDVMQVNVNATFMLTKALIPLMLKAPHASLILTTSSVGRQGRYGWGAYSVSKFATEGLMQVLHEEYKDSSLRINCINPGGTRTSMRASAFPDENAQKLKTPKDLMPLYLYLMSDDSIEVSGQSLDAQPDRKAGPAE

SEQ ID NO: 4677 - protein, 690 aa, Proteus mirabilis
IRTLIMKKTPLFNRKTMMSAFLDAIKKCTPQAQWHNPVMFIVYVGALLTTGIWFAVLLGYLPPDNHFTFQVMLWLWITLLFANFAESLAESRSKAQAASLRGAKQQSKAVRLQHADLHAPQEIIDSLLLHKGDIVLVNAGEVIPCDGEVIEGGASVDESAITGESAPVIRESGGDFSSVTGGTRVLSDWLIIRCSAEAGNSFLDRMIGMVEGAKRRKTPNEIALTILLTALTLIFLFACTTLYPFSVFAVQFQHHGEVISVVTLIALLVCLIPTTIGGLLSSIGVAGMSRMLDANVIATSGRAVEAAGDVDVLLLDKTGTITLGNRQASRFIPLSGITEKQLADAAQLSSLADETPEGRSIVILAKQRFNLRERDLTSMGASFVPFSAMTRMSGVNIGERIIRKGSVDAIRRHIEVSHSHFPDEVNTIVEQVARAGATPLVVVENQNILGVVELKDIVKGGIKERFAQLRQMGIKTVMITGDNHLTAAAIAAESGVDDFLAQATPEAKLALIRQYQSEGRLVAMTGDGTNDAPALAQADVAVAMNSGTQAAKEAGNMVDLDSNPTKLIEVVHIGKQMLMTRGALTTFSIANDIAKYFAIIPAAFAVTYPQLNMLNIMGLHSPASAMLSAVIFNALIIVFLIPLALKGVHYRPVSAHSLLRRNLSLYGISGLIVPFLGIKLIDMILAIIGL

SEQ ID NO: 4678 - protein, 401 aa, Proteus mirabilis
IMALVTQARTLGKYFLLLDNMLVVLGFFVVFPLISIRFVEQLGWAGVIVGFALGLRQLVQQGLGIFGGAIADRFGAKPMIITGMLLRALGFALMALADKPWILWLSCILSALGGTLFDPPRTALVIKLTRPYERGRFYSLLLMQDSAGAVIGALIGSWLLLYDFHLVCWVGAGVFVLAAIFNAWLLPAYRISTTRTPIKEGLKRVILDKRFVQYVLTLTGYFVLSVQVMLMFPIVVNEIAGTPSAVKWMYAIEALLSLTLLYPIARWSEKHFRLEQRLMAGLFLMSISMFPVGITHSLHAIFLIITLFYLGTITAEPARETLSASLADPRARGSYMGFSRLGLAFGGAIGYTGGGWMYDIGKQLELPELPWFLLGTIGFITLYALHRQFNRKKIETAMLTP

SEQ ID NO: 4679 - protein, 179 aa, Proteus mirabilis
IKGFIRARNQMRIECYSWSDVSEQILEQAIALQNSAFEDMKGNFYQVDIPYKLVLAIDDNQVIGHVAVYLRDVYLDSFPETIGILSCVVVAHKYRGKGVAASLIKMAHAILKEHSVNFSILFAVSHAYYLSSGYIPMKNLTRFIENNEKKEFIYDGGMVCELGSQNWNVNILELNGEVV

SEQ ID NO: 4680 - protein, 480 aa, Proteus mirabilis
NNKLLNILTIREVVMSFTKSMLALAVMAVSFTSHAAKQADLMIVDGTVLTMDAQNQVIEQGTVVVKENKIIAVGGPELTQEYQANKVLDVDGDIVMPGLINTHTHASMTVFRSLADDVPDRLHRYIFPLENKMVSRDMVRVGANLANVEMVKGGVTTYVDMYYFEDEVAKTVDKMGNRAILGESVINFPVADAQTPEEGIQYAVNFINEYKDHPRIIPAFAPHAPYTNTTENLQKIAKLSVELDAPVMIHLAETDREKEEIAKRTDGKSPVQYMADIGALNNKIIAAHAIMVDEQDIDLLKKYDVGVAHNISANTKSAKGVSPVVAMLEKGVRVGLGTDGPMSSNTLTTMNELNLVGKIHKLENKDRAAMPPLTVVEMATIGSAKALHMEDKLGSLESGKLADIIVVDTKAPNMVPMYSPYAALVYGANGSNVRHTIVDGKILMEDRQLLTVDEQAIISEAQNFANKVRQTVVDSGEVVK

SEQ ID NO: 4681 - protein, 239 aa, Proteus mirabilis
KNKLPAVIWLNGGYGGIGGDDYFWTPQPVENDQTGATFRDPNMVLMIPSFRGENTNPGRYEMFYGELEDLDSAREYLASLPYVDPKRIYVVGHSTGGTRALLASEYSDKFRAIFSLGGIPDLKLRTEGRMMVELPFDKNNEEEFNVRSVYRYIKSIKTPTFYFEGHDYFWDEFNELRVFAMEHDIPLKIYNIKNGDHFNIIVPVSQLIKEKILQDTDTNKESNIRFTNEEIKWINKMVK

SEQ ID NO: 4682 - protein, 134 aa, Proteus mirabilis
SAVWFNVFSWRDIEKIGKPVLIRDIIRAVRPDSVIAIIALTPFIWLAAYMVDMAIASSALSNTISKRCFDTLAAGIFSAPKQTCAIAATVSAGYCPAAVSADNITASVPSNTALATSMTSARVGIGLVIIDSII

SEQ ID NO: 4683 - protein, 99 aa, Proteus mirabilis
RRAWRCNMKYKHAFAVGNLLMAIGMVLMLGSLGYNLLSHIFPLGLPDILSDASLMGIFIGALVWLAGARIGGRETVAERYWWLRNHDERYRRHDNHRYP

SEQ ID NO: 4684 - protein, 317 aa, Proteus mirabilis
SINWHLHQRIIQIMNIELRHLRYFIAVAEELHFGKAAERLNISQPPLSQQIQALESEIGARLLERTNRSVSLTPAGQMFLKGSYQIMAQVKAVATRASRMEKGELGEISIGFTSTTPFMHLVTLSLRQFRENYPEVGIHMHQMNTKQQISPLLTGHIDLGIMRNTVLPDNLHHQLLFREPFILAVYEGHPLLEYKETGVNIQDIGQYPFVFFERDVGTALYDEIIQLLSLAGITPTIAQEAGEAMTILGLVAAGLGISIVTKSFTRMKVDGVHYLHFANSNAFSEVWLVSHNKRTIPAAANRLTQLLLKNILEDQKS

SEQ ID NO: 4685 - protein, 443 aa, Proteus mirabilis
HKNWRNKVMAGLLTLNEKREKQHQVEQRNQQALKQFSALYQQRKGEDNLNARNHWLQVEKVGFPAYRHEDWHYTPLDETLSQQYQMLPPFEVQDLIEQRALSFDCYRIVMVNGAFSPAESSQDFGPYQVTLLDNQSELPQAINGEVFLHLVESLAQQPLFITLKKGVVADKPLYILNITQGHAGQEVNSANYRFHLDVGANAQMQVIEHYISSDGENRHFTGARLTATIGDNASFNHIKLGFENGISQHFAHNDLSIGRDARVNSYAFLLGNKLSRHHTSAALTGENSELSMNSVVLPKANEIADTRTWLVHGEKNCLSRQLHKSIAMDAGKAVFNGMITVTPQALKTDGQMTNNNLLLGDKAQIDTKPQLEIYADDVKCSHGATVGRIDDEQLFYLRSRGIALSEARKMIIHAFAAELTESLENSVIKTHVLERINQRLSEV

SEQ ID NO: 4686 - protein, 128 aa, Proteus mirabilis
KMNWYLEVIKNNYANFSGRARRKEYWMFIVVNTIILAVLYGIMFSSIDSYTGEMSGTGFAALIIIGIYSLATIIPNIAVTVRRFHDQDRSGWMVLLSFIPFVGGLILFIFMCLDGTRGENRFGLDPKA

SEQ ID NO: 4687 - protein, 62 aa, Proteus mirabilis
VIDWFYLGFKLKIAIHCIVNQFLAELVINLFIYIAVIMLNKKTPQNSTSYFTVLFILVRDYI

SEQ ID NO: 4688 - protein, 61 aa, Proteus mirabilis
EFLWDTRYDIYYVEIKIYSRTKSQEYYTIQNRNSFLFSLIISYRYFCIVIIPISLNIYRES

SEQ ID NO: 4689 - protein, 305 aa, Proteus mirabilis
RYLWSGDQLIEGTPIYADGTLAESQQIQWLYQSGEITPTARYQQGKLHYVVTDHQGTPREIFSEGGQASWAGRLNTWGQMQFWRYREGKAENDPNYTECPFRFAGQYEDEESGLYYNRFRYYDKETGQYLSPDPIGLLGGLNPYGYVHCPTGWVDPFGLQVVNASLSGNSHSTSSAQGALLKQYYSTAESANDVVNSLKATGKLPDNYVTKAQAEAAGWSRGKALGNYVPGGQIGGDIFANSTKILPDAPGRVWYEADIGLNNSMSRAKQPGTRLLYSNDGLTYVTSNHYDTAEALGIWNCCKGG

SEQ ID NO: 4690 - protein, 242 aa, Proteus mirabilis
YHLCYPDYTKLIKINSLISPRRCEMFTGIVQGKGRVIAIEDKGDFRTHIIELPSELVNNLETGASIANNGCCLTVTKIDGNKISFDLVKETLRLTNLGELTVGSEVNIERAAKYGDEIGGHVMSGHIVTTAEIAKIITSENNLQIWFRIFDQTLMKYILHKGFIGIDGISLTIGDVVNNRFCVHLIPETRDRTTLGRKRLGDKVNIELDPQTQAIVDTVERVMAQQALTVKLQATHEEENKK

SEQ ID NO: 4691 - protein, 98 aa, Proteus mirabilis
LHICKETMMRATVFGKRIGLHNDKTTTGATCLASILTVTNEGISILRLGDKTTRCPVCNEEGTIVTGEQGMILDGQKIAVEGSIVQCGCSYGKNRVTC

SEQ ID NO: 4692 - protein, 99 aa, Proteus mirabilis
KIKCVLGAIMKKAIILSVSLATLFLAGCTADGKIKTSQLTPVNCVGVFNKTNEQVSFTAKDVDQRLYSPDKPIDSVDGWIDVKDVSGLLCEDVITANED

SEQ ID NO: 4693 - protein, 174 aa, Proteus mirabilis
RYEWECVILIGLIFKKKQSKRVTMPIWVDADACPKVIKEILYRAADREKVVITFVANQRLSIPASPYLRTLQVSAGFDVADNEIVQRANQDDLVITADIPLAAEVIEKGAIALNPRGERYTESTIRERLNIRDFMDTMRASGIQTGGPASLSQRDRQLFANELDKWLLQQKRKK

SEQ ID NO: 4694 - protein, 99 aa, Proteus mirabilis
NDRCITLNLIKKHHRIISLTVMTVLLTGCSQGHSPFIPMLGAYFPYWMLCTFIGLLGAFCLRVLLIYWGIDDKLPVPLLFYFAIMLSISLTISLLYFTY

SEQ ID NO: 4695 - protein, 302 aa, Proteus mirabilis
NTRWDMPLDSQFYKEKKTPSPAAVIWQCFSKDILSMVGFYGVIFLLILSIVGPYIAPYALDQQFFGHQLTPPSWYQNGNVTFFFGTDDLGRDVFSRILIGTSMTFGGAFIVTFAATLMGLIMGCLAGMTHGLKSAVLNHILDTLLSIPSLLLAIIVVAFVGASLEHAMIAIWLALLPRLVRMIYSAVNDELNKEYVIASRLDGASNISILWYTVLPNITPVLVSELTRAFSIAILDITALGFLNLGAQLPSPEWGAMLGDSLELIYAAPWTVLIPGATIMISVLLVNLLGDGLQRAINEGVE

SEQ ID NO: 4696 - protein, 188 aa, Proteus mirabilis
YRTRTLGDGDDVNTCYLLRGYFSDGSMGVKRLGIINIILTLIEDMILAAIPAVGFAMVFNVPLRALKYCALLGAIGHGSRTVLMISGMNIEWASFCAAILVGCIGIQWSRWWLAHPKVFTVAAIIPMFPGINAYVAMISVVKLTQIGYSEEIFEALVTNFLKASFIVGALSIGLSLPGLWLYRKRPSV

SEQ ID NO: 4697 - protein, 275 aa, Proteus mirabilis
CYYRNLRTNKDTAMGFMTGKRILITGVASKLSIAYGIAKAMHDQGAELAFTYQNEKLKPRVEEFAASLNSNIVLECDVSKDESIDAMYAELAKVWPKYDGFVHSIGFAPADQLDGDYVNAVTREGFKIAHDISAYSFVAMAKASRAMLNPNSALLTLTYLGAERAIPNYNVMGLAKASLEANVRYMANAMGPEGIRVNGISAGPIRTLAASGIKDFRKMLSHCESVTPLRRTVTTEDVGNTAAFLCSDLSGGITGEIIHVDGGFSIAAMNELELK

SEQ ID NO: 4698 - protein, 475 aa, Proteus mirabilis
ISYRVTCLGRNMKRLQNELTALINRGVDRHLRLAVTGLSRSGKTAFITSLVNQLTNVHSGARLPLFSAARNQQLLGVKRIPQHNLSIPRFTYDEAMESLYHTPPSWPVPTKGVSEIRLQLRYRSHESLTRFIKETSSLYLEIVDYPGEWLLDLPMLEQDYFEWSEQMNRVNQQRTAPVQQWQSLIKKCDPFAPADETLLAEIAAAYTEYLLACKKQGLHFIQPGRFVLPGELSGAPVLQFFPWADLTQYDSAKLKNADKKTNIGMLKKRYEYYGQHIVKGFYRDHFQGFDRQIVLVDCLQPLNQGADVFNDMRQALTQLMRSFHYGKRTLLRRLFSPCIDKLLFAATKADHITPDQHENLVSLLQQLIQDAKQNAIFEGISIDCMGLASIAATESGIVDHHGEKIPAVKGYRLTDNQPLVYFPGEVPKRLPEKAFWQKQGFSFESFRPQQISRDSAVPHIRMDSALEFLLGDKLK

SEQ ID NO: 4699 - protein, 484 aa, Proteus mirabilis
SQSRRQYRQCAFASLIKPINRGTQMDYFPIFCQLNNKPCLLVGGGEVAERKARLLMDAGAVISVVAPTFTPQFMQWQNEQRLQCFTAEFSVADLADKWLVIAATDNEQVNQLVYQQATEQRIFCNVVDSPKQASFIMPSVIDRSPIMVAISSGGKAPVLARILREKMEQWLPNSLGALAQLAGKLREQVKQRFATMGARRYFWERFFADKALQVEIDAGRDNGIQQRISTLLAENNQPQGSVVLVGAGPGDAGLMTIKGLQQCQQADVVVYDRLVSDEVMHLVRRDAERIYVGKRAGFHCVPQEEINQILINHAKAGKRVVRLKGGDPFIFGRGSEELEALIEHQIPFSVVPGITAASGCTTYAGIPLTHRDYAQSVRFITGHGKGLNDAQWQCIAQDNQTLVFYMGLSKADYIQQMLLNQHMRATMPVAIVEKGTLATQKVVVGQLQQLAEMASSMKSPALIIVGEVVSLNQKLQWFGTTLAN

SEQ ID NO: 4700 - protein, 571 aa, Proteus mirabilis
ERMLQSIHRGWTRIMKKSLVAVGVIVALGVVWTGASWYMGSKIESRLQEETKRTNVQLAQLAKESQLGADIKLEIRDYKKGVFTSTADLAVVISEHAKSDEDKKVEEVLFKTDIDHGPFPLSDIAQFNLAPKLAAMNNTLVNNETTKDLFKLTKEPSFIDMHSSLSFDGSVSGKVNINPINYSKDGSQLTTSAFQIDFSSDKNATNISTAVKGDEVIVKKGNDETFTLKNIAGSVEGTKVKDDQYLFDTQTLNFGDITFTSQDKSSNFTLKDTSLATKSQIKDKLFFITQDYSFKSLNVGGFDFGAGKFAYSIDKADPDAMLLLTKVYNSTFLPWNQNKYDNSAMIEQAVRDVLEKGLVFRIDEASLTNSSGASKLNFKLDLNAFNADALKKENKAPSVLFNELFNNIDFNIDLSVPMLTEFRSTTQYLDVMRYSEKGLTDEDKAEIQKTTANDMAQLKTELQQNINQISQDEKDALPLMLLSQDGNKLSLNLNYAADKFTMNGKTYSFDEFMEVTQAPQMLGLAAMLFGAGASSYDYDDSDYPEYSEEPDQNDAIEEPQVEIPAAPAENN

SEQ ID NO: 4701 - protein, 199 aa, Proteus mirabilis
KIMLVLKRGLDMPQIVMENLKNLYYDMRSNKLSVQIYNVQLGAISFNVCFSISENPFVLTLTSRTDTPEFFLFNVTNGFRLETFINIDTFKRLQYLLYIGKNSNKLSTKSFFLDLDKKSPTKANLEKIDEREILNLRQDIKYDRERPYFDHWREHITDGKNVTEDNLAKTLALLGKEAYYFSRNNNNSAIWSHCPVIRN

SEQ ID NO: 4702 - protein, 212 aa, Proteus mirabilis
TASRDNTHYLRRELMAQLYFYYSAMNAGKSTSLLQSSYNYNERGMRTLIFTAAIDTRFAKGKVTSRIGLSADALLFSDDMNIRDAILAENNKEPIHCVLIDECQFLTKAHVEQLCEITDSYDIPVLTYGLRTDFRGELFTGSAYLLAWADKLVELKTVCYCGRKANKVLRLAANGKVLSDGAQVEIGGNEKYVSVCRKHYTEATLKGRIEQL

SEQ ID NO: 4703 - protein, 466 aa, Proteus mirabilis
CASRKRIKIMTVLNAIVKDKAEYLVARKAQQPLSTFIDKIAPSTRSFYQALTRSHPVFILECKKASPSKGIIRSDFDPVAIAKIYQPYAAAISVLTDEKYFQGSFDYLRQVSDAVHQPVLCKDFIIDEYQIYLARFYQADAILLMLSVLNDEQYRALSAVAHQLNMGVLTEVSTEEERQRAIELKAKVIGINNRNLRDLSIDLSRTEQLSQGLPQEAIVISESGIHTHQQVKTLSQYANGFLVGSALMSQENIAQAVRALILGKHKVCGLTRTQDVKAAYQAGAYYGGLIFAEKSPRRVTLSQAQLLVTQAPLAFVGVFQNQSIELICDYAKQLNLSAVQLHGAEDAQFIAQLREKIAPQCEIWQALNMAYHHDIQHIAQVNKYVLDNGTGGTGNTFDWQTIPPTLRHKALLAGGLNSDNCLDALNTGCLGLDFNSGVESSAGIKDPQRLSQVFTQLQQSKFSQNF

SEQ ID NO: 4704 - protein, 268 aa, Proteus mirabilis
ATSLLVEYPLLLFFKSILVMSNSKSAPQDNLFATPIANLGDWRFDEKVAEVFPDMIKRSVPGYSNIISMIGMLAGRFVTPHSQVYDLGCSLGAATLSMRRNIDVAGCKIIGVDNSPAMVERCQRHIDAYKAATPVEIIEGDILDIDINNASMVVLNFTLQFLAPDNRQRLLNRIYQGLNPGGVLVLSEKFSFQDKQIGELLFNMHHDFKRANGYSELEISQKRSMLENVMLTDPVETHKSRLHQAGFPHAEVWFQCFNFGSLLAIKGE

SEQ ID NO: 4705 - protein, 139 aa, Proteus mirabilis
DSKRDFMMRSVRSQIVAIIVTASTGYLPFALSPDSITASVPSKIALATSPASARVGRGFLIMESNICVAVITTLRAALHFSIIIFCAKITSSTGISTPKSPRATMIPSEASKISSKLFKPSWFSILEMIMMFSPPCAFK

SEQ ID NO: 4706 - protein, 154 aa, Proteus mirabilis
LRKRLIIAVFMPMLNRHILSFIFCLFGLFLIIYSAYSLGDFSEYGAAFMPSLIGGGIIIFSLLDIFAKKQQMDTPLVTWHEIKFVLLIIGIILFYVFFAEYLGFIVTGFIVIAPLMMKYAKVKPIFSFIISAGIVLGVYYLFTAVLLVPLPQLF

SEQ ID NO: 4707 - protein, 67 aa, Proteus mirabilis
QSPLIYLNNLLLLSLLKTLHYARFFYTCPNNLTQFLILMHKIYDFMHRQPSQLSVKSRCFLVVLSLS

SEQ ID NO: 4708 - protein, 274 aa, Proteus mirabilis
MWRRQMFDKLLEVKNLSKTFRYRTGLFHRQQLKAVKPVSFTLEPKQTLAIIGANGSGKSTLARMLSGVTEPTGGDIFINGHQLSFGDYSYRSQRIRMIFQDPTNSLNPRQRIGQTLDLPLRLNTELSGIEREKRIYQTLRQVGLLPEHANYYPHMFASGQRQRIALARALILQPQVIIADEAIASLDMSLRSQIINLMLELQETHEIAYIYVTQNLGMTKHISDKVMVMDNGEVVERGNTAEVLASPLHEVTRRLVASHFGEALTAEAWRQDLP

SEQ ID NO: 4709 - protein, 74 aa, Proteus mirabilis
PRKRLHNSLGFILSGIKLYLSDENSTSEINNNQEPEKQYNAFLVLLIFSYPELDWHFCFRLIQFYIHQDLLQRR

SEQ ID NO: 4710 - protein, 272 aa, Proteus mirabilis
ILRRSMDNQIMAEEYAISQDKQREITKLCIQTALLLLQHGAESMLVEQLSTRLGLALGVHQVETAISANAVVLTTIVNGHCQTSTRKIVDRGINMHVVTEVQHIVILVEHHLADIDEARKRFEHIKPLRYPRWIIIVMVALSCGCFSKLNGGDWDGFLVSALGGGMGMWVRQLLTHRQVNPLINFCITAFVATSVSGLLLKLPYFQVTATISMAASVLLLVPGFPLINAVADMFKGHVNTGLARWAMATMLTLATCLGVILAMAVWELRDWA

SEQ ID NO: 4711 - protein, 295 aa, Proteus mirabilis
SMRRFIRVDLPPEPIINDKCVRKRLKQSLCDSCSKVCPVDAITFSLLNVEIDNERCFQCGNCLFTCPVDAIENISPHERSFQDNLLVINHDEPLASIEELLVWHRQYQIRGMKIAEPLVDKWLPILAQLNLQLKTLQEPIWQLVLVEPEPVDSGRRFMLFRQKLDEKPLNKGHVKTGLNARKQLYPQDSWFHIQLDKESCILCSACAKVCDEGAITIEDNRFIIDEKRCTGCMNCQVVCFPKSIKVVEQIAKNSTPTHYHYYDAQCDKCRLAFFAWEPNATLCPICTQHQKQGWL

SEQ ID NO: 4712 - protein, 234 aa, Proteus mirabilis
KDILFSLHKTDTHILLHTYGMFYGFFIMKLKSRQQENSEQTRLALLEAGQYLFVNQCYYDVSIDEISRYARVTKGAFYHHFSNKKALLRECYLLQVKHAVQKLDEVPTYDDKWQELTALFSLCVDHIYQCKNELIPLQEVISVLGWKEWEEIDANILIPRIQHCVDILFAEKQICAYSPAIVVNLIYGFITHIAINLKNEASLPKEACSDFKAIFADFLIGVKQASPQRHQHRV

SEQ ID NO: 4713 - protein, 341 aa, Proteus mirabilis
VLFFYAFLGSQNKKRLNIMSNKPLHRIDLNLLVIFQILLQERSVTLAAKWLSISPSAVSKALAKLRIWFDDPLFIRSPQGLIPTPLSLSIEDSLSDFINISHHIANKRNTEVPVGLKFNLVLETPLHQVMLPSLPQQILSHYPKSTLQIKNWEYNSLSNIIDGEVDIGLVGREYYSRSKELLELLPDVIDYEILFDDIPLVYLHKNHPLMKMKWDLNNFLSFSQVSTEYDKQSHWALDNILKEMNKSRQIAITYTSFEQSLFMISQPDHQLITCAPGYCRYYVKTHFPDIVTLPIPLPPVFLDHLHLPFVLLWHKRNSHNTKIIWLRNTIRKSINQQTSYI

SEQ ID NO: 4714 - protein, 279 aa, Proteus mirabilis
RYFSCTRRNLMSRYQLCFEALAQKQQGAFVPFVTLGDPDAELSLKIIDALIEGGADALEIGIPFSDPLADGPTIQGANLRALNANVTPTLCFELLSQIRQKHPTIPIGLLVYANLVFSNGVDNFYHKCQQAGVDSVLIGDVPLREAKQFREAALSANIAPIFICPPNADDELLQELATSAEGYTYLLSRAGVTGTDKRAEQSLTHLTSKLKAYNAPPALQGFGISEPQQVSQAISNGAFGAISGSAVVQIIENNLHQPDVMLKMLTQFVQQMKAATISV

SEQ ID NO: 4715 - protein, 282 aa, Proteus mirabilis
FMFSQSLLKLNIPSEYAVIGESDMHNELGYPLALSYVVVIICLDGRAVINIDFQTKTIKANDIVILGDDRMVTLQRKSANFRIFYCFLKKSFASEIAYALSNSLFTFLHENPICRPSTAHLNAINNWVEQLKYIDKSYTDHRKLMLRGQLQNLFFAITELIPSHYSLSKKEFSRKEHLCWQFWELVIKHSHQHRDVAYYANRLSITPFYLSQLTKQYFNDVPKTLINRQVILKIKALLTHTTLSVNEIAIKLHFDDPSYLCRYFKRETDCSLSGYRQQYQRQ

SEQ ID NO: 4716 - protein, 399 aa, Proteus mirabilis
GRKLIIFLEIITIRRFGVIAPLSGINIMEDKLKEIIKIDLIREFRDLVNDNNSFIYVKYSNIRNKNLFNPICSSMDWIGVTTNYLYNFPSLSKDIDVKVMQIYSFISSIDITLEAIKQLHRILLDDYKLKKWPFFKENNIFKNKTIKNINDDDYFKEIRAHFGAHPTNLNGNDNEKLFASWPFHPIFDDNDLSVRVYPNAIDKDDLKFGIKLNELIEYFDSRYCYLKDLMTEINKQYKNFCDEYKKIPIQNSQDIVSELEILKNEAEIRLNNNHYIYTLNDLTKIFRTSLGEHGLKKKETIFKEALEPLITEIRKNLQEMNLIDLKESKYISYSLKDKSHTYELTKLYTWLYSNSKDPLADYYLNKMNEISNGEYSFSILDSKEVNFLKLKIMLFFDNN

SEQ ID NO: 4717 - protein, 508 aa, Proteus mirabilis
TIVSKLPPTYSCDSFSTENSFTMTTFYTVLSWLTFFFYWLLIAGVTFRVLMHRRPVTSTMTWLLIIYILPLVGVIAYFAFGELHLGKRRVEHARQMWPSVVAWLEELKKCKHIFAKHYSDVAEPIFQLTAKRQGINGVKGNKIQLLTTCEDSLNAITRDINNARDNIEMVFYIWQSGGLVEEVTEALIQAAKRGVKCRIMVDSAGSRSFFRTNGPARMRAAGIEFVESLQVNLFRFFLRRMDLRQHRKIVLIDNYISYTGSMNMVDPRYFKQDAGVGQWIDIMVRMEGPVSTTLGIIYAFDWEMETGERHLPPPPDNNIMPFEQANGHTTQVIASGPGFPEELIQQSLITAIYSARKELVMTTPYFVPSDDLAHAISTAAMRGVDVSIIVPRSNDSFLVRWASRAFFTEILEAGVKVFQFEDGLLHTKSVMVDGQLSMVGSVNLDMRSLWLNFEITVVIDDECFASDLSIVQYDYIARSTQLTLDEWEKRPFMNRVLERLCYFFSPLL

SEQ ID NO: 4718 - protein, 862 aa, Proteus mirabilis
PRILTLDTFRSEAKMSKKTLAIIGNGMVGHRYIEELIDKGGNETFNIIVFCEEPRIAYDRVHLSSYFSHHTAEELSLVKPGYYEKHHIEVLVGERVITINREEKVVHTNTGRCVSYDKLIMATGSYPWVPPINGNNSPDCFVYRTIEDLNAIEACARLSRKGAVIGGGLLGLEAAGALKSLGIETHVIEFAPTLMAEQLDSMGGEQLKRKIERMGVKVHTAKNTQAILSTGENARKTLQFADGSSLEVDFVVFSTGIRPKDKLARQCSLDIAPRGGIVINDYCQTSDADIYAIGECASWHNQTFGLVAPGYKMAQVAVDHLLGQQTAFQGADLSAKLKLLGVDVGGIGDAHGRQAGCRSYIYLDEGKEIYKRLIVSEDNKYLLGAVLVGDTEDYGNLLQLALNTIELPEHPDTLILPAHAGSKPAIGVDSLPETAQICSCFDVSKGDIIQAIERGCHTVAAIKAETKAGTGCGGCIPLITQVLNAELTKQGIEVNHHLCEHFHYSRQELYHLIRVEGLKSFDELLKKHGQGYGCEICKPTVGSLLASCWNDYILRDDLVALQDTNDNFLANLQKDGTYSIIPRSPGGEITPAGIIAIGQIAQEYNLYTKITGSQRMAMFGAQKQDLPAIWQKLIAAGFETGHAYAKAIRMVKTCVGNSWCRFGVGDSVGLGVFLEHRYKGIRTPHKMKFGVSGCTRECSEAQGKDVGIIATEKGWNLYFGGNGGMKPRHGDLFAADLDEETLIHYIDRFMMFYIRTADKLQRTSVWLESLEGGVEYLREVIIHDKLGLNAQLEKELKVLQERVACEWQETLDSPQALKRFAHFINNPMPDPNIQMVKERAQHRPARVHERIDIKMVTEETQS

SEQ ID NO: 4719 - protein, 81 aa, Proteus mirabilis
KMSSSQLKKQYIGEHQLSPETLMMSYGYDPLLSEGSVKPPVFLTSTFIFKSAEEGKNFFDTVSGRKPLPEGRKSRFSLFSF

SEQ ID NO: 4720 - protein, 549 aa, Proteus mirabilis
LAYRLQDETDMRKIFVISCALVVQGLLISQANAAVVPSGTILDKKQEVVRHLKDEPASLDPINAVGLTEAQVQRDLFEGLVIEDERGRPIPGVAQSWRTEDNRVWIFTLRDNAKWSNGEKVTASDFVYSWQRLVDPKNLSPFAWYASLASIENAQKIIDGKLKPTALGVEAIDEKTLKVTLERPVPYFPSLATNFSLYPVPKHTIEKYGSEWIKVGNLVGNGAFILKDRVVNEKIVLTPNPYYWDHHNTVLTKVTFVPINHESQATKRYLAGDIDITESFPKHLYHKLMKDIPDQVYIPEQLGTYYYAFNTQAGPTKDIRVRKALAMAIDRKIITDKVLGTGEKSANRFTPDVTANFTPEPTLYDEYSQDELDSQAKILLSAAGYGPHNPLTLSLLYNNSENHQKIAIAVASMWKKKLGVKVNLRNQEWKTYIDSRNSGDFDVIRASWIGDYNEPSTFLSLLGSKHAGNIPKYQSQQYDEILVQANMTTDEEERNRLYNRAEQVIAEEAPIAPIYQYTNGRLIKPWLKGYPIENPEDVAYSHMLYVIKH

SEQ ID NO: 4721 - protein, 66 aa, Proteus mirabilis
YHNSIQQNKYTSYVITIMTPTLFHFVVPVGLKNNWFFLMNGFVVMGANYLKTLPHKVLKLIYHHKQ

SEQ ID NO: 4722 - protein, 821 aa, Proteus mirabilis
HCDRLIYVVVLTAGFSFFSLSHLFKKGLFSMSSNSLTPCNVLWYNQLGMNDVDRVGGKNASLGEMITNLAELGVSVPNGFATTAQAFNDFLEQSGINQRIYELLDSIDVDDVNQLAQAGNQIRQWVIDTPFTPQFEKDIRDAYQTLSEGESEASFAVRSSATAEDMPDASFAGQQETFLNVQGIDAILVAIKHVFASLFNDRAISYRVHQGYDHRGVALSAGVQRMVRSDLASSGVMFTIDTESGFDQVVFITSAYGLGEMVVQGAVNPDEFYVHKPTLAKGLPAIVRRNLGSKKIQMVYADSIEHGKQVRIEDTPEALRNRFSLTDDEVQELAKQAVLIEQHYGRPMDIEWAKDGHNGRLYIVQARPETVRSNQQVMERYQLNETGTVIVEGRAIGHRIGSGTVKVIHNLSEMDRIEAGDVLVTDMTDPDWEPIMKKASAIVTNRGGRTCHAAIIARELGIPAVVGCGDATECISEGQVVTVSCAEGDTGFVYDGKLDFSIQSSAIDNMPELGLKIMMNVGNPDRAFDFAGLPNDGVGLARLEFIINRMIGVHPRALLEYEDQTDALKAEIDEMMAGYASPVEYYIGKLTEGIATLAAAFWPKRVIVRLSDFKSNEYANLVGGDRYEPDEENPMLGFRGAGRYVSDDFRRCFALECEAVKRVRNEMGLTNVEVMIPFVRTVRQAEEVIDELARNGLKRGENGLKVIMMCEIPSNALLADQFLAHFDGFSIGSNDMTQLTLGLDRDSGVVSSLFDERNDAVKALLSMAIQSAKRQGKYVGICGQGPSDHEDFAQWLMEEGIDSLSLNPDTVIKTWVKLAQQ

SEQ ID NO: 4723 - protein, 352 aa, Proteus mirabilis
KRDRVMTKNLNVGIIGYGYASKTFHAPLISTTEGLTLSAISSSDESKVIADFPNITVYANPQRLIDDPDIDLIVIPTPNNTHYTYASQALKNGKHVVVDKPFTLTLDEAEKLAQQAKEAKRLLSVFHNRRWDAGFLTVQKLLADKTLGEVSAYEAHFDRFRPAVRQRWREDAGLGGGLWYDLAPHLLDQAVCLFGQPYAITADIAQLRPNAKNADYFHTLLDYGHLKVILHASMLVASPTPIFAIHGTKGSYVKYGLDTQEDALKAGYLPTEMYNWGADPQEGELTLSTESGELVTTKLPTLSGNYPAYYQQIYRAIAFGEESPVTVSQAINVMRLIEAGSLSNQSKTTIKL

SEQ ID NO: 4724 - protein, 894 aa, Proteus mirabilis
HFIRSLFMSVTNVTELNDLVARVKKAQLEFANFSQEKVDAIFRAAALAAADARIPLAKLAVEESGMGIVEDKVIKNHFASEYIYNAYKDEKTCGILSEDLTYGTITIAEPIGIICGIVPTTNPTSTAIFKALISLKTRNGIIFSPHPRAKLATNRAAEIVLNAAIAAGAPKDIIGWIDEPSVALSNALMHHDDINLILATGGPGMVKAAYSSGKPAIGVGAGNTPVVIDDSADIKRAVASILMSKTFDNGVICASEQSVIVVDSIYKQVRERFATHGGYMLTGKELKAVQDIILKDGNLNAAIVGQPAVKIAEMAGIEVPVNTKILIGEVKETTDAEPFAHEKLSPLLAMYHAQNFEDAVHKAEKLVEMGGIGHTSCLYTDQDNCPEHVAYFGDKMKTSRILINTPASQGGIGDLYNFKLAPSLTLGCGSWGGNSISENVGPKHLINTKTVAKRAENMLWHKLPKSIYFRRGCLPIALEEIATDGKKRAFIVTDSFLFNNGYVDEVTNVLKKFGVETEVFFEVEADPTLSVVRKGAEQMNSFKPDVIIALGGGSPMDAAKIMWVMYEHPETHFEELALRFMDIRKRIYKFPKMGVKAQMVAITTTSGTGSEVTPFAVVTDDETGQKYPLADYALTPDMAIVDANLVMNMPKSLCAFGGLDAVTHALEAYVSVLANEYSDGQALQALKLLKEYLPASYHEGAKNPVARERVHNAATIAGIAFANAFLGVCHSMAHKLGSEFHIPHGLANALLISNVIRYNANDNPTKQTAFSQYDRPQARRRYAEIADHLELSAPGDRTAAKIEKLLAWLEEMKSSLGIPASIREAGVQESDFLAKVDKLSEDAFDDQCTGANPRYPLISELKQLLLDSYYGREFNEHPVAEVKEAKPAKKSSKK

SEQ ID NO: 4725 - protein, 147 aa, Proteus mirabilis
YYISQQHLFETRKMSESLKILNNIRTLRAQARETSLETLEEMLEKLEVVVNERREEEQAMQAEIEERQQKLQKYRELLIADGIDPTDLLEAAGASKTGRAKRAARPAKYSYVDDNGETKTWTGQGRTPAVIKRAIEEEGKSLEDFLI

SEQ ID NO: 4726 - protein, 481 aa, Proteus mirabilis
CMSRRLRRTKIVTTLGPATDRDNNLEKIITAGANVVRLNFSHGSAEDHLARANRTREIAARLGRHVAILGDLQGPKIRVSTFKEGKVFLNVGDKFLLDANLEKGEGDQTKVGIDYKGLPADVVPGDILLLDDGRVQLKVLKVEGLKVFTEVTVGGPLSNNKGINKLGGGLSAEALTEKDKQDIITAAKIGVDYLAVSFPRTGEDLNYARRLARDAGCECQIVAKVERAEAVANDEIIDEIILASDVVMVARGDLGVEIGDPELVGVQKKLIRRARQLNRVVITATQMMESMITNPMPTRAEVMDVANAVLDGTDAVMLSAETAAGQYPAETVAAMAQVCLGAEKMPAANVSKHRLDMVFDNAEEAIAMSTMYAANHMKGVNAIIAMTESGRTARMMSRISTGLPIFSMSRHEKTLNQTALYRGVTPVYCSTHTDGIAAANEAIMRLCEKGFLVSGDLVLVTQGDQMGTIGSTNTCRILTVE

SEQ ID NO: 4727 - protein, 174 aa, Proteus mirabilis
RKWLYNRFRYYDKEIGQYFSPDSIGLLGGLNPYGYVHCPTGWVDPFGLSGTSQLNAFQNANFADSQKLTQHFEKHGHEFRATSEAEYLKIGRDVIEKGHKVEYYYKPLEQYRTGYVMYMRNTKRGDVQMAFVGINPQGQIATIHTKSGKDVWKLLNGNKDEKVINLIPRDANGL

SEQ ID NO: 4728 - protein, 342 aa, Proteus mirabilis
LSLRCYMSKLTIGGVNISTSQINKLSHASKARDAMSIWEKIKDWFNHGQKEHVLKLLYHTYFNPKNSIFDKVDCFAELYSMTGAQYKNNFHLYLKDGYDLKMKFVIKNVYNGEVLLDNLIKDMMVRIHNKNPSIEKDIGNIRSYIRRRLHEIPNKANYDINQYNFYLSKIKNDLLPNNYFNVERYLDSVTDFVRLYNINKNNSRISVDDKIEDRCKLQKLMNIIQHIDIEYRKNIQIKLLMNSVALNIKDKNSKEFLNLIKIELLSLYNPHVDIIEGFIKHGMETLFKDEDKKEKACGSLRKAIIDYNFPFIGSLEFNVTDETINNIYINNIVPSEYISFLQ

SEQ ID NO: 4729 - protein, 537 aa, Proteus mirabilis
TQLRSLLSATYFLGGLIMTIACQFSQLNIEFNQEALFPPLTHSLTCQRNALIGQNGKGKSVLLKLLAQKLLPSSGHIMWRMPFIHVDQLTRLTGNTIADALGIETFFQAFKRVDNGSASLEDFELLEDKWHLPMTWQNLLHSAQLPVSLDTPIPHLSGGEQTRLALCQAFLHDDHFLLLDEPDNHLDHQGQQWLVEQLMHHKSGVLFISHNRHLLSYAENIFELSEKGLQEYGGNYSLYETQKNAQIASIEAANERINSQIKQEKRQQHVTLQKALQRRKQGEKIRNSGSQSLLLLDMQTNRAEKKQSSIAKRHQRVMDDMQSQKQQLEQELTHIHQQKLILNYQGDGHRLNVFATELVLPFGKQTPYSFSAYGGEHWHIQGKNGSGKSTLLKCLMGKLSPLSGEYRLNPNYCYLDQHLTLLDKSLPVAEALYQYQPLMTIEQWRTKLGMLRIRGNKSLFPLETLSGGEQLKATLLALIYSPQPPAVLLLDEPDNYLDLDSKQLLENLLSQYQGTLLLISHDEDFVKQCGITNTLLL

SEQ ID NO: 4730 - protein, 125 aa, Proteus mirabilis
TMRLIMKPLLLSLLLLPAVAFANPSKMAEDYCNTFKDISVKAYDTNEAPEKIAKDALATLKSQNFDFAKLDATEADFSNGTVEVVKSLRDAKAEIGSREEFQEGLTQIVAACKIQMDSVLQEQKK

SEQ ID NO: 4731 - protein, 339 aa, Proteus mirabilis
SIISEYRMKIVSYSTKHYDRKHMEWVNQHNGYHYDIEYFDFNLTEQTAKNAVGADAVCIFVNDDANRAVLQELASLNIHILALRCAGFNNVDLKAAAELGITVVRVPAYSPEAIAEHTVGMMLSLNRRIHRAYQRTRDANFSLEGLTGFNMHNRTAGIIGTGKIGLATLRILKGFGMKLLAYDPYPNQAVLDLGAEYVDLATLYANSHVISLHCPLTAENHHLLNESAFSQMKDGVMIINTSRGALIDSAAAINALKRGKIGALGMDVYENERDLFFEDKSNDVIQDDVFRRLSSCHNVLFTGHQAFLTEEALISISETTLHNIKEVAAGITSPNEVKA

SEQ ID NO: 4732 - protein, 408 aa, Proteus mirabilis
PRVSTTSILLLNHIAEGIFMNQNNFNKLISRQNTYSAKWCNSNANVIPLSVADMDISAPDFIINKLSQFNLTGIYGYTDLSSDWNNVAVNWFKSQYAWHVTPESVVFCPRIIQAVSLYIQNFTQIGDKVTTLSPAYHPISNTVCVNHRQLLESPLIYHNGCYEIDFDDLEDKFKQSVCFILLSPHNPTGTVWQQADLLKIAKLAEKYKVFIISDDVHADFIFDNAIYRPISTLSSYVEQHSFICTSPAKTFNLAGLEIANIVIANPEYREKFKQCLIAAGIHNPGYFSVPAFLQAYTLQGQQWIKELKHYLAENRQWVKEQCARYFPDWVITQSHGTYMLWINYQKMQLTEQQLKHWFVSLAEVEMSWGSGFGAAGDGFFRINIATPRSILETVFTRLIRTSPHASLE

SEQ ID NO: 4733 - protein, 67 aa, Proteus mirabilis
MMVRTALLKIKNLIIWLYHQFSDLLHIAVTFVLCYFCFLLSPTLTIAVIGVVIIVVTMFLLSLFVLP

SEQ ID NO: 4734 - protein, 319 aa, Proteus mirabilis
FFSSERTINVTLPIFNTPHIGSIFMSIDLNLLRIFSAVAEQAQFASAARSLSMPTSNVSRAIKQLEQQLNCRLIDRTTRKMRLTEQGKILYQQAKKTLYELDNVVEHITSDGPLTGTFRLTIPSEYGSELLADILADFAALHPNLTIQCDTQLMPRNVIEDDIDLLLTFHRGQLADSSYHSRLIKSWRSIVVASESLLAKTGIPTDIEQLSQLPCISSLSALEGQPWIFIDKEQNPVKVTINSCYRVNSAILAKAAVLKGLGFAILAEHCCLDAIKAGKLRAISFPQQPASISLVAIYASRRSLSRNIEHFLAFLTQRL

SEQ ID NO: 4735 - protein, 330 aa, Proteus mirabilis
SQPRGYNKPMIIYSIRRLLLLIVTLFFLSLVSFSLSYYTPNGPLSGASLFDAYFFYTHNMFHFDFGISSINGEPIKAQLIEAFPATMELCALAFIFALLIGIPAGIIAGVWRNKPADTFISHLALLGFSVPVFGLALLLTLFFSLKLGWLPVSGRIDLLYNLQPITGIAIVDAWLSDSPYRQQMIINVLQHLILPVTTLAIAPTTEVIRLMRNSTEEIMVENYVKAAATRGLSRFTIIRRHILHNALPPIIPKLGLQFSTMLTLTMVTEIVFNWPGLGRWLVTAIRQQDYSAISAGVMVVGSMVIIVNVLSDIVGAMSNPMKHKVGYAFR

SEQ ID NO: 4736 - protein, 213 aa, Proteus mirabilis
GNQSMSEFKQYAPVSDEQLGFFIDSSRCSGCKACQVACKDKNNLEVGRRFRRIYEIQGGGFAPNGQGAFENNVFAYTLTISCNHCDDPICVKNCPTTAMHKRPGDGIVRVDTSKCVGCGYCSWSCPYGAPQMNTETGQMSKCDFCVDLLAEGKNPICVDTCPLNAIKFGKIKDLRAKYGHLSQVQGLPDFTITHPNLVIKPHTGAIKKGGNQA

SEQ ID NO: 4737 - protein, 290 aa, Proteus mirabilis
NWQSQGSVYLMNILERVQSSLDILSKSEKKVAEVVLTTPQTVIHSSIALMAKTADVSEPTVNRFCRRMATKGFPDFKLQLAQSIANGTPYVNRNIDDSDSVSAYTNKIFESAMAGLETVKNNLDIAVINRAVDILTQARKISFFGLGASAAVAHDAMNKFSRFNIPVTYFDDVIMQRMSCINSIDGDVVVIVSHTGRTKNLVEIAKIARENDASVIAITTSGSLLAAEATLPILLDVPEDTDIYMPMISRLAQLTVIDVLATGFILRRGPKFRDNLKRVKEALRDSRFDK

SEQ ID NO: 4738 - protein, 199 aa, Proteus mirabilis
IVRREEQSKRICSFLSPSTLSAIGIVMAIILGIDPGSRVTGYGVIRQQGRQLIYLGSGCIRTQVPDLPSRLKRIYAGVSEIITQFSPDVFSVEQVFMAKNADSALKLGQARGVAILAAVNNDLPVFEYAARQVKQSVVGTGGADKSQVQHMVRSILKLSAAPQADAADALAIAITHCHFNQNLLRVGDPRLVLTRGRLR

SEQ ID NO: 4739 - protein, 80 aa, Proteus mirabilis
LFIFNGNCESTAWPKTSAVIAVPSEIKKTVLSTSSLLSQLIEFKLNIIPLTFFLAELAIQTILSIVFLVIIKDKKIKFSG

SEQ ID NO: 4740 - protein, 321 aa, Proteus mirabilis
RFTRILPMLHKNNKFAHGFLIKSCLVTAMIASFSSSVQADVVASIRPIGFIAAAIADGVTPTEVLLPDGASPHDYALKPSDLRKITSADLMVWVGPDMEVFLDRPLNRLSDKNKLALAETDKIKSLLLKDDNDNVHKHEENHEHHSHGDYNMHIWLSPEIALSSAKQIHDRLVTLYPDKKELLDVNLSKFSEQLKQTDKNLVNILSPVKNKGYFVFHDAYGYFEKHYNLKPLGHFTINPEIQPGAQKLHQIRTQLVEQKATCIFAEPQFRPTVIETVAKGTGVKMGVLDPLGSGIALTQDSYVKFLTQLANQYASCLNETQ

SEQ ID NO: 4741 - protein, 203 aa, Proteus mirabilis
RTKRWFMNRQLNYRLVSKALFLSGALLLTGCVSIPESIKGTTATPVTDLNVVLAAPELYVGQEGRFGGRVIEVKNLPSSTQLEIAVMPLSHYDAAPELQQPSVGRLYANVTHFLDPTDYKNQYVTVVGTIKGVKTGKVGEAVYPFLRIDVTGMKRWTLTQQVIMPAPVMTWGYYGNAPYWYNYGYGGYGAYPYGTGQVVPVLE

SEQ ID NO: 4742 - protein, 161 aa, Proteus mirabilis
KCWRKAKMNIIFYHPFFDANTWISGMKARLPDAHIRVWEHGDDKPADYAMVWLPPYEMLASRNQLKGIFALGAGVDAILKQEQQKPGTLPAGVPVMRLEDTGMGLQMQEYAIAKVMYYFRRMDDYKRQQSQRLWKQLPAHTYDNFVIGVWGAGALGASVAN

SEQ ID NO: 4743 - protein, 239 aa, Proteus mirabilis
ICRSYGVSLRILAIDTATESCTVAVWNEGVVASRFEISPREHTQKILPMVKSALEEANLSLQSLDALAFGRGPGSFTGVRIGVGVAQGIALGANLPLIGISSLATMAEGVFRTTGIKQVLVAIDARMGEIYCAQYQRNDAGIWSGEETEAVMKPEQFAETLQATTGRWAIAGTGWQAYPDLALSLPFTVVETQITLPAAQDMLPLAVTAWHEGKATKVEEAEPVYLRNEVTWKKLPGRE

SEQ ID NO: 4744 - protein, 258 aa, Proteus mirabilis
TTFGDIFMAGHSKWANTKHRKAAQDAKRGKIFTKIIRELVTAARLGGGDPATNPRLRAAVDKALSNNMTRDTLNRAIARGAGNDENDNMETIIYEGYGPGGTAVMVECLSDNRNRTVSDVRHAFTKTGGNLGTDGSVSYLFTKKGVISYAPGVDEDAVMEAALEAGAEDVETYDDGAIDVYTTPEAFGEVKDAMDAAGFVAESAEVSMIPSTKAELDIDTAPKLMRLIDMLEDSDDVQEVYHNGDISDEVAKQLEDIL

SEQ ID NO: 4745 - protein, 724 aa, Proteus mirabilis
RVLGGSSLFCIVPFSLSIFAWRQIMLSKDPKSTPIDPASVLKDEAINQVKNRVQSKVNETLSTPTQKVAGMASAAASLTQSASASANRVTAHPLIHGGGFTGGQTFAENQALQAAHGALLDALGMDSLESGLVFTCTIGGLPDDTFQVTEFNLTEGLSSLFSLSISAVSALPFIDFQRHLGLASSLTVKRDGVLIRKVNGILAGAVQGNTDGVKTWYHFDIRPEMWVMTLNQDSRIFQHQSVPTILKTLLDEAHVKADCQFYREDLHPERLYTTQKRESAFDFWCRLAFEEGINFWFEEEQLFYSDEHMGMTAGIHLTYNPQADTDISDSTAMTWQYGEYLCVDETIHKDNNFVRPSYPLSHENKVEQGGQHSVFESYGRFQLDDEGRPLTQVRFEQLRNGSKVGQATTNCFALMPGKIFTLSQHPHQPMNDRWQVISVSHHGVQPLADNSGGEGTQLSNSVSFIPGTQEWRPPYRYKPTADGDEVATVVGPPGEEIYVNEYGAVKVHFHWDRRGSADHSASCWVRVAMGWSGNGYGFSAVPRIGTQVLVSYLNGDIDRPMITGCTYDGRNAPPIKFPENKTQTTFRSQTHKGEGFNELRFEDAGGKQEVFLHAQKDMNTRVLHDRTTHVLHDHVEVIENNQQMQVKGARTETIDKDNSETVGQHKKITVGKTLSINVGEVIELRCGASVLRMDNGGHVTINGQEFKFEATGPVKITGKDIDLN

SEQ ID NO: 4746 - protein, 60 aa, Proteus mirabilis
QGVGITISFYQKRQIKLNDCLKNNPLVMSVILASAHGKTSVKDNKILSICCKQPVFFVSL

SEQ ID NO: 4747 - protein, 67 aa, Proteus mirabilis
KITGDRMNIYDGIVSNSLLKKFPSGYPANVLLTNFVANFVDLEGVLACAGLFCPTFIEIDNVLMNIF

SEQ ID NO: 4748 - protein, 659 aa, Proteus mirabilis
LSTGIIYVLFYKKSMPVSDDFAENGILTRRVPGFHPREAQRQMAISVTEVIDKQGVLIAEAGTGTGKTYAYLVPALRSGKKTIISTGSKALQDQLYSRDLPTIIEALDYDGTTALLKGRSNYLCLERLDQQMLSGGDLEAEVLADVMHVRQWSTQTEDGDISRCHSVAEDSKVWPLVTSTNDNCLGSDCPRYKECYVLSARKNALAADVVVVNHHLFMADTVVKDTGFGELIPDAEIMIFDEAHQIPDIASHYFGQQLTSRQLFDLARDMIVAYRTEVRDQVQLQKSADRLTQMVQDFRLSLGDTGFRGNLRELLQNKETKRYLTLLDDALELSYDVMKLSLGRSQLLDSAFERATLYRNRLKRLIDTTIAGYSYWFESYGRHFLLAITPLSVADKFHELIKSHKSSWIFTSATLSVDEKMSYYTDRLGLENATTLILNSPFDYQHQTLLCVPRYLPPLNQPYTAKRLAAMLAPVILKNQGRCFFLCTSHAMMRGLAEEFKASLPLPVLMQGEMGKSQLLKKFVSSGNALLVATQSFWEGVDVRGDTLSCVIIDKLPFTAPDDPLLRARIEDCQLRGGDAFRDVQIPDAVITLKQGVGRLIRDIHDYGAIIVCDDRLVSRPYGEVFLSSLPPSPRTRSLEKTSYFLSQRAQRNEIVSES

SEQ ID NO: 4749 - protein, 331 aa, Proteus mirabilis
ILAGILWRLFFYMYHNIIGISWYLICRRRVMSSVVRKVRKAVIPVAGLGTRMLPATKAIPKEMLPVVDKPLIQYVVNECIAAGINEIVLVTHSSKNSIENHFDTSFELEAILEKRVKRQLLEEVQGICPSHVTIMQTRQGIAKGLGHAILCAKPLVGDEPFAVILPDVILDRYSADLTKVNLKEMLSHFEQSGASQILVEPVPEEEVSNYGIVDCMGEHLQPGDSKPITRVVEKPKKEEAPSNLSIVGRYVLSENIWPLLAKTAPGAGDEIQLTDAIAMLIEKEPVEAYHLQGKSHDCGNKLGYMKAFVEYGLQHEEFGEEFTKWIKSLQA

SEQ ID NO: 4750 - protein, 120 aa, Proteus mirabilis
YQNGNRGDAIMSQWIAVCQLDDITVGTGVCALVEQEQVAIFRPYQDERLYALSNIDPFAQASVLSRGLIAEHDNELYIVSPLKKQHFRLTDGYCLEDEHYSITHYEVKVEGNTVSVRSRH

SEQ ID NO: 4751 - protein, 214 aa, Proteus mirabilis
NNDGKKITVYSTISPETVVEVIGTYTSNKCERSHFNASYTRVTYSSLTQEVEAERKIAEDNKTATYIVPIDGGRWCNWKLVEIDIAPVSTIYKSHMVISKVIPIVDDKHSKIELFTTLAPVIVESKNDQKIYYASSEMEGEKKLSNKLNGEIYFNYKVEPKLTTTIISNDKKAIFPNGNIKTLSGSTYSKMIGFNEIIENSDEKAFASFVRYID

SEQ ID NO: 4752 - protein, 161 aa, Proteus mirabilis
VNILLTKSAIEGNKMRFLKLPFIYWLLLNCIPFIGFELHSGNIKPGVFFYLGALTIITSGIWLFFCLYFFIKHNTSPNPHQTPRHLVTTGPYKISRNPMYLGFLDISIGLFFIFGNWGFLGAALAFYFITDRYTIVQEEKILSERFPQAWRQYCRHVRRWI

SEQ ID NO: 4753 - protein, 334 aa, Proteus mirabilis
WYQGGRIMKSVNNAIIEDSDAIYMAQLNGHGGIMPITANSIASNERPFWVHLDYRKPKSDQWINQTELLPPIAKDVLLAENVRPKAQRIGEGVIINLQTINNNPDDRPDELIAYRIYINGQMIISSRHRRVNSVDSVIHSLEVGDGPENSGSWLITMADAVTDEIGDFVETLHDQLIELEDMILDQQIPARGELALLRKQLIVLRRYMAPQRDVFSRLSIEKLPWMSDSDRISLVEISERLSRRLEDLDSSISRTAVIADEITSMMADAMNRRTYTMSLMAMLFLPTTFLTGLFGVNLGGIPGNEFPYGFAIFCFSLFFLIVIVAWWLKRSRWL

SEQ ID NO: 4754 - protein, 214 aa, Proteus mirabilis
SRQGVRSLVMSTQYGFYIDSSRCTGCKTCELACKDFKNLSPEVNFRRIYEYAGGDWTEQDGVYTQNVFAYYLSISCNHCDDPACVKVCPSGAMHKREDGFVVVNEEVCIGCRYCHMACPYGAPQFDEVKGHMTKCDGCYERVAEGKKPICVGSCPLRALDMAPIEELRAKYGDLAEIAPLPSAKYTKPNIVLKLNANSRPVGDTTGHLANPEEV

SEQ ID NO: 4755 - protein, 341 aa, Proteus mirabilis
SGGGVSMSQATLQDRKVILEVNDLKVYFDVQDNKQWFWQPKKSLKAVDGVTLRLYEGETLGVVGESGCGKSTFARAIIGLVKASGGTVTWLGHDLLGMGNKQWRDVRQDIQMIFQDPLASLNPRMTIGDIIAEPLKTYHPKMKQAEVVEKVKAMMMRVGLLPNLINRYPHEFSGGQCQRIGIARALILEPKLVICDEPVSALDVSIQAQVVNLLKDIQKEMGLSLIFIAHDLAVVKHISDRVLVMYLGHAVELGTYDEVYHHPLHPYTKALMSAVPIPDPDKERNKHIDLLEGELPSPINPPSGCIFRTRCPMADEECAKTRPLLEGSFRHAVSCLKVDPL

SEQ ID NO: 4756 - protein, 206 aa, Proteus mirabilis
LLLGFKENTMHLFRSSLVMLVLLTLITGLAYPLFITGLAQLFFPWQANGSLVYQDDKLIGSELIGQSFNRADYFQGRPSMTSEMPYNSMASGASQLATSNPLLSEKVAAGVRLWQQRVDNHQVVPVDLVTASASGLDPHISLAAAYYQAPHIALLRQFTINEIKQLITENTTSPLIPFLGEPVVNVFKLNQALDRLSAEKNNKVSG

SEQ ID NO: 4757 - protein, 426 aa, Proteus mirabilis
VMLGKNIEQINHARLAGKEGLWRITVKNNQIAAIEPQPQSDFHPQGLDAQGGLVHAPFVEPHIHLDTTQTAGQPNWNQSGTLFEGIERWAERKALLTHDDVKQRAWQTLQWQIANGIQHVRTHVDVSDASLTALKAMLEVKQEVKPWVDLQIVAFPQEGILSYPNGEALLEEALKLGADVVGAIPHFEFTREYGVESLHKTFALALKYDRLIDVHCDEIDDEQSRFVETVAALAHKENIGSRVTASHTTAMHSYNGAYTSRLFRLLKMSGINFVANPLVNIHLQGRFDSYPKRRGITRVKEMLASGINVCFGHDDVFDPWYPLGTANMLQVLHMGLHVCQLMGYGQIDNGLQLISHNSAKTLALTDYGVEVGNSANFIILPAENGFDALRRQVPVRYSIRHGKVIAQTEPAKTEIMLAKPTRITYK

SEQ ID NO: 4758 - protein, 365 aa, Proteus mirabilis
TFMGFKCGIVGLPNVGKSTLFNALTKAGIEAANFPFCTIEPNTGVVPMPDPRLDKLAEIVKPQRVLPTTMEFVDIAGLVKGASKGEGLGNQFLTNIRETEAIGHVVRCFENDNIVHVAGKVDPAEDIETINTELALSDLDTCERAMHRNQKKAKGGDKVAKAEMEVLEKCLPHLEKAGMLRALDLSDEEKAIIRYLSFLTLKPTMYIANVNEDGFENNPYLDTVRKIAEAEGSVVVPVCAAIEADIAELDDEEREEFMQDLGIEEPGLNRVIRAGYALLDLQTYFTAGVKEVRAWTIPVGATAPQAAGKIHTDFEKGFIRAQTISYNDFITYGGEQGAKEAGKMRAEGKDYIVQDGDVMNFLFNV

SEQ ID NO: 4759 - protein, 405 aa, Proteus mirabilis
DEMGIPPSHIDHVKQFNLGTVFRLIDEHGPISRISLSKKATLAPASITKITRELVEAHLIHETEFPGLGFRGRPAVGLKLESKGWQFLCIRVNNGSLLFSLRELDNQLVVEDTFDFPKQNSDAFLHHFLAAIDTFFQRYQSRVERLTAISITMNAIVDPISGVIYSSPYYAIQDIPLADKIQEKTGVAVFLQHSVTAWTMAESLYGAAKNNTDILQIVIDDIVGAGVVTNGKTLHSNSHSAVEIGHTKVIDSQTQCYCGAKGCLETEISIPQLIKKAQHLAQENPTSILNQYPITVETLCDAVLIGDKQALDIINLVAQRLGFILAVMVNIFNPQKILIGSPLCRAKSALFPLILSSIQHHVLPRYAHNLVIEETELRNKGTLPAASLVKEALYNGSLLLELMQG

SEQ ID NO: 4760 - protein, 143 aa, Proteus mirabilis
GVSGRWHSFVIAPPCNRAWRYLWSGDQLIEETPIYADGTLAASQQIQWLYQPGEITPTARYQQGKLHYVVTDHQGTPREIFSEGGQASWAGRLNTWGQMQFWRYREGKAENDPNYTECPFRFAGQYEDKESGFIIAFAIMIRR

SEQ ID NO: 4761 - protein, 386 aa, Proteus mirabilis
EIIFSKFLGTFMKMKYSPFFILLMTTGTTLSYATDGEIKIMAGKTGYVGEVVPVTKLAETFPKSFTAPSSANYYARLGFLSLTNQTGYCGSTDGLQKIPEINEWGFKLINKNYPTSGYLLLAINGNIGGQYKTNNSGIQNIKGVLTRSKLTRSSLYNVSKNGSFCWGPSAYDQENFYDPSFRSYVSISINSYSVYAYGDIKPGIFSLETSFKLSRNTANSVDDSTAYFIRPGEIKVTALRSCNVISSTETNIKFKDQFTSTFTSPTLLDTSPVNSVNVTCTQGGKNYITIKAYNSLVSGNMSGMLLNGTKSNNQSEVYVVASLKNLTNQTCQANDTSAIRFFDGHYIPNMDNIKSFNQTFLFGLCANGKVIADKYSGAVDVSFIVE

SEQ ID NO: 4762 - protein, 424 aa, Proteus mirabilis
PLFMDTHEISSKNMALKEDVSINTTSKPNSPKHYIQRDDALYIKVTVSFFMVGLATFALLYFVQPILPILSKEFSVTPATSSLALSLSTGLMACGLLITGPLSDAFGRKNVMVIALFCAAFFTLLSAMMNSWTGILITRALVGLSLSGVAAVAMTYLSEEIHPAYLALSMGLYISGNSIGGMSGRVITGVLSDYYSWRVSVIILGIFALVAAIIFWRILPTSQHFRPATLKPRNLLITTKLHFRDKGLPLLFIEGGLLMGGFVTLFNYIGYRLLDAPYSLTQTTVGLISIVYLSGTYSASKAGLLTNKYGLGKVFIAGVSMMLAGILITLFDSLAIIFIGMLILTTGFFAAHAVASSWVGRRAKRGRAQASSLYLFTYYAGSSIAGTLGGIFWVNFGWLGVGLFIAFLMLTALLIALRLNRIAQ

SEQ ID NO: 4763 - protein, 206 aa, Proteus mirabilis
RDFMYFQYGEKEISFLKQKDKRLAAVMERIGEIKRPLTPDLFTALIKNIIEQQISVAAATTVQQRLLTLCDGIYTPVHIASLSVQDIQQCGMTMRKAGYIKGIADSVINHTLDLDQIPAMSDKAVINTLIKLKGIGIWTAEMLLISSLNRPDILSWGDLAIQRGIMRLYRHQSLDRTRFERYRKRYSPYGSTASLYLWALSKESAD

SEQ ID NO: 4764 - protein, 103 aa, Proteus mirabilis
GIFMIKVIAEDFIKSGSIETVLPLYQELVKASQQEARCISYDLFVDEKDPGHFIFIESWPNKEALDIHCNSEHFRRIIPMIKQYTKAESKITLVNSVFDKNID

SEQ ID NO: 4765 - protein, 358 aa, Proteus mirabilis
YGFIRLYLINPQSYATNSSSIGAIMSRFRSPWMSIAILLILFTIITLISVNSGPLALSFSTLWDRSFDDIEWQIWLDIRLPRVLLAILVGGALAISGTIMQGLFRNSLADPGLLGISSGAALMVAIVIILPFSFLSVFSFYSHIIAAFIGGLIVAMIIFSLHQLSDGNLARLLLAGIAINALCMSFIGVLSYISTDQQLRQFSLWMMGSLSKIDWNTLAIATLVIIPISALACWQGHKLNLLQLGDEEAHYLGLNVRKTKFILLLLSAILIGCAVALSGVIGFVGLVVPHLIRMRLGSNHIWLLPATLLGGAILLLAADTLSRTLVSPAEIPVGLITGLLGGPYFLWLILRQPAGRMS

SEQ ID NO: 4766 - protein, 221 aa, Proteus mirabilis
GYFLSSRVSPLIDRELFKMKLYYTPGSCSLSPHIVLRETGLDFSIERIDLRTKKTESGKDFLAINPKGQVPVLQLDNGDILTEGVAIVQYLADLKPDRNLIAPPKALERYHQIEWLNFLASEVHKGYSPLFSSDTPESYLPVVKNKLKSKFVYINDVLSKQKCVCGDHFTVADAYLFTLSQWAPHVALDLTDLSHLQDYLARIAQRPNVHSALVTEGLIKE

SEQ ID NO: 4767 - protein, 212 aa, Proteus mirabilis
YLLIHYLLIRILYMTFDIFLSLAIFSFVTSITPGPNNIMLLASGINFGLKRTMPHAIGVSLGFFVMLLAVGIGIGALIKSSPIIYNILKYLGALYLLWLAWKTAISHSVEQNSNKQGSPLTLLEAALFQWINPKSWMMAISGITLYTSPQYPYISMLLVAIIFTLINFPCVAIWATFGHSLRERLKNPKILKLFNFIMGGLLALSAISVLFQ

SEQ ID NO: 4768 - protein, 870 aa, Proteus mirabilis
GFIMLKSKTICFNLYIFLGTCFSGVVYADSFFNPNLISNIDNEVADLSRFDKGEGQPEGMYSVEIYVNDEYVETKNLIFYESDASSDDTGLLPCIDNKTLTNFGITLTENSKKKSEEVESKDSACENILDKIENSSVKFDFEGQKLFLSIPQIMFKNNVRGFIPPEKWDNGINAFLLNYNFTGRNSKNFKDNVDNNNYFLNLNPGINLGSWRFRNESSWNYASGESKQNKWRNIRTYVQKPIIPLRAELTLGDSFSNGTIFDSLGFRGIKLESDDNMLPDSMRGFAPTIKGIANSNAIVTVKQNGFVIYQISVPPGAFEIKDLYATSSSGNLDVTIKENNGKITQFVVPYSNVPILQREGRLKYELIGGEFRSGADYQDKPNFGQLSLVYGLPYNMTLYGGSQFSNNYQAYAIGLGGNLGTFGAISADVIQANSILPNDEHKKGQSFRLLYAKSINSTGTNFQIMGYRYSTQGYYTLNEVSYKKMAGREIVTDNGIIRDEDNLSNYYNLNYSKKGRFQLNINQQITNNSSLYILGSYQNYWRTTETEQLWQLGYNANIDRINYSLSLSKLKSPGMRGDNKNVAFNISIPLNDVFNQQTVSDLHSSRNSMYAVYSMNRSDDNVWVNQVGLTGTLLEDNNLNYNIQQGYTHNGSGYSGMVYANYKGKYANIGSGYNYSNDWHEFNYSLNGGVVAHAGGITLTQPLGDTNILIKANDANNIKVENANGILTDNKGYAVLPFASTYKNNRVSLDVNSLEENIELENTIINVVPTKGALVEANFKTNIGYRAMVTLSKKDGAIIPFGAMVVDEERSVSGIVGDNGNVFISGLAPVGRLKAKWGKMADQQCIFDYQINEKSSKEKGIYFISSTCQY

SEQ ID NO: 4769 - protein, 166 aa, Proteus mirabilis
KIIIRFPLGVIMFKHLLVGLFAVTTLAGCVNTSSLSGDTYTASQAKQAQNVTYGTIVSVRAVNIQAGSDENVLGAIGGAVLGGLLGNTIGGGTGRNLATAAGAIAGGMAGQQAQGALNTTKGVQLEVRLDSGKTVVVVQKADNTAYRQGQRVAVIGNGNNLTVSPR

SEQ ID NO: 4770 - protein, 275 aa, Proteus mirabilis
GNIMMIQALHSLYQQHTDNGGHGIGRCGGKGKHRGQHHNGNNEHCCHGERGHHQEGHGKCCQQGEQSHEHNDHAEHGCCHGEKQQEHGKRHGRGCGAGKGKGRGQGRQLKRMFDHGDLRVLLLSMIAAKPSHGYEIIRGIDEASSGLYVPSPGVIYPTLTLLEEQDLVVANIAEKGRKNYSITPEGSAFLAENQETEKNIQNKLAYARDLSQNAGGVSEEIEFAVGKLKAVLRHKLVLKQLSVEKAQRIAFILNEAVEKIEAINEALISEVREDE

SEQ ID NO: 4771 - protein, 255 aa, Proteus mirabilis
RTIMDAQLYKEFKIIEKAFWSEICENNIRIGDHTHCFMTPMDAPIFNFIYLRQGASENTFQQASTLFSSQKKGHMLVLPESLLPEFEEIIKKAGYTGDGMTTAMYLSLSDATYPPYKNNPCDIILTNHDLKQWAQPLKTAFPVGDDTITNEYIRYHQKALDNGATILHYALLVAGQPVSSLTLTLHDKLARFDDIGTDIAYQGNGYATHLITHVLEFCREQGVERCFLDASADGLALYRKFGFKPLFNYLSFINE

SEQ ID NO: 4772 - protein, 501 aa, Proteus mirabilis
SQIMSQSNVEIGDEVQGWLSDHHYKEGFYTDISTDTLDKGLNEAVVRAISAKRNEPEWMLEFRLDAYRHWLEMEEPHWLKADYPSLNYQDYSYYSAPSCGACCANGSCASGNNEAVSTQETQDYLTKEVEDAFNQLGVPVREGQSVAVDAIFDSVSVSTTYREELAKHGVIFCSFGEAIQEYPELVRQYLGTVVSSHDNYFAALNAAVASDGTFVYIPKGVRCPMELSTYFRINAAQTGQFERTILIADEGSYVSYIEGCSAPVRDSYQLHAAVVEVIIHKDAEVKYSTVQNWFSGGDSEGGILNFVTKRALCEGENAKMSWTQSETGSAITWKYPSVILKGDNSTAEFFSVALTNGNQQADTGTKMIHIGKNTKSTIISKGISAGKSQNSYRGLVKVLPGAQNARNYTQCDSMLIGTECGAHTFPYVEVMNNSAQLEHEATTSRIGEDQLFYCRQRGLSEDDAISMIVNGFCKDVFSELPLEFAVEAQKLLAISLEHSVG

SEQ ID NO: 4773 - protein, 494 aa, Proteus mirabilis
QGVIMEVFMKKYKITSETKEYNGVTLYRIRRVYTDSPGGWIENESNLSRDDNCFIFDNVMVFGNAKVTDNAIIRNNVKIYGNAIVKGNSKVKDNAEIYGNVLVEDNVTISDDVVIYDNAVIKDNARISDDAVIYDNAVIKDNAKVSEYAIVRGDAIVEKNGWVTGYATVEGNTIVSKGEVIKSQFGSWDDIDELRAFYIYINRYNSTATAYVNGRHQVPITIYIEALDKNGRIIKIAKEDIYRNTHIVNEKNLPIDRNDISLSDKENGFVFPSSEEATLNSPDASTCVIYLSVNKVIDTFRICAQTHIKGKEYTTAFKNNYSDYLNFIILDVAPKKIFTEADVDIEPLVNPRIEKDVETSGDVLTKYYLRFNGNNRTITKSVEYEENKSFHYFQKGHYQIISTSTDKYIKKIPLKPHYYTKEFHFKPDTLIPVTSANDEDGVCFWSYSIEYGKAFTSSRKDEEMNCIIYDQYGNDLQVSIKADENNKLKFYFGS

SEQ ID NO: 4774 - protein, 269 aa, Proteus mirabilis
EGVMKEIITGLLLASISLFSVSCSQEDTDVVKVAINTGPDQVIWDEVIRLAKLTEGLNVEVIAFNDYERPNKALENREVDVNVFQSIPYLQSEIKAHNYKFHIASKTYIFPLAAYSKKISDISELEYGDVVAIPNEASMKGRALLLLAENHLISLKEGVGFLPSVEDIIDNPNALIFHEVETPMLVEALDDPEVTMAVINNNFSSQIGLLATRDGLIMENKHSPYANVVVTRIDNMNDEKIKKLITVLHSRQVELKVQEMYKGDAVKAW

SEQ ID NO: 4775 - protein, 197 aa, Proteus mirabilis
GVSMKSINITFLIPLLLLYFPFIALSDNRRGSLPAPISCSFDIPNSTKVRSIRPDSFPSNYAGTLANDRYSKRIAIVFSLCSEKNTKITLRIDNTNIDFNNGYLINDVTGSEASDNVTFQLIDDENNPIDLNQKNTFTKTIDESGTAYFNFFINYVKKDNLRAKPGYISSRITFIVEAKDQIVENDNEFAGVENRVL

SEQ ID NO: 4776 - protein, 310 aa, Proteus mirabilis
GCSMRICSLLLCTTFLVSSITSSYAEISTHKLIRQDNSELIYYLDKQAEHNKTLLVLMQGSDCNSIKNNTFIQETFGRWLPSSDVLMVEKYGITAQLTYSDDNGEREDCPKNYKLHDNPNQRLTDYLAVLDKLSPNYTNIVLLGGSEGATMVHLVVAERHDISAAIALNGGGRFFLDDVLYNIRNTTPKEHVEEAINSFQQLANAIITNQIGDEQFVSEHSKLWWQQYLAIDLLEVIKRNTQTPVLIVQTLDDINVDVAAFHQLSQEITQPNVTFIKYDKLNHGFYNQQGERLTGKVVQDIQQWYAQYNK

SEQ ID NO: 4777 - protein, 135 aa, Proteus mirabilis
ENTMSSHLVMQNIEALSSPGGHYSHVVTANNMSFISGLLPLDKNGVPLTDKPIEFQINQVLENLNACLIGIKAQKTDIAQVKMYITDINEWPVVNELYAKWIGEHKPARLVAGVKELHFGSKIEIEAMVIKEQTL

SEQ ID NO: 4778 - protein, 657 aa, Proteus mirabilis
MITIENAVELFKPWAFKIFEEKVLPFVFCKGADVYNRKKNLYKLKGQMSDYLAKTRAQCSVINSLAFPNVLKKVNDIYIPLTLSMLDSREEREHTIKRGDLFLSEFNNILIIDNAGMGKSTLMKKIVIDTIDHSEYIPIYIELRTLTNNPIEEQINKLLGFDDVNDSDSILKKIPFIYFFDGVDEIPFDLKNDLIKKIKVFSDEMSNSKIIITSRPDQSLLELHSFNRFKIKPLEIEQSYDLIKLYDINLVKRGNRLILSNKLITEIKLMREKENNTILEFLTTPLYVSLLFCSYRYKPVIPRRKDLFYSQVFEALFETHDLSKETGYVREKSSGLDITDFSIILRRLAFWCLKNNGKLEFSRAELESILTNITEKLKGVNVKPISFINDLTYSVPLFIKEGALYRWSHKSLMEYFSAEFICIEVKDKRDDLLLKLYESGSAVKYKNIIELCSDIDYASFRKSILRKCLTEYFEHLEKLEDLDFLDDCNKEIWASISFFSDLKLLLTPYSNANLGDLNILDNVYVFEESDFSHSSFENNFIGFREYITHITYPVSLKNTVFDILRLKNNEYFFKEKDYYNRLSLDSLKIPENVMISTNSGYVKGYSNDIIPDIISILLQFRHTLTIPVIYKSLAMKALDDIVSDTSNGVNDLLEGFD

SEQ ID NO: 4779 - protein, 112 aa, Proteus mirabilis
MTTIEKIERQIKENPILLYMKGSPKLPSCGFSAQAVQAISACGERFAYVDILQNPDIRAELPKYAHWPTFPQLWVDGELVGGCDIILEMYQRGELQKLLKETADKYRGEEEA

SEQ ID NO: 4780 - protein, 148 aa, Proteus mirabilis
GVAMYKTILVPVDISEDELTEKALQHAVYIAKLEGAKIHLFHAIPDVSRFSISYSYHYDMLSSFANKAIERVQEQLQELANSVDLPKEQVDFSAAFGSARDKVLELAEKIKADLIVVGSRRPSISTHLLGSNASGIVAYAKQSVLVVR

SEQ ID NO: 4781 - protein, 228 aa, Proteus mirabilis
MNAIYLKTKWFFYFLGLLMVSSIFMVKAMANSDKADLVTLAQEGNLPELKRQIAQGENIEQRDIKLRTPLMAATHANQIEVAKYLIEQGANVNARDAIYDSPYLYAGARGLQEILALTLAHGADLNSINRYGGTALIPAAERGHVATVKTLIDAGVDVNHVNRLGWTALIEAIILGDGSQKYADIVTLLIDGGADVNLADGSGRTPLTLAKDKGYTNIINILQQAGAK

SEQ ID NO: 4782 - protein, 154 aa, Proteus mirabilis
CFYISLYLKYEERKMKIETIKKLSKQRRKFYIGSSLNITHINRQLAFLTPILDDAIDKIKYAQQKQVILSPIKETAQIFEYVKNNNKKKAAIYALDYLIFCFSHGCCTIKKFIRRELMFLLERIKHFIAYELKEIIQPSTFFCFNFLKALKKHL

SEQ ID NO: 4783 - protein, 360 aa, Proteus mirabilis
IIYMKNQKTNRFFVYGIIIVAIIAAGIFWWKTQAPALPDGFAQSNGRIEATEIDISTKTPGRIDTILVKEGDFVKAGEVLATMDTRTLKEQLHEVQAQLEQAKSSVMTAESALSQRQSEQVAAQAVVRQRIAELDASVKRLNRSRALVKTKAISIQQLDDDIARTEGARAAVEAAKAQVTATIAAIDSAKSGIIQAKTKVDAATATERRIMAELDDSILKAPRNGRVQYRVAEPGEVLGAGGRVLNMVDLSDVYMTFFLPTEAAGKAALGSDVHIILDAAPHIVIPAKTTYVASVAQFTPKTVETDNERLKLMFRVRARISPELLEKHLEYVKTGLPGRAYIRLDNSQPWPTDLEVKLPQ

SEQ ID NO: 4784 - protein, 66 aa, Proteus mirabilis
SIYIVFYIQNYFYAYHYSPYQLQQCVLKLTHINIFICNEQAYDPRKTRRSPNPIWRLCNPLSRLQY

SEQ ID NO: 4785 - protein, 438 aa, Proteus mirabilis
DLILIQGWNLQQVSKIHNVYRKSLHNYNKANFHKISDKDNITMRKLNPYFGEFGGQYVPEILIPALDQLEQAFIDAQNDPSFQQEFQDLLKNYAGRPTALTLCRNLTQGTRTRLYLKREDLLHGGAHKTNQVLGQALLAKRMGKTEIIAETGAGQHGVATALACALLNMKCRIYMGAKDVERQSPNVFRMRLMGAEVIPVHSGSSTLKDACNEALRDWSGCYERAHYLLGTAAGPHPYPTIVREFQRMIGDEAKAQILAREGRLPDAVIACIGGGSNAIGLFASFIPETSVQLIGVEPAGKGIETGEHGAPLKHGKLGIYFGMKSPIMQTEEGQIEESYSISAGLDFPSVGPQHAHLNSIGRADYVSVTDDEAIEAFKTLSRREGIIPALESSHALAYALKLIAQNPDKEQLLIVNLSGRGDKDIFTVNDILAARGEI

SEQ ID NO: 4786 - protein, 397 aa, Proteus mirabilis
NDNMFSKKSRSTTALLFSSLILTIGRGATLPFMAIYLSRQYKLPVDDIGIAMSISLTTGIVFSLAFGMLADKFEKKRYMVFSIITFIIAFSAIPMVNSTILVVIFFSIINCSYLVFSTVLKAYFSETLSISAKPKIFSLNYTFINIGWTVGPPIGTLLLMYGTQLPFWLAAISASIPLFMIQCFVQRSVVDHSTEENSVKWDPKIMLKDKALGWFVLSTFFGTLTFGTFASCISQYLLVVYDAKLAESAIAVILPVNAAIVVSLQYIVGKQVVAERLRKLMTLGTLFFILGLAGFMLAGDNLIFWAMAIAIFTFGELIYAPGEYMMIDNIAPLGMKASYFSAQSLGWLGAALNPLASGYILTTLPPISLFAILMGIAVLAWLCMLQGMNYSEKRIAA

SEQ ID NO: 4787 - protein, 524 aa, Proteus mirabilis
EENMMSVKINHNDISSLQILRISQGEKTKDVMSLWDKIKDWFQSNKREKALKTVENIVYQDLFDDKNHFKMLYHVLMLKTMASDAYKERIKIDINDNDKNITISIDNYNISITDIDNEQLNKMSTIINAFNRHSSIFSNEIALKCLYEKLDKNELNDQIFAELYIELDNKIRSGEIDLKLNKSNFNQVNFSAIRQLVSKAIENDNTNLDTENDNINLENDNINLENDNINLENDNINLENDNINLENDNINLENDNINLENDNINLENDNVNLENDNVNLENDNVNLENDNVNLENDNVNLENDNINLENDNANLNIKKALIKDINRNTYIFNGKEIKSKDQDKAMKEFETLTKDISEENKKAIYYLLNQEGITLIKSYNDSFDYYTLTTSFSMSNIVKQEQIYSIKTLSDDLIELKIKFFKKSSDKINLDIPLAQPFESKLYNFIYDMVAINNNIEITYDKILNEKMKEIIKQLDNKKPRIGELFSHLLSRNKIIKEDSVDITLKLNKGQLVSLGGECSYNFY

SEQ ID NO: 4788 - protein, 203 aa, Proteus mirabilis
LMNIASLLEQIADKGWCVWDDFLTPEAVKQLRACFGNDAQQARIGRHENLLAETTIRSDKIRWLEPQMGEPVQHYLMQMEKHSRAVNREFFLGLFEYEAHFACYEKGAFYKKHLDAFKENVTRRLTTVLYLNDEWTPQDGGELVIYDLDDNQLATVAPQGGRLVVFLSEQFPHEVLPTHKERISIAGWFRVNGVRDNFLDIAS

SEQ ID NO: 4789 - protein, 317 aa, Proteus mirabilis
CYDIVNYDYFSGAHTMQNVLLTLWPLFALIALGAILRRNKAFEPAFWVGTEKLNYFLLFPALLLNSLANAPLSDPQLPHLAGAIFSVVIITTILCVIFKKITGWSAGRFGAIVQGNIRFNTYLGLAIVADLFGVEGLGIAALILATLVPLSNVTSVLCLTAGQNVTFRQLIFPIIKNPLIISCVIGIVINLSGIGLPFGSDQFLKLLAATSLPLGLICIGAALHLSTLKAESKMISINTVTRLLIVPIIAYSVANFLGLSPLVMMLLVIFFSIPTAPTSYILTRQLGGDSELMAGIITAQTMLAAITLPIVLSFLIP

SEQ ID NO: 4790 - protein, 329 aa, Proteus mirabilis
QGDIVSNEQSIQRLRRLRQSENLRALFQETTLSKNDLALPIFVEEGLEDYQPIKSMPGVVRIPEKRLAYEIERIAKAGIKTVMTFGVSHHLDETGSDAWKSDGLVSRMSRICKDAVPEMIVMSDTCFCEYTSHGHCGVLHGEHVDNDETIHNLGLQAVAAAQAGADFIAPSAAMDGQVAAIRAALDKAGFTDTGIVSYSTKFASALYGPFRDAAGSRLIGDRKTYQMNPMNRREAIRESLIDEQEGADMLMVKPAGAYLDIIRDVRERTLLPLAAYQISGEYAQIKFAALAGAIDEDRVVMETLGSIKRAGADLILSYFALDLAERNLL

SEQ ID NO: 4791 - protein, 100 aa, Proteus mirabilis
IKSINLYFASTARLVKTFMQNYINIILQCLFLLSLLLLHNRGIFFLYLSSPKKKYAIIITYSLLIFWLSYLIACNTYLMLYNIQHMAISDIFRILNGITF

SEQ ID NO: 4792 - protein, 125 aa, Proteus mirabilis
IIFIGLRINRVNGMEKFTQELLRLDNFILRILRYYIIGTVFFFLGLLPGVLGFYFIEGHTFMESSLNAISMLSGQPVEPAPATPTGRFFIAIYGLFLQCVFILSIGLVVTPFIHRQLHKWHLEED

SEQ ID NO: 4793 - protein, 311 aa, Proteus mirabilis
GCFMSDKSQRTEKLQKILARSGHGSRREIEGYLQEGRISIDGVKAKLGDRIDANSTAKIRLDGRILSIREAQKDVCRVLAYYKPEGELCTRSDPQGRPTVFQRLPRLNSARWIAVGRLDVNTSGLLLFTTDGELANRLMHPSREVEREYAVRVFGEIDDAKIRQLTRGVQLEDGPASFRSVSYRGGEGINQWYNVSLTEGRNREVRRMWEAVGVQVSRLIRVRYGDIDLPKGLPRGGWVELGLNQINYLRQLVELNDETVTKVAVEKDQRRIKANQIRRAVKRHTKISARTSTSPAKRASSRRQSAGSKSK

SEQ ID NO: 4794 - protein, 188 aa, Proteus mirabilis
ANIMNELLHTRKIMRFLLWGMLLFSGYTVFFTKDATAELANTNIVIKANIVANTCRVSPDSLNKFVDLGVWGTKDFQQKNTTEPVKFTLNLTDCSIVTSGVKVMFSGDTDSKDSTLFKLAEKNAAQNIGIAILDKNQNKILPGKSSMIYPVETTNNISLDFYAQYIATNKDVVGGSANGEVLFSLEYL

SEQ ID NO: 4795 - protein, 344 aa, Proteus mirabilis
GDIMIKNNDLPAFMTQVVITEPGGVDKLQLENSPLPSLPPHYMLVKVNAAGVNRPDIFQRQGSYPPPADASPILGLEIAGEVVKLGEHCTKWAIGDRVCALVAGGGYAEYCLVHEDIALPSQGLSDIEAAALPENLFTVWANLFQLGQLKAGESVLIHGGTSGIGSMAIMLAHNLGCEIYTTVGSKEKAEVAQKLGANHVINYREKDFATEIPVLTQGKGVDVILDIIGGDYVEKNYQVAAKFGRVIQVGMMKGAPKNLNMMPLMLKRLIHTGSTMRSRTPEEKTHIAQELKQQVWPLIIKGQIKPIINAVFSLQEVAKAHQLMESGDLIGKVVLEIDMNKSLV

SEQ ID NO: 4796 - protein, 146 aa, Proteus mirabilis
YFPMTEQQSLPNGELVLRTLAMPADTNANGDIFGGWIMSQMDIGGAILAKEIALGRVVTVSVTGITFLKPVAVGDVVCCYARCLKTGNSSITVNIEVWVKKVATEPVGQRYRATEAVFTYVAVDENNSARRLPEGKTNFTLASTME

SEQ ID NO: 4797 - protein, 97 aa, Proteus mirabilis
LIPILCSLEAKAICCIKSLTWLMVVTISDMERPASLTCCDPTCTLFTEWVISSFISLAASALRLAKLRTSAATTVNPRPCSPALAASTAAFNERILV

SEQ ID NO: 4798 - protein, 535 aa, Proteus mirabilis
VFVLLISNNITMQFGSKPLFENISVKFGGGNRYGLIGANGSGKSTFMKILGGDLAPTSGNVFLDPNERLGKLKQDQFAYEEFTVLDTVIMGHAELWEIKQERERIYSLPEMSEEEGLRVADLEVKFGEMDGYTVESRAGELLLNVGIPLEQHNGPMSEVAPGWKLRVLLAQALFADPDILLLDEPTNNLDIDTIRWLEQTLNERNSTMIIISHDRHFLNMVCTHMADLDYGGLTVHPGNYDEYMLAATQARERLLADNAKKKAQISELQSFVSRFSANASKSRQATSRAKQIEKIQLTEVKASSRQNPFIRFEQEKKLFRNALEVENIAKGYEANAPLFKDVNMMLEVGEKVAILGTNGVGKSTMIKTLVGELTPDNGRVKWSENATIGYYAQDHATDFEVDMTVFDWMSLWMKPEDDEQSVRSVLGRLLFSQDDIKKSVKVLSGGEKGRMLFGKLMMQKPNVLIMDEPTNHLDMESIESLNMALELYQGTLIFVSHDREFVSSLANRIIEITPEKVTNFQGTYDEFLAKKGIDG

SEQ ID NO: 4799 - protein, 79 aa, Proteus mirabilis
KLAIMAISAAVSRSASSKIINGDLPPSSIVTSFKLDEEALAITFFPVSIPPVNETLAISGCCVSHCPTVASPVTTLNTP

SEQ ID NO: 4800 - protein, 122 aa, Proteus mirabilis
RIAIMINTLTKKQATRTLLFSLFLGLSVSSFSSVAASTNVTINGNGYDNVLDKEQARQMKEDWDQKRDLRNKINQREKTEFNKIDKAIDERDACLKSANIYAYWEPETRRCLDSNTGRPINP

SEQ ID NO: 4801 - protein, 281 aa, Proteus mirabilis
EKAMNKAPLIEVDNLCIDFPRARVVNNVSFQLGQERLALVGESGSGKSMTARSLMGLVRKPGKVSADKLHFMGDDLLAYSPKQWNQLRGKTISMVLQDPRYALNPVKTIYQQVEETVKLHQKLSHKERHALITETLLSVGLPEQSISRYPGELSGGMGQRAMIAIALINNPTVLIADEPTSALDAQLRHQILELIITQCAQRDMALLLISHDLPLVAEYCDRVMVMYQGEQVDELEAKALPQATHPYTRTLWTCRPNASTYGTQLPVLDRTLNFKGTPYAN

SEQ ID NO: 4802 - protein, 214 aa, Proteus mirabilis
IIYISADNKNIMEQQVITDISLSARIIGAAFYYPPTEKSDIVELLSSGKWLTEWPYGSEEEKQRIASLLAQTTYQDETLAQAYQRLFIGPYALPAPPWGSVYLDHENVLFGDSTLDLREWMLENGIDIALTQNEPEDHFGLMVMMVAWVAETRPEKLTELLAEHLLPWAYRYLEKLSLQGAFPYYEGLAMLATLTLKSWQSLLSITPVEKQLFC

SEQ ID NO: 4803 - protein, 213 aa, Proteus mirabilis
TYCIIKLFIKGKTMKIKNHIRLLSALLVISSSMNVLADNSKTTEKKNNNIINFSGTVISTSCNIDSPSSPITLPTINKSEIVLDKDWANAKSSTGSNFEIKLLDCGNNNATLTFNGTDLAGENKIMKNKSITNNSAKGVGIFIRSDEGNKNIIHLNGNQAITKRIENKTATYKIHANYASYLPKSTSGTVNTSVNLPLNILNLKNTGLFYYEG

SEQ ID NO: 4804 - protein, 153 aa, Proteus mirabilis
LRCIARSQVSKSESANSVLIVSISSAGSTLPATCTILSFSKQRTTWPIASVSRILVRNWLPKPSPLDAPLTKPAISTNSIVVGNTRCGFTISANLSKRGSGMGTTPVFGSIVQNGKLAASIPALVKALNSVDFPTLGRPTIPHLNPINVHLVT

SEQ ID NO: 4805 - protein, 307 aa, Proteus mirabilis
KMSIPKEQYNFNKLQKRLRRNVGQAIADFNMIEDGDKIMVCLSGGKDSYTLLSILMNLQKSAPIQFSLIAVNLDQKQPGFPEHILPEYLEQLGVEYKIVEENTYGIVKEIIPEGKTTCSLCSRLRRGILYRTATEVGATKIALGHHRDDILETLFLNMFYGGKLKGMPPKLMSDDGKHIVIRPLAYAREKDIERFAQAKNFPIIPCNLCGSQPNLQRQVIKEMLRDWDKRYPGRIETMFRATQNIVPSHLCDTQLFDFANIKQGDEIINGGDLAFDKDDIPTSPILSDDEDERPDFSQARLDVVEVK

SEQ ID NO: 4806 - protein, 216 aa, Proteus mirabilis
FVSIMNQAKRIEILTRLRDNNPHPTTELRFNSPFELLISVLLSAQATDVSVNKATAKLYPVANTPQAMLELGVEGIKSYIKTIGLFNTKAENVIKTCQILVDKHHGQVPENREALEALPGVGRKTANVVLNTAFGWPTIAVDTHIFRVCNRTKFAPGKNVNEVEQKLLKVVPAEFKVDCHHWLILHGRYTCIARKPRCGSCIIEDLCEYTEKTDPQ

SEQ ID NO: 4807 - protein, 112 aa, Proteus mirabilis
FIGMTMNQPTLISEEEALEQAYDLFLAQAADNLDVADQLLFNLQFEERGAAEVVTLGNDWQFIVGLPVSSARFSEVIIGLAPDENADIDDIFGRVLISRDPLQPMYHIIWKS

SEQ ID NO: 4808 - protein, 255 aa, Proteus mirabilis
TRGIIFCLGEIRSVMRFKLWVFISLCLHASLVAAAILYVVEDKPIAPEPISIQMLAFAADEPVGEPEPVVEEVTPPEPEPVVEPEPEPEPEPIPDVKPVIEKPIEKKPEPKPKPKPKPVEKPKPPVERPQQQPLALNKGNEMKNLNPNATPSNKGEEKPVATTSQGEGKVPNVLRQGLPIYPPRAKAVGIEGSIKVRFDIDADGRVDNVEILSANPKNVFEREVRKAMRQWRYEKIPYKGKVVIIDFNIDGVSAS

SEQ ID NO: 4809 - protein, 510 aa, Proteus mirabilis
FLLILFFGQNRASCYDVKNVRISRGSFMSKHHNPEIQKIINELKQQYQNAVDALRNAIIMYAQDGKLPDIKQRAEGLFAYPQLTVHWYGDVKKEDKTRAYGRLSKSGTYSTTITNPTLFENYLTEQLQLIADAYHVSFEVTASKQEIPYPFVIDGTGIGFDRSMSASLAKYFPTTDLSKIGDDITDGLIDDSELLPLSHFDALRTDFSLARLKHYTGTLPEDVQPYILFTNYNRYVDEFVRWACAQVADKNSPYCVLSCAGFQQITADTVDPEKLISDLTWKKYQMPAYHLIAKEGPGITLVNIGVGPSNAKTICDHLAVLRPHVWLMIGHCGGLRESQLLGDYVLAHAYLRDDHILDAVLPPDIPIPNIAEVQRALYDATKAISGKPGHEIKQRLRTGTVVTTDDRNWELRFSATSRRFSLSRAVAVDMESATIAAQGYRFRVPYGTLLCVSDKPLHGEIKLPGQANHFYEGAVSEHLQIGIHAIELLKDEEDKLHSRKLRTFNEPPFR

SEQ ID NO: 4810 - protein, 228 aa, Proteus mirabilis
LLLISDVLFSSDKYSLMPDKINPNELCNRFRGYYPVVIDVETGGFNAKTDGLLEIAAITLKMDEQGWLKPDNTLHFHVDPFEGANLEPAALEFTGIDPTNPLRGAVSEYEALHAIFKMVRKGMKDANCNRAIIVAHNANFDHSFVMAAAERAGLKRNPFHPFATFDTAALSGLVLGQTILAKACITAGIPFDSKLAHGALYDTNRTSLLFCELVNRWKKLGGWPLPTP

SEQ ID NO: 4811 - protein, 285 aa, Proteus mirabilis
ARLMNYKQWLHQAALQLIDSDSPKRDAEILLGHVTKRARTYLIAFSETVLLEDELVQLSSLLARRIKGEPIAYLVGEREFWSLPLKVSPATLIPRPDTECLVEKALEKLSAQASRILDLGTGTGAIALAIASERSDCRVLGVDFQPEAVALAIENAQHLALSNVEFTESCWFSSLSGYQFDMIISNPPYIDEEDEHLYQGDVRFEPLTALVAADHGFADIELIITNARQFLANNGWVLIEHGWQQGERVRNIFIDKGYCCVETFRDYGGNERVTVGRWNDDRNHS

SEQ ID NO: 4812 - protein, 125 aa, Proteus mirabilis
RELISQFLLMLKRLNMLAQFEWWHGAFLLLAVVLEIVANIFLKMSNGFSRWGLGILSLLCVLGAFSSLAMAVKGIELSVAYALWGAFGIIATIAAGWILFNQRLNYKGWSGIILLLVGMIMIKFA

SEQ ID NO: 4813 - protein, 100 aa, Proteus mirabilis
PLLIYSKGYYNFLITSGISLLANFVSLPVGIKYCPLGERFHSTIFILSLLISAMRHPSGSKTIICPPVALKYVLGSPINGNLPLQSSGFVDTLIFTHCIR

SEQ ID NO: 4814 - protein, 869 aa, Proteus mirabilis
VKVIMGKALVIVESPAKAKTINKYLGNDYVVKSSVGHIRDLPKSGSGSQKSENSSATKGVKKVKKDEKSALVSRMGVDPYNGWHANYQILPGKEKVVAELKALAEKADHIYLATDLDREGEAIAWHLREVIGGEDDRFSRVVFNEITKNAITQAFQTPGELNIDRVNAQQARRFMDRVVGYMVSPLLWKKVARGLSAGRVQSVAVRLLVEREREIKAFVPEEYWQLHASLLTPDEQPLRMEVTHYQDNAFKPVSSEETQVAVKALQNATFIVKNREDRPTFSKPSAPLITSTLQQAASTRLSFGVKKTMMLAQRLYEAGYITYMRTDSTNLSQDAIQMARDYIHDKFGAKYLPKEPNVYSSKENSQEAHEAIRPSDINVTAESLKDMDSDAKRLYQLIWDQFVACQMTPAKYDSTTLTVVSGDYKLRAKGRTLRFAGWTKVMPAMRSKDEDKTLPAVDVGAQLALAELSPTQHFTKPPARFSEATLVKELEKRGIGRPSTYASIISTIQDRGYVKVENRRFYAEKMGEIVTDRLEENFSDLMNYDFTAQMEDHLDHVANNQENWKAVLDAFFTDFSQQLEVAEKDPEEGGMRPNPMVITSIECPTCSRHMGIRTATTGVFLGCSGYALPPKERCKQTINLIPEDELLNILEGDDAETNALRARRRCPKCGTAMDSYLIDTHRKLHVCGNNPACDGYEVEEGEFRLKGYEGPVIECDKCGAEMHLKMGRFGKYMGCTNEECKNTRKILKSGEIAPPKEDPVPLPELPCEKSDAYFVLRDGAAGIFLAANTFPKSRETRAPKVAELVRFKDRLSEKMRYLAQAPVTDPEGNPTIVRFSRKTKQQYVSSEKEGKATGWSAFYIDGKWVEKSK

SEQ ID NO: 4815 - protein, 138 aa, Proteus mirabilis
HYSIIFQVTMDGMMKKVIFVSAISGGILFWSIHLQADNFDCRNAETQTEINQCAYQDFQQKDEELSQIYQQYYAKLETKRQQQLQHAQSVWMTFRDLSCQYEADYYQGGSLAPMVYSSCLKDKTIERINDLKNYIALY

SEQ ID NO: 4816 - protein, 211 aa, Proteus mirabilis
KCSMYFLGLENMPKIGMQSIRKQQLIQATLAVINEVGMQDASIALIARKAGVSNGIISHYFRDKNGLLEAAMRHIQYQLGFAVAMRLRILSDAEPKLRIQAIVDGNFDTSQTSETAMKTWLAFWASSMHQPNLHRLQKVNDRRLYSNLCYEFGRALTKDKARLAAKGLAALIDGLWLRSALSEEPFSLAEAKKITDEYIDMQLNLCQDKQT

SEQ ID NO: 4817 - protein, 205 aa, Proteus mirabilis
IFSIGIGTLDSYQTGGNTMSLINTPIKPFKNMAFKDGQFVEVTEKDVEGKWSIFFFYPADFTFVCPTELGDLADHYEEFQKMGVEIYSVSTDTHFTHKAWHSSSETIGKIKYGMIGDPTGALTRNFENMREAEGLADRGTFVVDPQGIIQAIEITAEGIGRDAADLLRKVKAAQYVASHPGEVCPAKWKEGDATLAPSLDLVGKI

SEQ ID NO: 4818 - protein, 264 aa, Proteus mirabilis
HISIFLFVMSKLMIPEKRVVRRIQSGGCAIHCQDCSISQLCIPFTLNEHELDQLDNIIERKKPIQKGQTLFKAGDELKSLYAIRSGTIKSYTITEEGDEQITGFHLAGDLVGFDAIINTEHPSFAQALETSMVCEIPFETLDDLSGKMPNLRQQMMRLMSGEIKGDQEMILLLSKKNAEERLAAFIYNLSRRFAQRGFSPREFRLTMTRGDIGNYLGLTVETISRLLGRFQKSGMLSVKGKYITIEDSEMLSELAGKLPSSTEA

SEQ ID NO: 4819 - protein, 123 aa, Proteus mirabilis
LEAIIMTMQSKSLYRLPQEGMIRGVCAGLAHYFNIPVLLVRVIAVIALFAGFFGLTIVVYLVLSFFMEPAPDNYNQHQEQQEDLKAILKEVDSQLTKGEKRLQQMERYITSSTYQLNKRFQDL

SEQ ID NO: 4820 - protein, 309 aa, Proteus mirabilis
ERAMLKFIFRRFLEAIPTLFILITISFFMMRLAPGSPFTGERKLPPEVMANIEAKYHLNDPIYKQYFDYLIQLTKGDLGPSFKYKDYSVNTLVGKAFPVSAKLGLSAFVLAVIFGVGAGVIAALNQNTKWDYTVMTFAMTGVVIPSFVVAPLLVLIFAITLRWLPAGGWNGGQIQYMLLPMVALSLSYIASISRITRSSMIEVLHSNFIRTAKAKGLPMKRIVLRHALKPALLPVISYMGPAFVGIITGSMVIETIFGLPGIGQLFVNGALNRDYSLVLSLTIIVGGLTILFNAIVDILYAVIDPKIRY

SEQ ID NO: 4821 - protein, 374 aa, Proteus mirabilis
GFKIMEKPQIHTDIPKILFTVLFISFFIIGSFWILNPFIVGFIWAGMIVVATWPLLIILEKRVKYRWLSTMIMMILILLIFVIPIILLISSVIDNSAPLIELAKSPSDIQPPQLLWLKEIPMVGNTLYETWHSILVSGGNALMAKIQPYIGQAANWFFAQALNIGRFALHLVVMLLFSGLLFLQGENVVAWLRHFAVRLAGQRGDAAILLASMSIRAVALGVVLTALIQAVIGGIGLGISGVPYATVLTVLMFICCLAQLGPLFVLVPSILWLFWTGDTTWGIVMIIWGGIVATMDGVLRPFLIKMGADLPMVLILTGVIGGILTLGMIGLFIGPVVLAVAHSLLNAWINEVPKPDPDLTETVEFMNKNFIEKE

SEQ ID NO: 4822 - protein, 408 aa, Proteus mirabilis
KIKMTLKNSTQSKTPSLFMVYLACLSMLGYLAIDMYLPAFGMMQRELSISEGAVSNSLSIFLFGFAVAQLLWGPLSDKLGRKPILLIGLSFFSLGCLGMLWVDSAAGLLTMRFLQAFGVCSAAVIWQALVIDRFDESRAQHVFASIMPLVALSPALAPLIGAFLLNHGGWRMIFMLLMAITLVLMLPTLMLKNIKQKSVIDAGPSTVSFLTLLKSPIYAGNVLVYASCSAGFFAWLAGSPIILEKMGYSPQDIGLSYIPQTIAFMVGGYGCRILLSKMSGKTLLPLLLIGYAVSMTALFLVAKYTHPTLTTILIPFCIMAVMNGASYPIAVSNALSAYPEVSGKAAALQNALQLGLCSLASFIVSAFISQQPLINTTAIMALTAIPMALGYFIQRNKSVSKHTVQATE

SEQ ID NO: 4823 - protein, 60 aa, Proteus mirabilis
NNKIYSKNSLTISTLKRVKFEDAIESITNNGEYIAFIMLNAVAINLSLMLLFMIIKKERS

SEQ ID NO: 4824 - protein, 337 aa, Proteus mirabilis
YIKMKYIIILIYLLSFHCYSDEPYKSFSNNCVYDDITDNGFIPVHNIRFKASDIDLGVDIGQPIAEMSFTDAALSTSILHCKDKVDLKLIINARHYKDDIFKTNIPGVGFKISANKTPFNLVGDEFNVTPEYANVCNAQTRKEGYKNIYCTDSWPRLYIQLIKISEIVLEPLSDIFVMDDFLVYTLDNKKFTYNNLIIEKPQNKVCELNIEQPNIELAPVEKNSLSDSIPANETHFSIGVICNQDTLVSLKLDAPAIYKSRNTNLLTLLNNGTPSGVGLSIKYNDNKYYLGNVIYNSVHRTPSTEYTFPFSVGYVKMSENILPGKVTSQINVNLEYK

SEQ ID NO: 4825 - protein, 181 aa, Proteus mirabilis
RIKMKFNFLLSTSILVVSTLSFNAYATLENTVSIGYAKSKLKVDEDLINDNLKGINLKYNHEVANDWGVISSFSYAKNKNDGYDHWGYAGTSKISYYSLTAGPSYRLNNYVSAYGLIGFGYFHEDFHYYDEREKENKISMAYGLGVQVNPITNLAIDVSYEYSKLYDIDFTTWVVGIGYRF

SEQ ID NO: 4826 - protein, 513 aa, Proteus mirabilis
EGKIMRIGIPKERLSNETRVAATPATVTQLLKLGFTVAIENEAGIASSFDNDAYQQAGAEILDCQNIWQSDIILKVNAPLEDEIALLKKGSTLISFIWPAQNAPLLEKLAEKEINVMAMDSVPRISRAQSLDALSSMANIAGYRAVVEAAHEFGRFFTGQITAAGKVPPAKVMVIGAGVAGLAAIGAAGSLGAVVRAFDTRPEVKEQVQSMGAEFLELDFKEEAGSGDGYAKVMSKAFIDAEMALFAEQAKDVDIIITTALIPGKPAPRLITKEMVDSMKPGSVVVDLAAQNGGNCEYTVPGEIFTTEHGVKIIGYTDLAARLPAQSSQLYGTNLVNLLKLLCKEKNGNINIDFDDVVIRGVTVIKAGEVTWPAPPIQVSAQPKAAPAAKPQEKPVAKPISPWKKYGLLAIAFLLFAWLANVAPKEFLSHFTVFALSCVVGYYVVWNVSHSLHTPLMSVTNAISGIIVVGALLQIGSGGWVSFFSFIAILIASINIFGGFTVTQRMLKMFRKG

SEQ ID NO: 4827 - protein, 112 aa, Proteus mirabilis
ILEINNFSLNFEYISERKIFCHSIGYELFLLRQRNSMTGAELGKLLNISQQQISRYERGINKIPIDILFHILNIFDISISDFFEKVSKRVITLKYKIKYDSDNNIPFFENII

SEQ ID NO: 4828 - protein, 274 aa, Proteus mirabilis
VVGMMIETIADYEFNKAPLVKGMILISQAIRPDFPVTSVGYQLAQLVEQAEAEIPHQASIQERIDALLKLFYKQWHFSGASGKYCLSDTLWLDKVLATHIGSPVSLGSILIYIAQAINLPLAPVIFPTQLIIRIDIPNEKPLFLNPINGEYLSRHTLDVWLKGNVGSTSELSASDLEESEHSSIIRKLLDTLKVSLMEEKRMEQALKTSETVLLFDPEDPYEIRDRGLIYAQLECNHVALSDLNYFVEQCPEDPISEMIKIQIHSIEQHPVVLH

SEQ ID NO: 4829 - protein, 337 aa, Proteus mirabilis
GGGIMPLLDIRNLTIEFMTPDGPVKAVDRVSITLSEGEVRGLVGESGSGKSLIAKAICGVTKDNIKVTADRFRFDDIDLLKLSPRARRRVIGHNVSMIFQEPQSCLDPATKIEHQLIQAIPGWTFKGHWWQRFHWRKRRAIELLHRVGIKDHKDIMRSYPYELTEGECQKVMIAIAIANQPRLLIADEPTNAMEPATQTQIFRLLTRLNQNNNMTILLISHDLQWMSKLASKITVMYCGQTVETAIPEELLVTPYHPYTQALIRSIPDFTNSLPHKSRLNTLPGAIPSLEHLPVGCRLGPRCPYAQRQCIEAPRLRAFKNHAVACHFPLNVETTDVR

SEQ ID NO: 4830 - protein, 75 aa, Proteus mirabilis
DLLINMEQLLTKTEMPEWFSYPREFLRIVEQNLLNFDPWIILEGERLRVRFGGLKKDTQQIEILFLLPIGKIMMM

SEQ ID NO: 4831 - protein, 80 aa, Proteus mirabilis
NILITIMIIIIITSISIAIEMNKNVHNLNDSSITRETSSPVIQSINSIELLGKSGVVYIQHNGELYQLRQTKTGKLILTK

SEQ ID NO: 4832 - protein, 415 aa, Proteus mirabilis
KGMMTHSIEKARDDFPILSQQVKEKPLVYLDSAASAQKPACVMEREKQFALTQYAAVHRGIHTLSANATTLVENVRKQAAHFLGAKSEEEIVFVKGTTEGINLVAYSYSHRFLNDGDNIIITEMEHHANIVPWYMLAKQYGFHVRVIPLLANGQLDLAQLPQLIDNRTKLLAITHQSNVLGTVNPIAEIICQAREYSAQQGGELHILVDGAQSAMHQAINVSALDCDFFVCSGHKLYGPTGIGLLYGKKALLDELPPWEGGGAMIKHVHINGDITYADAPWRFEAGTPNIIGIIGLGAALEYLAQFGMDKIAAYENSLMQYAQQQLTKVKSLTLYGNEARQGVIAFNLGKHHAYDVGTFLDNYGIAIRTGHHCAMPIMDYYQVPAMCRASLGLYNNKADIDALVNALLRIEKLLG

SEQ ID NO: 4833 - protein, 70 aa, Proteus mirabilis
VRMMLLFLKRLFLFVIFTIGISALTGCIRLEVATPEKPININMNVKIEHEINVKIDRQVEDLLKNNSAIF

SEQ ID NO: 4834 - protein, 87 aa, Proteus mirabilis
GGMMNSTLIPTTVKTNKLTKWAKKGVTFALMLLTLFGPAAITGGILKRVSYKPLRWLVLLIAEPMIKMGLDKLSRHVSWEKHETLTK

SEQ ID NO: 4835 - protein, 338 aa, Proteus mirabilis
LIVIEADRLISADIQQPEEEIIDRAIRPKLLAEYVGQPQVREQMEIFIQAAKLRHDALDHLLIFGPPGLGKTTLANIIANEMGVNLRTTSGPVLEKAGDLAAMLTNLEPHDVLFIDEIHRLSPVVEEILYPAMEDYQLDIMIGEGPAARSIKIDLPPFTLVGATTRAGSLTSPLRDRFGIVQRLEFYNVDDLQHIVARSASFMGLEITAEGARQIAMRSRGTPRITNRLLRRVRDFAQVKGNGEIDEDIASKALDMLNVDAAGFDYLDRKLLFAIIDKFMGGPVGLDNLAAAIGEERETIEDVLEPYLIQQGFIQRTPRGRVATNHAYRHFNRIMEAP

SEQ ID NO: 4836 - protein, 66 aa, Proteus mirabilis
LVVIPCNPCTILFGNLNFLITTQFVCLTTLANLSILICLKVAYIKTKKVAKATLENILTIVCDTFD

SEQ ID NO: 4837 - protein, 117 aa, Proteus mirabilis
YRTISIIINKDTDCICADGIFCCLFSQIKVKIFDIIMISIMLIDPFHMFAVIMFSTIGNNFHPVLAYYRLKFILRVRKQELSNPNREAFNTIIINNLMGKVDVRNVVNVIKRKMRCC

SEQ ID NO: 4838 - protein, 61 aa, Proteus mirabilis
TSKITAIILFSLLRISRITRKIINVSIPIEMLLCTECRVEMKLVSLLSNDIFKSTCYLLYL

SEQ ID NO: 4839 - protein, 337 aa, Proteus mirabilis
IRKIVKENMMTNSTNKPLLSVKDLCVTFGTPDGDVTAVNKLNFELSAGETLGIVGESGSGKSQTAFALMGLLAKNGRTAGSAHFNGREILNLRQSQLNKMRAEEISMIFQDPMTSLNPYMKVGTQLIEVLMLHKGMSKNDAYAESVRMLDAVKMPEAHKRMGMYPHEFSGGMRQRVMIAMALLCKPKLLIADEPTTALDVTVQAQIMTLLNELKKELNTAIIMITHDLGVVAGICDKVLVMYAGRTMEYGNARDIFYQPSHPYSIGLLQAVPRLDGEDERLATIPGNPPNLLRLPKGCPFQPRCQYATEQCLNSEPQLTQFAQGRLRACFKAAEELV

SEQ ID NO: 4840 - protein, 286 aa, Proteus mirabilis
MGWINVSNQDSTQQKNIYRPAPPRLVQVKRIVDITPGMRSITFTSDDLDNYPSHTGGAHLKIFLPVEGQTKPTIPTLTDKGPSWPENQPRAIVRTYSVRAIRPELKELDIEFAVHEDAGPAINFALNAKVGDYIGITNPGGPDPLLAPASHYYMAADPSSLPALMALIETMSPDVQGKAVIRIENESDRQIIDAPQGLEIVWLVGSVETQTQPLIDEFISWSLPKEDVAFWIAGEDKIIRALRRYIRRDKGYERGQIYAIPYWRFGFNEEGYHAERHHVMDNEDVS

SEQ ID NO: 4841 - protein, 451 aa, Proteus mirabilis
VVRIWFCFRFWFFVLNVIAKSSAGYPYSRINDTEALYMFSEERRQEIYSIIREQKKVKVAQLAERFNVTLETIRSDLKYLENEGLIKRCHGGAILGKQEIKKISKFSDSFDISCLLHDLLIVKEHKKKTPEGKVCVLGSFVVDIIANVDAFPRVGELVNSKGNSIGPGGKGTNQAISASFSDAKVHLITKVGEDHFSKYAYKYLQESGIDSFTIFQTEIEPTGSSISYLADKTQNNITATYLGANNTFTLQEVDISLPYISEADVLLLQGEINIDANVKAASFAHSINKTVILNVAPYSDDLKQLYLYVDFITLNAYQASDWSGIEINTINDAKQAVEIIAGNEKKKVIIYIDELGVVYFDGRNTFHIPPLPSLRVDTMAATDAFNGAFASKIAAGGTMPESVLFASAFLSAFIEQKGVTSMPSLSQVQARLKLRIEDIRPQVICNEKRCI

SEQ ID NO: 4842 - protein, 221 aa, Proteus mirabilis
MYRIRMNNNRALLCLEKIGFQLDSKIILDNVTFSLQPSEFKLITGPSGCGKSTLLKIIASLLSPTSGTLFFDGKDYLTLSPEQYRQQVSYCTQTPMLFGETVYDNLKFPYLLRKIAVDEKKLAKDLDYFNLPNEILNKGINELSGGEKQRISLIRNLQFLPKVLLLDEITSALDEDNKIKVNELIHHYVKEQKIAALWVTHDQNEIKHADDVIHLPSHMNN

SEQ ID NO: 4843 - protein, 679 aa, Proteus mirabilis
RRRITLMFNLFSLFKKDKIWDFKGGIHPPEMKLQSSRTPMRIAQLPDEVTIPIHQHLGTPGQLCVKVGDHVLKGQALTRGVGRTLPVHASISGTVTAIEPFPSTHPSGLPEIAVKIVSDGKDEWREKSPLVDYQSQSKEVLLTRIHEAGIAGLGGAGFPTATKLKGGGDLVKTLIINAAECEPYITADDRLMQEHADEVIAGCQILMHILSPDEVLIGIEDNKPEAIAALKQALAALTNEKRIFIRVIPTKYPSGGAKQLTKILTGKEVPSGGRSSDIGVLMQNVGTVVAIKRAIIDDEPLIERVVTVTGQGTKTPGNFWARLGTPIYALIKQAGFVAGSEQMVIMGGPLMGFTLPDLNAPVIKITNCLLIPSPEEMDTDNIEEACIRCGQCVDACPSGLLPQQLYWFSKGKEHEKAQQHNLFDCIECGACAFVCPSNIPLVQYYRQEKAEIREIDAEAKRAAEAKARFEAKKIRMEREKLEREARHQRAAVKLDDHQQNEVQSALSRVKEKHSIGKIIAVKAGEQPDNAAAIAARKKRKEEARAKQAAKLAQQVPQNTHTTADAESDPRKAAVAAALARVKAKKAQQAQATTKVDTPAETPAEVETDPRKAAVAAAIARVKAKKAQQAQATAKVDTPAETQAEVETDPRKAAVAAAIARVKAKKEAQQRHAKEEVTLD

SEQ ID NO: 4844 - protein, 189 aa, Proteus mirabilis
RSYFYIEGNMKYSLIYSIVLFFTLSFTAYSNDRENISLDDGIVTFKGGIVEPACTVSSESEYQIVDLGVISSNQFHGVGSHSIKIPFFIKLMGCNKSITDKVSIIIIGDVNNNDKRLFSITDQQNSASGLGVALFNDEGEIIIPNKFNKYKFIEENELKLKFKASYLATKENVIGGKADSVVWFVFNYQ

SEQ ID NO: 4845 - protein, 276 aa, Proteus mirabilis
SLFVVLKGTICPIDLVYLYRSSFMPTPARTIYRDSLNFYKNEQRSIITLSAVLALILSVIYLLVGPNAQESQIINDFIINFQKTRFADVSPAELEAMNNSVIGVFQKVLLVYVFELFQQSILVLVILMLAMALSAGHNVTLNQTFNASLPRLPKMFLLILLCSILISAGFMLIIPGIILLVGFALAPVVLVRQQSIGSAIRLGWKMGFGESGALIPALGIWILLQFGIGFLSNITGELPNMIHKFLYYFLKNITSAWMIIYLFRLFMLTENKYITK

SEQ ID NO: 4846 - protein, 176 aa, Proteus mirabilis
KDIVMPTPCYISIEGKTQGNITAGAFTADSVGNIYVQGHEDQMLVQEFSHVVTVPTDPQSGQPSGQRAHKPFRFTVALNKAVPLLYNALASGEMLPKVELKWYRTSVEGKQEHFFTTTLTDATIVNIDCQMPHCQDPAKADFTQLIEVSLSYRKIDWEHTVAGTSGADDWRAPLEA

SEQ ID NO: 4847 - protein, 197 aa, Proteus mirabilis
KAIVSKIKLIVGLANPGADYAQTRHNAGAWYVDLLAQRHQQSLKEESKFFGYTARINLNGNDVRLLVPTTFMNLSGKAVLAMANFYRIQPDEILVAHDELDLPPGVVKMKLGGGNGGHNGLKDIQSKFSNNPNFYRLRIGIGHPGDKNKVVGFVLGKPPTSEQKLIDDAIDEALACTDILMRDGYEKAINRLHSFKA

SEQ ID NO: 4848 - protein, 212 aa, Proteus mirabilis
GTVVQSPAANTPLILVSPRGSTTISPILLRSTVPSNHCVFGSKPIWTKIPAKAISCIESLVRSLYFSPVNLVPSPYTSVVWAFKITSTLLKLRSFFCKTASALISEANSSTVTCSTKPAKSIAASTPELPPPITATLLPLNRGPSQCGQYVTPRVRYSFSPGTFIFLQRAPVAIIKLRVFKIAPDAVSIWCRSPSAAPGIKRLTVWLSMTST

SEQ ID NO: 4849 - protein, 261 aa, Proteus mirabilis
LLSVLRIERGGMAKLEICCFGAECALIAERSGADRIELCTSPSEGGVTPSYGILKQVIDLVRIPVHPIIRPRGGDFCYSQADFAAMKNDISMIRDMGFSGAVVGILNEEGHIDLPKMAILMELAGPLAITFHRAFDMCINPLLALDQLTQLGVARILTSGQQANAELGLPLLRTLNEKTQGPIIMAGAGVRLSNIQKFLDSGLQEIHSSAGKQAPSTMNYRKAGVTMSSDSEVDEFTHYCVDEDVVGAMKDIMSIYTTSVN

SEQ ID NO: 4850 - protein, 293 aa, Proteus mirabilis
SVYVMKNILSIQSHVVFGHAGNSAAEFPMRRMGVNVWPLNTVQFSNHTQYPEKWTGCVMSAEHITEIVDGIAAIGKLAQCDAVLSGYLGSAEQGRRIVDIVKKVKQANPNAWYFCDPVMGHPEKGCIVPPEVSGVLCEDALPISDIIAPNLLELETLAGGATLHNVDQCVKAARQLCQQGPKIVLVKHLSRAGFRHDRFEMLLVTADHSWHVSRPLVDFGERQPVGVGDLTSGLMLVDLLKGVELKTALEHVAAAVYEVMLKTKEMNEYELQLVAAQDQMVHPTHNFCATQLD

SEQ ID NO: 4851 - protein, 360 aa, Proteus mirabilis
FHCVLLTLKEAFVEYILQYGLFLAEIATVVVAIIAIVSFFVVIGSKKQHRKGTLKVTDLAESYHDKQRVMQQAKMDEAELKVWHKAFKKQQKKEQKLSKNNAKEGRKGVVKPCLYVIDFKGSMDAHEVGALREEISAILSVAQAGDEVLLRLESPGGMVHGYGLAAAQLTRLKDKGIKLTAVVDKVAASGGYMMACVADKIVAAPFAIIGSIGVVAQIPNIHRLLKKNDIDVELHTAGEYKRTLTLLGENTDEGREKFKQDLNETHLLFKSFVHKYRPELDIDSVATGEYWYGTDAVDKGLIDEVGVSDDWLISRINDFEVLSVQYILKKKMVERVTGGAMESVDKLMMRWLQRGKNPLL

SEQ ID NO: 4852 - protein, 96 aa, Proteus mirabilis
VLFFLVTRMPLSKTRWFMTKYVIFSFFLVLIYPLGVDLYLTGLTAIASDLNASEVTLHHAFSIYLMGMVSSMLIAGWCSDNLGRKPVILFGTLIFS

SEQ ID NO: 4853 - protein, 152 aa, Proteus mirabilis
GNNVEMTQAFWQTKTLDEMSDDEWESLCDGCGQCCLHKLMDDDTDEIYFTNVACNQLNIKTCQCSNYEDRFRYEPDCIKLTRYNLPTFEWLPMTCAYRLLAEGKPLADWHPLIAGNKAKMHQGNISVRYIAVPEVEVEDWEDHILNRPKGRG

SEQ ID NO: 4854 - protein, 228 aa, Proteus mirabilis
QVNVYIMYSKSMGVTVWLEQFGVLNIWTYLAGMFFIIIVPGPNSLYVLKTSASRGVGAGYRAALGVFIGDAILIFLAFIGVASVIKASPVLFTIVRFLGAFYLLYLGIKIIHANFFAKKQSHTETNCIQEHVFRKALTLSLTNPKAILFYISFFVQFIDFNYAHTGLSYLILASMLEAFSFVYLSFLIFGGVALARFFGSRKNIAKLGNGIVGLFFMGFATKLATLSS

SEQ ID NO: 4855 - protein, 62 aa, Proteus mirabilis
ATRFFYILLHAYTFIHYNKTEGRKERHMLIWRKIILKQTYSNDKCLIINERYDVFQPQNFDK

SEQ ID NO: 4856 - protein, 479 aa, Proteus mirabilis
NHLVTNVIIISKGNFKMNKKTPSYSSLDDVYASVDLSQSLPKTHFPQQESHPRHVFDAVRDELMLDGNSRQNLATFCQTWVDDEIRDLMNLSIDKNMIDKDEYPQTAEIENRCVHMLADLWHSPDPLNTLGCSTIGSSEAAMLGGLALKWQWRKKRLAAGKATDKPNLICGPVQVCWHKFARYFDVELREIPLEGDRLMMSPEEVIKRVDENTIGVVPTLGVTFTCTYEPVKAVHDALDQLQKETGLDIPIHVDGASGGFLAPFCAPDLEWDFRLPRVKSINSSGHKFGLAPLGSGWVVWREAKDLPEELIFNVNYLGGNMPTFALNFSRPGGQIIAQYYNFLRLGREGYAKIHNACYHTAQYLAREIEKLGPFEMIFSGDSQKGIPALAWKLKKEAKVSYSLYDIADKLRSRGWQVPAYSMPADRQDLVIQRILVRHGVSLDLATLLIEDMKRTLDYFEKHPVSTPLSEEDGGGFNHS

SEQ ID NO: 4857 - protein, 457 aa, Proteus mirabilis
LLSLDHIQNYNLILNKDGSMSYFDKIEQIQYEGTTSDNPLAFRYYNPDEIILGKRMEDHLRFAACYWHNFCWNGSDMFGIGTFDRPWQTPGEALEQAKRKADVAFEFFHKLNVPFYCFHDVDVISEGNSINEYITNMAAITEVLAQKQQETGVKLLWGTANCFTHPRYGAGAATNPDPEVFAWAATQVCEAMKATKTLGGENYVLWGGREGYETLLNTDLRQEREQIGRFMQMVVEHKHKIGFQGTLLIEPKPQEPTKHQYDYDTATVYGFLKQFGLEKEVKVNIEANHATLAGHSFHHEIATAIALGILGSVDANRGDPQLGWDTDQFPNSVEENALVMYEILKSGGFTTGGLNFDAKVRRQSNDKYDLFYGHISGMDTMAMALRIAARMIQDGGLDKFIAQRYAGWSAKLGQNILQGKLSLEEVAKYAQSNTLAPRLQSGRQEMLESLVNRYIFG

SEQ ID NO: 4858 - protein, 232 aa, Proteus mirabilis
NNLVYKFNDNRFLSVMKNGWLKQLLDFAPLLVFFIFYKWQDIFYASGALIVATWISVGLTWLIFHKVEKAPLITAIVVTIFGTLTIAFHSDVFIKWKVTAIYAIFALVLIAMQLFTPKTLMERMLGKELAMPATNWKKLNIAWVLFFLACALGNLYVAFSLSQETWVNFKVFGLTILTLIFTVISVVYIWNNRLPEEETKEESTESHTSETSDNGTTSTSKVLHKDVTSKSE

SEQ ID NO: 4859 - protein, 230 aa, Proteus mirabilis
NKTVTPYNILIVEDEKEILRFVRLALENEGFRVYDASECQRGLIEAASRKPDLVILDLGLPDKDGLCFIQDFRQWSSTPIIVLSARDSEQDKVDALDAGADDYLTKPFGMSELLARVRASLRRFVKQETETTQFTFGDITIDWVKRIVTRQGVPIHFTPTEFRLLSELVNNSGKVLTQRHLMQHVWGPNFVEHSHYLRIYMGHLRQKIETDPTCPVHLITETGIGYRFMP

SEQ ID NO: 4860 - protein, 309 aa, Proteus mirabilis
VRQVLYGILLKIRCITEDKQGEGMTELLSDLRVIYDLHSHTTASDGELSPDELIDRAIEKQITVLAITDHDTTAAIQPAKNYIAEKSLPLTLISGVEISTLWENIEIHIVGLQIDIEHQAMTTCLAKQSQCRETRAKMIGERLAKAGIAGAWEGASALAKGGQVTRGHFARFLVNEGHVASVNKVFKRYLAKGKTGYVPPQWCSIGDAVTAIHQAGGVAVLAHPGRYGLSSKWLKRLVLYFKQQGGDAIEVAQCQQPPQEREQHAALAQAYDLKASLGSDFHRPCSWIELGRNLWLPANVEPVWTLWQG

SEQ ID NO: 4861 - protein, 91 aa, Proteus mirabilis
RAQVNTEEISEKKNITLYVKKLHHLDYKEKGMKAGRYIGVMSGTSLDGVDVVLAAISNKLVAQQANHFLPYPQTLRQRILAVCQGPTCDVA

SEQ ID NO: 4862 - protein, 419 aa, Proteus mirabilis
GVKVSQDNNYSQGPVPISARKGGLALTFVMLGLTFFSASMWTGGALGTGLSFNDFFLAVLIGNLLLGIYTAFLGFIGSKTGLTTHLLARYSFGIKGSWLPSFLLGGTQVGWFGVGVAMFAIPVGKATGIDINLLIAISGILMTITVFFGISALTILSIIAVPAIAILGSYSVYLAVHDMGGLNTLMAVKPAEQLDFNLALAMVVGSFISAGTLTADFVRFGRNPKIAVIVAIVAFFLGNTLMFVFGAAGAASLGMADISDVMIAQGLLLPAIIVLGLNIWTTNDNALYASGLGFANITGLSSKKLSVVNGIIGTLCALWLYNNFVGWLTFLSAAIPPVGGVIIADYLVNRARYNQFNADKMQNVNWVALLAVAIGIAAGHWLPGIVPVNAVLGGAISYAVLNPILNRRTARQAEISHAG

SEQ ID NO: 4863 - protein, 214 aa, Proteus mirabilis
HQKVVEGYMSQLFYIHPDNPQARLIEQSADVLRKGGVVIYPTDSGYAIGCCLDNKDAMTRICRIRQLDKHHNFTLMCRDLSEIATYAYVDNVVFRLIKNNTPGNYTFILKATKDVPKRLMNDKRKTIGLRVPSNPIALALLENIGEPLMSTSLILPGNDFAESDPEEINDLLGKQVDLVIHGGYLGQKPTTVIDLTEDSPVIVREGMGDITPFQ

SEQ ID NO: 4864 - protein, 237 aa, Proteus mirabilis
PGKVCNEFNARRVRIYNDLKSFILQEKEIPKKHTSGVINNSIHVYYDWGKSQYLTALYQAANKNCSHINMMRFSKDNFEEIPDYDGNTLILSSDKIISEKFSLIHQVKNKYLGICCQQILAQKAQENINTLLKENIWLCDPALYKTAKIKKLENEIADQGKPVSIRLMDDLNCCLNFIQTHHSLLFTDENPIKSEDEKQLCFIPLTQTELIYNCYIYKSKYHSSILNRFVDLIKELE

SEQ ID NO: 4865 - protein, 348 aa, Proteus mirabilis
RSGVFHTMATIKDVAKRAGVSTTTVSHVINKTRFVAENTRAAVWAAIKELNYSPSAVARSLKVNHTKSIGLLATSSEAPYFAEVIEAVENSCYSKGYTLILCNSHNNLDKQKAYLAMLAQKRVDGLLVMCSEYPDHLLSLLEGYRNIPMVVMDWGKARGDFTDTIIDNAFHGGYIAGRYLIERGHRDIGIIPGPLERNTGGGRLQGFLKAMEEAKITVKEEWIVQGDFEPESGYKAMTQMLNQKQRPTAVFCGGDVMAMGAICAADELGLRVPADISIVGYDNIRNARYFTPALTTVHQPKERLGQMAFSMLLDRIVNKREDAQTIEVHPRLVERRSVADGPFIDYRR

SEQ ID NO: 4866 - protein, 323 aa, Proteus mirabilis
PYLVITGHPIRGSNTLISRRYPVKNLGIPCGNSCRTYYRTSWWTLFSLAYFTTTSRTHVMMENQHTPLLYGNNLSYKIGNKTILEDVSIALNTGELVTIIGPNGAGKSSLLRLLTGYTPPTQGECFFKGKTYSQWNSQLLAQNRAVMRQNSQLSFSFSVEEVVAMGRAPHGQKHKQIAIETALLQTNCLKLKTRDYRQLSGGEQQRVQLARVLAQLWQPTPENVALFLDEPTSALDLYHQQQSLRLLKQLVKTQNLMVCCVLHDLNLASLYADRILLLHQGKLVCEGTPQDVLTAENIEKWYGAEVSVNTHPELSQPQVFLRP

SEQ ID NO: 4867 - protein, 286 aa, Proteus mirabilis
LCLVVVVLNNWVFIVIITNIIRSVIMIELLLPGWIAGMLLAMAAGPLGSFVVWRRMSYFGDTLAHASLLGVAFGLLFNIEPFYAVIAVTLLLAILLVWLELKPQLSVDTLLGIMAHSALSLGLVVVSLMANVRVDLMAYLFGDLLSVNYQDVISIFIGVVIVLLVIIRSWRPLLSMTINQDMAFVDGVNIQRERLKLMMITALTIGLAMKFVGALIITSLLIIPAATARRFSRSPEQMAVIAVAVGMFAITGGLTFSAFYDTPAGPSVVLAASSLFVLSLLVPAKQ

SEQ ID NO: 4868 - protein, 103 aa, Proteus mirabilis
LIMVVKKYYSDNPTEMIYQLTGMVIPLKNLRAWLIGLPGDATDFELDANHLLKSVTWPTPEGDWVVTYQSYDTAITPNLPQRLELKQGERTIKLKMDNWDIQQ

SEQ ID NO: 4869 - protein, 579 aa, Proteus mirabilis
GNPVNIQAFLSEKISMAMSAAGAPADSEPLVRQSAKVQFGDYQANGVMGAAKKMGIPPRQLAEKILEHLDITDIADKVEIAGPGFINIFLSPVWVAQQAEFALADEHLNITKVTPETIVIDYSSPNVAKQMHVGHLRSTIIGDASARTLSFLGHNVIRANHLGDWGTQFGMLIAYLEKKQNENAADMALADLEEFYREAKKCYDEDEVFAERARNYVVRLQGGDEYCRTMWRKLVDITMQQNQLTYQRLNVTLTEDDIMGESLYNPMLPGIVADLKAKGLAVESEGATVVFLDEYKNKEGEPMGVIIQKKDGGYLYTTTDIACAKYRHEQLHANRVLYYIDSRQHQHLMQAWTIVRKAGYIPDSMSLEHHMFGMMLGKDGRPFKTRSGGTVRLTDLLDEAHERALTLIREKNPDMDEEELNNIARVVGIGAVKYADLSKNRTTDYIFDWDLMLSFEGNTAPYMQYAYTRVASIFKRAEIDESALTQPISLTQPHEKQLALRLVQFDETITQVAREGTPHVMCAYLYDLAQSFSGFYENCPILSAEDDNVRQSRLKLARLTARTLKQGLETLGIETVDRM

SEQ ID NO: 4870 - protein, 202 aa, Proteus mirabilis
EYKVYPMSDAQHQQRQQRLKEKVDARIAQAQREQGILMIFTGNGKGKTTAAMGTATRAVGHHKKVGVVQFIKGTWENGERNLLEQAGVPFYVMETGFTWETQDKAADTQACLNTWQYALQLLNSPDYDLVVLDELTYMISFHYLPLEDVVAAITSRPDHQSVIITGRGCHRQLIELSDTVTEMRPIKHAFDSGIKAQKGIDW

SEQ ID NO: 4871 - protein, 315 aa, Proteus mirabilis
LNKVIEMSKYDAIQRFNLCFQQLETEINALTDFLRQLKQLPSAVFELPEVSKEDEHDEITNVTVSPSYDLDALELSLKLMTNLFIYDNAPHVSSKRAIRLPGVLCFSVSNPVFKNVKTQVESINSLKKQLSDIVTKESGISKEERFDFVHNQLKGLITLNAYRTLTLLSDPDTVRFGWANKNIIKNLTRNDVLAQLEKSREANRAVPPYTSEQWAERIDKEIMTLSQLPENAKLKIKRPVKVQPIARVWYSEQQKQVQYACPLPLLAFYIDKESDFKPIIGELADYDVNNIQIRHRPKAKKLQLIIPRLHLYLEK

SEQ ID NO: 4872 - protein, 243 aa, Proteus mirabilis
ILKVHLMLIDIHHLRVQFEQNRQIKQVVKGVNLQVKQGETFSLIGRSGCGKSTVLRVIAGLLHHWQGDIKLLGQAIKPQQRFQGKLRRNIQMVFQDPYASLHPQHRIERAFIEPLKIHHIAYDKTTITSALEQVGLEGDIAYRYPHQLSGGQRQRVAIARALLLQPQLLLLDEPTSALDMSVQAEILNLLNTLKKQHNMTYLLVSHDADVIAHMSDSAALMEEGQLTCYYDRKALSQGLHRLD

SEQ ID NO: 4873 - protein, 140 aa, Proteus mirabilis
NVEVFMIDKIMTYVNKLTEVGVFNNYKSTNYISDVSNTPAVYNTNIKQFSLNNVNNYVYLGSTNSPLLNNMGITLDDDGTLMLIKGKTYDLFTGLIQKYFNGGFKYNVFHINSQHGDDIKFKELYVDYNGFLIGSKRDSS

SEQ ID NO: 4874 - protein, 132 aa, Proteus mirabilis
RSEVQMKITHLDHLVLTVADIEASCHFYHNVLGFEIITFKQGRKALAFGHQKINLHQLGKEFLPKAAKTTAGSADLCFITETPLLDVIEHINQQGINIEEGPVPRTGATGPIMSVYLRDPDNNLLEIANIIE

SEQ ID NO: 4875 - protein, 94 aa, Proteus mirabilis
FVEVIMKKARFTETQIVNILKLADSGMKVEDICRQNGISNATYYNWKSKYGGMETNDIKRLKELEDENAKLKKLFAEVSLENHAMKELFAKKGW

SEQ ID NO: 4876 - protein, 65 aa, Proteus mirabilis
LFLLYLKPDRVLVAFFGLLKLEMYHGHHFQNADELIDKIEEYIEYYNTKRIKVKLKGLTPVEYRN

SEQ ID NO: 4877 - protein, 63 aa, Proteus mirabilis
KNLFSSFYLYTVIYKLCINIQLDSFHQKITKHNNNPLIQIIKMIICSQKNLVLQLHYSFHHLF

SEQ ID NO: 4878 - protein, 63 aa, Proteus mirabilis
KLLFNYFLTHSKSQKIGLFMAKGRLNNLYEKSKNESFFCLRHYYCCNYCSRYFLVENTSTSTP

SEQ ID NO: 4879 - protein, 142 aa, Proteus mirabilis
VFLFISFISAFFIFKLALSFSKLILSFSKLTLSFSKLTLSFSKLTLSFSKLTLSFSKLTLSFSKLILSFSKLILSFSKLILSFSKLILSFSKLILSFSKLILSFSKLILSFSKLILSFSVSKLVLSFSIALLTSCLIALKLT

SEQ ID NO: 4880 - protein, 570 aa, Proteus mirabilis
SILFLILMTETEEITMVYDYIIIGAGSAGNVLATRLTEDPDVTVLLLEAGGPDYRFDFRTQMPAALAYPLQGRRYNWAYETEPEPHMNNRRMECGRGKGLGGSSLINGMCYIRGNAMDFDEWAKLPGLEDWNYLNCLPYFRKAETRDIGANDYHGDSGPVSVTTPKKGNNVLFHAMVEAGVQAGYPRTDDLNGYQQEGFGPMDRTVTPHGRRASTARGYLDQAKSRKNLTIETHATTDIIEFEGKKASGVRYFKGTNTTPQHVKARKEILLCAGAIASPQILQRSGVGPEDVLNEFDISPVHVLPGVGQNLQDHLEMYLQYECKQPVSLYPALKWYNQPKIGAEWLFKGTGIGASNQFEAGGFIRSSEKFAWPNIQFHFLPVAINYNGSNAVEVHGFQAHVGSMRSPSRGRIKITSRDPHQHPSILFNYMSTEQDWQEFRAAIRITREIMAQPALDPYRGEEISPGKDIQTDEQLDAFVRERAETAFHPCGSCKMGNDEMAVVDGAGRVHGIERLRVIDASIMPNIITGNLNATTIMIAEKMADKIKGIKPLPASQADYYVAGHSPARRN

SEQ ID NO: 4881 - protein, 104 aa, Proteus mirabilis
EKLFIPDEYNVILLLGIIFRLINKRYKGKFTMNEKFKTQADVETLAQEVACLKTLVTYMLKALGQADAGRVILNIERAISEVADEQQAETFRNTLNQIKTAYRQ

SEQ ID NO: 4882 - protein, 249 aa, Proteus mirabilis
MIIFITGASAGFGEAIARHFINHGHKVIGTARRLDKLQALHQELGDLFYPLQLDVTDKKAVSEIYHQLPEQWRSIDVLINNAGLALGLRPVDKANLDDWDTMIETNNKGLVHVTRALLPSMVERNVGHIINISSTAASWPYMGGNVYGATKAFVKQFSLGLRADLQGKKIRVTDIEPGLVGGTEFSLVRFKGDTDKVEQTYAGADALTPEDVAQAVFWTATLPAHVNINTLEMMPVSQSFAGLSVHRQN

SEQ ID NO: 4883 - protein, 70 aa, Proteus mirabilis
SLILSAKTTLLLSKIKDVFTLFFIEIAVFFLIFNILLAFFIIDGQFDIFNITSWFSFDLLLSIMYSQLVS

SEQ ID NO: 4884 - protein, 833 aa, Proteus mirabilis
LKILKIKKYIGRESMSMSRLSLQPQRNLFMSKISFRLKTSLLLILNAYPFFSIANNNIHSLYKSVLSNIDNKTIGKLLNNEHPDGYYSTNIYINENKKETIILYYENKDGILTPRINVNDLIRLNIDPSFYNIPIDLSSDLLLSDYNIDFKYNFSSQSLYLTIPQKALDNKKNMLASQVLWDDGVPALFSSYSYFGKYNNQNKIEHKISFNSGANLGAWRVRSKSYYHHTDKQQQFKLYSLYAYHQLNTLLATLNVGEFRPTSRMLSTDKLIGFQLISSNLLSGNDLYMNSPIIEEIAESHAEIKVKQQGRTIYETIVPPGPFILNDLPVIGSNELVLEIKEADGRIRKSTHYFTTMPNQLKKGRYQYNFISGYSYDRYNQFNNQNNNPIFLLGEFSYGINQKITAYGAIRKKLNSNTFFSGLSLDLGRWGGVASDISYFEHNNLLKYQLRYNKRWSNIGTSLNISSSHYQSIKSDSVSIRKSQTDNIKNSYTISLFQPIKSFGTFSIGYHQNSYAKRKNDFTINTSLSSSIKKMNYSIKYQYKNEKYYNDNHFSLNFNIPLTNSSQSYHWVSNQFDYHPNNKGYINSTTIGGSLLEHYRLGYSINYRRDFSHPNAGYHTSVNTQYKGRYQSYSINTTKSSNNKTNLRLGINGAIVLHQSGVTLAPDLGNTFAIVNTNGIAGIKTNRSSQAITDNNGNLILPHIMPYRKNTIGLNINSLPEFSNTKTQSKIIVPTLGAVAKINFPINRGYNVLFTSNTPIPFAANVMAFDDNNNLISSDSVYDHNRIFLSGIKESGTVQVKWGDTEEQQCFFHYNVKNESKNNSIIKKQIYCQ

SEQ ID NO: 4885 - protein, 68 aa, Proteus mirabilis
VLVLLNSGNEFMFSPIVFLRYGMMCGNIKLPLLSVMACEERLVLIPAMPFVFTIAKVLPKSGAKVTPL

SEQ ID NO: 4886 - protein, 803 aa, Proteus mirabilis
RIVLIMIKLSPISLLLLFTPYVYANALYLQAIENHNGNIDFSLLLNENFLEGTYNITIYINNNKKQNSEISFKNKNNNLTPIITLFDLKQWGINTNYYEPLKNKLDNDIVDYDLLKKLFNIKLEINKQSIYFKVPLIAIEKNTSYSKEKLDDGDNAAFIKYNYQGHYYKQNSLNGQHIHNLQLYNGINLFAWRYRQDLNYNNNNNSFSINQQYVYRTLRNINSILTMGDFYAYSPNLNTYKILGVQINSDNAMKDGSLVGYAPIISETAYTYAEVSIEQNGETLYSTSVPPGPFTLNNLPSLGTNGELVLIIKEENGEVRKKKIWNYSSQYLLRKNQWNYYYTMGLVNNPQKRQFPSNKKKELLTQLNLSYGVSNYLTTMIGAEKKGDDIKALIGNTLGLNILGIVSLENAWIREKYHQQYQSNKINYQKVFSMENTTISLNSSFYFRFKENYAVNKEYKKYDLGFHFSQSLNNNIALTLGYNIATYYHSKEKSQRLFINTSSNYKKLSYSLELENSKDQYSNNNQLSIFLNYPIGQDLSHWATARINYDNREKYFHENISFSGNTLENNRLNYNLDFSKNNKERLDSSMKINYLSRIAKLNINSRFNKDSYSLGYGLNGGIVFHNGGITLAQDLNDSFAILNFAGAKKVKIIGKPTIESDRRGYLIIPNLTSYHNNKFHIDAKSLDYNYNIDNYSYHLIPTKGAIIAKNIKVTKGESALFTFHQNIPFGATAYVKNSDGTLSDISYVNEDNKLYISNLPISGKIFVKWGSSNKQQCSFNYQLNDNEKQNRIYFKTVNCIKEE

SEQ ID NO: 4887 - protein, 166 aa, Proteus mirabilis
FEVFFTLYYEATMDNCIFCQIVAGKAPCHKIWEDEHHLAFLSIFPNTKGFTVVIPKKHYPSYAFDLSDEALALLIIATKKVAKILDKTFPDVSRTVMFFEGFGVDHVHSKLSPMHGTGDMTKWAPIENRQKIFFDNYPGYLSSHDFERANDEELAQLAALIRQNSQ

SEQ ID NO: 4888 - protein, 115 aa, Proteus mirabilis
KGVFMTAKIDPKAFFDLPFENGKDITDKELKAAYDAGHTFIHIDLSDAHFSPQITLFNGNELDRIRGGVIRIDNNSTKSTLVAEGPSKKPEQLKAGYYYHASGTTGWDIIVKPIK

SEQ ID NO: 4889 - protein, 551 aa, Proteus mirabilis
LGVFDKMINVTKKSALAIAIGTIFGFTALNATAAVVPDGVKLADKQELVRNNGSEPQSLDPHKIEGVPESALARDLFEGITIVGPDGEILPGSATSWENKDFTVWTFKIREDAKWSNGDPVTAQDFVYSWQRLADPNTASPYESYLQYAHIVNIDDIIAGKKKPTELGVKALDNNTLEITLSEAVPYLPKLLAHSSMSPVNQKVIEKFGEKWTQPANFVGNGAYVLKNWTVNERIELERSPTYWDNKNTVINKVTFLPISSEVTDVNRYRAGEIDMTYSNLPIEFFQKLKKEIPDELRISPYLCTYYYEINNEKAPFDDPRVREALKLSMDRDIITYKVKNQGDIPAYGFTPPFTDGIKESKPEWFASWTQEQRNEKARQLLEEAGYNKANPLKFKLLYNTSDLHKKVAIAASSIWKKNLGAEVSLENQEWKTFLDTRHQGNYDVARAGWCADYNEPSSFLNMMLSYSSNNTVHYKNKQFDAYMKESLRVKSDDERAEIYQKAEGVLDKDSAIVPLYYYVNTRLVKPYVGGYSGKDPLDNLHTKDLYIIAK

SEQ ID NO: 4890 - protein, 344 aa, Proteus mirabilis
LWVLLMNKALVGKKILIIDDEVVFRTMLTEYFSHEKACVYATDNGSQALLLLEEGLRPDLILCDIRMPVMNGPTFLCHLEQRHWSFPVIAISCTDNMAEIDDMLRFGAQDVFLKPVTNLAKLKQKVIEVLCPGFFESELIARGQLGPLWNNLREQPHYIQSFVKQMQPQVKQIVAGYNVNYRQLNDASQMGLLFDIATLSKDQIIFYCVDVSNDEENGLLVALLLRVVFNRFLKATEKRRFLPSMYNILNKINKMLEDMGVRGSFPLILGYYHTKEKNILLASAGLRAEIKTENKKYVLNSGIPLGTLHSLYINQIKCVGIDWQCKIWNQHHKINLMFSPIHKR

SEQ ID NO: 4891 - protein, 605 aa, Proteus mirabilis
SLSLAFVKLFIENFSQFVFFDNFGLASFLSYNSQIVYLKDIIMRPILLISTMLLASISMTCMAEIATKATELSVAQEPTNIHQNGFVYCVDGSVNTFNPQLSSSGLIIDPLAAQLYDRLLDVDPYTYRLIPEIAARWESLDNGATYRFYLRKNVSFQTTPWFTPTRKLTADDVIFSFERMFSANNPYNQVNGGKYPYFDSLSLADNIKSIKKLGKYTVEFNLKSPDASFLWHLATHYAPILSEEYASNLEKSGNQSQLDWKPVGSGPFYLDEFQPGQFVRLLRNEQYWKGQPKMQQVVIDTGAGGTGRISKLLTGECDVLAYPAASQLKVLRDDPRLRLTLRSGMNIAYLAFNTNKPPFNDLKVRQAIAYAINNERLMGSIYYGTAETAASVLPRASWAYDNRAKITEYNPEKSKQILKELGLEGLKLNLWVPSAPQSYNPSPLKMAELIQADLAQVGIQMNIRPIEGRYQETSLMDRTHDMTLSGWSTDSNDPDSFFRPLFSCAAISSQTNLSHWCSPAFDNVLQQALYSQQLASRIDYYHQAQDILAQELPVLPLANSLRMQAYRYDIKGLVLSTFGNASFAGVYREAEVDEDSHNQEATTNP

SEQ ID NO: 4892 - protein, 199 aa, Proteus mirabilis
AMSLEEKNIDKPRTKPAEVRLEELMNAAETLFLEKGFEATTVSDIVKQAGVAKGTYYHYFTAKTDILDALRTRYMDWYIDKVEQAMASCQLQDFRAKLKQWCETSVIAYVEKQELHDMLFHQVFHQSGNIHENRALQQLQTILMGGAENKTWQVLQPELTCTLIYHGMHAAVDNLEHSTEYTPQTLGALLYRQFTQLLS

SEQ ID NO: 4893 - protein, 61 aa, Proteus mirabilis
LIPFNSIHLLKIAIAYPFLHFRQQKTTYSPKQINQSIYLTKEVNAFSSLFSIISLKLIIPV

SEQ ID NO: 4894 - protein, 224 aa, Proteus mirabilis
LHTFQLDIILARLASLFYEAFSPFFNNFGIAMTDYLLLFVGTVLVNNFVLVKFLGLCPFMGVSKKLETAIGMGFATTFVMTIASISSWLMDTFILVPLDLLYLRTLSFILVIAVVVQFTEMVVRKTSPTLYRLLGIFLPLITTNCAVLGVALLNINQSHTFMQSAVYGFGAAVGFSLVMVLFAAIRERLAVANIPAPFKGSSIGLITAGLMSLAFMGFSGLVKL

SEQ ID NO: 4895 - protein, 536 aa, Proteus mirabilis
YQQLVQGHSVLRRFKMRLEVTCKDRIGLTRELLDLLVLKNIDLRGIEIFPIGLIYLNFSQIDFNIFQPLMAEIRRIEGVIDVRTVAFMPSEQEHRAMWTLLESVPVPVFSINTKGQIKLLNPATRHLFELDENDKNEKSFNQLIPNFNIHRWLEQKDPHAEIISIKLKKQHFDMEIVPIKLTDDNQFNHCVGALILLKYRGIIHEHPKLIVNDNSGFEQVIAVSTPMKQLVERAKKMAKMDDPLLLVGDTGTGKDLFAKACHLLSPRAREPFLGLNCASMPDDVVESELFGYAAGAYPNAIEGKKGFFEQANRGTVLLDEIGEMSPQMQIKLLRFLNDGTFRRVGEEHEVKVDVRIICATQKNLWELVQKGLFREDLYYRLNVLTLTLPPLRERKADIMPLALHFINQYCLEQKASKPVISPDLSAYLVQYGWPGNVRQLRNTIYQAMAQLVGNTLRPQDIALPEHTADTLFDEDLLEGSLDEMTKRFEASILRRLYRDYPSTRKLAKRLGISHTAIANKLREYDLTSKKADKTEK

SEQ ID NO: 4896 - protein, 688 aa, Proteus mirabilis
MNKFLEFLMTTLNSSKKPQKDKLNSVVFFASATLILAFSFFTILMTDTANAWIIKTLGWVSKTFGWYYLLAATLYIVFVIFVATSRFGNIKLGPEQSKPEFSVLSWSAMLFAAGIGIDLMFFSVAEPITQYMLPPTGEGETIEAARQSMVWTLFHYGLTGWSMYALIGIALGYFSYRYNLPLTIRSALYPIFGNRIYGPIGHTVDIAAVLGTIFGIATTLGIGVVQLNYGLKVLFDLPQGLGVQGGLILLSVIMAVISATSGVNKGIRILSELNVLLALGLILFILFAGDTEFLLNALVLNVGDYVNRFLGMTLNSFAFDRPTDWMNSWTLFFWAWWVAWSPFVGLFLARISRGRTIRQFVIGTLIIPFVFTLLWLSIFGNSALYEVIHGNQTFAETVLASPEKGFYSLLELYPGFGLTASVATITGLLFYVTSADSGSLVLGNFTSQLSDINNDAPNWLRIFWSIAIGLLTLGMLMADGVSALQNTTVIMGLPFSFVIFFIMAGLYKSLKVEDFRRVSSLNTNAPAPLYGNTTMNWKQRLGRVMNFPGTTYTQRMLDLVCTPAMQDVANELSLRGANVSFNLYPLEEEPRLNHLELVVDLGQEQHFIYQIWPQKYSVPAFTYRARRGKSHYYRLETYLWEGSQGNDLMDYTKEKVISDILDQYEKHLNFIHLSREAPGATLTFPESN

SEQ ID NO: 4897 - protein, 156 aa, Proteus mirabilis
LMKLKPQTNVLPEQSPKAPITGWLLAPLAYLLLSIVGLGLMSVLYLIRYFSDFSIIHQLPFHVVSSWYLSVLTTWAMFAFTAYLLRQFFYRAKNFPRLFIIWLLINLLLAIKSFGFAPVDDQTAVKSLLWAVMATVCFVPYIKYAKRVRETFTQDR

SEQ ID NO: 4898 - protein, 65 aa, Proteus mirabilis
ITKFINIQFNEILILTLKICVIRDIRYPSTKTLSGVLYCNVHLYTYLGAFYGGTSHWARVYGVFR

SEQ ID NO: 4899 - protein, 158 aa, Proteus mirabilis
  UNSURE (35): Identity of amino acid at the above locations are unknown.
LAELGFNVRCWSRSKKQINQVESFYGTDQLSDFVXECQLLINLYPYTPQTHGILNFSLFEQLKPSSYLINLARGAHLVDQDLLEAIDQGYIADASLDVFSQEPLPGMHPFWTHPRISITPHIAAFTIPDIAMDTIVENIQRIEKGETPFGVVDMKSGY

SEQ ID NO: 4900 - protein, 176 aa, Proteus mirabilis
IITSIIAISTVTNEVIMEGVQLRLAEPHEAKRLWYLRNKALRFGCQHVYPPDILATWTPDEMPDGYRQSIINNPFYVIDDKKLSIPVASGFLDLKTGFAEAIFTLPECMGKGYAGLILKQLQYEAKQRNFVQLFLDATPNAMLFYLKQGFTVLEEREYYSSLAQASLHCYRMYIDL

SEQ ID NO: 4901 - protein, 299 aa, Proteus mirabilis
IANSAKKKVRGMILSLNSINCDNNELVDRTVFFISDGTAITAEVLGHAVLSQFPLKMKSYTLPFVSSVERAEEIKNKINEIYKKSGAKPLVFYSIISPDVKRIINSSEGFCQDIVQSLVLPLEKEIGVQALPQLNKTHGLTEKNLSKYDARIAAIEYTLSHDDGISLRNLDQAQVILIGVSRCGKTPTSLYLAMQFGIQAANYPFTADDMDFLKLPPELKEYQHKLFGLTIAPERLAAIRSERRENSRYASIRQCRIELAEVEALFRKNNIPYLNTTNYSVEEISTKVIDSMGLARRMF

SEQ ID NO: 4902 - protein, 81 aa, Proteus mirabilis
LYNSVVSVEHRCYSVFFNKLTISDIRLDLEFNSFIISKAVIEGLDSIIFTTSFISLTRADSSTIDVRLLFSCRSPHISSAS

SEQ ID NO: 4903 - protein, 163 aa, Proteus mirabilis
NAFFSYFNRLFIKERKMNTLNYHSTENGFTLMELMIVIAIISILSSVAIPAYHGYIQKAALTDVLQTLSPYRSAVELCHYEHQYNQCHADASFMPQQFRSRYLTDIHVANGVISAKGKAQLEGLTIVMTPAANSKETLPQWQINCTSTNTALQTLCHKVFKSH

SEQ ID NO: 4904 - protein, 97 aa, Proteus mirabilis
HRCSTETTELYNQSVIHFWCLIRVLILYHLKIPELKSIKCSNDNLPSNLSPYSRFIVCMSNLNDIFLNLPDLFMGINLLSKKNLITFLCPSISSIFK

SEQ ID NO: 4905 - protein, 73 aa, Proteus mirabilis
NIGSGDLPTDEHLREIRWVLLSTLSMNYCIILIVESNLLSVNFVVCACFLNKSTLMLKKCDHGACLDRVKLVQ

SEQ ID NO: 4906 - protein, 80 aa, Proteus mirabilis
FYLSYPLLSSFHGKKVVLGANYFLKLRIIYNLCDNSAQSRIAAILLNKTAVNNNAYSVLCSKAVLIASGIELPCPFPVKR

SEQ ID NO: 4907 - protein, 80 aa, Proteus mirabilis
QMASIHGHEVLHMILSSKVAFTQRSLIEAIHQRFGEEARFHTCSAENMTAAELVAFLEKKGKFIAADGGFTTSENKICRH

SEQ ID NO: 4908 - protein, 684 aa, Proteus mirabilis
LQGFVMKFKISALTACILMTSYSLHAQEDKVERLVVSASGFAQQQTDAPASITVINKEQLEKKPIHDLADAVKGVEGVSVNGNANKQEITIRGLPGEYTLILVDGRRQNSRESRPNGSGGYEGGFIPPADAIERIEVIRGPMSSLYGSDAMGGVINIITKPVTKEWHGAVSMGGTLQHNRDAGDSINGDFYLSGPLIEDKLGLQLYGSSYLRAEDKITYGQGRNDNKNITAKLAFTPTDNQTILLEAGRNSLQRTTTPGKSMSEFTNRGGRLDKNKMLETNNDRNHWALTYKNQFDILHSELSVYQEQTKRVQKTEGVDKATGNSYKYYEDRRPEITNTVFDAKFTAFLPDNVMTFGGQYQYARLKDESSVGGKEVKQSTITADQKALFLEDEFSVTDNLALTGGIRFDDHEYYGKHWNPRAYAVYHLTDEFTIKGGIAKAFKAPSLREISPQYGTSTEKGRAIMYGNRDLKPETSVSQEIGVGYDNGDGFTANVTFFNTEFKDKLTNYDTGEIDPITGLKLYQYDNVGKANIKGIETAVAFPVADNWRVSANYTYINSKRKSDDEKLGSGESLKGYPLDMTPKHSANARVDWQYDEATSFYANTAYTGKQIWAAQRNGYTGARYRSGYTTFDLGMTYNFNKNTMLNLAVLNITDETGPAVNDKGGNWVVDEGRRYWANIKYSF

SEQ ID NO: 4909 - protein, 131 aa, Proteus mirabilis
KRESIDMVKSPAKKTTKGFEETLWDTANQLRGSVESSEYKHVVLSLVFLKFISDKFEAKRSQLIKNGQEAFVDMDVFYQQDNVFFLPQVSRWSYVQERAKQDDIAVIIDTALSTIEKSNASLTGALPEIQL

SEQ ID NO: 4910 - protein, 63 aa, Proteus mirabilis
KVAFNLIKYFQNRSQYSSFFSKKPIFWLIDFFQLVIYIAKITTNTITIKIKQMILFVDNAYSL

SEQ ID NO: 4911 - protein, 371 aa, Proteus mirabilis
KRAFMNNTIHTATEFIEQLLRHSLAQRVSDLHLEPQQNSLRIRARIDNHLVLFSPPDNQLANEILTRLKILANINIAEKRLPQDGQFNWSYQKNNYSIRVATLPTLYGEKIVLRLMNNLQQPQLAQLGFQTIHLTLLKKYLTQPQGMILVTGPTGSGKTLTLYSCLQYLNKDNRNINSIEDPIELPLHGINQTQITEKAGITFATILRALLRQDPDVIMIGEIRDQQTAEIAIKAAQTGHLVLSTLHTNSTQATLARLANLGIAKDLIDSCVKLIISQRLVRCLCSNCKYPSPEQKNFIINNQQIILPNWQATGCQFCYSGYKGRTAIYDCFELAKQSHPSPYALFNSGIELIKKGITSLDEVYQVVGDIE

SEQ ID NO: 4912 - protein, 180 aa, Proteus mirabilis
KDLTVPIIKKTISGVDLRASFYLTSQSLGYPSNKQAILMADIATLIAKWRNGLEVEIYTENYEFRYGRIKSSRFNASGEESVYYATYFHTRAKPKDNDPFLIITFDPVVGQDDFMFIETIIDHRTYFGSPGAGKTKSHIERRSSDLKRRIENGKKISSEPSSSVQNVNKNNNDSPDQENK

SEQ ID NO: 4913 - protein, 127 aa, Proteus mirabilis
GAYTMDYEFQRDLTGGILARFSMDHEAIGYWLNDEIQGDISLIDQILTEMDEVKGSEKQWQLIGKEYSLSIDDEEIMVRANTLHFETDDLEEGMSYYDNESIAFCGLDDFATMLQKYRLFILENRRS

SEQ ID NO: 4914 - protein, 66 aa, Proteus mirabilis
INITLTKIIIKTPFFIKNTNKIDRFKDLLIIVLLLIKIYFLHLMRHILNLCFRTNRCGVNSLIPYI

SEQ ID NO: 4915 - protein, 897 aa, Proteus mirabilis
KQITDKEYTMSDMLKNDVDPIETRDWLQAIDSVIREEGVERAQFLIDQVLKQARNGGLDIALGGSVHSDYINTIPVEDEPAYPGNLELERRIRSAIRWNAVMMVLRASKKDLELGGHMASYQSSATLYEVCFNHFFRAHNDNDGGDLVYFQGHISPGIYARAFLEGRLTEEQLNNFRQEIGGKGLSSYPHPKLMPEFWQFPTVSMGLGPLSAIYQAKFLKYLDHRGLKDTTKQRVYAFLGDGEMDEPESKGAITIAVREKLDNLCFVVNCNLQRLDGPVTGNGKIVNELEGIFAGAGWNVIKVMWGDRWDALLRKDTSGKLIQLMNETLDGDYQTFKSRDGAYVREHFFNRYPETAALVKDMTDDEIWALNRGGHDPKKVFAAFQKAKETKDKPTVILAQTIKGYGMGETAEGKNIAHQVKKMNMDGVKHFRDRFNIPVSDEKVAELPYITFDKDSEEYKYLHARRQELEGYLPARRTRFDEKLEIPTLEDFSQLLEEQSKEISTTIAFVRALNVMLKNKSIKDRLVPIIADEARTFGMEGLFRQIGIYSPNGQQYTPQDREQVAYYKEDVKGQILQEGINELGAGASWLAAATSYSTNNLPMIPFYIYYSMFGFQRIGDLCWAAGDQQARGFLIGGTSGRTTLNGEGLQHEDGHSHIQSLTIPNCISYDPAFAYEVAVIMQDGLERMYGDKQENVYYYITTLNENYHMPAMPAGAEEGIRKGIYKLESLEGAKGKVQLLGSGSILRHVREAAQILSTEYGIGSDVYSVTSFTELARDGQDCERWNMLHPSEEPRVPYIAQIMNDAPAVASTDYMKLFAEQVRTYVPADDYRVLGTDGFGRSDSRENLRHHFEVDTSYVIVAALGELAKRGEIDVKVVEEAIKKYNINPEKVNPRLA

SEQ ID NO: 4916 - protein, 272 aa, Proteus mirabilis
TNKTTSSALLRISSKKQYRTIAMSEETSTIIFEHPLNEKMRSWLRIENSLIQLNSFQSINSLSSALSFFRAVSEFIEVLDRGEIRAELLKELEKRQKKLQQWLSFPNVDKEIVSHIINELSESACALSKAPRIGQHLKQDKIISLVKQRLSIPGGCCSFDVPTLHLWLNLPQTVRTEKLTCWQEGLYPLQNALNALLTLIRQSDTFKPVLSHNGFYQDSTEEGELLRIKLLASQQIYPQVSGHKNRYAIRFLPLDSEHGTIPSELPFEISCC

SEQ ID NO: 4917 - protein, 374 aa, Proteus mirabilis
KLKTITIKISLFVLSLFFPLLTKALVIPDNGTGYIGELTPPQSYMSLSSSGNTYGAAVGVNNVVDYCSKNSAQWQSFLFPFPGSQEGEYGLKLYNKNASEAENRENYLVAAINGIVSIDAVYYQNGTYSPTRITLRRGKEVSRTAEYADQFVYRHPMCWYGYISRVNNTSLRISSYSIYAVGHVKPGIYDFVAPIYFTTAQTATDAPPDLSSVPFSFGNGPIHVLKTCNVSPASSTNIQFAIQLAQNFKSAKLLEQSVASMLVSCPHSGNMYVTLKPYNELVNGSKTGMTMSPSIPLKNKEVAPYITVSDATKTITNAVCNNNSSEALEFYAGQPSGKYNGGSVYKSLSFNLCANGNIPTNTYKGSIDVSFLIE

SEQ ID NO: 4918 - protein, 120 aa, Proteus mirabilis
KMKTSELIKKLQEIDKTVPFDADIVTGDDWLPCGVENVYHAPPNTYIQFNSYDADEMWGDLQENNRRTSIVELSARVSEINDVVKMIESNPSITALDIIKELNSRSKRMSEMVNLLKKTE

SEQ ID NO: 4919 - protein, 254 aa, Proteus mirabilis
NKKTVDNLFNLQFSLLITNNDINEKQFKILSRLLCREAVDSLLQSTWFLRKKHCSVPLTKENINAVVNLADKYQSNISDINWNALNAKINIADHARFIQAIIKPIFIWWVEHITPHIFTLYEIKKELEYQINQCENIKLFEEKEPSNIASSFLSLEDIKTKLEADKARFVVIDDLLKKDIKLVIEAWEKEPVFNKKINNTLEYLQNTQPHSELLQPLWDILITIPQHPENCKKLKHWLVEHSLCLINDEFMWHV

SEQ ID NO: 4920 - protein, 71 aa, Proteus mirabilis
YFMTMYRCHLLALNHIRCIYYASFWEGNFVFNHKKAMTKGHRFRSLINNICAVVKNGLFLSLLKYFLHFIF

SEQ ID NO: 4921 - protein, 155 aa, Proteus mirabilis
KTTTISCCNNKILKQELISLVTLWKSHLTVSWFTQLFSTSVYVIFEIALLLYPWPPGFIYIWVPLLLLLILGWYFSQKNINKRKGDLVLLNGNRIQWKYHEWQIAKQPWISRFGAKITLDSILNNKQITLWVAFDSMPENEWRNFSQLLMQYPDI

SEQ ID NO: 4922 - protein, 67 aa, Proteus mirabilis
CSLAILYNYNKSSPLDVNCDARGFYLKSTLNGKIISYQIKFLCCLIHHNEKRAKLIMNLALNIYTLS

SEQ ID NO: 4923 - protein, 141 aa, Proteus mirabilis
QNKAFCSNLIADFLLLSPFKTSGGMTNMLYKFTPIILLIISNIFMTFAWYGHLKYGNKPLIIVILLSWLIAFVEYCFAVPANRIGHNYYSAAELKTIQEVITLTIFAVFSVTYLGESFTLNHFIGFILIGAGALFIFKGPF

SEQ ID NO: 4924 - protein, 464 aa, Proteus mirabilis
ETLATSTRITMMKSKIKQMIAHYFKTKKEPKNYDFYPNHIAVLEKPPTPYSRIIAIIISLSVIIFLLWAYIGKLDVLSSAIGKLVVSGYSQQIQIYEHSRLSAIHVKNGQQVTKGEALLTLDILGVDEEINNLKNKIENLLLLKIRYQALGQNTRPDTIDDFNLLNKEKKEAVLLSYQKEKDEFDASINHINSEIETNNKNKLLTHQEINSLNELKNNIEKRFNIKKKLYDKKIISTMEFLENKKELLEINQIIKRKSSELVILSSQEQQYIKNRDRLEKQKHLEWHDKFKQYESGVFIYQQNLYHVQKRQQLKIVRSPVTGTVQQLAVHTLGAVLQPSQAVMVIVPDTQHNVAEVNILNKDIGFIYPGQKAVIKIDAFPYTRYGTIEGTIVNIAKDSIQHEQLGLVYPVLIELDKQVMGEDEAQYKLATGMSLVADIKIEKRRVIDYLLSPIEVYQHEALREK

SEQ ID NO: 4925 - protein, 278 aa, Proteus mirabilis
SKMAQLQSRLVYSMIGWHHVISQNPMVIVSVVGLSATKQKEKNNMLNEQNRAEFLQTIAQKLGREVTHTPKPQDPPINNLAKTRLTNLTQDELCKEFTDFAQTQQVRCVITKPEQVINSLIALCESYDCQGSVIISGDERLNALGVTQAISEKYETYIWDPKLGHENIIHAERSQIGIVFAEAGLTESGGIVLFSSPEKGRSVSLLPETSIVILRKSDILPRVAQLAERLHKMAQDGIRMPSCINLIGGASSTADIELIKVWGVHGPVHAAYLIIEDC

SEQ ID NO: 4926 - protein, 140 aa, Proteus mirabilis
PINLSSQSCVMIKCILNTTIRSESTMSGKRINREKQTIQKMVALYERAHPNTDPEYYQQLVTYAYKRLDKCRYGEEKPACKQCPIHCYQPVKRAAMKQVMRWAGPRMLIYHPYLAIRHLIDDKKPVPALPAKKSKRLSGK

SEQ ID NO: 4927 - protein, 150 aa, Proteus mirabilis
QSNLVKNLLLGANVKIGTLLISYSLLTMSLLSFSSFAQVNHDPLTKCYELSTDASQTTIKACLLDELRLSEEQLNVIYNKSKGDLEDSDSIAAKSAIDALVSSQEQFILFRSSECQRQSALMMGGNGADEVLLACEIKLNQWRAKLLLTN

SEQ ID NO: 4928 - protein, 242 aa, Proteus mirabilis
  UNSURE (18): Identity of amino acid at the above locations are unknown.
SIIYIFKFIKRNGYMKKXLFSLATLIVMSTPALATPPGANLKINGDITSPTCTVNAGDNDIIIDYGVISPSFIPAEENYALGAKSANIKISCDASNYLTLKVSDTYKTSSTDSAKISVFGLVNAKNTEQEIGGYIIDVIDIKVDNKRAYLGRVADKIWTGSSATIFKDTLTALTSEPQAQVDKNNLKLIAGKVFNAKIQIGAYNESRYAYILSRKKLAQNNIDLTDGIDYIGEAVFTFNFGV

SEQ ID NO: 4929 - protein, 96 aa, Proteus mirabilis
YCIYIQFICLGMVKIMRVEILFNKQSNVTDSLFPLLEHELRKKIIPIYPDMQFRIAFSSMNTIQVTGVKDEAKHEHIMELIQSVWEDDSWLQTNDD

SEQ ID NO: 4930 - protein, 418 aa, Proteus mirabilis
RAHYPKSNFKIAIVVDMWLTGFDVPELDTIYIDKPLQKHNLIQTISRVNRRFEGKEKGLVVDYIGIKSRMNMALAMYSKADKSNFEDVQQSIVEVRNHLNLLSQVFHQFDSRDYFSGSPTRQLDCLNRAAEFVLQTKKVELRFMGLVKRLKAAYDICVGSEDITQDEREHIHFYLAVRSIVYKLTKGDAPDTAQMNQKVREMIAEALKAEGVEEIFTLGDEKAENIDIFDDEYMARINKIKLPNTKMQLLQKMLQKAISDFQKVNQLQGINFSKRFQALVEQYNQRKENDVLNGEEFDDFTAQMADMIYDIKAEMMSFEDIGIDMEEKAFLDILQHMCQKYDFTYDDDKMLALAKDMKLIVDDSTQYPDWSNREDIKAKLKVDLILLLHRYGFPPVANDEVYKSVLEQAENFKKYQLG

SEQ ID NO: 4931 - protein, 62 aa, Proteus mirabilis
CGYLLEVSSITKDILPNISRRCLSFNAQSRDLVTIFKAASSHSISLKLLSMIYLSVSNGLLI

SEQ ID NO: 4932 - protein, 239 aa, Proteus mirabilis
IGIQMKKKLLWLPILFSMVSMPVFADNAAIKAQLAKMQIKAESIQPTPIVGLNAVLSDKGIFYITDDGKYLTAGPIYNINGEEPVSIANQVIMKKIDSLKNEMIVYKAANEKYVITVFTDISCPYCQKLHQEVPELNKQGVTVRYLAFPRNGVKNNVVSQQMNAVWCSGFPKKSLDSAFKGDKIIAIDDCKKININEHFKLGTMMGIQGTPAIVLPDASIYGGYISATNLLELLNKKEK

SEQ ID NO: 4933 - protein, 399 aa, Proteus mirabilis
MKLHFIYRYNALTYQGEWLSGNIVAQSKHEVIDQLIQQQKLPVKIRLYRVITFQNSDKQYRIQLLEQLALLLHSGLALLPALTLLKEECRYLHWQCVLNDIIFHLNQGGALSKQLSRYPLYFPANLTHFIYIGEESGKLDEVLLLQTTQLKNQRDLIKKIIKAFQYPLFLLLTLIVITISMLIYVLPEYQSLYSAFNTELPTLTLTLIRCSQWFSQYSLIILLFILIISYSYYTIKHHNAKFRDIEQRCWLNLPYLGILLRYHQLHIIFQIMTITQQAGLPLLQGLKIITEQLTHSLYQRALTDMIAHITQGKSLSSFMRHNPLFPPICYQLISSAENSGQLQFFCQQLTHWFYHQLEERLDSVKTWLEPILMTLIALITGTLIIAMYLPVLQLGDTIH

SEQ ID NO: 4934 - protein, 85 aa, Proteus mirabilis
YQQQKSSQLNSGEIMSEKLIVKCPTCRTEVIWDESSPYRPFCCKRCQLIDLGEWAAEEKRIPSQSESNDSDEWSEMPEQDPKPFN

SEQ ID NO: 4935 - protein, 485 aa, Proteus mirabilis
LAGQINNEVTMSTEIKAQVVVLGAGPAGYSAAFRCADLGLDTVLVERHSTLGGVCLNVGCIPSKALLHVAKVIEEAKALSEHGVVFDAPKTDIDKIRIWKDKVISQLTGGLAGMAKGRKVNVVNGEARFTGSHTLSVEGSEGTTTITFENAIVAAGSRPIELPFIPHEDPRVWDSTDALQLKTVPERLLVMGGGIIGLEMGTVYHALGSQIDVVEMFDQVIPAADKDVVKVFTKRISKKFNLMLETKVTAVEAKEDGIYVTMEGKKAPAEPQRYDAVLVAIGRVPNGKLLDAGKAGIEVDDRGFIHVDKQMRTNVPHIFAIGDIVGQPMLAHKGVHEGHVAAEVISGKKHYFDPKVIPSIAYTEPEVAWVGMTEKEAKEKGVSYEVATFPWAASGRAIASDCADGMTKLIFDKETNRVIGGAIVGSNGGELLGEIGLAIEMGCDAEDIALTIHAHPTLYESIGMAAEVFEGSITDLPNPKAKKKK

SEQ ID NO: 4936 - protein, 191 aa, Proteus mirabilis
YDFKCRKKRGVVEIKQGWLTGVKHVPSPNYDNRPEGEIPSLLIIHNISLPPGQFGGPYIDQLFTNTLAVDDHPFFNEIAHLRVSAHCLIRRDGEIVQYVPFTARAWHAGVSFYKGREKCNDFSIGIELEGTDECDFTPQQYQQLSTLTQQLIEHYPGIKENITGHSDVAPGRKTDPGPHFNWSYYRALLAK

SEQ ID NO: 4937 - protein, 239 aa, Proteus mirabilis
MKVNFYATCLGDVLKADSARDTVLLLEKLGCEVLFQERQGCCGQPALNSGYVNDAKPAMKSLIETLEVNDYPIISPAGSCTYAIKGYPSYLADEPQWAQRAQGVADRLIDLTSFIVNTLGVVDVGARLAGKAVYHPSCSLTRKLGVVSEPLTLLKHVEGLEMLPFANSETCCGFGGTFSVKMSEISGEMVTEKVKHIMEVSPDYVIGADTSCLINIQGRLSREKRPVKVLHIAQVLMSQ

SEQ ID NO: 4938 - protein, 108 aa, Proteus mirabilis
TLPKPPISAQASPLPIWVNILPPPTMAPILVPLPTLVKIFPTAPIIPRVCPSPTCVSTLPIPSIMPERSPLPTLVKILAPPSITPCMLPFPICVRTLPPPPIMAKISP

SEQ ID NO: 4939 - protein, 264 aa, Proteus mirabilis
CCYNCNLVTIPIHDFCQEVFVKVKAMVLASMLALGAPSIALAGAVPEGPHITTSGNATIKATPDMATLNIQVSEKAKDAAQAKKQVDERVAKYFAFLKENGVTKEDIDAANIRTQPNYEYDKKAERSVINGYTATRTVDVKIKKLDQLNTLLDGALAAGLNEINNVEFGVNDPEQYKAKAREVAIKNAIQQASSVAKGFGADLGAVYSVSYRAPEATPYPIARMKMDAMALSAPSPEAVKETYQQQSIEFKDYVDVVFELKTAK

SEQ ID NO: 4940 - protein, 287 aa, Proteus mirabilis
  UNSURE (284): Identity of amino acid at the above locations are unknown.
YLYNNFGRKMNTIQCGENTKQDCVIQKLSYFYPQYQILENNQKALYIIRNNALVLQNCTNTITINKDQIIFLQQGNYTIKTLGNEPCETIYIPLSDDFLRNFMSKNSDILSNIDREENFSSAFICFEDSPLIHFCSNGFDYLSSQNCPDTFTQLRIEEMLILLLSSEQGANLMALLRQLSHRQVDRLKIFMEKNHLKNWKLKQFAREFGMGLTTFKELFNHVYGTSPRTWICERRIIYAHQLLLTTEMSIVDISMESGFSSQSYFTQSYHRRFNMTPSKARHLXLKL

SEQ ID NO: 4941 - protein, 436 aa, Proteus mirabilis
RSHKKINQEQQQLNHSLVTLQQQKAQADDQLTQIPALKLELQNKVNELAELKKSLSTGEKAFDALISEKNGVIAKLEKAQADLANKYQALDTQFKENNTTIGQLKESKIANDNAYAQLEKQLAEKQSLTDKLTTQLTQAKDQLAKQNSESNQLIASLKQQQVESTAQFKQQESVLANSQKEFNEVSKQLEAQRALTKTLEEKELKLSEQLKEKESEIKKINSENANAQKEFNEVSKQLEAQRTLTKALEEKELKLSEQLKEKESEIKKINSESASVQKENKTLKQQLDKAMGEGQIIASQLAYAYSIIGKDNAQRNKSILSEIQKQNYVQYDDNTYFKILKQGKPVDSIAGKTVVFAMHEQLTDGTVTLNYDKAKPLILPYRQLPLPLNTFVAKAGLNGKAKIYIKPDGGYGKDGIPGQVPPESMSIVTIEILAIK

SEQ ID NO: 4942 - protein, 272 aa, Proteus mirabilis
HFNNQGNSYPIMASSNMAYTKIRQPKLSDVIEQQLEHLILEGTLRPGEKLLPERELAKQFDVSRPSLREAIQKLEAKGFLLRRQGGGTFVQDNLWQSFSDPLAQLLSGHPESQFDLLETRHALEGIAAYYAALRGTDDDLERIKASHARIIDAHDKGDIAAESDAVLQYQLIVTEAAHNVVLLHLLRCMVPMLEQNIRQNFEFLYTRKEMLTAVSEHRTQIYQAIINREPEAAREASHRHLAFIEDVLLDMSREHTRRERSLRRLQQHPDLF

SEQ ID NO: 4943 - protein, 715 aa, Proteus mirabilis
EKNNSEISMNYITKNTPSLHPSIIDGLIYFSKKNKGTLKKEQLIHFLGNDDNLSELNIIEAAQQLNLKCEFSFFNSESEYKDKIIIDTLIEINGYWYILKNRTSDKLIIIDPSTNTESHYHIDKKITYTTLLIINKIFTPKQSKFSLMWCIPSLLKQKKSLYLIFILSCFIQLFALVNPIIFEKIIDKVLTGRSLSNLQVLGVLLVLIAIIEPIYLLLRDKLYAFVSCTLGAEFSGKIYQHLIRLPSQFFNQRQSGQIIARIQELAHIRQFITGSALMMVLDFIFIIVFLSVMFAYSVLLTWITIAALVVYFLFWLILGPMIRYWVEQEYQANADNTSLLTEAINGIETIKITATEHQFIEKWQYKLTNYILKRFSAAKKALLAQQLIGAIHKITMAIILWHGVNLIMKAQLSVGELVAFNMFATHITQPILRLAQLWQDVQQTGISIRRIGEIVNTPTEHQHQGLATVPNIAGSIVFSHVRFRYTANTPDVIEQLSFSIPAGKFIGITGPSGSGKSTITRLIQRFYTPQQGQIYIDGMDLAIANPLTLRQSISVVLQDNFLFSGTIMENIRLSKPDCSEEDIIEASKLAGAFHFITQLPEGFNTQVGERGSNLSGGQRQRIALARALLPDPRILILDEATSALDYTSEAEILANLPAICKNRTVICIAHRLNAISISDYIYVIDKGRILEEGTHSDLLNKKTLYQQLWQQQTQQ

SEQ ID NO: 4944 - protein, 70 aa, Proteus mirabilis
IMDNNLREIECELAALKIVTKSLLCALNDKQRRDMLGNISLVIEDTSSRYPHHNEVINLTEQYVKKLIQA

SEQ ID NO: 4945 - protein, 308 aa, Proteus mirabilis
ICHNILLVAILFIRIISLKGGLMNELPASLDEATGWFVANQELFIQYAVNIVAAFLILFIGLFVAKMVSKGVARILTLRHIDATVVTFLSVLVRYTVIAFTLIAVLGRLGVQTASVIAVLGAAGLAVGLALQGSLSNFAAGVLIVIFRPIRAGEYVMIGAVEGTVRDVQIFSTTLRSADDRIIVIPNSKIISSEVINLSREPNRRTQIIVGVAYDADIDKVKKVLGDVVAQDKRIQHNQGVTIRLHEMAPSSLNFVVRVWTTNDDAWPVYWDLMENFKRALDANNIGIPFPQMDVYMHQAQNTVMKAE

SEQ ID NO: 4946 - protein, 76 aa, Proteus mirabilis
GINKEEIIHTLENCQHIIFTHLSVFPLIIISLLSGASSENFCHLTIRFILFLLLVFSTDFDACLFEIALSTIAYKV

SEQ ID NO: 4947 - protein, 218 aa, Proteus mirabilis
QMIKSLNKDDFNYHRLIQHGNNSLKIFIFSFLSLIILPISVSQAITPTQNKQLVAYATDLPRAVIYDPAYRKINYPNGDVPAHYGVCSDVIIRSYRGIGIDLQKLLHEDIKANFALYPSKRIWGLSRPDTNIDHRRVPNLEVFFSRKGKVKPISKEASDYLPGDIVSWRLDNGRPHIGLVIDKKSSDNQRYLVMHNIGFGQVAEDVLFSWKITGHYSY

SEQ ID NO: 4948 - protein, 345 aa, Proteus mirabilis
NKSKEVNVEILVTGGMGYIGSHTCVQMLEAGMTPIILDNLSNANEEVLNRIEALTGKRPLFYQGDIRDEKRLATIFTQHSIQSVIHFAGLKAVGESVEKPIEYYDNNVNGTLVLVRCMRDAGVKSIIFSSSATVYGDPQTVPITEESPVGGTTNPYGTSKYMVERILSDLYIADESWSISLLRYFNPVGAHPSGTMGEDPKGIPNNLTPYISQVAIGRREKVAVFGDDYPTKDGTGVRDYIHVMDLADGHIAALNALGEKAGLHIYNLGTGNGTSVIEMIEAFRKASGKAIPYEIQPRRPGDIAQCWSSPAKAEKDLHWKAIRSIDDMAADAWRWQSQNPNGYLK

SEQ ID NO: 4949 - protein, 518 aa, Proteus mirabilis
KIANLRIKIIMSDYLSFLLGIVPLAVLIFMILKMKSAVHHAVLVSLIITVALAIFHWNNTLQFASVSVLYGAVKGLWPIIIVILAAIYSYNLMLKTGGMEVLKDVLAGISDDKRVQVLLISWGFGGFLEAVAGYGTAVAIPIGILIALGFDPFKAAVASLVANTVPTAFGAVGIPVSILAQNTGLDVLVLSKTIIIQLGLFNILLPFVIVAIAGGGIKAIKGVGFITLMCGISTLIPQYIVAANLGAELPAFAGSLVSLIVVIFLAKRMKTGHDKSKQPTKHSAKELLVASSIYLFTFIFILACSPLFPTIQTAVGTIATKIPFVLSDTQTEYQTIAWLSTPGVLIILASFVGGTIQGASLSTLFSVLVKTTIQLKNSIIAIMAIVAMATVMDFSGMIGSIAETLVNFTGAGFIFIAPVIGALGTFVTGSDTNSNVLFGKLQTSAAAKLHVDPFILAAANTSGATGGKMISPQSIAIAVSATKMDGQSSAIMRETLKYCIAYIIILGAKIGIIYHLMN

SEQ ID NO: 4950 - protein, 204 aa, Proteus mirabilis
TIPLNATFILMSIQNTLPDYSAIDSLLQQHAVPLTAAEMHGLITGFICGAVHDNSWKTLLHELTNEGLAFPKSLSEPLESLYHVTHEQLDDSVFNFSMLLPDDTESVFPRADALAGWVNHFLLGLGVAQPKLSEHKELTEVITDLRNIGALGYEEDENQQELEDALEEVTEYVKVSVQLCYITFVASKETTTENDKQDEQRTLH

SEQ ID NO: 4951 - protein, 60 aa, Proteus mirabilis
TIKNCKLKDKNNYVRLSIIFTGNCSFSRSDFYDFKNEIGRSSRCPRFANYHCGSRYFSLE

SEQ ID NO: 4952 - protein, 400 aa, Proteus mirabilis
WQEKFKAKISMNVIIVGGGMAGATLALALSALNKGNISISLIEAREPDNGHPGFDARAIALAHGTAKRLAQIGLWSVLKPFVTPINHVHVSDRGHCGFVNINAQDYDIDALGYVIELHDAGRQLFAQLKKQPNITLYCPAKVEHVQRHLDNVEVTLDDGTQLSGDLLVAADGTHSPIGHQCHIQWQKTPYHQVAVIANVKTEIDPKGCAFERFTQFGPLAMLPMSEGRSSLVWCHPIEKLEQVSQWDDQTTIAQLQRDFGWRLGKIEQVGQRHCYPLVLQKAQQMISHRLALIGNASQTLHPIAGQGFNLGLRDVMTLANTLTSAIQSGLDIGSYRVLSQYQQLREQDRESTITITDGLVKVFANRCMPLIISRNLGLMTMELVPALRNKLAHQTLGWTN

SEQ ID NO: 4953 - protein, 141 aa, Proteus mirabilis
VRCFMKIRENDFWVYFSSKNESNSTNNDKIGKWMYFFNDAEFTEKICQKAILNSVVEHCKYTNNAESGVACFYLNIDDIEGHKKVIKFFLDNKLIPINKSGKFKNISFKLDMQTMNREYGDKFEGKLSLEHFIDLSSGIFK

SEQ ID NO: 4954 - protein, 220 aa, Proteus mirabilis
FFALKCIRLFSVKIAHIKYLVVRKLGVNMNILLINGGQKFGHSAGQLNRTLHDIALAHLATLGHQVKETQIEEGYDINEEIEKFIWADTIIYQMLGWWMMMPWKVKKYMDEVYTYGHGKLYENDGRTRHDPSKQYGSGGLLQGKQYMISVTWNAPIEAFNEFGNFFDGRGVDGVYFAFHKSQQFLGLSQLPTFMTNNVIKEPNIEKDIVEYKAHLTKVFG

SEQ ID NO: 4955 - protein, 62 aa, Proteus mirabilis
LDKNAVNIEWLVNIAKVKIVIEICFFLNKKSSYIPKKGMSYYYSLFLIVTKTTIVRVLTKRK

SEQ ID NO: 4956 - protein, 391 aa, Proteus mirabilis
MGKKKQTKYPLPRGVTIRQNKIKETLIITFTYKGVLCREPLSRLEINSKNIKYAERLLAEIQNNIEKNIFNYSKYFPNSKKLNLFGVNNREKRVIDYLEEYLVICETRNLSPSTINGYKKCKSALSDLHQLHVSSLTPAILKNWIQKQTTVLKTIRNQLSFLRSSLDEAITDGIVSINPVSLVSASRYQSKNNSAESNYIVDPLSPKEVSALLVAAKYEQWKNLFQFAINTGLRSSELCALRWSDIDFIENTAHVQSASVVGVIKKTKTKAGTRKVELNSEALNALNSQKQFTFMKDDVIFEDPKTNKAWTGADAIRKKAWVPTLKKAGIRYRNPYQTRHTFATRHISQGTNLFWLAGQMGHKGPEMLFRHYGKYLKEYDGNTINTLYTNT

SEQ ID NO: 4957 - protein, 357 aa, Proteus mirabilis
IREKIMSKLIFDPVEHPHRRYNPLTGQWILVSPHRAKRPWNGKDEKPQIATLPSYDPHCYLCPGNTRVSGDKNPDYTGTYVFNNDHSALLTDQYSVEVSDNPLFQTQAVRGISRVVCFSPDHSKTIPELPISSLRKIIDTWDNQIEALSKEYLWVQVFENKGETMGCSQPHPHGQIWASDFLPNELARKDSQLKDYFNQYGRNLLMDYVKAESEDGSRTVVETKYWLAVVPYWASWPYETMLLPKSHIRRMSELTAEQRDDLALAIKKLTSRYDNLFHCSFPYSMGWHFAPSFKEGESIEHWQLHALYYPPLLRSATVRKFMVGYEMLAESQRDLTPEQAAYNLRQVSDIHYKEQEN

SEQ ID NO: 4958 - protein, 63 aa, Proteus mirabilis
EVFENRFHLREATKKERETMPLLASYYALNENIFSRAIFAFCSQISTNAVHNMGCDNLLNDIT

SEQ ID NO: 4959 - protein, 621 aa, Proteus mirabilis
MSIEIKVPDIGADEVEVTEVMVKVGDRIEEEQSLITVEGDKASMEVPSPQAGIVKEIKIAVGDKVETGSLIMIFDTEEGAQAPAQEAAPAPSAAAPAASELKEVHVPDIGGDEVEVTEVMVNVGDTISEEQSLITVEGDKASMEVPAPFAGVVKEIKIAVGDKVSTGSLIMVFEVAGSAPAPSASAPAPAASAPAASAIKDVNVPDIGGDEVEVTEVMVKVGDTIAEEQSLITVEGDKASMEVPAPFAGVVKEIKIAVGDKVKTGSLIMTFEVAGAAPAAQAPAAPAASTSAAPSAPAKAPASAPAAKEEFVENEAYVHATPVIRRLAREFGVNLAKVKGTGRKGRILREDVQSYVKELIKRAESAPANAGGGLPGMLPWPKVDFSKFGEIEEVELSRIQKISGANLSRNWVMIPHVNLFDEADITEVEEFRKQQNKEAEKKKLDVKITPLVFVMKAAAKALADMPRFNSSISEDGQKLILKKYINIGIAVDTPNGLVVPVFKDVNKKGILELSYELAEVSKKARAGKLTASDMQGGCFTISSLGGIGTTGFAPIVNAPEVAIMGLSRSSMKPVWNGKEFVPRLMLPMSLSFDHRVIDGADGARFITLINQYMSDLRRLVM

SEQ ID NO: 4960 - protein, 212 aa, Proteus mirabilis
FLADGLIMTQPPVFQQRDQIRKAIRQKRRQLTVAQQQDAAHKLSERVLHHPKVKQAKTIALFLSFDGEIDTAPLITHLWDLNKQVCLPVLHPFHRHHLLFLRYAPTTQLVKNRFNIFEPPLNVNNIIPISDIDIIFTPLVAFDESGQRLGMGGGFYDRTLENWQRQSFYPMGLAHTCQQVHSLPSANWDIPLPEIITPDKVWRFDERLIQRN

SEQ ID NO: 4961 - protein, 235 aa, Proteus mirabilis
RNNDMKKVLLSLAMLSVISTPVLAKAPVANLKINGDIKPPTCTINGATQSDMIFDYRVISPTLIPQSKNYEYPNGIVQNTVTIECDAKTYLTFVASDTYDSAELANNTLAQFHLVDKENPETAVGAASFLWEDVTVDSKPAYISRANDVTITETNYYNVLYKGATNGWTSEQQKGNVSKESLALIPGEVFQAVFKDVYKIPSFLLSKDALNKKGIDLSNGLDFMGEAVLTFNFGV

SEQ ID NO: 4962 - protein, 872 aa, Proteus mirabilis
QRSEEKVVLEEYRKHVAERAAEGVVPKPLDATQTAALVELLKSPPKGEEEFLLDLIVNRVPPGVDEAAYVKAGFLTALAKGETTSPLITPEKAVELLGTMQGGYNIHALIEALDNDKLAPIAAKALSHTLLMFDSFYDVEEKAKAGNVYAKQIMQSWADGEWFTERPELAEKITVTVFKVTGETNTDDLSPAPDAWSRPDIPLHALAMLKNAREGIEPDQPGSVGPIKQIEALNKKGFPLAYVGDVVGTGSSRKSATNSVLWFMGDDIPYVPNKRGGGVVLGGKIAPIFFNTMEDAGALPIEVDVSKLNMGDVIDIYPYKGEIRNHETNELLETFALKTEVLIDEVRAGGRIPLIIGRGLTSKARSALGLPPSTLFRHAKAVEQSDRGFSLAQKMVGRACGRDGIRPGEYCEPKMTSVGSQDTTGPMTRDELKDLACLGFSADLVMQSFCHTAAYPKPVDVTTHHTLPDFIMNRGGVSLRPGDGIIHSWLNRMLLPDTVGTGGDSHTRFPIGISFPAGSGLVAFAAATGVMPLDMPESVLVRFKGKMQPGVTLRDLVHAIPLYAIKEGLLTVEKKGKKNIFSGRILEIEGLPELKVEQAFELADASAERSAAGCTIKLDKAPIIEYLQSNIVLLKWMIAEGYGDRRTLERRITAMENWLADPQLLEADADAEYAAVIEIDLNEIKEPILCAPNDPDDARLLSEVANSKIDEVFIGSCMTNIGHFRAAGKLLDQHKGQLPTRLWVAPPTKMDAAQLTEEGYYSVFGKSGARIEVPGCSLCMGNQARVADGATVVSTSTRNFPNRLGTGANVYLASAELAAVASLLGRLPEPQEYLDFINKVDETAEDTYRYLNFDQLEQYTDKATQVIFQTTV

SEQ ID NO: 4963 - protein, 311 aa, Proteus mirabilis
YTVEHKIKENLSMKRPDYRALQALDAVIRERGFERAAQKLCITQSAVSQRIKQLENLFGQPLLVRTVPPQPTEQGQKLLALLHQVEMLEEQWLGDENSGSTPLLLSLAVNADSLATWLLPALHPVLTQLPIRLNIQVEDETRTQERLRRGEVVGAISIQPQALPSCLVDQLGALDYLFVASPDFAQRYFANGVTKSSLLKAPAVAFDHLDDMHQAFLQQNFGLSPGSVPCHIVNSSEAFVQLAKQGSTCCMIPHLQIADELKSGELIDLTPGLCQRRMLYWHRFAPESRTMRKVTDALLDYGRKVLKQDEE

SEQ ID NO: 4964 - protein, 218 aa, Proteus mirabilis
MTQDELKKAVGWAALEYVKPGTIVGVGTGSTASHFIDALATMKGQIEGAVSSSEASTAKLKSYGIPVFDCNEVDSLDIYVDGADEINHQMQMIKGGGAALTREKIIAAVAKTFVCIVDESKQVDVLGKFPLPVEVIPMARSYVARELVKLGGLPEYRENVVTDNGNVILDVYNLTILNPIELENKINSIAGVVTVGLFANRGADIVLMGTSEGVKTIK

SEQ ID NO: 4965 - protein, 99 aa, Proteus mirabilis
QTGEKMAVDHNDFISQPRRAEIQPEFSHIIECVVTNLTRYFPKLIHSLYVYGSVAEGRAEVGKSDLDMTVIFKYEPDQTIKEQFATVQSVLEKKQSRYQ

SEQ ID NO: 4966 - protein, 230 aa, Proteus mirabilis
LIMDNKRTQRDIIFSIIWIIWSCALMAFWRYQIAGELLITLILIFSIIIYSITLRLKKTAMFSRKTETPKAAEPIAPVMAEEKKPMPEQKLYTIIAKGTVFQGDINVDGDIQIWGKISGNINVKDGVIRVMHAGQVEGELTAPDIIIDGFVKGICAANNLDILEHGELRGTSRCGSMSIKRGGVFTGQSEQVEHQAKAVAQQRVVSIKEGTVNTNKESVTAESKLKENKK

SEQ ID NO: 4967 - protein, 210 aa, Proteus mirabilis
VIALPYERIFMTQQTNGAFGPFSDTINFIIELDKLKRVYRKNNVLDNSRAENTAEHSWHFAVAAMSFQPYAGDIDIGRAIQLALVHDIVEIDAGDVMVYDVAAREAIKEQEQKAARRIFSLLPAPQSEYFLNLWLEYDAAQTPESQFANILDRAMPMLMNLHNEGQSWVENNIRLEQVIARNLFIEKQWPEFWQYLYPQLLEAQKKGWLK

SEQ ID NO: 4968 - protein, 340 aa, Proteus mirabilis
TVYRINYIAGDVMTQNSTQTKRPHAAINLPLTLISLDDWSLITATGADSEKYLQGQLTADIAALPTTEHTLAAHCEAKGKMWSTLRIFHQQAGFAYILRKNVAEKQLTELKKYAVFSKVTFTENTDAVLLGLAGQGAAQALAEFFPEIPRKANEVVNHQNSYLLQLPLPTERFLIVTDEETAKKLATTLPAETSDSDQWLALDIEAGYPIIDTPNIEQFLPQATNLQALPLSICFKKGCYTGQEMVSRAKFRGANKRAMYLLSGGAAQLPDIGGSVEWQLGEDKWRKTGTVLSAVRMADNTIIAEVVMNNDMDADSVFRVQGDTTSRLTIKPLPYSLEDE

SEQ ID NO: 4969 - protein, 700 aa, Proteus mirabilis
ISIFNHIAFNMKNRESTKFIKSINIILNLSGKQLDNTKPNINKYDDTIASLEKKHAFKLKKKNIHYIFKKQLHYPIIFLDRYKNIFILLKYNNNEFLIYNLQTDNMETWNKERLINNSINHYYYLDFAEKHFFDITWFVPTFMKYRILFQSVLFYSLILQLLALASPIITQIIMDKVIIHQALSTLDVLIIGLIFVAVSESVLKGIREYIYHHTANKIDMLLSLKLTNHLFKLPISYFKSRQTGIIVTRVKELDIIREFITKTLLMLLVDFSFIFIFLFVMAYLSLKLTLIFLATIPLYFILAKLIAPKIEKTVQQLYQYSATNSAFLTETLGGIETIKSLSLEPRFTQQWHTQIHQLTNENLKLQNIDNLSQYIVSFLQKITTAILLCLGAFEVISLAMTIGQLIAFNMLLNHCLQPLSSAIEVWGKYIRAKTAIYNLQDILNLPIEQEKANKKMTLQGEVSFENVSFSYQHDAPPVVRQISFRINEYETIGIVGTSGSGKSTLARIIAGLYIPQLGQVKLDDIPVCEIPPAVLRQQIGFVLQENFLFHLTVLDNIRLTQPSASLDDVIHVAKLAGAHEFILKLPLGYDTLIAENGRSLSGGQCQRIAIARALLSSPKILIFDEATSALDGESQAIIEKNLPLITQDKTVIMIAHRLSTIKNCDRIIVLEKGQIIEEGKHNELIRKDGAYKKLWQHQQG

SEQ ID NO: 4970 - protein, 354 aa, Proteus mirabilis
KKSLSGLKSSGGIFDYDAKKERLEEVNAELEQPDVWNEPEKAQALGKERSSLEAIVETIDQLEQGLEDVSGLLDLAVEADDEETFNEAVAELEGLNKKLEQLEFRRMFSGEYDSADCYLDLQAGSGGTEAQDWASMLMRMYLRWAESRGFKTEIIEESDGDVAGLKSATIKIIGEYAYGWLRTETGVHRLVRKSPFDSGGRRHTSFSSAFVYPEVDDNIDIEINPADLRIDVYRASGAGGQHVNKTESAVRITHVPTGLVTQCQNDRSQHKNKDQAMKQMKAKLYELEMQKKNADKQVMEDNKSDIGWGSQIRSYVLDDSRIKDLRTGVETRNTQAVLDGDLDKFIEASLKAGL

SEQ ID NO: 4971 - protein, 60 aa, Proteus mirabilis
SRERNLLNIKLNLIKNQRVNYKLKFIFKHYFNKYEQLTYNANDTFTLNLSLREKINHKLK

SEQ ID NO: 4972 - protein, 214 aa, Proteus mirabilis
IIIRIFCMLTTFFQGFLLSAAMILPIGAQNAFVLQQGSKKQYHLMSAFLCALSDVILISGGVFGGSALLSQSEYLLLLITWGGVAFLLWYGWNAFKTAFTKEIELSQHKNQVKSRWRVIVTLVAVTWLNPHVYLDTFVVLGSIGGQLSAELRPWFTFGAVFASISWFFALSLLAAWFSPILSQVTAQRIINLFVGCVMWFIALQLAAQGWKNLF

SEQ ID NO: 4973 - protein, 74 aa, Proteus mirabilis
SLYSYFRENCPLHHKSKRLHYTEYFNYMIKLILIGFYHTLLTSTLICFTVKLRVASIDELKRRECDLYLLVNTN

SEQ ID NO: 4974 - protein, 346 aa, Proteus mirabilis
CRIRVIYEVDMATIKDVAKEAGVSVATVSRVINNSPKASRASIEIVNSAMQKLGYRPNAAARALVSQSTQTLGVLVHDVSDPFFGTLVKAVDNIARKAGKHILVCNGYHDAQDERQSIELLINSRCDGLVIHSKALSDEELLAYANEVNSMVLINRFIPEIAERCVALDNYKGAWIATEHLIRQGHTQIAYISSTHHIEDTSQRLAGYKAALAAYNISLPESYVEYGEPEGEGGEQAMMRLLTKSIDFTAVVTYNDFMAAGALSVLDENEIPVPEKISVIGFDDVLIARYIHPRLTTVRYPIHMMAEQAATLALKLSQGEVLIQKQRIYSPTLVQRNSVYNLSHLS

SEQ ID NO: 4975 - protein, 368 aa, Proteus mirabilis
KEGRMAKQTPLYDEHVACGARMVDFHGWMMPLHYGSQIDEHHNVRQDAGMFDVSHMTIVDLHGPQVKDFLRYLLANDVAKLTEKGKALYTGMLNASGGVIDDLIVYYFDETFYRLVVNSATREKDLAWITEHAKDYVVDIQVRDDLALIAVQGPHAQEKVQRLLSESHRQIVAAMKPFYGVQLDDLFVATTGYTGEAGYEIAMPKEQAVDYWQKLLAVGVKPAGLGARDTLRLEAGMDLYGQEMDETINPLEANMGWTIAWLPEDRQFIGREALEKLRATGTDKLVGLVMREKGVLRAGSAVHFTDDLGELREGVITSGTFSPTLGFSIALARVPAGIKDSAIVLLRNREIPVEVVKPGFVRSGKALV

SEQ ID NO: 4976 - protein, 319 aa, Proteus mirabilis
RRESKPVTQTKLSTQTTTDNNQEDNDVIIEQFLDSIWLEQGLSANTLSAYRLDLQALSQWLVTQKLNWLSVTTLDLHAFLATRLDEGYKATSAARLLSTLRRFFQYLYREKLRQDDPSALLSTPKLPKRLPKDLSEQQVENLLSAPCIDEPIELRDKAMLEVLYACGLRVSELVGLSLSDISLRQGVLRVIGKGDKERLVPLGEEAIYWLEQYLQYGRPALMQGKTDDIVFPSLRGQKMTRQTFWHRIKHYAVIAGIDSEKLSPHVLRHAFATHLLNHGADLRVVQMLLGHSDLSTTQIYTHVATERLKVLHQQHHPRG

SEQ ID NO: 4977 - protein, 281 aa, Proteus mirabilis
ISRSLLMSQLDGNAISQIQNMAVASLSLDAIEKSLCPAIVLPNDFKVSSLENLQEGRFRFRGEMKTTSISDFVKYSIKNAIDEGVSCFIDADEMSAETIFNIGTIGEPGHADNTAAVKLKQTAPFAALLKIDGVKHRQKELAEWLEDWRDYLMAFDADGNILDIKQAISAVRRITIESTRSAEHEDADFSAKRSVLENVEARSKDVMPTTFQFTCTPYDELKERSIKLRYSVLTGGDVPILVLRIVQLENLEEQIAQEFRNLLCDEFDESEIETFIGKFSA

SEQ ID NO: 4978 - protein, 170 aa, Proteus mirabilis
QRFGAVNMEKMMNKVILSLVAAMSLSACAQAVDSLEKVAPYPKAKENQIRHVIELEQKENEGNYQVELIVGKEMMVDCNRQWFGAELDKKDLEGWGYDYYIVSDLNGPMSTMMGCLDNTKKPAFVQANMGQAAFIRYNSKLPIVVYAPKDVDVKYRVWSTSDEVKDSTKK

SEQ ID NO: 4979 - protein, 68 aa, Proteus mirabilis
LLYGVYSSLLIKFLFVGDVGFIFISILFKIILKDVCVRFIVLVIYYLNQMTLIYKISYVYRVALISIY

SEQ ID NO: 4980 - protein, 2807 aa, Proteus mirabilis
KNDGRFNNKLTTFNQELLDDAQQAINRLSINAGIRQKSANVLPSFTSDLNGDDVATYQQPSLRSGNLQYHKIGAIAVNLSGLGESPIFETLKQKFNVKIKNRNTYFTFILEKNSGRIQKNIYLDNINDPTQQKIIEHFILANYSNFEAMPNELHLENDKIKSSHNNKDRILAEYVEHKWQMLTDSKVMSVDELHKVASVKGKIQGESYKSIITTLSEYHEKESNTNCLPIEKLRVLAQLRNQIDGYLLGHPDSERNDGLKQLQTQVNTRYKHASALIQDSHTINADSSFSRLYDSLSNANLKRSKHIYIDINGHFVTEGKNNLQGKNRLTSGKEVIERVKNAVEKEYGAPIANKVFSQFANNEFAENGEGIDVSGLKKIHRAIERELSPHSATLYIWKPSNHSNLGHATLQIGQGRLLLNTEDAQNNHKENYISWWPNKAKSYFDVMGVPSQPKESLASDVAAEENDGFGLNYKYKELNRYDRLMNIAKGETVTTADDLSLADAKNILTIPNYIENSKIPRTIGQPFIDEWVITQKKLNNIATNFLEAVQGKFSGNTITINGAMILLTEPTLLSKRKIPLSVAQPFIEQWDNIKTQQEDISIQLLKAMKTWIQEGKDPTLTKKRIALVENEFAEQKQKSIDRFKTSLPDEGRVFRINLEGLDVAAMQAEWQRIKNSPNGRYHLLTQNCSSIVAKVLKAGGADELIGYNWQPKYNIWTPNQMFAFAQELQEAQMARQQSRMIPPNLHALSGSENIRQELENTSPLISAEQKLNIVFSEQETGFLLTQASDETNEKFIYIKNGDNQEQQKIMSNFILTHYRDFDSIPEQLYFLDNTIVSLDKNHSRILSEKVGENWQPVAYSNLMTADELTSAAEVTGKARGENYKAIIQSLRDYELQSTNTNNTPIDIFQQLSTLRIQINSYLLKHPDSKRNEALQQLRDQVDIRYKHASILLSNSQQVDSNNTFSYLYEIFSNANLKINKHIYLDENGNFVTKGKNNLQNQDKLISGKNAITSIKRLVEKEYGSEITNQVFNQFTENEFAQNGHGIDLSGLKKIHQAIEQQVSPISSTLYIWKPSKHSRLGHAALQIGSGRLQLDSDSVQDNHDNNYVSWWPAGSKSLANPLNITTEKNPDLKLRWYDLSQPVSRSTNFMTLQIDIQEEEKTNFKLNKDEGENDRQLKEFRDKTNLTRGLENITPEIAGLLLNAPHWIPETLIPPEISHPFIKQWKSPNSNLLEVSTNFSIAVKNWLKVAFPTAMINQTFALEIKKIKEIEDRKTENFKTSVADDTNDGVVFRINLEGLDAAAMQKEWKRINSQSDPRYQLLTKNCSSIVARILKAGGADQLIGHHWKPRFGIWTPNELYKFSQKIQEARLAQIAVQQGKPIHSNLQALSDHNKVAIDNDGTSPNERKNLSPLTRFFNDHFFGSYERRRDMTTVMRIKNEEKITLKGDAGRLTGSYYRGNDNIPEATDKKVVLFLHGSNSPTEKQSSSFYHYYNQQGIDMLAINMRGFGESDGSPTEQGMYADAQTMFRYLVNDKGIDPKNIIIHGYSMGAPIAAKLASDISANGQHIAGLFLDRPMPSMSKAIESYDEYSLKKLTGQLAKKINGQFSVEKNLQGFSKDIPIILLTDCGELGIGGEKMRTKLLDKGYLVKGERTDVSHLESLKLMNQYGKQIISSLLSPEYVNNTNHRNALDSIQNPIKKNKVTDWGMVYVKPNDNGGDSRFDSQIIIQTEDDPIVAQAASALAAKHAKNSIVVQLDADGHYRVAYGDPAQLSGKIRWQLVGHGRETTENNHLRLSNYNADELSNQLVKFNTVFSKENNINTTPEHISIVGCSLISNDKQAGFAHQFINALDQQGIRSSVSARVTEVAVDSNGHKYTKDNNGEWVAKQNQNKVVLNWNKEGKITTEFEQIHNGVAEGDIDLTKIGASADNKVRGAIADNNEVFTAPKKGKKSTKQSSSGSDNSSLSYSGNIQVSVGDGEFTTVNWGTSNLGIKVGTGGFKSLVFGDNNVMVHVGNGDSKHSVDIAGYQAFEGMQLFVGTRNVSFNLGRSNDLIVMLEKSIPTPPLINPFDGAARITKVLESIACSGENNDNDWLSVQNDQWTLAGAKKFAIDMSGIDQTSNVDYKTLTDLNSQNKRSSRGLKSDLEATLNKKYNQWLGGSGNNNEMGKISRAEQLRQLDSKIAFNFAIGGQGADIQVTAGNWNLMFGDNIQSIIDTNLGSLFGLMTQQFTATGMVETTFTYTPQNLPTKLKNKLLGRLASVSSDTTLGDIFGVDSTTDGKIISRNGEPIDVVAILKDMLAVVTEFGGEKLSAFTDPTKLLDNLQSSINLGKDGIISFAESHGLKEKATEDQQNESEVSINAQTPITTSQTENSKITEENDRPFGFNSLNIPNLFATIFNKDKQTDMRDLAENLKENLAADVLNMEKKTLDFLRNSGHLKGDGDIHVSLGNYNFNWGGDGNDLGAYLGDNNNFWGGRGSDTFYATGISNIFTGGYGNDLGVLMGRSNMMFGGDGDDTAIIAGRINNVYLGDGLDKAFVFGEGGEIHTNAGNDYAVTTGNYNRIFSGSEQDFVVTIGNHNQISLEEGNDFAKIFGNYNRLNGGGGDDEIQLMGYHAVVDGGDGNDQLIAASFSKFSLLNGNTGNDIIILGGYQNHFKGGNGIDSFLINNNVIDCYIDDISQEDNIVLGDIDWNKLWFERSGYDLKISHIRFPQNTGEQATFERIGSTTFTDYFNGNQAKIVIAMTDKDHSDQREYTALSSNALAIQIQAMSTFPMKAGASGFFDNISDEAKQMIAVAWTDTISGKGILV

SEQ ID NO: 4981 - protein, 513 aa, Proteus mirabilis
LKSGPVRKNMSQQQQGAEQAPDLNNELQTRREKLSALRDNGNAFPNDFRRDAMSDELHQKYDAMSAEELDAANVEVAIAGRMMTRRIMGKASFATLQDMGGRIQLYVSRDDLPEGVYNEQFKKWDLGDILGGRGRVFKTKTGELSIHCTELRLLTKALRPLPDKFHGLADQETRYRQRYLDLISNENSRNTFKIRSKIMSAIRQFMVNKGFMEVETPMMQTIPGGASARPFITHHNALDIDMYLRIAPELYLKRLVVGGFDRVFEINRNFRNEGVSPRHNPEFTMMELYMAYADYRDLIELTEELFRTLTQDVLGSTIVKYGDEEFDFGKPFEKLTMKEAICKYRPETNMADLDDMDKAVAIAQSIGIKIEKSWGLGRVQCEIFEEVAESHLIQPTFIIEYPAEVSPLARRNDDNPFITDRFEFFIGGREIGNGFSELNDAQDQAERFEEQVRQKEAGDDEAMFFDHDYITALEHGLPPTAGLGIGIDRMVMLFTNSHTIRDVILFPAMRPGK

SEQ ID NO: 4982 - protein, 312 aa, Proteus mirabilis
ATRGNMLLQTILAALGPIILGLLVGWLSGKYGFIKREYSQAFADFVVKIALPFSLFLAATQASPSVFFNIDYLLALAVGLIVSYLIGFLGGKFFFKHDKKNSAMQALSVSFPDMAYCGPPVLLATVGSSGLIAMVVGNLIYTVIILPFTIMIISGAKQGKSILQSLLNAISQPLVFLPILGAMLAIFGVKLPEILQNSVNEIGKTSGGVALFFLGLLISGLKLKVNTEIVFNVIIKNVVQGALILGTGFALGLETELLKAVFLIGVLPTATAVPALAITNKAYADMATGTVLLSTLCSLLSIIGGITIVEMM

SEQ ID NO: 4983 - protein, 479 aa, Proteus mirabilis
VNKGAAMSIKTSNIDFRPRLAHEMNDTIMRNAVVMAQERIGANRQIMVKELGDWEAWRDRAEQIRNHVLENLDAYLYQLSEKVTENGGHVYFAKTAEDATRYICNVAKQKNAKKIVKSKSMVTEEIGMNKALQNEGIEIIETDLGEYILQLDNDPPSHIVVPAIHKDRYQIRKVLNEKLGYQGSETPEDMTLFIRQRIRQDFLSADIGVTGCNFAVAETGSVCLVTNEGNARMTTTLPKTHIAVMGMERVAPTFEEVDPLITMLCRSAVGSRLTSYNTWVTGPREAGNVDGPEEFHLVIVDNGRSEILGSQFKDILRCIRCGACLNTCPAYRNIGGHAYGSIYPGPIGAVISPLLGGYKDFHDLPYACSLCNACNVVCPVKIPLAQLILKHRRVMAESGLTPKAERRVTGMFNYINAHPTLWKVGMNVGAKMAGLMIKNGSTPIKISVLNDWMASRDLPKPDGYSFRSWFKRHKAEGKK

SEQ ID NO: 4984 - protein, 64 aa, Proteus mirabilis
MNKGVLVSKKRRIENFNEVILNLSDNNFAWHFKEKIEDRHFIFYILLFLQKSVMLLKNDDDILL

SEQ ID NO: 4985 - protein, 145 aa, Proteus mirabilis
YQILSIKILKEFDEMIRCVRLWTGEDGNSLFEEGIIEFKDSSRGDSESLPIAVSELSFRETTSGGSYDWHQDPVPRYVITLSGTLEFETKDGSTFIIKPGDVLLAQDNSGTGHKWRLMDDEPWRRAYVVYKEDAGLCFKPTKTTK

SEQ ID NO: 4986 - protein, 415 aa, Proteus mirabilis
DTFIMKSFDVVIAGGGMVGLALACGLHGCGLRIAIIENHPVTTHFHPQDDFALRVSAINTASELLLKKLGVWENLTALRTAPYQGMEVWDQDSFGRIAFSAQQEGLSHLGTIIENHLIREVLWQKVTSHSDITCYSPAQIERIVWGENEAFISLNDGEMLTARLVVGADGANSWLRKNADIPLTFWDYEHHALVATIRTEQPHDNVARQVFHGEGILAFLPLADPHTCSIVWSLPSSLAEDYKSADKTRFERTLGVTFDMCLGQCELVSERMTIPLTGRYARQFAAPRLALLGDAAHTIHPLAGQGVNLGFMDVAELIGEIRRLKAEGKDFGEYLYLRRFERRRKHAAAVMLATMQGFRELFEGNNPIKKWVRDIGLSLADSLPGVKPKLLEQAMGLSDLPEWLKHKNSVSAEKI

SEQ ID NO: 4987 - protein, 225 aa, Proteus mirabilis
QDFIVLKYSGRSLIYAKKAYDLGNKEAAELIYWYYMQNICEDKDNINKADYYLKEWLTTGEEPSKYSSSNEYKYSSISIIADYYLESPCLVERNLDKAIEWYQLSLDYPYEINDFLYSELNNMYTNAPKYISKDPFVNVYLSTLKNHNDYILDMNIRLGKMNFAISSFDKLYEALLLKGDVKEAYYYGLLLNYDVNNVAMFYSLSDIERKNIEYRVADYLKEIQK

SEQ ID NO: 4988 - protein, 130 aa, Proteus mirabilis
YCLITVYTTKHVAQILCQEGIMSAQPVDLQIFGRSLRVNCPPEQKDALLASAAELEQRLQDLKERSGVSNTEHLIFIVALNMSHELAEEKLKTRDYAYNMEEKIKMLQQSIEQALHDQGKHHDRTFSTSK

SEQ ID NO: 4989 - protein, 393 aa, Proteus mirabilis
GFIMQALINNVTHSFTSIFGYAPTHFIQAPGRVNLIGEHTDYNDGFVLPCAIDYQMVVAAAKRDDNLIRVIAVDYQNAQDQFSLEHPIEFLPNKMWANYIRGVIHFLQQAKYVFQGMDIAITGNVPQGAGLSSSAALEVAIGQTVKTLYQLPISQKEIALNGQKAENQFVGCNCGIMDQLISACGEESHALLIDCRSLATTAVKMPESAVVMIINSNKKRGLVDSEYNTRRQQCEEAAKILNVTALRDATLAQLQAKKTLMNDKVYRRARHVITENERTLQAAEALKQGDLTKLSELMAQSHISMRDDFEITVNEVDTLVEIVKSVIGSQGGVRMTGGGFGGCVVALVTPDLVAKVTQAVEAQYKTQTGLKETIYVCSASQGAGYLEITNGIK

SEQ ID NO: 4990 - protein, 576 aa, Proteus mirabilis
SPIIIFELIPLSRGKMKKKVVLLTLLSCFSTSGLSANETGNLGSISESRRALQDSQREINQLIEQNRYQQLQEKAVNISPTPTLITESEHCLPIKGVYIQGITLLTEKDLNSLSPLPDQCIKSADINRLVKELTQRYLQHGYITARIQFLRPNQHGELGLYAIEGFVERIEGGDRGVNTTLLFPRIKGQPLKLATLDQGLDQANRLQSNKVTVDILPGTELGGSVIKLSNQRKSPWHLNIASDNYGQKNSGRWLIRTNASLDSPLGLSDFVSLNANITTDNPNTRFNRAYTLLYSIPYGGFTFSSFGSYSEYQFHQKLQTRTVSLYGDTTQVGIRGDYAFSRSQKQIDTLNIQVTHKRIRNYFSQIRLDLSSPKLTTIELGINHLQIIPNGVLSTNLSVEKAVGWFGAEETPYITNGNGNDYRFTKVKLFANWYQRFSLWRSTFLFNSTFLGQYSHDTLPGVEWLSLTDKNAIRGFDQSTLSGDNGGYLRNTLSYPYRLNHFSITPRIGVDIGQVKQHGNYKGWQGGYGLSSGLNIQYQQAQLDLEVAKGELLYHQTNSNKTKDPTQLLVKFSYLF

SEQ ID NO: 4991 - protein, 443 aa, Proteus mirabilis
IITMKLKQSACLAFMMFPALSFANNEFNFVIEDFDRYLEAQQPVDIKPEPSATISSSSTPDQRSGTVRSTVTLKEKPPQKPQQKIQPKQPVVRNEHQTVVRNEHRPVVATPSVPQVTLSEQCSVVSTNTNKINSDYTHYLTPLLSFVPIKPQFTPEDLNRYYQSKSVVYNPLMLYTRKRYPGQPYQSTDNTLLDFIPNTVYSVTEIPFHFLYQFKRSLLDHKQPLFNKELLNRLANTREKYQRLYQKFTEQTALLTESLTKLQTAEEKVQQLTAELAKTQDKLAVANNLLNDDSLKQSVAKLQNELAQSKKEQDTLLAQLAEKDQLLFDATEKNKVLTKQQEDFDIQAQKLNQLTTHVAQLEQQKQQLQSQYGQAQRLLTNNSAKKEIEVLQNSLTNLSAVRQSLENQLAKNKASFEATLAKNNQLIDTQRQQIAQLNDHIKK

SEQ ID NO: 4992 - protein, 322 aa, Proteus mirabilis
ENAMKPVVILYQPLPEKLQQKLSAVAEVKQFNALSLDCADFKATLAHAEGLLGAGGNIDKHFIEKAPKLKAVSTISVGYDNVDVATLTERHIKLMHTPTVLTDTVADTMMALVLTVSRRIPELADNIKQGLWVKSITPDWYGTDVHHKTMGIIGMGRIGKALAQRAHFGFDMDIIYHSRTEYNDVNQHFNAKFCSLEMLLQQADFVCITLPLTPETHHLLSAKQFALMKADAYLINAGRGAVVDEKALINALEQRQIAGAGLDVFEQEPLPTSSPLLTMKNVVALPHIGSATKETRYAMAECAVDNLIAALTDNVKENCVNF

SEQ ID NO: 4993 - protein, 101 aa, Proteus mirabilis
SEHIKEQNMTIDIENKARINWACRRGMRELDISIMPFFENEYDTLSDDDKRLFVRLLECADPDLFNWLMNHGRPDDEDLYYMVKLIQERNRIRMAEIVNKY

SEQ ID NO: 4994 - protein, 548 aa, Proteus mirabilis
KENIMHTEGVGLSTIDYAIFALYVIIIISLGLWVSRSKDGAKKGTKDYFLAGKTLPWWAIGSSLIAANISAEQFIGMSGSGFSIGLAIASYEWMAALTLIIVAKYFLPIFIEKGIYTIPEFVENRFKSRNLKTILAVFWLALFIFVNLTSVLYLGSLALETILGVPMMYAIIGLALFAVIYSLYGGLSAVAWTDVVQVFFLILGGLFTTVLAVSYIGGDGGIMEGLSKMTAAAPDHFKMILAKENPQFMNLPGIAVLIGGLWVANLYYWGFNQYIIQRALAAKSINEAQKGLVFAAFLKLIVPILVVVPGIAAFVITTDPTLMAGLGTMAQEHIPTLAQADKAYPWLTQFLPIGAKGVVFAALAAAIVSSLASMLNSIATIFTMDIYKEYIGPKSSETRLVNVGRISAVIALIIACFIAPLLGGIDQAFQYIQEYTGLVSPGILAVFLLGLFWKKTNAKGAIIGVVLSIPFALFLKLMPLGMPFLDQMMYTFIFTAVVIGLVSLTSTKSDDSVGAIVLTDATFKTQSGFNIASYIIMIILCVLYAVFW

SEQ ID NO: 4995 - protein, 808 aa, Proteus mirabilis
GLCMSGRITKINTIKKMAVFQDFQWSSSVRDDGNNIAEFKNINIIYGRNYSGKTTLSRAFRALETGIISDKYDSAEFQFSFDTNNIITQDTLLNHGQIIRVFNEDFIKENLRFIVDDEQTINSFVILGENNAKIEEEIRKNEEELGNEDDKSGLISILLDADNKVKEADKIHSKRSIDLEDKLRNKANQSGTGIKHNKIFGDANYNVSKIKTDILTISKNTYSPISGDKVSKLQDLLREVPKPTIPESPPLDLQYSIIESEAKKLVEKKIQTSETIQELLNNAILASWVRTGRELHKYKQEKCAFCGNILPEDLLQKIDKHFNKESEELHESLNILLSTIEKELLKIPNLLKIKTIDFYSNFANDLNTLNDDLSKLSIDYSKSLSLIKEQIEKRKSDIFTPLEFHSSVSVEDSINELRYSYEKIRSKSNDFTKSLNTEQVKARNELRLHEVYKFITDIKYVDERNTINKLLKEKEDLEKTSINIKQNVDEKRKKINELKGKLKDESKGADRVNDYLNNFFGHQYLSLKAIEEKLDGKISQYRFEVTRNNKKAFHLSEGECSLIAFCYFMAKLEDVETKGNQPIIWIDDPICSLDANHIFFIYSLINAKIVTDEQYNDGEELKTRPRFKQLFISTHNLDFLKYLKRLPGALNRNKSQYFIINRTEQKSTITLMPRYLKDYVTEFNFLFHQIYKCANAQVVNDENHDCYYNFGNNARKFLEAFLYYKYPNAMEKDDKLSRFFGDDALAASLTDRINNEFSHLAGVFERSISPIDVPEMKITAKFILKKIEEKDPDQYSALLQSIGQQDNS

SEQ ID NO: 4996 - protein, 145 aa, Proteus mirabilis
SIGIKHYYFKWRVRSMSQIPSELKYAQSHEWIRSEGNGEYTIGITEHAQELLGDMVFVDLPDVGSEVDLGDDCAVAESVKAASDIYAPLSGEIIAVNEELDGSPELVNSDPYGDGWLFRIKAKDESELNDLLDAAGYQELVENEE

SEQ ID NO: 4997 - protein, 195 aa, Proteus mirabilis
LIFIVILQYRRVKMSHFNIGVVVGSLRKDSYNKQTAKALTSLFPQEFTFQFLDIGTLPLYNQDDDDKTPEAVVEFKQQIKQCQGIIFVTPEYNRSIPGVLKNALDQASRPYGTNAWDSIPAGIIGVSIGNISTAIAQQHLRNSLAFLNMPTLNQPECFLKWYDGMVENGQFSEKTAGFMQNWVNSYINFVKHNQK

SEQ ID NO: 4998 - protein, 1589 aa, Proteus mirabilis
STFIATNGDNSMKSKNFKLSPSGRLAASLAIIFVSLNAYGNGIVPDAGHQGPDVSAVNGGTQVINIVTPNNEGISHNQYQDFNVGKPGAVFNNALEAGQSQLAGHLNANSNLNGQAASLILNEVVSRNPSFLLGQQEVFGIAAEYVLSNPNGITCDGCGFINTSRSSLVVGNPLFENGQLKGYSTLNNTNLLSLGKNGLNTTGLLDLIAPRIDSRGKITAAEISAFTGQNTFSQHFDILSSQKPVSALDSYFFGSMQSGRIRIINTAEGSGVKLAGKFTADNDLSVKADNIQTDSQVRYDSYDKDGSENYQNYRGGITVNNSGSSQTLTKTELKGKNITLVASSHNQIKASDLMGDDITLQGADLTIDGKQLQQKETDIDNRWFYSWKYDVTKEKEQIQQIGSQIDAKNNATLTATKGDVTLDAAKINAGNNLAINANKDIHINGLIEKESRSENGNKRNHTSHLESGSWSNSHQTETLKASELTAGKDLGLDAQGSITAQGAKLHANENVLVNAKDNINLNVQKTNNDKTVTDNHVMWGGIGGGQNKNNNNQQQVSHATQLTADGQLLLAADNNVNITGSQVKGNQGAFVKTTQGDVVIDNAMSETISKIDERTGTAFNITKSSHKNETNKQTSTGSELISDAQLTVVSGNDVNVIGSLIKSADKLGIHSLGDINVKSAQQVTKIDDEKTSLAITGHAKEVEDKQYSAGFHITHTTNKNTSTETEQANSTISGANVDLQANKNVTFAGSDLKTTAGNASITGDNVAFVSTENKKQTDNTDTTISGGFSYTGGVDKVGSKADFQYDKQHTQTEVTKNRGSQTEVAGDLTITANKDLLHEGASHHVEGRYQESGENIQHLAVNDSETSKTDSLNVGIDVGVNLDYSGVTKPVKKAIEDGVNTTKPGNNTDLTKKVTARDAIANLANLSNLETPNVGVEVGIKGGGSQKSQTDSQAVSTSINAGKINIDSNNKLHDQGTHYQSTQEGISLTANTHTSEVAQDKHQTTFHETKGGGQVGVSTKTGSDITVAIKGEGQTTDNALMETKAKGSQFTSNGDISINVGEDAHYEGAQFDAQKGKTVINAGGDLTLAQATDTHSESQSNVNGSANLKVGTTPESKDYGGGFNAGTTHHSKEQTTAKVGAITGSQGIELNAGHNLTLQGTHLSSEQDIALNATNKVDLQSASSERTEKGNNLSGGVQAGFGKKMTDDASSVNGLGSAQFAIGKQDEKSVSREGGTINNSGNLTINGNSVHLQGAQVNSKDTQLTSQSGDIEITSAQSTDYKNNWGTDIGFNGKKTNTTPKEVTEEKPATSIHNIGGKLLVNVEDQQKTSHQNATLETGTLTINSNKDLTLSGANVTADSVTGNVGGSLNIASQKESNRHVTVGVNVGYNHTNDPKSSQVNKTAKAGGSLLEKTIKDTIDSGIKSSTDAISDKYNSLSSTIADKTGISDETKAKIDQGFGKVGNGIKNIVTGAEGHTANADIKVTHVDNDAVTKTTSLTSNNDLSLNVNGSTKLTGAEIASKQGQVDLGGSSVKLENIEGHHYEAGADLDLKSSVVDLAKQLVGGDISFKSPVKTNETVNTKASISEKK

SEQ ID NO: 4999 - protein, 78 aa, Proteus mirabilis
KRIIPAIFSKIIFSITVNKHHFKIFSCVLFSLSMLIPFHVFSPYNLIALTIICTQMHLKKNKIAISDIKGLFLIITFR

SEQ ID NO: 5000 - protein, 67 aa, Proteus mirabilis
VIHIPASGFIYMASIIKSMLENPCINKEFEKLIAADLLPILQNETNMTENFTALHLIKKTNNRRIIL

SEQ ID NO: 5001 - protein, 81 aa, Proteus mirabilis
LGGICKIVWRESMFFECIPISVYCKLFDETTDAINKRLQRQFWHEGVQVLKVEGSKERWIDIIEVNKWARKNKQNTHYQEV

SEQ ID NO: 5002 - protein, 207 aa, Proteus mirabilis
TNAMTYTVALTGGIGSGKTTIANGFASLGVPLVDADVIARLVVEPDSPGLKALQQHFGDTILLPDGKLNRAQLRHIIFQNQQEKAWVNQLLHPLIQQETQKQIQQIRAPYFIWVVPLLVENKLTHLADRILVVDVTEEEQITRTMQRDGVSRDHVLKILQAQAKREQRLAVADDIIENHDNSLNQDEQIKQLHQHYLELAQKSNTGQ

SEQ ID NO: 5003 - protein, 67 aa, Proteus mirabilis
KKKIIDLFIKMINYMEKVFMAINEKFVQEISSINYNNGIFSLYFVGQDPHKIAQGIMPEKDEELALK

SEQ ID NO: 5004 - protein, 192 aa, Proteus mirabilis
LIRMRIMMELATPRLRLREWRESDKAPFFLHINASASVMRYFPSPLTRAESDAMVDTLRDKFIQQNGWGLWAVELKETQELIGFVGLNIPNAPLPFNPCVEIGWRIAQSHWRKGYTYEAALTVLKYAFEQLKLEEVVAFTAVTNLPSEGVMKKLGMKKSEYFMHPSLDKTHPLAQHVLYRLKKADFIFPINV

SEQ ID NO: 5005 - protein, 286 aa, Proteus mirabilis
LMRILMLCGMIMLSSIVQARPNQQVPQLTPQVSTYYHIMEKEVEHQGKQYRFFLAIPKNTPKTTVLYSVDGNAQFPLIVNEALAQAKKPLPVIASLGYVGEKAYFIAERTHDYTPRVHGEAFAKGGNVEQFYQFMVSQLKPYVLAQMAQENITITEQSLFGHSFGGVFTLYVLFNHPDAFQRYIAASPSLWWGKGEWITQDKWQQIPNNVAVTITLGELEETPDFSQMSEEQRLRYQTRSSWLTPRQLCDYLTDAGKTCQFYLFTGKGHGSSIPDAIKTALEQSTE

SEQ ID NO: 5006 - protein, 221 aa, Proteus mirabilis
FKGIDMNKLSETERQAGVQLLSQLKMFNEAVVYFDQHIEPAFWKSFDKCIDRFIKNNNWAGDADYENKGYCWLAPKNWLIEDDNCKYYFATSTTVDEELDYTLAVLTGQGIEQGNFGFEFQLNAAHFGGARKLASYNNSMSEKHKEDKEKLIKIGLKDQVKGNYFIPIIIDSKLLADCWALNGEFPVEHEIFSPLRNALEILFESTNTLDNMFRDAIEVSE

SEQ ID NO: 5007 - protein, 398 aa, Proteus mirabilis
LTVLIVETRVVKQNTTLVRKGDSTLVPVAGLTVFAIASGYLMSLIPLSMDSFGIDTFYASWLASIYFIGLLIGSVMIEPIIAKIGHRLSFVLFLLLLAFTVSILPLLPYLSVWLVSRFFGGMAVAGIFVVVESWLLIGDNPKERAKRLGFYMTSLYGGTTLGQLAIGAIGTQGAIPFIAVLALLLIAVLPPLFFKQGQPQCHEHKSLSLKQISRLNKASLVGCMVSGVVMGSIYGMMPLALNQGQFNTDQIGVLMAAIILGGMVVQPIISKLSVMMSKTLLLAMMCLVGVFAMGMTYLSNDYVVLIIALALLGMSSFALYPIAITLACDHVNASYIVAITQVMLLSYSVGSAMGPLGAGMFMSQASNGIMNFFFVVLLATAVYMLFASLRRKSHIVLN

SEQ ID NO: 5008 - protein, 133 aa, Proteus mirabilis
GKMMSLLKNKNNVLALSMAVTVLTLSGCSILSGDSQPVEVVPTQVQSTVTSPADNNYQQMNVGEQKLASQTACIKQLDSLKTFSPAEYKSMVDEFKEISEINALYRSVENTASKISLALLKMSIEFKTEGTMC

SEQ ID NO: 5009 - protein, 1824 aa, Proteus mirabilis
GKMMSKILKDLEFTFTGKRYGTDGNDDIDAIGFGGIIYAGKGHDTITVGTLAVTAYTGDGHDFVRGGSAYLKIIDENGDLDVRGLNAWGEIEKSGHGDLKYVGASAAIKINHTGYEYGNINYSGAAIANIITRKGAISNINYQGAGGYNQIWHETNTGNMTFKGGGGYNKLVRTWFNSYQNSKGNINFEGLGGGNGIFSRVETGDIKFTGGGLENVLIREGKSGDIFMYGAGANNRLTRISRNTDTYKETSGNIYFSGGGGYNHIYSNIAQGNITFYGAGAYNEIIRTTQVHPHNDLLVEYTKAENIFLTSAYMLNLDLDKSINFLTSDNKQNFESGKPVEVKAIKSLREPNTYLFKTPGPGDTNLFISDYGRRDYTFNKVKIYNDPETGKLQYDSELWRITPDSGDIRNIRFDKKNFEDTYNLSVVNNCWNTLEKQEIIESPRFTKINADSHYQLSNLKVFQHINTEQIQRKSLETIKLGVAQELFKDDNSAECSGDINFTGGGAGNVIKSDVTQGDINFTGGGIANVIKHNSNYGNTNFTGGGAANIIVKKGQRGDLTFDGGGLANVLLHQSKEGRMNINATGATNVLIRIGDGEYKAHLTALGNVSIHKGQGDSHITMLGGLNTHTQIDSHQRDKALWRALGGLNVMTQVGAGTITSLLGGGGNVLTKMGEGDLSSIMLGDANIITHISNNKIKSNTYTITLGGLNILTKKGQGDILAIMGGGGNVLTHIGNGNIHGVMLGGANILTKVGNGDLSGIMLGIGNVLTHVGDGQTLGIMGAVGNIFTKVGNGTSMGAMVGGGNIFTHIGNGEAWALMGGLGNVYTKIGNGNTLALMIAKGNVFTHVGDGMSVALMLAIGNIATKVGDGMTLAAMIGSANIFTHIGHEETFAAMVGKGNVLTKVGNGLTLGLMLGVANIYTHVGDGISIGLFSGKANIMTKVGNGTTLSAMFGKANIMTHIGDGITGILALGQANIITKVGDGIAGIIAGAKGNIVTHVGDGITAAILGGKANILTKVGDGLTVGLLISKVGNIMTHIGNSTTIGFAKGNANIITKVGYGLGINAAWGKANIFTHIGDGERYNFAKGNANIITKVGNGQETSVVKGNINIITHVGSGNNYTGAWGNGNVVTQIGDGRQVALAKGHANIVTMLGKGDNYGIVWGKANISTKVGNGTQVTIAKGQANITTTVGDGLGVTVTYGNANINTKVGNGVSVNVAWGKYNVSTKVGDGLNVSVMKGTANANIHVGNGLGINASYAKNNVIVKIGNGDIYSLSVASSNTQSNKLATFFGNIKQSVLGVVGSQAINYLVQGDDVTTSGSRKGKGAIHLIEKSSIDGFKMNKIDEVKSNIDINLKGHITEVETPSLSDVNTDESNLTNNSPNLIINGDFKHGFKPVTEGWNIAYTQDKITAISQYGHRASIDTPTNTNNKDYWDGGLIAEYKEEYEPNIAIYQDISGLMQNEVIELSFEYERQDNTPTENKLSVIWNGEVVFTSSSDDKSIAWQQQQIKLTANAENNRLIFTIPGSDGLQGNNYRLRNIVAKSAVANINKHISDSDATKNALADKKKADANRQKLTDEKQRLLDHISTTQTELESTDHLALEKNGHRERDAILEEANSVTHNLTTVGQTLEVLSEYSQDAPPSDQPWSEPFAEGILKDVQKSLINTKKIVSVPVNNIKTQYVANLTKVKKSIKKSEYGVIQSEEHCQEVQLDTSKAKNDADKRYSDAIDKKNSAQMAEKKASTMVEDARSRGDTEQKTATSISDKAQKEAKSVQLKESDKPNRHRAHGSGLSGEAAYVEGADDNPSSYIKPISTKKMMVVSIIN

SEQ ID NO: 5010 - protein, 90 aa, Proteus mirabilis
RSAIVMDISQDIRRLGENLKGRLAPDIVDFDLEYIDHSESILAFETLCDHIADYDVVITSDEYKQIIGIVNKLNLELDDRYLYINPDNIK

SEQ ID NO: 5011 - protein, 78 aa, Proteus mirabilis
EKEIQMSTFIRRSRNVALAIDAGRKSGSANIEGNTPADIQASLLKSLGEFTASIPTTKQQPYVKGSHGANHKKNYFGR

SEQ ID NO: 5012 - protein, 192 aa, Proteus mirabilis
IKVFMEYQFKSYSKGSKKKSLPSYIFVILYCSWLAYLFLSLYLGDNIVLFEWFPKWTIIIIFAIFTGIIGGIWHPFFRPSKYVISDYWGAFLGLMIIIPTFNVLAYLSLDQTIHYQTQYHIVSPGPERLKAPQCEYGIRIKEIYTGEWVFWCIRDPKSKTKENTGTVWVTAKTGPIGADIVDYQFYSPNAQQ

SEQ ID NO: 5013 - protein, 248 aa, Proteus mirabilis
YCFVIYPLKRNNDMKKLLLSLTMLAIISTPVLAKSPVANLKINGDIKPPTCTINGATQSDVIFDYGVISPTLIPQSKIYSYPASMVQNTVTVECDAKTYLTFVASDTYDNTELSVNNTSDWFHLVDKANPETAVGAAYFVWDNVTVDGKPAYISRANDAAITGTNYYNVLYKGPTNGWTSKQQTESVDKGSLALISGEIFQANFRQGIESNPTQTFILSRDELSKKGIDLSNGLDFIGEAVLTFNFGV

SEQ ID NO: 5014 - protein, 149 aa, Proteus mirabilis
VRFVMYKKILVPIDILEDELSQELITHIEQIAQVGKPEIHFLTVIPNAELFFGIEFAAIPEKFKDSSERTRLAFIALQDMIKDAKIPDEQIVCNVGVGNAKDEILEYARQIDADLIAIASHRPNVSSYLLGSTASSIVRHAKMSVLVIR

SEQ ID NO: 5015 - protein, 87 aa, Proteus mirabilis
LSSFLPYNCALMPTVEKRNPHRQPPVARQYLIYRYEDRRLSNRNGIAANQDKISTFMVESDTPIVLNHGSSTNINRVIYKEQILINN

SEQ ID NO: 5016 - protein, 74 aa, Proteus mirabilis
LFLVWASINIILINFLFILLLLVISKYFYILFKSSFNNCNDRLFSTKIKHLQRLVQNQYYASLNSADYHCFSCL

SEQ ID NO: 5017 - protein, 180 aa, Proteus mirabilis
TKRVQLLRVVHQGGEQMPNSEERKSTSYYWIYGIMVKFVSETYDLIRLFMIDKKKLHIAAGVICDKQNNVFITQRPLTSHMGGYWEFPGGKLEDKETPEQALYRELQEEIGINVTQCQLLETVEHDFIDRHITLSFFLVTEWENKPYGKEGQLSRWIPIMSLNAEDFPPANRSIVALLQK

SEQ ID NO: 5018 - protein, 441 aa, Proteus mirabilis
RIGVGMNKQEFLSRRQALLAQMKPASAAIFFAAPEAQRNADSEYPYRQHSDFLYLTGFSEPEAILVLIKSDETHNHSVLFNRVRDLTAEIWFGRRLGQEAAPEKLGVDKALPYEDVGEQLYQLLNGLDIVYHAQGEYAFADEIVFNALDTLRKGSRRNLKAPQTLIDWRPIVHELRLFKSDAEIELLRKAGKISALAHTRAMQKCQPGMYEYQLQGEIEHEFISHGARFPSYNSIVGSGENGCILHYTENETKMRDGDLVLIDAGCEYEGYAGDITRTFPVNGKFSRQQREIYEIVLKSLNVSLELYKPGTSIKEVTKHVVYIMVEGLVKLGIMHGDIEHLIETKAYQRFFMHSLSHWLGLDVHDVGHYGTDRDRILEPGMVLTIEPGLYIAPDADVPQEYRGIGIRIEDDIVITETGNENLTAMVVKDPDEIEALMAGKI

SEQ ID NO: 5019 - protein, 579 aa, Proteus mirabilis
RFMVTIEPTLRRRVAKATALPESLDPLLRQIYANRGITSETQLERSLKGLLHYQDLNGIDVAISLLVEALKLQSRIVIVGDFDADGATSTALAIKALRQMGFQQVSYHIPNRFDDGYGLSPQVVHDVAKKGVDLIITVDNGISSFEGVDVAHEYGIRVLVTDHHLPGHSLPQADAIINPNLADCAFLSKSLAGVGVTFYLMTALRAELEKQGWFTAQGLARPNMADYLDLVALGTVADVVPLDENNRIFVYEGLRRIRAGRCCAGIKALTEVSRKTLSQLVSSDLGFALGPRLNAAGRLDDMSVGVALLLTNDIGVAREIANELDGLNQTRREIEAGMQEEASTIFRQFITTQDDLPNGLAIYHPQWHQGVVGILASRIKEKLHRPVIAFAPSGDGLLKGSGRSIHGVHLRDALERLNTLNPGLMVKFGGHAMAAGLSLEEDKFPLFQRHFSALMAELVSAEQLQGVILTDGELSDSQLSLPIAEMLREAGPWGQAFPEPLFDGKFTLLQQRIVGSKHLKMMLQPINSHVMIDAIAFNVDVNIWPDNSIKTVELAYRLDVNEFRGQRNAQLLVEHIWPC

SEQ ID NO: 5020 - protein, 416 aa, Proteus mirabilis
MVKVSLEKEKIKFLLLEGVHQSAVENLRAAGYTNIEYHKGALSGEELKQAIRDARFVGIRSRTHLTEEIFAAAEKLVAVGCFCIGTNQVDLDAAARRGIPVFNAPFSNTRSVAEMVLGELLLLLRRIPEANAKAHRGIWDKQAKGCFEARGKKLGIIGYGHIGTQLGILAESVGLDVYFYDIENKLPLGNATQVRHLSELLNMCDIVSLHVPETPSTKNMIGHEELLRMKPGAILINASRGTVVDIPALAQALESKHLSGAAVDVFPTEPGANNDPNDPFVSELIKFDNVILTPHIGGSTQEAQENIGYEVAGKLAKYSDNGSTLSAVNFPEVSLPSHGDDVNRLLHIHENRPGIMNSINNVFTEENINVAAQYLRTAGNVGYVVIDVTTQTKAQAELVLQKLKGLPGTIRARMLY

SEQ ID NO: 5021 - protein, 503 aa, Proteus mirabilis
VIGVCMNKTISEHVDVALIGAGIMSATLGTLLKELESNLKVAMFERLNDCGQESSNSWNNAGTGHAANCELNYTPPNPDGTVNISKALEVNTEFDLSRQLWSYLVTKGKIADPRDFIHACPHMSFVWGADNVKFLHQRYRQMSANHCYENMQYSEDKQQIEDWAPLIMEGRDPNQQLAVTRVATGTDVDYGALTHLLVKQLSQQDNFELHYKHDVIDIKRNETGGWNIEVKDLTTHDKYLITAKYVFVGAGGRAIDLLQKSGIPEGKGYGGFPVSGIWLRCDEDKISSRHHAKVYGKADVGSPPMSVPHLDTRIIAGKRSLLFGPYAGFSSKFLKHGSYLDLFESIRPSNIEPMLDVAKDNWSLTEYLIGQVLQTSAHQFEMLKQFYPQAQHEDWQEAVAGQRVQIIKPAAKHHGVLEFGTELISSADKSFSVLLGASPGASTAAFIAINIIKSCFKQQLENEGWEDRLKTIIPTYGIDLKIDADACRNIRASTAKILKLETP

SEQ ID NO: 5022 - protein, 753 aa, Proteus mirabilis
FLLLCYIYIKRMSFKRNIMSRKIKNILISIFLVFMAFGLYLNKNQIQPELKPNGYSYYQKGDYKEAFNYFSQHAQSDPQAAFSLAMMYWDGIGVDKNALASQKWLIKSANLQNKNALYNLGYLRNKGLIQSPTDDAQGLTSLTKAADLGSSIAKDFLHDLNFPVIYYDQKEYTLLPIYGEQSWSEKKRTLEELEKLAEEGNKEAVYQYLENKDSVKQSKKTKNMIRPFIEEKDPKMMYLKYKLISQDINLLFDSAYLNYPEATYLLYQIYKGDKKNYPLQENSFLANIYLKKSADLAHHDGLIKIIEELNNSNTLSSNYFRNLLEKYIDTLLLKYPNSPQAMLALANVYLKPNSSFYNFEKALKLVEKAYNIQPSPESKLLLAKLYSNSEGVHQNIRKAVSFLKENITNDKLTGKSQRELVKIYFDFGASDYLKKEEIVNILRESVIKNKSAGTFNQNYSLAHFYADLLLEEDVANNEEYAFSLYQKARGYAYEATFHQAIATIKYKNIIDDQALINIVSELKDDLESRRLTEKKRQEGYSILFRYGMDSQYVIDFIVERSLYDDKIRKAIQPLLSQNTNLVFQYTIKNIIHENSANNINEDNLKKYYKDIFKLAEIGSIDAIKFIITKEYKDKSAGDEIYQDYSFDKLTNITIKERLAWRKKCADLGNFICLKELAIIYRDGKEGVRKNIAKASEYERRISINSSHFELESEKYEIDRRWKEKRDNTLDYLLNQKESSKQQLELARFYSIEV

SEQ ID NO: 5023 - protein, 316 aa, Proteus mirabilis
GRLFIQNKIIIMTHNHIDDIELNMAEKTQSDKFKAAKKSTLVSVFVNIFLSIFQITIGFFSHSQGLIADGIHSLSDLIADFVVLIANKGSQKQPDADHPYGHFRYENAASLVLGTILLIVGLGMIFSAIHKMLDPSIIPDVHSIALYVALLALAAKEGLFRYMLAVAKKVDSSMLVANAWHARSDAASSLVVAIGIIGSLAGFKFFDPLAALIVGLFVGRMGWRFTYQALQDLMDRGADEETLEQITNTLITTPGVQGVHDLKTRRAGDYLLVDVHLEIKGELTVNQSHDIVVNAHDRVLKQHAQILSVMIHVDPA

SEQ ID NO: 5024 - protein, 278 aa, Proteus mirabilis
AEVLTLAFITLKYIGHQQEIFRMDNLTEHRNSSLANWLPDFFKQWPKNIDWSREKKHTKIDINTAELTQFLNQLSAPLKLVQHRALSFDPWEVAGLERKEVRNTAILAWLLDPKGTHGFGRLPLQTLLQIIRHNKNDIPKDYHHYCRVQVETNPTGDCTNRVDIEIDADNFLLFIEVKIDANEQPEQIARYCKDAKQRSMSRPWAVVFLTPQGKESQTRGKDFKSEYVPCLSWRQLASSLEDPLQSHYNEFISADNYSPSRQIAAHAVFCFLNRIRQF

SEQ ID NO: 5025 - protein, 207 aa, Proteus mirabilis
PKSLAKNQTAQKECYMRYIIIFLSLILYGFNLMAYSEQTLVFIRHGEKPNNDSGQLSCQGLNRALALPNRLITQFGQPDALFAAAPKQNKLGNSLRSLQTLTPLAVKTSLPIHLNYHAKEIDPLRNKLLSEEYQNSVIFIAWEHDNLVKVVRDIMAQFGGDPKAIPKWESGDFDSIYILKIIKEADKKKVLFEQQHQQLNDVPKQCP

SEQ ID NO: 5026 - protein, 357 aa, Proteus mirabilis
LMALNENRFFKPEQMTTQAAFDGLPAQVVILTNRFGMSISIMDIGATWLSCIVPVNGYRRDVLLGSADMKAHQQQTAYFGATVGRFANRIAGAKFTIAGTEYRLVANEGNNTLHGGKQNFSHRRWTIVAQSTQSVTLSLLSADGEQGFPGTVEASVTYTLTDDNEVHINYQAISDKTTALSLTNHAYFNLAGEHTQRTALEHDLVIHASHYLKNGAGNIPTGEIVDVTGTGFDFRQLKRIGIDFMRDECQKAANGYDHAFILDKQKIADKASIATVIAPEGELKMDVFTTMPSIQFYTGNFLAQSKGKTRRYGNYSGLALETQYFPDGPNHPEWGENQGILAANTPWHSQTIYKFYQ

SEQ ID NO: 5027 - protein, 81 aa, Proteus mirabilis
RSQFLSLGGYMFSERQSLVSQLKNTHPRFQALYDKHHRLDQEIAKLEGPNGAGYNDEVAKLKKEKLYLKDEMQKILQQAEK

SEQ ID NO: 5028 - protein, 85 aa, Proteus mirabilis
YAKLSHCYRNSSSEEYMEKKLVNIEHEVAALKVILKSLLLTLTNKQKESVIYDINKTIRNAYAEHPQYQDIIEKTEQYIKKILQK

SEQ ID NO: 5029 - protein, 194 aa, Proteus mirabilis
QLFSNMNLIRLLKSNLQLFSLFLKKNNPVISKIDFDCGLLEQVLDPDNVLSWGYWIKHHCHCVYGEDLSHHFQAFKPSKAIAVAVNGDFMEVLDKLVIQIKASSNENKKLQLRRSAARKLIRATNILRSEQDNDWPDSLHEYRAKFNSRYPALAEDMDYLLEISIKPRESIADFEKRAMAFARWLSCEFNNQKA

SEQ ID NO: 5030 - protein, 146 aa, Proteus mirabilis
KRFSKTSYITLRSDKTVSGMSKHSNDFIYMQDNPCMHCGACCAYFRVSFYWAEMKSGGGVVPDEFTEPLTPFLSCMKGTNEKQPRCEKLIGEVGECVSCAIYEQRPSPCREFEQSWANGVKNEACDRARAAFGLPPLPNISLPHSA

SEQ ID NO: 5031 - protein, 211 aa, Proteus mirabilis
ASFSTNSSFAAGAEAGAFAGAEGAADVDAAGAAGACAAGAAPATSKVMISEPVFTLSPTAILISFTTPAKGAGTSIEALSPSTVIRDCSSAIVSPTFTITSVTSTSSPPISGTLTSLIAEAAGADAAGAGADAEGAGALPATSNTMIREPVLTLSPTAILISFTTPAKGAGTSIEALSPSTVIRDCSSEMVSPTLTITSVTSTSSPPISGT

SEQ ID NO: 5032 - protein, 191 aa, Proteus mirabilis
KKFSGTIVTFISKNILKIFMKIGLFYGSSTCYTEMAAEKIRDILGEEFIDLHNVQECDITLMQEYDILILGIPTWDFGEIQEDWLAIWETLPTLDLKDKLVAMYGMGDQIDYGEWFLDALGMLYHHLLPSGVKFIGFWPIEGYEFTSPKPLTDDGKHFVGLALDEVNQFEESDERLSQWCMQILREIEENL

SEQ ID NO: 5033 - protein, 68 aa, Proteus mirabilis
CSVSLPSSPQSKRLIMRCFLEARHWHSFHLEKMKAIVMKTVGGVPKLGVREYSSLLKINKIIKSNASE

SEQ ID NO: 5034 - protein, 490 aa, Proteus mirabilis
FTELTPPRWEKLMAQPFIHTSELCWSSQELDLMAQAIESCFLQYQIRGEVVGYDEGATFTLFRIELGRGIKVSQVIALVPELCRSLSVVDIKVIDFIAGTPYIGLRVTNTYRRAVPFIECFNQWNENNGLSSLSVMLGEDIIGEPIGWDLAQMPHLLITGVTRSGKSMLMHSLVMSILYRNPPDKVRFVMFDTSQLELSLYNDIPHLLFPVASDSIESIKPLSFLVSELQRRQKLFSALNQRNLSGYNKVISNAKELGKPIPDPFGRSNKNYSEHPYLDSEPEIVVCVDDYVQFIGEYKQIGEMLVLLSQQGHAVGIHLILTTRSPLSTGIGSQLRINIPTRIALSVSSRADSNLILGQYGAESLFGLGDMLFVSPSFSGPIRIQGTYVSDSDIRDAVDYCKRWGSVSYLNLYDDVQNTNMSAEELDSLFAQVVEFTVEKQWVSISGIHRQFRIGYNRAARIIEQLELQGIVSEQNCNGNREVLAPRFDS

SEQ ID NO: 5035 - protein, 964 aa, Proteus mirabilis
IQELPAMTQTLTQLEYRDEFIRRHIGSSPEQIKEMLDVVGISSLNELTQKIVPDNIQLATPPNVGGGATEQEALAELKAIARKNKRFTSYIGMGYAPSVLPPVILRNLLENPGWYTAYTPYQPEVSQGRLESLLNFQQVTIDYTGMDLASASLLDEATAAAEAMAMAKRVSKLKNAERFFVADDIHPQTLDVVKTRANTFGFEVIVDKAEKVLELEGVFGVLLQQVGTTGEIHDYSQLISELKTRKIITSVAADLMALVLLTAPGQQGADIVLGSAQRFGVPMGYGGPHAAFFACRDEYKRAMPGRIIGVSRDAAGNRALRMAMQTREQHIRREKANSNICTSQVLLANIAAMYAVYHGPEGLKNIAQRIHRLTDILAAGLIQNGMTLRHQTWFDTLTVETADKAGVLQRAKDAEINLRTDIVGAVGVTLSEVTTREDVVRLIEIISGKAFSDDIDTLDALVASSSTSIPTAMLRKDAVLTHENFHLYHSETEMMRYMHRLENKDLALNQAMIPLGSCTMKLNAAAEMLPITWPEFTEMHPFCPPYQAQGYQIMIEQLSNWLAAITGYDAMCMQPNSGAQGEYAGLLAIRRYHQSRGEGNRHICLIPSSAHGTNPASAHMAGMTVVVVGCDENGNIDIADLKAKAEKHQAELSCVMVTYPSTHGVYEEGIREVCEIIHQYGGQVYLDGANMNAQVGITTPGFIGSDVSHLNLHKTFCIPHGGGGPGMGPIGVKAHLAPFVPGHSVVEMDGVTTQGAVSAAQFGSASILPISWMYIRMMGSEGLKQASQVAILNANYIAQRLKDDYDILYSGAEGYVAHECIIDIRPLKANYGISEMDVAKRLIDYGFHAPTMSFPVAGTLMIEPTESESKVEIDRFIDALLSIRAEIAQVDDGVWPIDDNPLVNAPHTQYELVQEWSHSYSRECAVFPSEATKRNKYWPAVKRLDDVYGDRHLHCSCAPISDYE

SEQ ID NO: 5036 - protein, 62 aa, Proteus mirabilis
ANFSTSHQTYPYGSAPNGKTCGDTLSCYGTFPCPYPLTFASRNRSNSPNSCPYGSYPSSINW

SEQ ID NO: 5037 - protein, 129 aa, Proteus mirabilis
RLISLMLNIAIAVFIGGGLGSVLRWLISYRLNSLFPHFATGTLVANCIGAFIIAFGIAWFSKAPNIDPIWKIMLTTGFCGGLTTFSTFSVEVVALFNEGRIGWALGTMGANLAGSFLMTAFAFWLLREM

SEQ ID NO: 5038 - protein, 266 aa, Proteus mirabilis
YNRFQGASRRDSQTYSEDNQYVMRRMKYLVAAATVSLLLSGCSSSDKDATADMSPSELYATSQEKLLDGNYGAAIKQLESLDNRYPFGPYSQQVQLDLIYAYYKSAELPMAISAIDRFMRLNPTHPNIDYVLYMRGLTAQALDDSALQGFFGIDRSDRDPQHARVAFKDFSQLVRYYPDSLYTADATKRLVFLKNRLAKYELSVAKFYTKRGAYVAVINRVEQMMRDYPDTEATREALVYMENAYKKLGLTQEADKVASLIAANPA

SEQ ID NO: 5039 - protein, 123 aa, Proteus mirabilis
GTPLSSTTAVAGLFVCSVGFWMCIRVDFISGFSNYIHNVPSPHQINDAVVVFPAESNIPPVYIYAGYPGKIYLDEKDTRDEQDKEFNQVKDAVKFTAAFYKETFNVYGEKAEQFVCTFLIRMQ

SEQ ID NO: 5040 - protein, 250 aa, Proteus mirabilis
AIRFWRVSRCGVNEMITKKLRESIFEHVKAEYPKEACGVICQKSRVKKYFPCSNLSDNPTEHFELSPEDYALAEDWGEPIAIVHSHCGDGVTTQPSEIDKLQCDATGLPWVIASCPEGDIRIIYPRGERELEGRPFVLGYADCWSLIMDYYHQKHGIELHNYSVDRHWWEEGENLYMDNYEKAGFVDVTGEPKEGDMVIMQVQADVPNHAGVIMNGMLLHHLYGQLSRLVPYSDYWRDRTVKIVRRKEFV

SEQ ID NO: 5041 - protein, 349 aa, Proteus mirabilis
GSLSMASTNQPAHTEVIDRWLEQAGSSVTEYNFYQLVELLNKIIHQDVNSMEDDSGILRFKSYSNIAFPTRDVISIEKNNVEQYELEVAFLGLQGSQSPLPGYYLDEFAWEDAQQIEGISAFLDIFNHRLIALLYRIWRKYRYYICFENEGQDSFSQYMFSLVGLGNGANRGRIKINHSKMLAYAGLLASPSRSSDVISSLISHCFDLENVKVIGWETRRVPIPESQQNKLGTISHQSGQKSRPRMLLGENFSLGSHIYDCNGKCTIEISELSLERYMRFLPNGSDFAPLVAFVSYIFHEQLAWDLRLSIAEKQAEGFRLGHQQHNQLGWQSFLGQPAKKPDVTITVLE

SEQ ID NO: 5042 - protein, 181 aa, Proteus mirabilis
KRLSHFMAIIGIFFGSDTGNTENIAKMLQERLGADNAEVHDIAKSSQEDIEAFDILLLGIPTWYYGEAQCDWDDFFPTLEDIDFNGKLVALFGCGDQEDYAEYFCDAMGTIRDIIEPRGAVIVGHWPTEGYHFEASKGLADDNHFIGLAIDEDRQPELTEERVDAWVAQIKEEMSLDEILG

SEQ ID NO: 5043 - protein, 131 aa, Proteus mirabilis
AQLSNDQDIVIRRGYYMKLKRNSFYLIVLLSLVTLNGCQSFHVANDNWQGKDKAQHFLFSMVASAGANAYADHQNYSYREGLVIGLSFSISLGVAKELYDSRPQGTGWSWHDFAYDVAGAAAGSLLYQQLK

SEQ ID NO: 5044 - protein, 99 aa, Proteus mirabilis
TAISYFNTNQFTALCGTALVSMAYLDILFSNIHLHINLMKKLLLVVIALLAFGSLGGVFLAGLNIYTRSTTPVDTEQTQPNRSPAQQFPALPDSSPSTK

SEQ ID NO: 5045 - protein, 68 aa, Proteus mirabilis
DFSSIRLFFGSFFDKMINQRANEHFSRKLMQKAVDGFVCNTHNAPRNADEGYAKKDGYVAQLVRAQHS

SEQ ID NO: 5046 - protein, 260 aa, Proteus mirabilis
LFSSFYHLKQLMTIQKKRMSIQLKNINCFYGSHQALYDINLECSAGETMVLLGPSGAGKSSLMRVLNLLEMPRSGELDIAGLHFDFGQQPNAKAIRTLRQNVGMVFQQYNLWPHLTVLDNLIEAPCRVLGLAKPQAKEKAMKLLERLRLSDYAQRFPLHLSGGQQQRVAIARALMMEPQVLLFDEPTAALDPEITAQVVDIIKELSETGITQVIVTHEVEIARKAASKVVYMENGRIIEQGDNHHFTAPQTEAFANYLSH

SEQ ID NO: 5047 - protein, 289 aa, Proteus mirabilis
RVTSASLHLYTIKGLIMSYRVIALDLDGTLLDDQKRILPGSLTALNLARKAGVKVLIVTGRHHVAIHPFYQALDLDTPAICCNGTYLYDYLGKKVLESDPLTPEETRAVLDLVKQTDVHHLVYADDAMMYDQLTAAVQRTLNWADTLPLAQRPNLVKVDDFYQAMHHVDSIWKIATTTPNHDELRALIEQVEQQVGLECEWSWVDQVDIAKKGNSKGRRLQRWVEANGMKMSDVMAFGDNFNDLSMLEHVGLGVAMGNASDEVKARAKLVTKNNNQPGIAETIHKYILS

SEQ ID NO: 5048 - protein, 594 aa, Proteus mirabilis
PPASKLHRMPNQYRKLAIIAKKAIQGRRMTFQIADTLYYNGLIYTADNSNNFVEAIAVSQGIIIATGTKSNLLAYCNEKTQHIDLQKKMVMPGIIDAHMHPFWGGATLAGCHLDYLSLTIDEILSRIQRYLDADPTDSDTAWLKVSAWYREGMQPEGIQMTRYHLDSLNTSRPILLFSSDCHSVLANSRALELLNITAETPDPPDGNIERDGDRTPIGILEDAPAMQAIDSLPPLTAEQNLQIARHVQKLLNQQGVTTIMDARVGEPQLRAFNTLREAGELTVRVENAVEITPDDVADIAAIPHAVQQAITRFSHWHQISQGAQPSVAIRHIKLFLDGVLQAPIMTARLHAPYRINVGTDETPHWQDSEHVGDLYFSPEILTPLVTEISRAGYHPHIHTVAEGAISVALDAISEMRNALPEKDIRPGLAHNELMCEKDYARFAQLNTYPFLSFQWAGVEQHNIDKDLEMLGKARCQYLETAGKFIDAGVTVAFGSDWPIDPLNEWYDFKVAMTRQKDPSQPRLDNDRNLTLIEVLRAATINAAYALDMDKQIGSLEVGKFADFIVLDRNLFEISAEDIENVRVLCTIIAGKPTI

SEQ ID NO: 5049 - protein, 472 aa, Proteus mirabilis
CIKSITTILHHDTGELIMTGLIIAALVTALVVYLLARGYKPQPVLLLGGMLLLLLTASLDLNPLLPENKSTQFKYFDIFQIFTDIMSSRLAGLGLTLMAIAGFSRYMEHVGASRALFAIFEKPLKTIKSPYLLLVISFLVTQILVIFIPSHAGLGMLLMVTMYPILIRSGISPLSALAVIGCCQFIDHGPGSGNVIMAAKTADIEPAVYFVQHQLPITIPIIIAVAITHFFIQRWWDKREGFVFDPTAIDNVKEEGSQVPLSYALLPVIPLILIIGFSPLFHNYIKLEVTTAMIISTVIALVFEYVRLRDAKAVMNSFMLFFEGMGKQFVLVVSLIVSGEFFANGLLKSGAVDTLISSAQDAGFGIAAMIIVMSAILALAAFLMGSGNAAFFSFAALTPKIAAFLKVDVITLILPMQIMTSFGRTVSPITAAIVAIAGIANVSPFQIVKRTAIPMAIAATVNLAMTFWFLYT

SEQ ID NO: 5050 - protein, 579 aa, Proteus mirabilis
SVESIALMHYHSCSSTRDKKRTKMKSDIEISHQAPLLPIQDIAKKINVDQDDIEFYGKYKAKFSQSIWSKITSKKQGKLVLVTSINPTPAGEGKTTVTVGLGQALNQLGKSAIIALREPSLGPCFGLKGGAAGGGYSQVVPMEDLNLHFTGDFHAITSANNLLAAMLDNSLYQGNPLNINPKKIIFKRCMDMNDRALRHLVIGLGGDKDGVVREDSFVITVASEIMSILCLAKDINDLKQRLARIIVAYNYEGEPVSAEDLNAVGAMATLLKDALNPNLVQTLENTPAIIHGGPFANIAHGCNSLRATKLALQLADITVTEAGFGADLGAEKFFDIKCRIGDLQPDCAVLVVTTKALKYNGGLGKTQWDHENLTALATGIENLGKHIENLKKYGVPVIVTVNAYVTDSAKEHEFIAQYCQQRGCRFAISQVWEKGGAGGIELANQVIDTLENDAPQFQLLYPDNMPLKQKIETIAQKIYGAKGVTYNANAQEMLTKIEDMGFGHFPICMAKTQYSLSDDPALLGRPTDFTINIREVYVSAGAGFVVALTGTINTMPGLPKKPAAMAMDVDDHGAIKGLF

SEQ ID NO: 5051 - protein, 85 aa, Proteus mirabilis
ALESSSLSIINCCNSEPCKRVTFFYLVNSIEKITKRYFKGIYTNKSILLDDLFQLSIAKTSIKYGCYSTLDLEKFIYAYLLRHNK

SEQ ID NO: 5052 - protein, 374 aa, Proteus mirabilis
DMRSVNERLMDELIAHSLFSGRYSTGVARRMIKALNEFDAELTASLIVSLDDTSIDVNSFTARRLESLLSSVRSINKRAVDSAFSLLTEEMRAHALYEAGYYPSLFDALLPDVVLRKYPLMSITEEMLFSSVMSRPFQGKLLSEWADGLESDRMTRINNAVRNGYLNGDSAVEIGRKIRGHANQGYKDGVLQLSRANATTIAKTAISHLQATARDQFADANKDILDCKQWLSTLDNKTSHDCIIRDRLRYTLEGKPIGHKVPYLQGPGKIHFNCRSTETLVTKSWRELGIDLDEMDAGTRASMDGQVPADTNFLDWIQRQPEWRQRQVFGETRFRLMKEGGMHPSEFYTDKGEFISLERLREIDGHAFREAGYS

SEQ ID NO: 5053 - protein, 826 aa, Proteus mirabilis
PLMSCKYRSFIMTLLSIVLFLVLIGILSYRKYSLVVSSILLIAYTFVMGLANIWSYWLLLPVALILLPFTLPSIRKAYISAPALKAFQKVMPSMSKTEQEAIDAGTTWWEGELFRGAPDWKQLHNYPKPQLTAEEQAFLDGPVEEVCRMTNDFQITHELADLPPEIWQYLKDHRFFAMIIKKEYGGLEFSAYAQSRVLQKLAGVSGILAITVGVPNSLGPGELLQHYGTDEQKKRYLPGLAKGDEIPCFALTSPEAGSDAGAIPDSGVVCMGDWQGEQVLGIRLTWNKRYITLAPIATVLGLAFKLRDPDHLLSDNENPGITCALIPTDVKGVEIGHRHFPLNVPFMNGPTRGKDVFVPIDFIIGGPKMAGQGWRMLVECLSVGRGITLPSNSTGGLKSAAMATGAYSRIRRQFKLPIGKMEGIEEPLARLAGNAYLLDAASTLITTGIMLGEKPAVLSAIVKYHCTHRAQRGIIDAMDIVGGKGICLGPSNFVARSYQGSPIAITVEGANILTRSMIIYGQGAIRCHPYVLDEIAAARDNNLHDFDHALFGHLGHVASNTLRSLWLGITNGRLSTAPTKDETRRYYQQINRLSANMALLSDVAMGVLGGSLKRRERISARLGDILSHIFLASAVLKRYEDEGRNTADLPLVHWGIKECLYQAENAIDELLRNFPNRFVAGALRAIIFPLGKVQKLPSDKLDSKVAQIIQQPSETRDRIGKGQFLTPSEHNPHGLMEEALLDILAAEPLFERICRLYEKKFSFTQLDKLADKALADKRVTPEEADILRKAEQSRLRSINVDEFDFDALAVPAKKSSTDTIKTDKAA

SEQ ID NO: 5054 - protein, 60 aa, Proteus mirabilis
SATFPCPIKGRICCNISDNNALDNVVVTADSLDRQGHPVGCPCDYLLKMYNFLLVPPNVK

SEQ ID NO: 5055 - protein, 274 aa, Proteus mirabilis
KQPSTIPLPTSKVYSIAFVLRGRKTAPFSSRGTMLKFILIFLTLSVSIVAQASVVIMGTRVVYPATQKSINVQLNNDDESPALIQSWLDTGDAAAAPDSIHVPFIITPPIFRMEPKSGQTIRIVYTGESLPQDRESLFYLNVLDIPAKPKLEENSENSEGNNNYLQLAVRSRIKFFFRPDNLNVTPDDAYQKVTWHQEGALRIKAINPTPYYITYNKISVGQDKQLTPVEQSGMIAPFSSKIFSLKEKPILTNKVTWVVVNDYGGYQQGESTLE

SEQ ID NO: 5056 - protein, 774 aa, Proteus mirabilis
SGESFKEEVLMLNHELELSLNIAFAKARDNRHEFMTVEHLLLALLSNKSAREALEACKVDLAVLREELEIFIRKTTPILPEHVDRETQPTLSFQRVLQRAVFHVQSSGKNEVSGANVLVAIFSEQESHAAYLLRKHDVSRLDVVNFISHGILKDDQQNSDDQSDMGDINAQSQQEMPQGDDRMDNFTTNLNQLARQGKIDPLIGRQAELERTIQVLCRRRKNNPLLVGESGVGKTAIAEGLAWRIEQNDVPDVMKGCTLYSLDIGSLLAGTKYRGDFEKRFKALLKTLEKDEKSILFIDEIHTIIGAGAASGGQVDAANLIKPLLSSGRIRVIGSTTYQEFSQIFEKDRALARRFQKIDVIEPSADETVLIIKGLRQKYEAHHDVRYTNKAIQAAVDLSVKYITDRHLPDKAIDVIDEAGAKTRLIAPSKRKKTINVSDIESVVAKIARIPEKTVSSSDKSMLKNLDNQLKMLVFGQDQAIHALAESIKMSRAGLGQENKPVGSFLFAGPTGVGKTEVTVQLAKALNIKLLRFDMSEYMERHTVSRLIGAPPGYVGFDQGGLLTDAVIKNPYSVVLLDEIEKAHPDVFNILLQVMDNGTLTDNNGRKADFRNVILVMTTNAGVHETQRKSIGFTEQDHSTDAMVEIKKAFSPEFRNRLDGIIWFNALSADIIAMVVDKFIVELQAQLDDKGVSLEVSQEARQWLSDKGYDKAMGARPMARVIQENLKKPLANEILFGSLVNGGSVSVTLNDQENKLQYQFTSQEKLAKKEDTVI

SEQ ID NO: 5057 - protein, 402 aa, Proteus mirabilis
YRFFRLTSLILGDKGMFALTNAVIYTGYDRLEDHAIIINGSRIEQVCPQDQLPKDIATRDMQGAIVSPGFIDLQVNGCGGVQFNDTAENVTVKTLEIMQKANERLGCTSYLPTLITCSDELMKIGIEATRAYMQKHQNKVLGLHLEGPYINIIKKGTHDPQFIRQPSAQMIDYLCDNADVIAKITLAPEMVDEKYVRQLITAGIVVSAGHSNATYEEARKGFRNGISLSTHLYNAMPYISGRGPGLVGAIYDTPEVYAGIIADGLHVLWANIRNSKRLKGEKLLLVTDATAPAGLDPNKNEMDSFVFAGKTIYYRNGLCVDADGTLSGSSLTMIDAIKNSVLHVGIPLDETLRMATLYPARAIGADNELGTIEAGKIANIASFDKDFNLCTTFVNGIEITDN

SEQ ID NO: 5058 - protein, 98 aa, Proteus mirabilis
LLTFNFNDKSILKNRVYALIGNNGVGKTQLVSKLPCDIANDNKNLFSGKVPLFSKIIAVSYSIFDKFSIPENSSKINYIYCGLRKKIKTKKVIYQKKS

SEQ ID NO: 5059 - protein, 72 aa, Proteus mirabilis
PPFPVVIPLYRADPHTLLTRPPLVSKKASFLLLPLDLHVLGLPPAFNLSHDQTLQLKVFDAQRNRKLSLFII

SEQ ID NO: 5060 - protein, 588 aa, Proteus mirabilis
RGTLIMRVLLPFLALYRRHWFMLLLGILLAILTLLASIGLLTLSGWFLAGTSLAGFAGIYSFNYMLPAAGVRGAAIFRTAGRYFERLVSHDATFRVLSHLRVFTFKKILPLSPGGIARFRQGELLNRLVADVETLDHLYIRVISPIIAAFVVIMTIMFGLGLIDARLANTLGGIMLTLLVVLPFVFYYAGKPIGRDLTDLRGQYRTVLTSMLQGQAELTIFGALPRFRQNLAQLEARWLRRQAQQANLTGLSQSLMILASGLTATLILWLAADGIDAHFMPEALIALFTFCALAAFESLGPVTVAFQHLGQVMTSATRITHLIEQQPDVTFPAQGGEIKPSASLTLRDVCFTYPNQPMPVINHVDLTIEAGQHVALLGKTGCGKSTLLQLVNRAFDPSQGVITLNHLSLADYDEATLRSMMSVVPQRVHVFSHTLRENLIMAKEDATDEELTHVLRQVGLEQLVENDEGLNAWMGDGGRQLSGGEQRRLGLARAILHNAPLILLDEPTEGLDADTEQQILALLQQHCQGKAVLMITHRLSGLDKMDKICVMDGGHIVETGTHRQLLQQQGQYAKFHQRQALLMPHDEA

SEQ ID NO: 5061 - protein, 387 aa, Proteus mirabilis
RFSPDKTVYDLLNQQKMVNVMSSSQTLVVKLGTSVLTGGSRRLDQSHIVELVRQCAKQHEKGHRIIIVTSGAIAAGREYLNYPDLPATIASKQLLAAVGQSALIQVWKQLFAIYGIHIGQMLLTRADIEDRERFLNARDTLHALLDNKIIPVINENDAVATAEIKVGDNDNLSALAAILGGADKLLLLTDIEGLYTADPRSNPDAKLIPEVFDINDELRQMAGDSVSGLGTGGMATKLQAATVAGRAGIDVVIAAGVKPDVISKVIDNEPVGTLFHGLKSPLETRKRWIFGAPVAGVIIVDNGAEKAIKEQGSSLLPKGIKEIKGDFSRGCVIRIQSLQGKDLAHGVAHYNSDALRLIAGHHSQEISQILGYEYGSVAVHRDDMIVS

SEQ ID NO: 5062 - protein, 122 aa, Proteus mirabilis
ATNPSSRLSTALLCCCAAALASAAALALASAAAFAFASASAFALASASAFAFASASAFAFASSAFCFAANSACFFASASALAFASACSFKIRSRSALACAAASSACFCSSFALAAAVAASRR

SEQ ID NO: 5063 - protein, 204 aa, Proteus mirabilis
NCLFNLKKGNKMRLCDRDIIQWLDEGKLVIEPRPPVERINGATADVRLGNQFRVFQGHTAAYIDLSGPKNEVNEALERVMSDEIVLPEGEAFYLHPGELALAVTLESVTLPDNVVGWLDGRSSLARLGLMVHVTAHRIDPGWHGHIVLEFFNSGKLPLALRPGMVIGALSFEPMSGSADRPYNRRQDAKYKNQQGAVGSRISED

SEQ ID NO: 5064 - protein, 112 aa, Proteus mirabilis
SQLFGGYMATITVKKSRKPEFLRGASANRRHARRKAEAIAKKNIELKLESVFPQEKRLTSVEKTLSLSHIPVTRNIEPKFKPSVDNCCLPNVAVFSGVKTKQPSSEFGVTAR

SEQ ID NO: 5065 - protein, 212 aa, Proteus mirabilis
IFMLLPQNIMITMAFFTFLKGCSDYFSTSVLARLSPIRYQQLWQVYLIICFYWSFTISNYSLLILFLLFSFYLLTLSFFDADYLQLPDNLTFWLLFFGITLNLTPYGVISSTCSFYGCLVASLFFYSIYWLGYWIYQEAILGLGDVKLFSAIGAWCGIELLPYILFFAALLGIVIYMLIWAFTNVKIKQIAFGSCLAFSAIVVLRVKTIIMY

SEQ ID NO: 5066 - protein, 96 aa, Proteus mirabilis
RIMLDKSYQLLNKGPIRALVLIMALAMAFCVMWDPSRFAANTSSLAIWQGILLIWAVCAGAVFGLAYRPKHVVAQYLLHPIPAIIILVVGLYYFFF

SEQ ID NO: 5067 - protein, 362 aa, Proteus mirabilis
NLFPYISPLIIKLRNIENSLLVKGFSMNSFNSIKKPTYFYLPDGKIVINYMYGWPKQPHSNITKITYIFPDYDKKRNYSNKKYSVTEKDRIESIKHTAKVYELTYLKEKKEKEIASLKYYRNKYSISKIAELEKDIEDIENSINKNKNSIHPYFYNTQTTIYPHQQEVISDILNEIAYITQAKFVASNPEFDADIKFGFYDDFHISHGSIEFSYTTRGFATYPSRYSTPIKKINIDEQYQYSGTIFLNLSSHQYYKIIHQNDLDNYIKTEGNIGDAFNFKDNGTVLIIKKTNTLIETLKNNKYQPGTYHYKVVLHEVGHALGLSHSWQYLEYKDKNHVLASWNILVWGMIYQPQSLLILGGL

SEQ ID NO: 5068 - protein, 493 aa, Proteus mirabilis
VFSPFGVLYLEIGVGAYFFFSQSQRGNNAMVMQHAKPGRVALAVMGALLVTALPAKMSYAEGFIDDSTLTGGIYYWQRDRDRKELTPNSPDYGKYKANLHHSTFNANLDFSSGYLGDFFGIDLAAFGAVELNNSGPAAPNEIGFSDAKSRWDEKWTGDRSGVSIYKAAAKFKLGHFWAQGGYIQPKGQTLLRPHWSFLPGTYRGAEAGAVFDFDKNGELSFSYMWTDEYKAPWYRNMYNFRKADLETNISYLHSFGAKYDFKNSLVLEAAFGQADGYIDQYFGKVSYDFPIANNTLKTSYQFYGAKDKVTGGGINDVYDGLAWLQAFTLGYTYNVFDFKVEGTWVKAEGNQGYFLQRMTPGWATSNGRLDIWWDGRSDFNANGEKALYAGVMYDLKNWDLPGWAIGTSYVYAWDAKPSSNPIYDQSKRIRESAWNADIMYTVQEGRAKGTLFKLHYTRYDNHSDIPSYEGGFGNIFQDEKDVKFNVIMPFTIF

SEQ ID NO: 5069 - protein, 339 aa, Proteus mirabilis
KAVFHAPFNNNDKESVTMSASYLSRVNAINWNRIEDEKDLEVWNRLTMNFWLPEKIPLSNDIPSWNTLTQAEKQLTIRVFTGLTLLDTIQNTVGAPTLMPDAQTPHEEAVLSNICFMEAVHARSYSSIFSTLCLTTDVDDAYRWSEENTYLQKKSDIILRYYQDSDPLKKKIASVFLESFLFYSGFYLPMYWSGRGKLTNTADLIRLIIRDEAVHGYYIGYKFQNQLLNKSSLEKQDIKDFAFSLLLDLYDNEVKYTEDLYDSVGWTEDVKKFLHYNANKALMNLGYEALFPDEITNVSPAILSSLSPDANENHDFFSGSGSSYVIGKTINTEDDDWDF

SEQ ID NO: 5070 - protein, 190 aa, Proteus mirabilis
MQPPSASPLEINVAIFIAKYLVYLFPLSLAFYWLWGNEKHIDQQRTLACKAGVALIIALSISWFIGMIAPHDRPFAANIGYNFLDHEATPSFPSNHGTFVFTIALAYLFWHNSKRIGMLMLILGLAIAWARIYLGVHWPIDMVGAFIVALLSCALSQILWSQGGKKLQKAIHQLYQLCFAYPIRKGWTKA

SEQ ID NO: 5071 - protein, 265 aa, Proteus mirabilis
NKGPYFGAFLSRQFWSNPVMSVLGRIHSFESCGTVDGPGIRFIVFFQGCLMRCLYCHNRDTWDTHGGQIVTVDELMKEAVTYRHFMNASGGGVTASGGEAILQAEFVRDWFRACKKENIHTCLDTNGFVRRYDPVIDELMDVTDLVMLDLKQVNDDIHQKLVGVSNQRTLEFARYLAKRGQKTWIRYVVVPGWSDDDDSAHRLGEFIKDMKNIEKVELLPYHELGKHKWVALGEEYKLDGIHPPSKETMENVKAIIASYGHKVMY

SEQ ID NO: 5072 - protein, 60 aa, Proteus mirabilis
SNSFTLSKLRYSTPCLKKKLLIIIIRRKRSGYTGIKTLWGYSSAGRAPALHAGGQRFDPA

SEQ ID NO: 5073 - protein, 61 aa, Proteus mirabilis
ILPPCYTLQKLTGSVMNLANLSQEEKDKINVDLATSGVAYKERLNMPIVASKVERQQPAHL

SEQ ID NO: 5074 - protein, 87 aa, Proteus mirabilis
YVPFVGNPLQLFLETNLGLSIRLCIISGRIRTVLLYPGVKAVSGDIETCCNAGNRMTTINNLFDCFNFKLFRITLTAHGHLSLSHLK

SEQ ID NO: 5075 - protein, 363 aa, Proteus mirabilis
LMKPTKKVVIVGSKFGEVYLNAFIQPQDKWHLIGLFSKGSTRSRELSKAFGIPLFTRFDQLPEKIDLACIVVRSAIVGGEGSQLAQAFLQRGISVVQEHPVHPDEITRLQSLAEKMHCHYIVNSLYPYNKAGRLWIENTQKIYQKIQQRPVWGQIITSRQLIYSALDIYCQAMKLHPNDITVTLEKDNTPLQFLRLSTPTGDLLLCLQKHLSSNDPDQHSLVMHHMILGWPAGYLTLAGSYGPVEWNNALYIHHHQDSKKAMYQSPATMELDEPLFHSFHTPPNSWQDVMECEAPEAINYLLAEIDKCWQLPNDKKPMILQPHYQLALSQLWIKTLQTAGKAIDGTIAPFKRMNFTKSSGRRK

SEQ ID NO: 5076 - protein, 95 aa, Proteus mirabilis
REVPMSGKRYPEEFKIEAVKQVVDRGHSVSSVATRLDITTHSLYAWIKKYGPDSSTNNAQSDAQAEIRLQKELKRVTDERDILKKAAAYFAKLSD

SEQ ID NO: 5077 - protein, 109 aa, Proteus mirabilis
KKTPRLRQQTRRVVQWNSPFNVQIYCINIQFLSQGKFRFPFFDTALEWRNYTMRQRINHEFNGCDEYKNIMENRLLQEITPLGCQRLKEALKDAKLRKAHRDKLLGERK

SEQ ID NO: 5078 - protein, 241 aa, Proteus mirabilis
TTALITISIAGRTMALVAGRHERMTHSQVMLSYGWCEMVGVEIYTNNRLIQLTDKLETICVLRKATPDELTSSSGPHDSYPRIYALNSQWMVAPISKVSIPQHGVGLEVYDEQGKMKFSSLAKLVCFEKYYDVNTGSAGKGSLRIAGKSGHRYGMIKTRSMGYFHNTNIRSYIDPDTWDEVWTFKRYSERYVLVDDVGGLTFEYRYEFLGEEDGWISMPPSREGSGLMEQGLMIDVSMLED

SEQ ID NO: 5079 - protein, 93 aa, Proteus mirabilis
ILAFLKNSSCEYDSKRILSSLEVIELNIDPLLIISIISIDKFIIINNLFLLYLLLRYFDSRLFVSDSTQRLYQASHFCLFKIINDFYFIFCIR

SEQ ID NO: 5080 - protein, 64 aa, Proteus mirabilis
YPKLFISDNCYYFLLFCRSEFYHLSFSLSDYSSDLAQANGNIILTETLTIRINRIKISHFSTND

SEQ ID NO: 5081 - protein, 107 aa, Proteus mirabilis
RIKLKAFLLVKGEKVVICTRSLKQYQEIDNHLIREVFMKLKLGNICIRPEDKEISIPVDVYMGNEADFEPPKAYLVYQTSFDANKPLSEYFKESEEYARKTIKELNQ

SEQ ID NO: 5082 - protein, 383 aa, Proteus mirabilis
YALTCANNNKDIIMKSRAAVAFGPGEPLKIVEVDVMPPQAGEVLIKISHTGVCHTDAFTLSGDDPEGVFPAILGHEGAGVVVEVCEGVTSVKPGDHVIPLYTAECGECLFCKSGKTNLCVAVRATQGKGLMPDGTTRFSYNGQPIYHYMGCSTFSEYTVVAEVSLAKINPQANHEEVCLLGCGVTTGIGAVHNTAKVQEGDSVAVFGLGGIGLAVLQGARQAKAGRIFAIDTNPEKFALARQFGATDCLNPNDYDKPIQEVLVEMTQWGVDHTFECIGNVNVMRAALESAHRGWGQSIIIGVAGAGQEISTRPFQLVTGRSWKGTAFGGVKGRSQLPNMVEDAMNGKIELKPFVTHTLPLEKINEAFDLMHEGKSIRTVIHFD

SEQ ID NO: 5083 - protein, 265 aa, Proteus mirabilis
IHITRGDIMLAKRIIPCLDVRDGQVVKGVQFRNHEIIGDIVPLAERYAKEGADELVFYDITASSDGRVVDKSWVSRVAEVIDIPFCVAGGIRSVEDAGKILSFGADKISINSPALSDPTLISRLADRYGVQCVVVGIDTWFDEKTGEYLVYQFTGDEKRTQQTPWKTLDWVQEVQQRGAGEIVLNMMNQDGVRQGYDLKQLALVRQVTQVPMIASGGAGEMSHFLDAFKLANVDGALAASVFHKQIININELKQYLAENGVKVRI

SEQ ID NO: 5084 - protein, 401 aa, Proteus mirabilis
YWITIKNLNKKITKGAKNMSNSSQSSPAHFSWRRLYALCLKETKQITRDPSSALIAIVIPLTLLFIFGYGINLDSSKLNIGILTNQQSQPAQELVYTFTNSPYINATISDNRQLLIDKMQAGEIRGIVVIPVDFAQLLARQDSKAPIQVITDGSEPNTANFVQAYTKGVWQIWLQQQALSQGIQQQPLIEIEPRYWFNPAAISQHYIIPGAVTIIITVVGAILTSLVIAREWERGTMEALLSTQITRTELLLSKLIPYQVLGSFVMVLCMLVTVYILGVPYRGSLWILAGITSLFLATALGMGLLISTLTRNQFNAAMISLNAAFLPAVMLSGFVFEIDSMPFFIQVVTYFIPARYFVSSLQTLFLAGDIPMILMLDMWLLIVSAIFFIGLTALATRRRLD

SEQ ID NO: 5085 - protein, 318 aa, Proteus mirabilis
VMATMTNNDLVIYNDLAQTAFLERRQDNLAVFNQASNGAIVLDNLFIEGDFRKRAFYQIGGSIEHRDVNSTASVENKKIGAGESVDVKAPWKYGPYATTEEAFKRRGRDVSEFSELVGTDAADASLEGYIKYSLAALGAAIGNNKEMVVTADIATDGKKTLTKGLRRYGDKFNRVNLFVMHSTTYFDIVDQAIDNKVYEEAGVVIYGGQPGTLGKPVLVTDTAPVDAIFGLVPGAVTITESQEPTFRSYEINDKENLEVGYRGEGVVNVGVLGYSWDESKGKNPDLTQLGTAGNWKKHFTSNKLTAGVMIKLTAEEGK

SEQ ID NO: 5086 - protein, 103 aa, Proteus mirabilis
YEYTGLHYNTFRYYAPDLGRFTQQDPIGLAGGINLYTYAPNPLTWVDPWGLHVQHGIDVLADDWWVKGAHAHIDKIEIAIKPGKYGQIIYKPVFSKTDVNTVA

SEQ ID NO: 5087 - protein, 179 aa, Proteus mirabilis
YEYTGLHYNTFRYYAPDLGRFTQQDPIGLAGGINLYAYAPNALTWVDPWGWSCFNSSKRFDKSNNITSRFINLLTGKTPSDVEHYLKNKGWTVTYPQSATPAKTQHVVFVKTTKSGEVYHLDYNPAGKTHGSDYWKVIKPNDPIEKVYGRIGHGNFSHYDKIKNSPVYIDGVLMNPWSK

SEQ ID NO: 5088 - protein, 164 aa, Proteus mirabilis
FQELCMSQLTHINAAGEAHMVDVSAKAETVREARAEAFVEMSAETLAMITEGRHHKGDVFATARIAGIQAAKRTWELIPLCHPLLLTKVEVHLEALTDSNRVRIESVCRLTGKTGVEMEALTAASVAALTIYDMCKAVQKDMVIGSVRLLEKTGGKSGHFKVDA

SEQ ID NO: 5089 - protein, 179 aa, Proteus mirabilis
SHGTRNARRQSPYVRTRKTLELSLKLQLIAVGTKMPDWIQTGFMDYLNRFPKDMPLELIEIPAGKRGKNADIKRILEKEGEQMLAAVGKGNRIVTLDIPGARWDTPKLAEQLDRWKLDGRNVSLLIGGPEGLAPACKAAAEQSWSLSPLTMPHPLVRVVVAESLYRAWSITTNHPYHRE

SEQ ID NO: 5090 - protein, 71 aa, Proteus mirabilis
TRGTFSKLWLKTSGGVSVRISNALSIRPRKSGTKVSMRILGFFSRIAVIQSAKCCAPPSRRSSRSTEVITT

SEQ ID NO: 5091 - protein, 254 aa, Proteus mirabilis
LLVTLNRDLTMKKILFAALLTSITLSATAADKETIRFATEATYPPFEMIDANNQIVGFDVDLANAMCEKINAECTFTNQSFDSLIPSLKFRRFDALMAGIDITPERQKQVDFTDSYYDNSAVFITVTGKISDVASLKGKQIGVQNGTTHQKFINEQHKEMKTVPYDSYQNAVLDLKNGRIEAIFGDTAVVNEWLKKNPELGIVGDKVTDPNYFGTGLAIAVRKGNADLQDKLNKALSEVKADGTYDVIYKKWFE

SEQ ID NO: 5092 - protein, 142 aa, Proteus mirabilis
SMWFQKEILLQAKPRGFHLITQALLQELPELRQYKIGIAHFFIQHTSASLTINENADPTVRSDFESFFNRCVKEHEAYYLHTYEGSDDMPAHLKSSLLGQSVSVPICQGELNLGTWQGIYLGEHRNHGGRRRIVVTLQGECY

SEQ ID NO: 5093 - protein, 334 aa, Proteus mirabilis
LYHTADKYRKTLMTDTNKKKLTINDIAKLCGVGKSTVSRVLNQDPMVNEETRKKVNSIIEKYKFTPSKSARAMRGYSNRSFGIIVTRLDSYAENQAVSAILPILYQNSIDPIILESQFSQAKVEENLKMLAHQKIDGVILFAFSGINAANLASWKQKMVVIARPLEGFVSICHDDERAVNALMHYFHRDKHYQHISFIGIQINDETTGLLRYQTYLQYCQQHQLISQAQLGELNYQSGYLLAKQALASKPQAILCATDSLAFGVQKYLAEQKIDHIEVACIGRNDLLTFLFPQTKFYRLGFRESGQEAANILIQMLEKNIPAQKIIISSHDLNP

SEQ ID NO: 5094 - protein, 263 aa, Proteus mirabilis
ILRLTVLNSGTVQMWIGVISLFPEMFRAITEYGVTGRAVKHGLLNVECWDPRDFTYDRHHTVDDRPYGGGPGMLMMVQPLREAIHQAKAAAGDGAKVIYLSPQGRKLDQQGVCELATNEKLILVCGRYEGIDERVIQTEIDEEWSVGDYVLSGGELPAMIMIDAVARFVPGVLGHAASAKEDSFAEGLLDHPHYTRPEVLDGMAVPAVLLSGNHAHINRWRMKQSLGRTWLRRPELLESLALTDEQRVLLAEFQQEHLQRTAE

SEQ ID NO: 5095 - protein, 92 aa, Proteus mirabilis
HKRLCKEGFSVSAYGVQKLMAQLGLVVTQRVAYKVTTKRKHSDAVVDNLLNQNVNPHAPNEVRAGDVTYLKTGEGWVYLVIVMDLYSRRIAG

SEQ ID NO: 5096 - protein, 279 aa, Proteus mirabilis
YDCTCHHKEKIDLILVINMKLNALLNYQIHQPETATINNLPIVLIHGLFGDLNNLGVLGRDLRQDHTVIQIDVRNHGHSPHSESMHYHDMAQDVLALLDSLNIAKAIVIGHSMGGKIAMAMTALAPLRLERIVVIDMSPVAYNVRRHDKIFAALEAVTKAHVTQRTEAIAIMRPFIEEDGVIQFLLKSFKKGEWLFNLPAIKQAYPDIIGWQEVPAWHHPVLFIRGGLSPYILDEYRDNIARQFPQATAFVVANTGHWVHSEKPETVIKAIRRFLAKTV

SEQ ID NO: 5097 - protein, 285 aa, Proteus mirabilis
RGCTMEFDYFVTPQWLFEHHDAQDLVIVDVSAPMPTQDIDYHQRYLERHIPGAHFFDLDEIADKTTSLPHMLPSDTLFSETLTQLGISNNTTVILYDIGNLFSAPRGWWTFTTLGCHKVRILAGGLQAWQEAGFPLEQGETPKVPATHPFIVTRHTQRRVDKQQILDNLTTQQNQIIDARSADRFYGRAPEPRPGLRRGHIPNSKNVPWDNLVINGQLKDKAQLQHIFEQAGVDLSQPIIVSCGSGMTAAILFLALTLLGCQNIALYDGSWAQWGAENALPCECE

SEQ ID NO: 5098 - protein, 95 aa, Proteus mirabilis
YLSTFHCDCEQTHSHFYKGYSMSVILYTKPNCVQCSATERALQQQKIPFTAVDLTQDTQALAKIVSMGYRQVPVVVNGDEHWSGFCPDKIRQIAR

SEQ ID NO: 5099 - protein, 361 aa, Proteus mirabilis
SDLTKGYSVTVIAHTQVATQEIFLEPADNDRLMSLCGPFDDNIKQLERRLGIEINHRDNRFKLTGKSLNVNAAAGILRHLYVETSPIKGVIPDIDPEQIHLAIKESRVLEQSDEHVPEFGKSTNIRTKRGVIKPRTPNQAQYIANIQTHDITFGIGPAGTGKTYLAVAAAVDALERQEVRRILLTRPAVEAGEKLGFLPGDLSQKVDPYLRPLYDALFEMLGFEKVEKLIERNVIEVAPLAYMRGRTLNDAFIILDESQNTTIEQMKMFLTRIGFNSKAVITGDITQIDLPRGHKSGLRHAIEVLSNVDDLSFNFFHSEDVVRHPVVAKIVVAYEAWEVEDQKRRQAIKAEKERLQRENHE

SEQ ID NO: 5100 - protein, 106 aa, Proteus mirabilis
YERFGMINEDLFIKNIYSKNQDRISVALVYDTLSKEAHRGCGLYYEIYESCFIGLLRDYLSELNEADTNKLRRYAESKGTKIDDASWSDALEAERECRAEIYREQM

SEQ ID NO: 5101 - protein, 71 aa, Proteus mirabilis
EERLISQVMALVLSVFVTAYHCALITDELMTVAVAVAVAVAVAVAVAVAVAVAVAVAVAVQNVEPSVLEAQ

SEQ ID NO: 5102 - protein, 155 aa, Proteus mirabilis
SMITIRKAVLSDVEQINTLYGYLFAEMAKLQPERLKPGKQDEAFIINGIKNDKFHLLVAELEQKIVGFTIAQIQETPLFNCLVQRKYAYIFDIVVDPSVRGQGAGALLLNAMKAWAKQQKMTHLELSVLAENADAKRFYQREGLKEVSTVMGIAL

SEQ ID NO: 5103 - protein, 359 aa, Proteus mirabilis
GISTMSQKILFIDRDGTLITEPPTDHQVDSLNKLAFENGVIPALLNLQQAGYKLIMITNQDGLGTDSFPQADFEPPHNLMMQVFSSQGIVFNEVLICPHKPEDNCPCRKPETGLVTQYLVESALDKTNSYVIGDRQTDLQLAENMGINGLRYNANELSWSAISELLTKKDRYSHVERKTKETQIAIDIWLDREGESQISTGVGFFDHMLDQIATHGGFRMNINVQGDLVIDDHHTVEDTGLALGEALREALGNKRGIARFGFTLPMDECLASCALDISGRPHLEYKAEFKYQRVGDLSTEMIEHFFRSLSYTMGCTLHLKSKGKNDHHKAESLFKVFGRTLRQAIRVEGNTLPSSKGVL

SEQ ID NO: 5104 - protein, 637 aa, Proteus mirabilis
VKSTNGMKKRKRTPFRDYTAESKLFIRRVIVAFSGILVLTGILVFNLYHLQVARHDDYQTRSNDNRIKLVPIPPSRGIIYDRNGVPLALNRTIYQLEIVPEKVANIQETLESLREVVDLTDDDIAAFEKERKRSRRFSSIPLKTSLDQVQVARFAINQYRYPGLEIKGYQRRYYPYGSALTHVIGYVAKINDKDVERLEKEGLYPNYAATRDIGKLGIERYYESVLHGKTGYEEVEVNSRGRVIRQLHEQPPQAGKDIYLTIDLELQTYIETLLTTSRAAVVVTDPRNGEILALVSNPSYDPNLFVGGISNTDYQGLLNNPDRPLINRATQGLYPPASTVKPFMSVAALSEGVITPNTTIHDPGWWQLPGSEKRYRDWKRWGHGKLNVTKSIIESADTFFYQVAYDMGIDRISTWMSRFGYGEYTGIDLSEERNGIMPTREWKQQRYKKPWYQGDTIPVGIGQGYWTATPIQMSKALMTLINDGQVKTPHLLYGTKLGNEMLPYVDKETRQIGDINSGYWELAKYGMYGVANLPNGTGRRSFADAPYKIAAKSGTAQVFSYETYNASQLAEHLRDHKLMIAFAPYENPTVAVSIILENGGAGPSVGDITRQILDHIILGDNNTELPISPPSPRGSEE

SEQ ID NO: 5105 - protein, 68 aa, Proteus mirabilis
QAPTLERVGILYFETRLVAPEILKIQFSLLLNLIFTDPPLPLLVLPLNVTAPEIAFSGNCVIIRSSHK

SEQ ID NO: 5106 - protein, 569 aa, Proteus mirabilis
TITTELRPEREFMYLERVEIAGFRGLNRLSLPLDMNTVLVGENAWGKTSLLDALTLSLGIETYQYAFTAEDFHRLPNEPENSKKNLQIILTFTESRPGRHRSYRFRKLAPVWIANGDARKHIYYRISAELDEQQNVKTFRYFLDKEGKQIRLANGQTKAIIAEIVRLYPVLRLQDARFIPNLTTEVIDSHNEPHREAFNNKMSELTKALINNPDNLSDEDLREGLDAMQQLLGHYFADHGALLFKSHLKHRKVSEPHIRGWHALENINKILAKPNQRNIRLIILGMFSSILQSRGSVELDPYARPIVIVENPETRLHPIMLSVAWGLLNLFSLQRITTTNSGELLSLAPLQSVCRLVRDTDKVAAYRLGDKQLHAEEERRISFHIRYNRPSALFARCWLLVEGETEIWLMNELARQCNYFFESEGIKVIEFAQCGLKPLLKYATYMGIEWHTLVDGDEAGKKYAATVKEFAAKRNDAERDRLTRLPALDMEHYLYKEGFRNVYHEVAGVPDNEKWPVRRVIIKAIQRSSKPDLALTVANNAAQRGIDAIPTLLKVMFSRVAWLARGKAN

SEQ ID NO: 5107 - protein, 79 aa, Proteus mirabilis
LIGLHMKKIILLTIISSIVSLAGCKEEAKTTKWYRDHPDELKVVYDKCQKTGSASENCKNANEAHWQIQQLNAPEVDFN

SEQ ID NO: 5108 - protein, 413 aa, Proteus mirabilis
LMGLKNLFEKVEHHFEPGGKYAKWYVLYEAVTTVFYTPGTVTRNGSHVRDTIDLKRMMILVWLSVFPAMFWGMYNVGQQAIPALNQLYSGAELQQVIASDWHYALAQYLGASLTPDAGWGSKMLLGATYFLPIYLVVFAVGGFWEVLFSLIRGHEINEGFFVTSILFALIVPPTLPLWQAALGITFGVVIAKEIFGGTGRNFLNPALAGRAFLFFAYPAQISGDLVWTAADGFSGATPLSQWSVSGQSALLNNVTQQPISWMDAFLGNIPGSIGEVSTLMILIGGAIILFARIASWRIVAGVMVGMIAMSYLFNLIGSDSNPLFSMPWHWHLVLGGFAFGMMFMATDPVSASFTDKGKWAYGILIGVMAVLIRVVNPAYPEGMMLAILFANLFAPLFDYVVVQANIKRRKARG

SEQ ID NO: 5109 - protein, 77 aa, Proteus mirabilis
VSKTPRNLTHRTNTREPPYRSPSEVTMKTNYYSAMRDCMAVRITTPQARKNKRTSPWLFSLAVVIVTTVGVIPTFVS

SEQ ID NO: 5110 - protein, 78 aa, Proteus mirabilis
RNETLDICRRKGLARACQSSRGGVSTMSWKTLIIIIGFILALLITVAGGIYLLIDNSCTKDQVSLEKRCQIALSYHRY

SEQ ID NO: 5111 - protein, 159 aa, Proteus mirabilis
SRRTNWYRYPHNFTNGWSCIMSNRTVMGFDFGTKSIGAAIGQEVTGTARPLASFKAKDGIPDWSQIEKIIKEWQPDLVVVGLPLNMDGTEQLVTTQAKKFANRLHGRFGVQIALHDERLSTVEARAHLFEQGGYRSLDKGSVDATSAVIILESWFERQY

SEQ ID NO: 5112 - protein, 328 aa, Proteus mirabilis
ITGTGTIMSKPIQMERGVKYRDADKMALIPVKTIVTEREELLRKPEWMKIKLPADSSKIQGIKAAMRKNGLHSVCEEASCPNLAECFNHGTATFMILGAICTRRCPFCDVAHGRPNAPDPQEPIKLAQTIKDMGLRYVVITSVDRDDLRDGGAQHFADCITAIREKNPNIRIETLVPDFRGRMDKALEILTDTPPDVFNHNLENVPRVYRQVRPGANYQWSLTLLERFKQAHPNIPTKSGLMVGLGETNEEIIDVMRDLRKHGVTMLTLGQYLQPSRHHLPVQRYVSPDEFEYMKEQALAMGFTHAACGPFVRSSYHADLQAQGIEVK

SEQ ID NO: 5113 - protein, 242 aa, Proteus mirabilis
SALTQRRYTMKTRFRTLILACVIASPLAHAGIPVAVDADPMRDVQWAQELKRWMETARHYQSQIQAYKDQLATATGVRDIADFVDQAKGLKADLEKLRKPGQALNDLLLSGGSSGQFDALYEKYKIFDTCNTAQSGSYANVCKQQVINKAIQLEQTDEVQNQVSQTLGEINSLSNRVALAKDSKESQDLANSIQLKSVMLNTLTTQWEMSVKAAEKRENALEAERVKQWNQQQLNAPDINFN

SEQ ID NO: 5114 - protein, 150 aa, Proteus mirabilis
IRMTDNNKALKNAGLKVTLPRLKILEVLQDPECHHVSAEDLYKKLIDIGEEIGLATVYRVLNQFDDAGIVTRHNFEGGKSVFELTQQHHHDHLICLDCGKVIEFTDDAIEVRQRNIAERHGIKLSNHSLYLYGHCAAGNCKEDSHAHDEK

SEQ ID NO: 5115 - protein, 415 aa, Proteus mirabilis
KMMTTSNNAILSQLAQTYGTPLWIYQGETISEHIEQLKAFDVVRFAQKACSNIHILRLMKQQGVKVDSVSLGEIERALVAGFQGGRERSEIIFTADLLDEKTIERVVELDIPVNAGSIDMLRQLGERHQGHAVWIRINPGFGHGHSQKTNTGGENSKHGIWYEDVPEALAVINQYNLSLVGFHMHIGSGVDYQHLASVCDAMVEQVLTSNVDIKAISAGGGLSTPYQQGDKRVDLNHYFSLWDSARQRIAQHLGHDIELEIEPGRFLVAESGVLVSQVRAVKSMGNRHYVLVDAGFSDLMRPAMYGSYHQITLLDKYGQLKSSEFQQETIVAGPLCESGDVFTQQEGGMVAPRLLPPAEVGDYLVIHDTGAYGASMSSNYNSRPLIPEVLISQGIPQLIRRRQTIEELLALEINL

SEQ ID NO: 5116 - protein, 459 aa, Proteus mirabilis
RWMTNASEAILSNLSLDFSQNEFQPLAARMRPETLEQYIGQKHLLAEGKPLPRAIKAGQLHSMILWGPPGTGKTTLAEIIGRYAQADIERLSAVTSGIKEIRAAIDIAHQNRNAGRRTILFVDEVHRFNKSQQDAFLPHIEDGTITFIGATTENPSFELNSALLSRARVYLLRSLTETDIEQVLQQALDDTERGLGGRNIILPDNTRKMIAELVNGDARRSLNLLEMMADMAEVDSQGKRTLTAELLKEISGERSARFDNKGDRFYDLISALHKSVRGSAPDAALYWYARIITAGGDPLYVARRLLAIASEDVGNADPRAMQVAIAAWDCFTRVGPAEGERAIAQAIVYLACAPKSNAVYTAYKAALADAKSKPDYDVPAHLRNAPTQLMKEMGLGAEYRYAHDEPNAYAAGEVYFPAEMAQTRYYHPVNRGLEIKLAEKLDWLSQQDQNSVTKRYRKL

SEQ ID NO: 5117 - protein, 110 aa, Proteus mirabilis
LIVTLQVMSYNMSRTQDVINYLKSKKKAISCNGSKGLLLQLESLGFEHKEGKTVGHRIFIHQRLSSMSDYKTHSVDCGHKPNREMKSAYITNTLRVLNKYKDELEEIERK

SEQ ID NO: 5118 - protein, 699 aa, Proteus mirabilis
QKVTGSMKKSIFNYTTFFISMSYSLFANASPAIKSTENRNNEVLEVYSTPLHTPQEKMAIPVSVLTQEDLRANRSASIAETLTSLPGFHASFFGGGSVHPVIRGMSGNRVKVLHSGSDLMDVSSIGADHAITSEPFLSQRIEVLKGPSTLLYGGGTIGGAINVIDSKIPVSVPEKGYEGELHYQYDSVSKGNTGSVGLTLGENNLALRLEGTKRYQSDYKQPEPLHQGETSRLAGSYQDNQSANIGVSWLFDDGYIGIGYGEQHRRYGLPGHTHFHDHEDDHHHHAPIRPPLIGHHHHDHNHEYPDEQHKHGTPYIVMDSKRWDLRGEKNNPFTGIESIRFSAARTDYHHDEKEGNEVSTTFKNKGDELRLTFIHQPILGWHGVIGGQFNQRDFSAQGEEAYVPSTKTKNHSLFLLEEYQFGDFRYELGFRQEWQSLLNWETQKNYKQSGSSISAGLAWNFTQDYFLNLSLSHTKRLPVAEELYANGVHAASRTIEKGDSHLTAEAANNIDIGVTKATGDIQFNVNTYYNRINNYIYGKFTGAELNNGYRPLQYVQHDAEFKGIEGNIDYYYYQDSLIGFSGDYVSASLLHNKGNIPRIPPYRLSAYLKHYLTENLSGQIRIDHFGKQSKTAEYETSTSSYNTVSLSSEYNGYLDQLDYTLYAKINNIFNEKGKDSTSYIKDEMYLPGRNIILGATLTF

SEQ ID NO: 5119 - protein, 110 aa, Proteus mirabilis
KKVTLLQGSELQQFIIDKLEDSKAQDIIALDVRGKSSVTDYMIICTGTSNRHLMSVADNLVDDCREAGLQPLGIEGQGVSDWIVVDLGEAMVHVMQEDSRRMYELEKLWS

SEQ ID NO: 5120 - protein, 64 aa, Proteus mirabilis
LTFATAISISALASNNSGALFNELFNIYFKEFACELNNTPPKITNVIILSLFIENTDITSNKKI

SEQ ID NO: 5121 - protein, 221 aa, Proteus mirabilis
ESIAVMSQVLEVEKQLRKLILNMELGPGERLTERWAEAKFNASRTPVRAALQKLESEGLICRDGIRWLVAPIDADEIEQLCIYREILEVAALKLSVSQITEEQLNNLERLLKETTVDSPEESMENAGTRFHRELARLCNNAFIIEGINDALRRLSRARWLDRAPSNPAWDEHREIFVALRSRDTDKAVELLATHLCESRLRLLDTITSSKRSLRARGIAIS

SEQ ID NO: 5122 - protein, 671 aa, Proteus mirabilis
SAIAHFGVYMENKGTLFKSISFVAATMVTVSSVAATEQHDNTITVTATKRIQSSFDVIGNVNVQTDEQLKKSLVNQTDDLSAVFPELLSANRSSRIYNNMTLRGQSSADFFSPSLGLFVDGAPQLSQSYAQSLQGVEQVELLKGPQGVIYGRGTLGGIISVITKKPSSHAEAWLGGQYFGQGERINTGGSTGYMENGWAFQGNVSLDRNNGSLNNPAWDKKNVDSRDIKAGWLSANYISPDILFESNLKVGGENYHSHEEYFVPFSPLSRSKIDTEWLYETPNLKRKLKNISWNTGYDFNDEWKFKTILSYQNMDIDRLFMDGTLQDDSQDILYSEARANYEGGDLSGIIGISFQKMGYRHDNLSVGKVGMGGKKSDNDIYNYSGYFDGAYRINDNWELGAGARFSHEKAKTRMIILEKGKGESNYNNNAVFNAFIPRASIAWLPNEQNRIWFGVGRGFKPGGFNKEGADKLALTSYKSETATEMELGWKWHSVNDNHMAEITLYQIDSKDVQGYVGVIGYQALSNMGDSRSRGIEYLWKSKLTPNHSISLGGMFNQSEFTSGEHKNKRPAYTPSYSSLISWDGLYGKEQKWSSRIAVRFNGPFYFNEQNNLEQGHYTVVDASISWHPTKQYELGIYAKNIGDTLYRTYAFGNKAQLGNPREIGVQGSINF

SEQ ID NO: 5123 - protein, 561 aa, Proteus mirabilis
NYSATINNNLLKNSAKLLIIPKSAYAVFIEGKTNCMEWIVDPTIWVGLSTLIVLEIVLGIDNLVFIAILADKLPAKLRDKARITGLLCALIMRIVLLFSLSWLITLTKPLITLFDHPFSARDLIMLLGGIFLLFKATMELNERLEGKDHNEGKQRKTTSFWSVVAQIIVLDAVFSLDSVITAVGMVDHLGVMIAAVTIAMFLMILASKPLTTFVNNHPTIVILCLSFLLMIGFALVAEGFGYPIPKGYLYAAIGFSIMIEIFNQLAQFNRRRFLSASRSLRERTAEAVLRIINGKPEASELDPHTSDLVANTEEVFDPQERQMIVRVLGLSQRNVNSIMTSRHDVEYVDLKATQDDIRQLLEEDPHSRLVITDEENSDEPIGVVNVIQLLNQQLRNEPLDLRLLITQPLIFPEGLSLLQALEQFRNAHTHFAFVVDEFGSVEGIVTLTDVMETIAGNLPVSTEENDSRHDLVQNEDGSWTVNGFTPLEDLVLYIPIKLDEKREYETLAGLLMEHLQRVPAVGEKVVIDGIEFEPLDVHNHRINKVRIVEPTPEDEENVDEA

SEQ ID NO: 5124 - protein, 277 aa, Proteus mirabilis
YSSAIFSLLYFPSLLGLAYVFMGLIIQEQCVIVDHNCPDWLITQSEGNPTIDYTDGLKVYAIFKRQFLSGKRRRNRKQRQLGDNCPLIYALKKKDDLYTNISSIKKLNDSFKIICNKLMELEPKGYQLIISMPSAHNISPIIAKRLAKKFNATYLTDILRKITVDNAFQLLDKADINIEEAKSLSFKIKLQAKEVGLKGGFSLKSIPTEFRNIFPPFVLNTQASSNTEKIRILLVDDLMATGTTLTTARDIIAQQYPNAIIHAICLFSSIKKQNKKT

SEQ ID NO: 5125 - protein, 164 aa, Proteus mirabilis
AGSAKEGCVTQILDMCCGSRMFWFDKEDSRAIYSDIRAEKHILCDGRKLNITPDIIADFKNLPFPDGSFYQVIFDPPHLIRVGHNAWMFKKYGRLNKESWKDDLSKGFSEAFRVLKPNGTLAFKWNETQIPTKQVLALTDQKPTIVQRVGKNDKTHWVLFIKEA

SEQ ID NO: 5126 - protein, 576 aa, Proteus mirabilis
FKSAYWIIVGQYAFCFEEKMTMNEADARPTNFIRQIIDEDLATGKNNSVHTRFPPEPNGYLHIGHAKSICLNFGIAQDYQGKCNLRFDDTNPVKEDVEYINSIQKDVQWLGFQWDGNVHYSSDYFDQLYQYAIELINKGLAYVDELSAEEIREYRGTLKEPGKNSPYRSRSVEENLALFEKMRAGGFEEGKACLRAKIDMASPFIVMRDPVLYRIKFAEHHQTGNKWCIYPMYDFTHCISDALENITHSLCTLEFQDNRRLYDWVLDNITIPCHPRQYEFSRLNLEYTVMSKRKLNQLVTENIVDGWDDPRMPTISGLRRRGYTAESIREFCQRIGVTKQDNNVEMASLEACIRDDLNENAPRAMAVIDPVRLVIENMPEGEEILTAPNHPNKPEMGTREVPFSREIYIDRADFKEEANRQYKRLVLGKEVRLRNAYVIKAERVEKDEQGEITTIYCTYDPQTLNKDPADGRKVKGVIHWVSIPHAIPAEIRLYDRLFSVPNPGAEEDFLSTINPESLVIRQGFVEASLKDAAIEKAYQFEREGYFCADKLSTADKLVFNRTVGLRDTWAKISKQG

SEQ ID NO: 5127 - protein, 94 aa, Proteus mirabilis
PSTAIGRSLIACIPKIALCGGLIIGVDINEPKTPPLVIVKLPPVKSSTVNLPSRPFTANALIFFSISAMLIASASRNTGVTRPRGVDTAILISK

SEQ ID NO: 5128 - protein, 281 aa, Proteus mirabilis
VIDAKLIIIKYLLDRQISEVWGSRSLPHFFTGGEIMSIDWDWGIFFQEAPFGNTTYLGWLISGFQVTVALSLCAWIIAFIVGSFFGILRTVPNRLLSSLGAIYVELFRNVPLIVQFFTWYLVIPELLPQAIGDWFKMDLTPNIQFFVSSALCLGLFTAARMCEQVRAAINSLPRGQKAAGLALGLTLPQTYRYVLLPNAYRVIIPPMTSEMLNLVKNSAIASTIGLIDMAAQANKLLDYSAKAYESFTAITLAYVFINVIIMLIMHWLEKRVRLPGTAGGQ

SEQ ID NO: 5129 - protein, 99 aa, Proteus mirabilis
NNIACCLKDYIMMKTKLNELLEFPCSFTYKVMGHAKPELVDQVVEVIQRHAPGDYTPSVKPSSKGNYHSVSVTINATHIEQVETLYKELGELELVRMVL

SEQ ID NO: 5130 - protein, 79 aa, Proteus mirabilis
PRIALTSTLCFCGSIPKILISPASGFSNPASMRIRVVFPAPSGPTRPVTEPPVMVAVSEATAGFSSPTKRFSTPLKLMV

SEQ ID NO: 5131 - protein, 342 aa, Proteus mirabilis
KMTAKNISLDRYKQRFFGDFLELPGLTEIAVNRPSELYTKINGVWEQHAVPLSYEDCYNFARCLAKHHGDNIEDIKPGLSATLESGERCQVIVPPACERDTVSITIRKPSKVQIPHQSYINAGFYNRVTGEEKTETHDEELIALYNTKNIPLFMEKCVGYGKTLAVAGETSTGKTTYMKMLIGYIPVHLRISTIEDNPEITFFIHKNYVHLFYPSESSDEKGSVVTPASLLRWNYRMNPDRILLTEVRGAEAWDFLKITGSGHEGSMTSIHAGSAKEAIDGFITRCYENPQCAQLPYTFMLRKVLDSLDVIVSIDLDGNVRRMNDIYFRPIHRNQYFEEMKA

SEQ ID NO: 5132 - protein, 65 aa, Proteus mirabilis
EEDAPQINAALITVIAICFPVIFLITDFLSDSKKPPMFISIMDEPSSIVITNSIDSNSFFDKRLF

SEQ ID NO: 5133 - protein, 101 aa, Proteus mirabilis
QPDAIPRWGLVVLLTNEDVMVTIRLARGGAKKRPFYQVVVTDSRNARDGRFIERVGFYNPLATGNAEELRLDVDRVEHWVAQGATVSERVAGLIKSAKKSA

SEQ ID NO: 5134 - protein, 194 aa, Proteus mirabilis
DRGARRKFHVLLKIFKNFLRRFFMPLLDSFTVDHTRMSAPAVRVAKTMKTPSGDTITVFDLRFTVPNKKAMPEKGIHTLEHLFAGFMRNHLNGEGVEIIDISPMGCRTGFYMSLIGQPDEQRVANAWKAAMEDVLKVKDQNHIPELNVYQCGTYEMHSLAEAQDIARDILSHTIGINHNDELALPEDKLKELQI

SEQ ID NO: 5135 - protein, 106 aa, Proteus mirabilis
VNLASASIDSIPMPTFLITALLIIVFTRYFNVLLNDYVSKEKLMSKLFRHIVLYASCFIETVWAGMISVVVGLMTAGVQITLALAKFSRFFIFHLKQPHPKYYPIY

SEQ ID NO: 5136 - protein, 187 aa, Proteus mirabilis
YWVAMKKIEIDDELYRYIASETRHIGESASHILRRLLKLDAKQPVQPVVVTESVQAPVVKQDADLKPVAPAKNPVREMRELLLSDSYAEKTKSVDRFLQILSTLYSLDSATFTQSAETVHGRTRIYFAGDEKTLLDSGRHTKPRHIPGTPFWVITNSNTERKRTMVQSIMQDMQFPANEIDKVCGTI

SEQ ID NO: 5137 - protein, 373 aa, Proteus mirabilis
EGYFMAFFLTKKQGKIIAAILIFIAIGLFFFWPKEHLPSYQTQKITRGELSKEVTATGKLDAVRKVDVGAQVSGQLQTLYVKEGDVVKKGDLLAIIDPKKAQNEVAESQETNNELTANLQQAKAELRLAQLTYQRQLKLIGTHVIAQEELDRTKTDVEVKKARVATYEAQIRKNQATLDTARTNLQYTRITAPMDGVVTFIKTLEGQTVIAAQEAPTILTLADLDTMLVKAEVSEADVIYLKPDLKASFTVLGAPDKAFNGKLKDILPTPEKINDAIFYYARFEVPNEQHLLRLQMTAQVKILLEHKKDILLVPLSALGEDVGINEYQVEVLVNGQPEKRVVKIGIRTDVYAEVISGLNENDDVILGEIAGES

SEQ ID NO: 5138 - protein, 263 aa, Proteus mirabilis
AMKARLKNALALLECHDVETLAVQFLKYSFFRSSLSGLIISLMNKAENKLESWNIDLTLQVQSHFLDTDITDADHPLIQLLFKGEPVFWQNLQQGSYINNAAMRGFISQLPVNTGLYSLPIYDVNHKACGTIILLGQAEELENIEQGIFPIYCELFNHQLKHLFELSNMQQKISYLQYINQLQREKETTLNETLDKLTASVATIALPTIQIKGVNDLEVAIENYEKEILLDKQQELKGDINAMAEQLSISKRALIYKLKKYGV

SEQ ID NO: 5139 - protein, 119 aa, Proteus mirabilis
SHRAPLSLDTMARWLNLRLRGLLYYGRFCQSVMDYVARHIDLYLAKWVARKYKRGHGSLVQAYEWLDRIRNVKPSLFAHWTICTRCYQSTTRARWRDTATSGSVGVQGESSPARRGNPM

SEQ ID NO: 5140 - protein, 255 aa, Proteus mirabilis
SVRAEMLIHNVAERKEAANRKMLALLTFLKEETYSDFKTLKKVVGFKGKSHRPTYALLNKAVALGFLIKHEYPVIAGKKSLWGITMQGLAMVVKPDDKVFPGYFEPGKLKYRTLEHRLLNHRVRIALEEKGGQGWLNGDRGEFIARYPGIRHRPDGIITLDSGAIVAVETERSMKTRARYINIINSHLAASDAGRWHYAMYVMPDDKTKTSLIRLFDSIKTVMRNNVPVPFDAKNSEMFLFRTIAELEQAPCSHN

SEQ ID NO: 5141 - protein, 249 aa, Proteus mirabilis
QNMAGTNIEGHMAYRINSNLVMTIDTQMLNWVNIRGSVCEQATPTLTAHASEFTVQFPISVTFYINDMVIDSQLPIPEMDLGGYVRAFTRSGTSPPQNSWALNDVTVPMRLAASQLNVTSSCKTVTSTGQVSTLNLKHGQLNTLNYDSLVTESVTYNCVFSKATKVRLRLDYITDNDPQKRLPMVSTQNSNNKIYSELTMTDEITGQKGKDFKIDINDLRTIKITSHLQGTNAIAGDYKGSAWLIATFD

SEQ ID NO: 5142 - protein, 460 aa, Proteus mirabilis
IREANIMVSVFDIFKIGIGPSSSHTVGPMKAGKEFVDLLAEKNLLSSVSRVVVDVYGSLSLTGKGHATDIAIIMGLAGNLPDTVDIDAIAPFIKQVENTGRLMLANGAQEVDFPAVGGMNFHKSNLPLHENGMTISAYNGEQLLLKKTYYSIGGGFIVDEEHFGQPEENKVEVPYPYQYAADLRRHCKETGLSLSALVMQNELALRSKEEISAHFAAVWEVMKSGIERGVNTEGLLPGPLRVPRRASALRRMLVTEDKTTTDPMTVVDWINMFALAVNEENAAGGRVVTAPTNGACGIIPAVLSYYDKFIRPVNENSYTRFFLVAGVIGSLYKMNASISGAEVGCQGEVGVACSMAAGALTELLGGSPEQVCIAAEIAMEHNLGLTCDPVAGQVQVPCIERNAIAAVQAVNSARMALRRVSDPRICLDKVIETMYETGKDINSKYRETSQGGLAIKVSCD

SEQ ID NO: 5143 - protein, 76 aa, Proteus mirabilis
SARAIYYTHSSLSGLPEALTNSEGEIVWQGQYSAWGHLQRQTRPTSTFNREQNLRFQGQYFDKDKFVGNKFEQRLR

SEQ ID NO: 5144 - protein, 73 aa, Proteus mirabilis
YFHFYTLIMSYLWRRIVIGTVLELMFSWTNPSFDASLITCSIPKVYQSLSILKFRMTLSSSMILKFIFQRITS

SEQ ID NO: 5145 - protein, 106 aa, Proteus mirabilis
VFNLAINGVYMAINTITASGNLGKDCEQRWTPNGKAVASFSLPVKQGYGEHEKVSWVICKMFGSKAEKLPPHLTKGIKVTVSGEFIMEEWTSQSGEKKSAPVIIVN

SEQ ID NO: 5146 - protein, 65 aa, Proteus mirabilis
FINFLNDNIKKSLGAYLFTISYKNQFIPYLLMNNSLFRKKWIDFYDKTRNKFILHYNDSIVNNTT

SEQ ID NO: 5147 - protein, 434 aa, Proteus mirabilis
RSFYLFMESLTLQPIVHIEGTINLPGSKSVSNRALLLAALAKGKTRLTNLLDSDDIRYMLNALTALGVQYQLSNNNTVCDIEGLAGSFHPQQPLELFLGNAGTAMRPLAAALSLGEHDIVLTGEPRMKERPIGHLVDALRQGGAKIDYLEQTDYPPLRVCGGFSGGSVDVDGSVSSQFLTALLMMAPLAQQDTTITIKGELVSKPYIDITLALINTFGGEIENQNYQRFMIKGGQQYQSPGKYLVEGDASSASYFLAAAAIKGGIVRVTGIGKNSLQGDIHFASVLEKMGATIRWGDDYIECERGKLKGIDMDMNTIPDAAMTIATTALFAEGETTIRNIYNWRVKETDRLSAMATELRKVGAMVDEGRDYLTVIPPKQLTTAEIKTYNDHRIAMCFSLVALSNTPITILDPGCTAKTFPDYFEKLASISHAKV

SEQ ID NO: 5148 - protein, 99 aa, Proteus mirabilis
KKFYERAEYRYDNLRRRIEKRLLKASAIANTVTYHQHEPDEVYTFGWVGMRLVSEHSSAAPHTTVYHAYNDQSYTPLARIECTDNPLNPHGRFIIRTAV

SEQ ID NO: 5149 - protein, 70 aa, Proteus mirabilis
MYLYDFPNEVRLKYHTFQQTEYNNLHSYPFCNYLIQFPANYTYCSKLFDEIFSLRRFFINLMEISTAIKV

SEQ ID NO: 5150 - protein, 111 aa, Proteus mirabilis
KSVYCWRMKFMSTINSIIAYRIKQKRKELGMTGREIAHSLEISQQHYSRIENGYTKITVEHLFSIAFILGVKPKELLPNYNFSNEKEIIKAKQSLSAEIIMPIKKNDMYPT

SEQ ID NO: 5151 - protein, 523 aa, Proteus mirabilis
GLVYMNNIKRECVNYLLGLMALFLLTISKITFAEINNNVNNCFLINEIKIERNGLLTNKAQKELISKYINKCLTLSDMQHIIKSMTNAYIEKGYITSQAFIADQDLSNHQLTINVIEGKIKSIFIDNMTSPMVDILFPSYQDKRLNLRELEHGLEQLNRLTTSQYRLDIQPSDRIGYSTIFIYKKNKTHPFRNQLTIDNSGSKATGEMLLTNTTTIDSLFGFGEQWDLSLNSNTDLLHSHYYRGYTASINIPYGYWFYQYQLSYNRSSHFIKSYSNKYIYKSINTNQQVDISRLLYRDSKKKIILKGILKHKKVKTELAKQPILINSPTLTSLSLAPQYHFNLTSGYLSINPSAEIGLSFFGASPDYIAENSPRSHYRKLSLNIHYQYLFPYSVSYITSFYGQYTSDNLYSVEKITIDGLNAVRGTKQNKLSANRGLYWRNEINTPWINSFLGQWRFITAVDYGVIYSDQYETKQQSLLAGAMGLSFYRSPFSSQLLINKPFIYPKWSNANQWSLSWSISFAL

SEQ ID NO: 5152 - protein, 422 aa, Proteus mirabilis
YFSYQLLFIFPEFPEQTNRMKQTRPVKLLRTRLFSATFILLAISHHAIADDTLKTMIPAVPNIEAESYILIDYNSGKVLAEKNADVRRDPASLTKMMTSYVIGQAIRAGKISNNDIVPIGEEAWATGNPVFRGSSLMFLKPGDKVTVSQLTRGINLQSGNDACVAMASYVAGSQDTFVTMMNDYVKRLGLQNTQFQTVHGLDAPGQYSSARDMALIGAALIRDVPEEYAIYKEKEFTYNNIRQTNRNGLLWDTSLNVDGIKTGHTEAAGYNLVASATEGNMRLISAVMGGHSSKGRDAESKKLLTWGFRFFETVKPLQVGKEFAAEPIWYGDTDKVQLGVDKDVYLTIPRGRLKDLKASYVLDNVELHAPVSKNQVVGTINFQLDGQVIEQRPLVVMNEVKEGGIFSRLIDYIKLLFSRWFG

SEQ ID NO: 5153 - protein, 232 aa, Proteus mirabilis
ERFLMAKTWFLTGTDTEVGKTVVSSALLQCATQQGYQTAGYKPVASGSEWLPEGLRNSDALTLQQFSSVPLAYQQVNPYCFETPTSPHIVSEETKQPIDFQVMSKGLSYLQQRADWVLVEGAGGWFTPLSANQFFADWVIEEKLPVILTVGIKLGCINHALLTQQAIWQSGLTLAGWVANEVEPAGRYQQQYLATLMAHIKAPLLGKIPYLTQDVKQHNFTSYLDLSYLKSH

SEQ ID NO: 5154 - protein, 303 aa, Proteus mirabilis
YLAYVNWYCPIRYVLGSSPKFLVPFAATLAAPHQRGKAVGTIMSGLLLGILLARTASGLMASFTNWQGIFWLASVFLAILAITLWRCLPTYKSQTNLNYFQLLGSIFKLFATTPVLRTRSLIGALIFAHFGLLWTSMAFLLASDPFNYSDAVIGLFGLVGAAGALMAGKAGVWVDKGKGKKTTTSGLILLFICWGLIVIAPYYQWIGLISFIIGVVLLDLAVQGVHVTNQSTIYRILPDARNRLTAAYMTSYFIGGALGSLLSGYAYHQYGWIGVSSAGAIIGLLGLLVWLFGYKNDPVIQSE

SEQ ID NO: 5155 - protein, 248 aa, Proteus mirabilis
RHYYVDYALVRKTGAFTWHSRRSIMYEFDWSSVVPSLPFLMDGMVITLKITITAIVIGILWGTILAVMRLSTFKPISWFAAAYVNTFRSIPLVMVLLWFYLIVPNILQNVLGLSPKSDIRLISAMVAFSLFEAAYYSEIIRAGIQSISKGQFSASLALGMTKSQTMRLVILPQAFRAMIPLLLTQGIVLFQDTSLVYVLSLTDFFRTAANIGERDGTQVEMILFAGFVYFIISFSASMLVNFLKKRTT

SEQ ID NO: 5156 - protein, 481 aa, Proteus mirabilis
PYYYENINMSIPQDNQAIEELITLVGGSDNVISVSHCLTRLRFVLNDPNLADIDKIKKISFVKGCFNNAGQFQVIVGMDVDIYYKLLIDKLSLKAKSKDDIKSDAKKNMGSWQKLIANLAEIFVPLLPILICGGLLLGLRNVIGEMPISDNKPLTYFYPWLTPIYDFLWLPCEAIFHFLPVSICWSSVKKMGGTPALGIVLGITLVSPQLMNAYNLGSQLPEVWNFGLFTIEKVGYQAQVIPSILAGLFLGWFETKLRRFIPDYLKLVIVPIVTLIVAVFVAHVILGPIGRSIGDGLAQLIKFLMLGDFAPIGSTIFAFFYSPMVITGLHHTTLAIDLQMTQSYGGTPIWPIIALSNIAQASAVVGIIIVSRKLNEQEITIPAAISAYLGVTEPAMYGVNLKYGFPMLCAMIGAALAGLICGLNNVLSNGIGVGGLPGILSIQPTYWLVYLLAMIVAIVVPIGLTILVYRYKEKAGTLQVD

SEQ ID NO: 5157 - protein, 207 aa, Proteus mirabilis
NRYYMNNELKRLEKKYNSIMVSPTEKESQYYNSVMSSFSYKKISKGRLYNIKPYEIQRAGLNPGKELKENPKKIKGVCVYYFDTKDNILLIEIYGQNENIINRHYYFHTVNQIKSIYFNSGYQSIRNIDLLKCKNGQVMEVLNYGEMGSSISNYIYDSGKLIEIDIKQKEHNKNEIAKYKVYFEYKDDILNRIVDKHPNGYEEQRYP

SEQ ID NO: 5158 - protein, 140 aa, Proteus mirabilis
NRHYFASAAATTCLAASVKLLAAIIFKPLSANFLVPNSALFPSRRTTTGTLTPTSSTAPIIPSAIRSQRTMPPKMLTNTALTFSSDKIILNASVTRSLVAPPPTSRKLAGSPPCSLTISMVPIAKPAPLTIQPILPSSAT

SEQ ID NO: 5159 - protein, 177 aa, Proteus mirabilis
VINYLGRTIMSTAKLVKSTPSALLYTRNNVDDSVKLHTIELLQQMVTQFIDLSLITKQAHWNMRGRNFIAVHEMVDGFRDTINEHTDEFAERLVQLGGTVLGTPQTVSKKTPLKAYPLDIHDVQDHLKALADRYAVVANDIRKAIDEVEDEDTADMFTAASRDLDKFLWFIEANIEN

SEQ ID NO: 5160 - protein, 151 aa, Proteus mirabilis
LANYNRLYNSRGDKETEFMTSSLHPTRGKLLKRFAQIGPYIREQQCQESQFFFDCLAVCVNKKVTPEKREFWGWWMELERNGEQLIYYYQVGLFDKNGDWVNQVISKKDVIESIHETLIRFHDFLQAAVSELEMTLVPDEKMSNFPLPLKP

SEQ ID NO: 5161 - protein, 396 aa, Proteus mirabilis
QDNYYHCILSSKYQALGKQRMNRKLSLWLAIALMMFPQIAETIYSPALTDISNGFRVSANEAGQTLSLYFFAFALGVIIWGRLCDVIGRRPTMLAGLFIYAIACIGVFMTDNFSVLLILRMLSAFGAAVGSVGTQTIMRDVYSGEELAKVFSVMGAAIALSPAIGMLSGSLLVSYAGYQGVFSGLALLAVVLLLWSTIALPESRPATIKTAPLGETAIKMLKDKQIAKTILLIAFFNISLFAYYQLAPFMFDNQGYSASTFGYSGIVLAIGVGIGSYINKALLSHHWQCEKLVLLASIIAVISAVGVYLLRNHISFIIPMMTSVVAYGIAIPNILATALAQYKDRLGTAGALLGLFYYLLIGGGLALAGWGQSLAITLLICSIGALLLSFSRQTAK

SEQ ID NO: 5162 - protein, 542 aa, Proteus mirabilis
SNCYLLININQRGRSPLIPDVSKALSWLEAHPKVLCGIHRGIERETLRVTPDGHLAATGHPVELGKSLTHKWITTDFAESLLEFITPVDDNIDHTLHFLSDLHRYTARHLTNERMWPMSMPCFIEAEDKITLAQFGTSNVGRFKTLYREGLKNRYGALMQTISGVHYNFSLPIEFWQAWANITDEETGKEAISDGYLRLIRNYYRFGWIIPFFFGASPAICGSFLKGRKTNLPFENTPKGAKYLPYATSLRLSDLGYTNKSQSDLDITFNHLETYVKGLKKAIHKPSEEFAKLGVKKDGKYIQLNTNVLQIENELYAPIRPKRVVKGDESPSDALLRGGIEYIEVRSLDINPFTPIGVDETQIRFLDLFLIWCVLADAPEMNAEELACCRANWNNVILEGRKPGQVIGMGCGERKEPLAQVGKALFADLQRVAKVLDSCSGTKYLEVCLKLEEMFDNPQLTFSGRLLEKIKAQGIGGYGLSLAEEYHQQLVNTAYEVLTDDAFEHERISSIKRQADLEKSDTISFDEYLKLHAGPNNDGVAS

SEQ ID NO: 5163 - protein, 320 aa, Proteus mirabilis
MSGYVYAGFPSSVGVIIGGFFLVILFKWLRFALQDNKLPTATMPATTEPEPVLSSPATESPVNQLLPKEWGLYVAAPYAVMNEWAYNEYNQGKDDGGLSAAWGVNDRWDLIYQLFWLLTQGHTNDFYQLRDQILNGKEEDIQSLKNDILLSDLTENDKNERLWQIDMMNTNRMNIQNVKYLIWDLCRFNKLCLEGCQQGYITQQEAQTWSLMSASMLRRIYDGWEDMWQNFIATRWLWASGDQNWASSHQTFSDVVQNILKAENTLATEENWVMELPPLDLMSFTRAVAGLGFMKNDVPMTLAEIEEMISERITLKTLNS

SEQ ID NO: 5164 - protein, 209 aa, Proteus mirabilis
RNILFFSPTIPIYLTMALLGISVQTEVFVPYFLQMIHGITPLLSGYLAALVGAGWSFSAIISSSQPSNIAQRLMRIGPAINFTAIIVLGLLISNYLLLPYGQVIIICLALFFTGAGIGMAWPHYLTRVLQVSQGEDAQKAATSITTIQLFSTAVGAAISGTVVNMAGLTNPGGIAGAQNAAHWLIIGFSITPLIAFITAKIVVSNIRKH

SEQ ID NO: 5165 - protein, 196 aa, Proteus mirabilis
RSVLPSIIILSVAIMDIVDSHRRKWLGLGMAAVGLGLLPSHAFASLATPRPKILRFNNLNTGETIKAEFFDGKRYNKQELARLNHLFRDHRQNKVKTIDPALFDQIYLLQVMLNNNKAVELISGYRSLATNNHLRQHTSGVAKKSYHTRGQAMDFRLVGTDLSKVRQVALRMKAGGVGYYPRSNFVHIDTGPVRSW

SEQ ID NO: 5166 - protein, 115 aa, Proteus mirabilis
RGNYMIINITSKQMDITPALREHIESRLTKLNKWQVNLINPHIILTKDPKGFSVDASIHTPNGQLVANAQHVDMYAAINDLLAKLERQLNKVQHKNESRRAANSLKEENLLVNEI

SEQ ID NO: 5167 - protein, 87 aa, Proteus mirabilis
IMIYTTGTVSTVSGSAIVSGTGTIILIKNGNANFIYMVDRVNSDTELVISQPATFTVKNTSYSINLTEPNSYSDANNRMTAIASDIT

SEQ ID NO: 5168 - protein, 328 aa, Proteus mirabilis
FCPYYLLDLCNNVFTKTGFFSHFMQPIIERINMMEKIKMKKLLPLTLATTAFFATSVMATELTLDIYNPGDASVFPVSSEIIYGDKDAVLIDAQFQKNDAQALVDKIKASGKNLTYIYISHSDPDFYFGLDVITEAFPNAKVIASAPTVKIINETQAGKLAYWGPVLKDNAPKKVIIPEVVTGDSFSLEGEKLYIKGLDSQSPERTYVYVPKLNAIMGGVILSENIHVWLADTQSKAQRQYWLEALQQIKTLSPKTVIPGHYVPKSNYDMRSVDFTMNYLKEAETKLAETQNSEQFIAAMEKSYPDLADKSSLELSAKVLKGEMKWPQ

SEQ ID NO: 5169 - protein, 404 aa, Proteus mirabilis
ENRYCMAIKLEVKNLYKIFGEHPKRAFELLGSGMNKDQIFDKTGLTVGVQNANLAIEEGEIFVIMGLSGSGKSTLVRLLNRLIDPTKGEVLIDGENITTMSDKDLRQVRRKKISMVFQSFALMPHMNVLDNTAFGMELAGISKEERYEKAMAALEQVNLSSHAQSWPDELSGGMRQRIGLARALANDPDILLMDEAFSALDPLIRTEMQDELLSLQGDKQRTIVFISHDLDEAMRIGDRIAIMQGGVVVQIGTPDEILNNPANDYVRTFFRGVDISHVFSAKDIAKRRPETLLHIAPGFGPRSALKVLEDEDRNFGYLIERGRKFAGIVSVTSLEEALKAKQPIGSAILTEPCAINGDTPLNELISTVAQSPCAIPVIDEKNRYIGLISKGMLLQALDKETPNE

SEQ ID NO: 5170 - protein, 83 aa, Proteus mirabilis
KRRYRYLIIAVYLRLKSRHHRSASIHALPVVFFFTRNDDIAGENGLGSTATEDDTAFAQVIWGQLNGNLVACQDTNIVFTHFS

SEQ ID NO: 5171 - protein, 591 aa, Proteus mirabilis
HKLYIFLLFCRIYTCHVTNCLTRVFFMELEHESKRPLYIPYAGPILLEFPLLNKGSAFSEEERSTFNLHGLLPEAVETIEEQVERAYRQYLDFKNDNDKHIYLRNIQDTNETLFYRLLESHLTEMMPIIYTPTVGEACEHFSDIYRRARGLFISYPNRANIDDMLQNATKQNVKVIVVTDGERILGLGDQGIGGMGIPIGKLSLYTACGGISPAYTLPVVLDVGTNNPQRLNDPLYMGWRHPRITGDEYNEFVDEFIQAVKRRWPNVLLQFEDFAQKNAMPLLNRYRDELCCFNDDIQGTAAVTLGSLIAASRAAGRQLKDQTVAFLGAGSAGCGIAEQIIAQMKSEGLSDEQARARIFMVDRFGLLTDKLPNLLDFQSKLIQKSETLADWQTETDAISLLEVVKNAKPTILIGVSGQAGLFTEEIIREMHKHCERPTVMPLSNPTSRVEARPEDIINWTDGQALVATGSPFAPVTYKEKVYPIAQCNNSYIFPGIGLGVIASGAKRVTDAMLMVASRALADCSPMAKEGDGPLLPLLADIQQVSRYIAKQVAKEAQVQGVATVTSDSALEEAIERNYWEPEYRIYKRTSF

SEQ ID NO: 5172 - protein, 217 aa, Proteus mirabilis
AMMYHIIPVTNYMQNCTLIWCDDTKEAAIVDPGGDVETLIAEIEQRQLKLTKVLLTHGHFDHVAGTAQIVEHFHVPVYGPHKDDNFLIEDLEQQCRMFNFPSGKSFTPDQWLNEGDTVTIGKTITLSVLHCPGHTPGHIIFVNHQNKLISMGDVLFRESIGRTDFPRGNHADLIASIKNKVLPLGDDYLFIPGHGPMSNLGHERQYNPFLQDEMPIW

SEQ ID NO: 5173 - protein, 88 aa, Proteus mirabilis
WYKYRRNNGKNGGHHFIRGGRSRKTKNFGTNNEGRQEALLKGVKFGRKRSVDRERIIELKRSGWGGTAIAKEMKVARSTVYKILNEEI

SEQ ID NO: 5174 - protein, 418 aa, Proteus mirabilis
ILEYTMSQCQVSGLLSLDEALEKLLEKPVAITDTLSIPLHKAAGYILSEHITSPLNVPPFDNSAMDGYGVRYTDLNTQSPLPIAGKAFAGVPFEGELPQGQCVRIMTGAMIPAGVDTVIMQEETQVTDNGILFPHPAKLGQNIRRIGEDIKQNDIVLAAGTKLSTAQLPLIASLGIANINVYRKLKVAVFSTGDELQTIGQPLKAGQIYDTNRFAVRLMLEKLDCDVLDLGVIPDSPEKLRETFKTADAQADLVISSGGVSVGEADYTKQILDEIGEIGFWKLAIKPGKPFAFGRLHNAWFCGLPGNPVSATVTFYQLVQPLIARLSGFSQWRSPQRFHAKTCSPLKKSAGRLDFQRGIASINENGEWQVTTSGHQGSHVYSSFSVANCFIVLERERGKVAAGETVTIELFNPLLKSE

SEQ ID NO: 5175 - protein, 86 aa, Proteus mirabilis
RREYDMGKMTFVVEYEDGKEPSVNAGVDILGGRLTAVASYDYRDDLLTQGEAQAVNNSIEFTVLRDYCEEFEVDFDEVVAKLESPL

SEQ ID NO: 5176 - protein, 319 aa, Proteus mirabilis
FSDFSKALEKYYHQHEPDEVYTFGWVGMRLVSEHSSAAPHTTVYHAYNDQSYTPLARIECTDNPLNPQRAIYYTHSSLSGLPEALTNSEGEIVWQGQYSAWGHLQRQTRPTSAFNREQNLRFQGQYFDKETGLHYNTFRYYAPDLGRFTQQDPIGLAGGINLYAYAPNPLTWVDPWGWSCGPKLKTEVDYKKAIQNLESQHGALNAHGLRRHGAGTTLEQQQYRARTGNSPDNHYTIVLDRKTLGRSAPSSTRFLSYKDQYEVMQQVLKLGGPGKTIEMNMGHVVAEGYQSGGKVYGMTSNVKAYFDDDGKLVTIFGVL

SEQ ID NO: 5177 - protein, 279 aa, Proteus mirabilis
LSDLSFFYEVIMRLIPLSTAQQVGKWSANYIVEKINAFAPSADRPFVLGLPTGGTPLATYKALIELHRAGKVSFQHVVTFNMDEYVGIPADHPQSYRTFMYENFFNHIDIKDENINLLNGNATDPQAECARYEAKIKSYGKINLFMGGVGNDGHIAFNEPASSLASRTRMKTLTEDTRLANSRFFDNDINKVPKYALTVGVGTLLDAEELMILATGINKAQAVQVATEGAVNHLWTISCVQLHPKAILVCDDPATMELRVKTLRYFQQIEAQERQQYQD

SEQ ID NO: 5178 - protein, 78 aa, Proteus mirabilis
YPYLKAIFLNKKEWRIKYTSLFYFSYYLINPSLAKKCIDNQTIRCGFSAIALGEQLLSPFFFYEHHKVQDNHTLSQYQ

SEQ ID NO: 5179 - protein, 342 aa, Proteus mirabilis
WQDLALLCQFIHTENYYQKVYNEVSMRLQWVLMGVSALLLAGCVADKPVNNNQPTTRLPNVPTQPVLGIEPRYEPYHPTANQDYRKNGVIYRIVKDPANFSERGQAIVYDSLAMSRLTTIGERVNPYEFAAAHPTLPIPSYAKITNLINGRTMIVRINDRGPYVEGKQIQVTPAVYNSLQLMPTTPIQIEGIVVDQNGQISGIGTQGAQIEKRATTLPERPNFNTQPSTMAPQPSVTAPSPITVTQPAPAPAPAPAPAPQPVSSSSAIAQGYYVQVGALSNQTNAQTWLTELTNALNTQGVINTTDGLHKVQLGPYSSKTQAETIKSALKQSKNIDGFIVSQ

SEQ ID NO: 5180 - protein, 361 aa, Proteus mirabilis
LEDLLMAGIFSSVEKNLIGGITNATSGLMMSYSSMMMGLAAASVTIYIMWRGYQTLAGKLSTPMEDTMWDIMRMAIILSFVANVSGYLDGVIDAINGLKEGFSGGENIWQMLDNLWKSARILGKTLHDMDNSTYVKDEGWTAQFYVWLGIFILMLITAFVSMIAEVMILLLSITAPIFIFCLMYGFLRPMFNNWLQNIFAAILTILFSALSLRIVINFLTSRMAEATAQAGKANIVELGAQVCLAGFCAAILVYISAKVAAALAGASATVSMQGLAAVGIGAAAFGAGKLAGGAVKETKRSAQDNIQGWKDANAGKPGKPGGELGYNASKARKYAIEQMIARNEARRLAQSRESAVKKFNS

SEQ ID NO: 5181 - protein, 605 aa, Proteus mirabilis
RRFQYHVPLTITRKILMKPAMSQTFIPGKDAALEDSIASFQQKLTQLGFNIEEASWLNPVPNVWSVHIRDKDCPLCFTNGKGATKKAALASALGEYFERLSTNYFFSDFWLGADIAEGEFVHYPNEKWFPLTDDDAVPEGLLDARLRQFYDPEGELCGSELVDLQSSNSERGICALPFIRQSDKTPVYIPVNIIANLYASNGMSAGNTQNEARVQGLSEVFERYVKNRIISERISLPKIPHEVLARYPAVIEAITTLEKEGFPIFSFDASLGGQFPVICVVLFNPQNGTCFASFGAHPDFGVALERTVTELLQGRSLKDLDVFNPPSFDDEEVGDHTNLETHFIDSSGLISWDLFKKDADYPFVDWDFSGSTEEEFHTLMSLCQQCDAEVYIMDYNHLGVYACRILVPGLSDIYPAEDLQLANNIMGVHWRDTILSLPTSHGTKEEYLSLIGQFDEDGLDDFTRIREMIGIAPGKDNGWSHLRVGELKSMLALAGGDLEQALVWVEWTQDFNASLFTPARQNYYRCLHNLLLLREEHEREPAQYMEAFSRMYGEETLQAALNAIEGKQPFYGLQPIAPSLANLPVHQSLLAAYEKLQQAKRQSNK

SEQ ID NO: 5182 - protein, 1534 aa, Proteus mirabilis
LDIQTKQNSIILTVDGKITFNGNIQSEQDINVSSKALQMNSNASLKAQRDITLATNTLTNHSDIIAEKDMRLFVDKFTNKGEKALIQAKDNLWIQKNAQGEPSSLIENQSATIKTEKGDLIIRTKKLVNESITPLFKEIKQEPDSTSSINIGTHFLHPYNSPTNNFLIIILLAELKELSDKKWFDILDLKNNGGVNVERSLFEKNKKYVPSVIYSGKNLYIQSNEFFNTQSDIFATNDLIATGNNAKVYYYRFGHLNKWDLYSHDNAHIFYRDDVNKYNIDETKFQKIVHFIPFTKIGSHYEFIVDSASEYMIKAGNNLVLDFKDSIALERKFPFLEKEIKKYRRISDFESTILAKNILLNANNLNISLNLKSSNSLSVIANKNINISNSNLLSGDIINLTAIDNVNSENIDVTAKHFSIITKNGDINYSFSPIASYTLNSIKAPFIDVSEKIDFYSGKNIYISNVIINESNEKSLSALENIKIKRDESLFFNLMPNFRDEQYISAFLFNMGLWKSKNNISLMAGKDIVSQGIKYYSNKEITFNAGQDIFLASKLIKEAAPFFSDIHYPQLQSKLFSDNNLILNAARDIDLSSTVLNSKDKIIVLAGRNIKLGANAYSAIEDPHEDAQDIQYTTTSIMGNKGISIASSGSLTTEGSSLKSEGDIAISSGGNIQLGSVRTHFRKESDSELEELRKQVSTEINSGNHLTLLSEGSILFQASQLAANKKMDIAAKGGFLYAQAMEESSYYEEEKKKCNWWTLCATKKKYTKTFNNTTNKVTEFIANDDINLIAKDDITLEASKLETAKNAKLTSKTGGINFKAVKDTAFKQVITRSKDIYITQRNQGYTKGTWLLPELYIDGKLTIDAPKGISADIKAKKEQSLEQALTALSNTPEYAWLNALQRQENINWNLVKDTYSSWDDKTQQLNPVVGAVIAIAVGVATYGTATAASIGGMASNATIAAGASAGVASTASVAAQAGFASLVSQAAVSLAENQGNISKTFGALSRSDTVKSIVTSMTVAGALQGLDQFMGWDQAIQGGTLPTTGKLLATDNATWTQVAQRVASQSVVSSTLGTAIQGGSFIDNFKTALLSHIGSQFHAEGANLIGDNGAVLGHAGKVLSHSVVAGVSAEIAGGSVTGAVAGALAAEIAAISLQSKLFEPSYLNETDRQVALIQEALHGNEGKTQLTKLIGALTGAIVTRKPEGVFSAANSAELVYRHNYSEHMLSKLALENNKDIIAASKGDVAAAERVVNRQNAGMIAIALGLGGSASIIGGHTVIAATPELIAITQAAFSTCKANWVYCANQLGINIAGISAPEAAIAGVTVGTGYKVLASSEESAKAFSSMLANSSKSLMTSGKLNITAIKPIVEQEKLLITTNKKAIEIINNGEFIIYSGVTTNGYKVSNGAKTVVFKNELEHPIVQSRINIKVGDVESGWLHVQKRHFSGAQNASQFTLSEQEIKDILLSPAVIKIPINKTRESYNKNTNSIDILYERVIQLDKNIGIDKFSKQPTNIITMLTDKNGNLITTTPGEIK

SEQ ID NO: 5183 - protein, 187 aa, Proteus mirabilis
NRNLKYMKRKVIALATILSAAFAGSSMAYDGTITFTGKVVDQTCSVDTQSKNLAVILPTVSVATLNNVATTAGLTPFTIKLTGCSTDKDGAKNVKVYFEPSADTDLTTHNLKNTATGTKANNVQVQLLNSDAATTIQLGTDSATQDVHPVQIDNANVNLPYFAQYYATGQSTAGDVKATVNYTIAYE

SEQ ID NO: 5184 - protein, 870 aa, Proteus mirabilis
PLIHHRIIGAMQEQYRPEDIEQTIQEHWEKNNTFKVTEDNNKEKYYCLSMLPYPSGRLHMGHVRNYTIGDVISRYQRMLGKNVLQPIGWDAFGLPAEGAAVKNNTAPAPWTYENINYMKGQLKKLGFGYDWDREVTTCTPEYYRWEQWFFTKLYEKGLVYKKTSAVNWCPHDLTVLANEQVIDGCCWRCDTPVERKEIPQWFIKITDYAEELLNDLDTLDEWPEQVKTMQRNWIGRSEGVEITFDVADSDDTMTVYTTRPDTFMGVTYVAVAAGHPLAQKAAQNNPEIQHFIDECRNMKMAEAEMATMEKKGIATGLYAIHPLTQEKVAIWVANFVLMEYGTGAVMAVPGHDERDWEFATKYGLPIKAVIADAEGNQPDLSTGALTEKNSLINSGEFSGLDNQAGFNAIADKLTAMGVGERKVNYRLRDWGVSRQRYWGAPIPMATLEDGSVVPVPDDQLPVILPEDVKMDGITSPIKADPEWAKTTINGQPALRETDTFDTFMESSWYYARYTCPDYDKGMLDPKAANYWLPVDWYIGGIEHAIMHLMYFRFFHKLMRDAGLVNSDEPAKRLLCQGMVLADAFYYTGEDGARHWVSPAEAIVERDEKNRIIKATDSAGHELTYAGMSKMSKSKNNGIDPQTMVERYGADTVRLFMMFAAPPELTLEWQESSVEGANRFLRRLWRLVHEHTEKGTTQSLDLATLTTEQKDLRRDLHKTIAKVSDDVGRRLAFNTAIAAIMELMNKLTRAPQETEQDRALMQEALEAVVRMLSPIIPHACFVMWQALGGKEDIDVAPWPVADEEAMVDDTKLIIVQVNGKVRGRITVPANSEKDYVQEMATKEYSVAKYLENVTVRKVIYVPGKLLNIVVG

SEQ ID NO: 5185 - protein, 487 aa, Proteus mirabilis
LLSHCKYRIYTMSTIKKLYIKTWGCQMNEYDSSKMADLLESTHGYQLTDVAEDADILLLNTCSIREKAQEKVFHQLGRWKNFKDNKPDIIIGVGGCVASQEGEYIRQRAQCVDIIFGPQTLHRLPEMINQVKGTKSPVVDISFPEIEKFDRLPEPRAEGPSAFVSIMEGCNKYCSFCVVPYTRGEEVSRPCDDILFEIAQLAAQGVREVNLLGQNVNAYRGETFDGQICSFAELLRLVAAIDGIDRIRFTTSHPIEFTDDIIAVYEDTPELVSFLHLPVQSGSDRILTLMKRNHTALEYKSIIRKLRKARPDILISSDFIIGFPGETQDDFEKTMKLIADVNFDMSFSFIYSARPGTPAADLPDDVSEEEKKQRLYLLQQRINQQAMNYSRAMLNSVQRILVEGPSRKNVMELSGRTENNRVVNFEGTPDMIGKFVDVEIVDVYANSLRGKVVRTEDQMDLRIHESPESVIARTRKEDELGVGVYQP

SEQ ID NO: 5186 - protein, 478 aa, Proteus mirabilis
LFTQTRNGTQNKGGSTVMNQVPNNLMAEQNVIGGLLLDPQSDNAQSIFSLLKPEDFYARHHQIIYLTLREMYTQRMPIDIMTVTDCLESKGRINQSGGFAYLAEMARETPSIANIMAYAKKIRECSAQRFVIEKTVEIQKLMMAPSELGFTDKIEQAQRLLDEATSFGKMGRKTGLRRIDDVLDDVFTDICDRQDNPEKHRGLKTGFKDFDRLLSPKQIVIGSLFVIGARPKMGKTTVLTEMAKNVSQQGKPVLLFSMEMTDKQLVERTLAQQTQINSDKFYQKLEEHEWDRLCSAIGRLKDEPNIWVDDTPGMSLQHIRSESRRIKRKVGDIGFIGVDYLTLMQAGKADRNDIAYGEITKGLKILAKELNTVVVLLVQLNRGLENRADKRPVPSDSRDTGQIEQDCDYWLGIYRDAVYHDNADETLTEMILRLNRHGKTGTVYVDQQGLSITPVDQYMAAYRAQPKREPKKYCEKSF

SEQ ID NO: 5187 - protein, 513 aa, Proteus mirabilis
RKTHLQYFRYFTTNNPFKSGLPLVEIMMNNTSYAWKQQLLTALDEQQVSSAINDNDADWEYIDSEMIKFGSLSHGQLDIKEIQRRCLHLFETQTKDFRILVHLLRTLQHAGEPKELVLAAQILTDFNRQYWQSCYPTNMKLKSRLANQVLKRFETASESFCHAANSAMRDDILGSFAFLAQFWHEQSPALAEQIDDLSRDYNRIENNDAPIIVASPAEKEEKVQTPPVSESIETPTKNSLTPTINVNHQDERQWKQTLLQVADVICQQAPESSVGYRIRRYAIWHAITVLPQANAQGKTPLAPVSIDRVMDYKAQLTQASITLLNNIEQSLSLSPYWLEGHMLAAQVATKLGYGEVESGIIEELRIFLARLPELVNLHFSDMTPFFPESVQPWLEQYNQTENGQLPPSNTNTAILEQEVLQCYEQQGLEAALKLIELNLASRSEPRDRFYGQLLSAQLFELSGMDYMATQLYQQLNTSASHYSLADWEPNLIRQLMQKIDKKTEITMTMDRDQ

SEQ ID NO: 5188 - protein, 275 aa, Proteus mirabilis
RYHHVNDCIIIRCNVEIVTKRNRRMKENYYYLEQTSEIASNKNALLQADWQRFCQLLCYEGIEIKQNNDEKRQNKAVICRVKMKGEYSSTLFMQILGEGELQLTLEQFSQPSGLEHFLTQFFALIDYQQQVNAKLSKKALIQFHSRYKYLLMAYSQVAYRELGRYMANIPNSLPLLQFAEQYQKALMKALSIPATREGHTNALMHMAGYFKRALSAEQKQLLTQEILSYRQGKTSLSAPLSRLKNYLAFYPDNYLLSQRYFSPYPAVFDDLRAQF

SEQ ID NO: 5189 - protein, 134 aa, Proteus mirabilis
IMNQSTINTEIRKLVASIGKDLNLKIAWPNLPFNDINDPYLQLHIMPVETDNIGLSQDMPVYRGVIQINVVGKVGGGDSRLSTIVDDVKARLENGLTLGEGVYINGEPSQFPPISDETNYTIPIRASYRCNAIR

SEQ ID NO: 5190 - protein, 95 aa, Proteus mirabilis
FNCQHAYYLSGKWLGYLDSNQGMPGSKPGALPLGDTPPDKLTTVKMVREARLELAHLAAPEPKSGASTNFATPAKKYGGYDGIRTCDPNIMSVVL

SEQ ID NO: 5191 - protein, 83 aa, Proteus mirabilis
NYRHYLLISYKIRLDLVKTTYLEVCCYFQKTTRRFTMSTRISLSGVLLLSEEILSYPYLCIRWLSRGKTKPPLTRFLISVFPA

SEQ ID NO: 5192 - protein, 391 aa, Proteus mirabilis
NTIHQMVGLLILIYLWDEKRANELLENNLSGVKRLSYDDALASGYIHEQDLIMPYVKALGDVVDMKAIKKAGLKLGVDPLGGSGIEYWKRIGEYYELDLELVNDQVDQTFRFMTLDHDGVIRMDCSSPWAMEGLLQLRDKFDLAFANDPDYDRHGIVTPSGLMNPNHYLAAAINYLFRHRPQWSNEVKVGKTLVSSAMIDRVVADLGRELVEVPVGFKWFVQGLFSGEFGFGGEESAGASFLRFNGKPWSTDKDGIILCLLAAEIKAVTGKDPQQHYNELAQRFGSPSYNRIQASATHEQKALLSRLSPEMVTANTLAGDPITARLTHASGNGAAIGGLKVMTDYGWFAARPSGTEEAYKIYCESFRGPEHRELIEKEAIEIVNNVFASKQ

SEQ ID NO: 5193 - protein, 72 aa, Proteus mirabilis
SQYQTMMANTAEKDNQKLADNMASGSSNKITAALQIAHCQGKKSPLRQWSKTQIVRPIIALVAGIPHPDKAA

SEQ ID NO: 5194 - protein, 247 aa, Proteus mirabilis
GQYHYRHAKEKGRREMISNDIILSKTGIDLTKVEQGSEEWMSIRLGVVTASEAWKVISKPKSGKKWTDTKKTYLNTLIGEVCTGVYKEVSARTLEWGKNYELEARMTFEFYTGLTAKEVPIIFKDEQLRMACSPDGICSDGSGLELKCPNNTDVFIDLALNGIDAMKKEYVAQVQYSMWVTSKDIWHFANFDPRMPAGKEIAYFPVERDEKMMKEFDELVPEFIEVMDQGLNKLGIQFGNQWSVYGN

SEQ ID NO: 5195 - protein, 87 aa, Proteus mirabilis
KMHQFLLIDEATSSIDCSSEVLIQQALSLLSKDKTIIMIAHRLNSIKNADNIIVMENGKIAEQGKHAELLAKNGLYAHLWLQQKALC

SEQ ID NO: 5196 - protein, 290 aa, Proteus mirabilis
SINHLTRSPRWPFLLPKLSSGLSYYNALGASNPKGNHMLFMNIERKYYSQADDGSQGGGGGTPEITPEIQAIIDQQVSGLKAKNSELLGKLKEQGDNLKRFEGIDPDTVKGMLKRFENDEEAKLIADGKIDEVLNKRTERLRGDFDKKLKEASSKAEKAEAFANKFRARVLGDEIRSAAGKAGALTSAQEDLILRAKGIFQINDEGQAVAVDEDGNPIMGKDGRTPLSPIEWIESLKESAPHLFPAASGTDAGKHKQGGAHFKRSQMSASDKADYIRRYGRDAYLKLPKE

SEQ ID NO: 5197 - protein, 79 aa, Proteus mirabilis
RSNHVLTNSGWLTAVEPITTRLAPAANSDFTSSSLRIPPPTCTGTLTQATSCFNSGICRASGSFAPVKSTRCNNFAPSC

SEQ ID NO: 5198 - protein, 429 aa, Proteus mirabilis
TVLQKTPENNLMTQPITATDFSINDMKTLIETMQIYKKDNHDKGITRIAYSEEDEAAHLYLASVMKEAGLEVYRDGIGTLYARLPGQDRTLPAVGTGSHLDTVPQGGAYDGALGVIAGFYALMQYKPQQLKRDLELIVFRAEESSRFGFSCIGSKVLTGKIDRTRWEQNRDDEGNNFFDVLKSLGYQHENLDQCLLKSDRYSAFVELHIEQGKRLENDQKTIGIVNGIAAPTRFSVTVNGHADHSGATPMYQRQDALVASAGIITDINHAACTEAVYGTVGTIGKLNVIPNSMNVIPGQVKFSVDIRGIDTDSIQRVVQRLTNSVEKAEKDFGVKIIVQPISAESPVKLDDSICQVIESICQKHDINYMTMLSGAGHDSMNMASLYPTAMIFTPSVAGISHHPDEFTEFSDIAIAADILAETLGVLANQ

SEQ ID NO: 5199 - protein, 68 aa, Proteus mirabilis
RALQGVFIMGKKPGENTGKDGGIYREVGPRGGLKNNYATVRDNEKLPPTTQSGNTWVLEKRTPNSKRP

SEQ ID NO: 5200 - protein, 100 aa, Proteus mirabilis
NKLHLLWIKKKNKNKESYISEEELKTRFFKSMKNIIYKDRLISWMHINSEFFTPELIATWIKTVSNSSTNSIDYEINRIELEKSIKKIKLRASYFLIYYD

SEQ ID NO: 5201 - protein, 176 aa, Proteus mirabilis
SIAHFENWCMINTSVDLGHISMKSKRVQITIWHYIRSFFILYLCLFAGNLISALLPFAVPGSIVGLLILFGLLAFQLIPLRWVKPGGNILLKNMSLLFIPIGVGVMNYYNLLSQQLFPIVLACVVSTFAVMALVAYCSHYVHRERPIIGAKPDKVEDVELAEQQDDDRALSEKKKC

SEQ ID NO: 5202 - protein, 145 aa, Proteus mirabilis
SKKQTYRKQIMSIKIDPLIESVQVLHNEIETVFTQTPIATQALKNIEMLLANTFSMIGITGKKINYDDVMAMFSRNAGKRPELRIETDSYNIIYQSEHWATVSYRETHYENKKILTRQSVVVLRRTSLDCQWQWYYLHETPVLDN

SEQ ID NO: 5203 - protein, 343 aa, Proteus mirabilis
ELKQQHSPQSPLCRFGSAIWDKGEIMIKLGIVMDPISSIKIKKDTSFAMLLEAQRRGWEIHYMEMNDLYLNQGEARAHTRLLSVEENPEKWFEFGQEQDIALGSLDTILMRKDPPFDTEFIYATYILERAEDMGTLIVNKPQSLRDCNEKLFTAWFPSLTPNTLVTREAKHLRAFHEKHGDVIFKPLDGMGGASIFRLKKDDPNVGVIIETLTEHGHRFCMAQNFLPEIVDGDKRILVVDGEPVPYCLARIPAKGETRGNLAAGGRGEARPLTESDWAIARQVAPILKQKGLIFVGLDVIGDRLTEINVTSPTCAREIEAAYPEVSITGMLMDAIEARLNKKN

SEQ ID NO: 5204 - protein, 392 aa, Proteus mirabilis
IVKQNKQTTLIHSGRQAIKTSGPINPPVMRASTIVFDSIKSWREIRDRRITERVLSYGARGTETAFALEALVTELEGGYRAQLFPTGLAAIAFTIMGYARSGGHVLFADSVYEPVRKIASAFLEPNNITYSFFKTDGSDFEQKIQENTQLIFVESPGSLLYEMLDLPEICHIAHEKNIPVGVDNTWGSAWLYNPLELGADVSVIAATKYLCGHSDVMMGIMIANETAWKQIGALPEALGQASSPDDAALVLRGMRTLAQRLTNHGKSALAIAQWLETRPEVAKVWFPELPTHPRHDLWKRDCKGSNGLLTIEFKQKYTIKQSEQFIDALTLFGIGASWGGFESLALPANVMGARTATDWREGHGPFVRLHIGLESTDDLIADLTQAFSALNQ

SEQ ID NO: 5205 - protein, 916 aa, Proteus mirabilis
EAEHMAKLLKAMKRPAALWGVPMVPLLAVTGVTIIVAVWTSVALLFLLPLQFLVMKSLTRNEPMRFSLIAVWLRAKGKPVANRLFGATTFMPVEHEAVDIREFIDAMKLNQCATIRKYIPYSSHIHQHVVRSPKSDLYCTWELMGTPFDCESDESLRFGTNQLHGLIRSFEGMPVTFYIHNDRNTFTDNLHKDSGNPYADEVSRLYYASVGLFRRNRLFLTVCYRPFVSLEKAERKRMKDSQKLKELDGALLEMLEIKSTLDTALSRYGARPLGTFTEGNAVFSSQLAFYEYLLTHQWRKVRVTRTPAYDVMGAAALFFSAESGQINHANGTQYFRGLEVKEFSEETATGMMDSLLYAPCDYVITQSYTCMSREEAKKAIKRTRRLLMSADDDAVSQRLDLDVALDLLTSGKIAYGKHHFSIMVYSPSLESLVADTNEISNALNNIGITPVPAEISLSAAYMAQLPGNYNLRPRKGELSSQNFVELAALHNFYPGKRDKAPWGDAMALLRTPSGDGYYINLHNTLADKDEFNEKNPASTCILGTNGSGKTMLMTFFEIMQQKYGREDSFSPDAKTKRLTTVYLDKDRGAEMNIRALGGRYYRVISGESTGWNPFSLPATKRNINFIKQLMKILCTRNGSTISPRDERRLSDAVNAVMNDEPQYRVYGITRMLENLPEPATKEAQENGLSIRLSQWAQGGEFGWVFDNESDTFDISNCDNFGIDGTEFLDDASVCAPISFYLLYRITSLLDGRRLVIFMDEFWKWLRDPVFKDFAYNKLKTIRKLNGMLVVGTQSPAEIIKDDIAPAVIEQCGTQILAANPNADRAHYVDGMKFEPEVFDVVKGLDPQARQYVVVKNQFKRGDTKRFAARVTLDLSGIGRYTKVMSGDAPNLEIFESIYREGMQPHEWLDTYLAKAL

SEQ ID NO: 5206 - protein, 142 aa, Proteus mirabilis
LRRHILRLFGYARVSTSQQSLDTQKKALIDAGVAKHRLFSDKGSGSHINRDGLQLLKIKVECGDIILVKKLDRLGRDTADMIQLIKEFDSMGVAVRFLDDGISTEGTMGKMVVTILSAVAEAERQRILERTMRAGKKLCSKG

SEQ ID NO: 5207 - protein, 299 aa, Proteus mirabilis
TIMQNQIDRIRSFIAVVDTGSFTQAAKYLRLSKSMVSIHIKALETELNVSLLNRNTRRFTLTETGEILYQDFRQVLVQLEQTLDKARLGQQNLQGTLRLTSTAEFGEHYILPLLHQFMCLHPQLKVQYIFNSSIDDLINHKLDLAIRLGALKDSNYRYRKLADYTIKLVVSPHLLKKYPIQEIADLAAVPYLANSNLRHSKLSQQDKINQLFSQLHSMALFETNTISALKQMALKQMGMTILPEWYIQQEITQGELVSPIPELTLLNQSINVIFPHGEHMPRKTRLFIDFLKERINSMP

SEQ ID NO: 5208 - protein, 382 aa, Proteus mirabilis
CWMHLRMLKLPPLSLYIHIPWCVQKCPYCDFNSHTLKGEVPHQEYVQHLLNDLDADLTHVGSREVQTIFIGGGTPSLLSAESMADLLYGVKERIAVAPDAEITMEANPGTVEAERFAGFQRAGINRISIGVQSFGNDKLIRLGRIHDADEAKNAARLAKELGLRSFNLDLMHGLPDQSLSQALSDLQQAIALSPPHLSWYQLTIEPNTQFGSRPPKLPDDDMLWDIFSEGDKLLTAAGYQQYETSAYCKPGFQCQHNLNYWRFGDYLGIGCGAHGKISFADGRIMRTVKTKHPKGFMAGRYLHQQNWVDNDDRPFEFFMNRFRLLEAFPRQDFSDYTGLAQETIRRQIDEALALGYISETETHWQITPHGKLFLNSLLELFL

SEQ ID NO: 5209 - protein, 77 aa, Proteus mirabilis
RAVQLSLPFPVFCVVARRCILRLPHSVSSANLSGFSLFILFSQPVRLAPCAVTTRTHYREFSEAGNSFLKKNVQQHI

SEQ ID NO: 5210 - protein, 439 aa, Proteus mirabilis
VNPQRNRMSPLRYWNKEMDKYQPTISFSIKNSEQLESGYLPNATLTQSGGQIGSGNQCDWKIQDNEGAIADRQCTVFWKDQHFCLKVNSGPVYINNAIIPLHLDAVRLTQGDQIKVGKLVIATNISLTGEPVQNMMAMTPQSIIAKDHNPLDSLFDVDTTVKNERKEPPFVPTVQGALTTDPLQALENENLSLISKNTQATSDDPLLSDPHSYSSAFPTSDNQENTMVQEFIDLPKITPNENEHMTDVDHVAVNPLMKGLGIHLNLTNTQHANDFLVELGKTVKAAIEGLLILQQQQESLQDKQLRPIEDNPLRLNSGYEETMKLMFTDERSPVHLSAPAAVTESLHNIQLHYQANQEAISTALSTMLAAFSPEHLLNRFSQYRRASDNTPMNDGWAWEMYNNYYKELSSSRQQGFEKLFYEVYSHAYDRALRKGIEEA

SEQ ID NO: 5211 - protein, 244 aa, Proteus mirabilis
VCAQFFWQLVLSYCWEPLGILNYIVIQLYADELRSSSPVYFGDFMTTQFNNNNNNIDKNSALLVMDFQTTILNNFLPQDRAEDVIRNTSSLISATRAAGIPIIYVSVEFREGYPEVSQNNIIFSSIKDNGILITNSESSAIHDDIFPQENEIVIIKRRVGAFSFTELEMVLRTQGIETLILAGVTTSGVILSTVSQAFDLDYRLVIASDCCADPDHDTHVFLLEKILSQHAVVTSSSEISKYWV

SEQ ID NO: 5212 - protein, 256 aa, Proteus mirabilis
EMEHSMTDDILLNHDDEERITKKNYQLPLRGNNINPMIDAATPLLGMVLRMKAMSETPLSEKLYQQVVMDITSIEQQLQIQGYEPGAIVSFRYVLCTFIDETALGLGWDQDNGWVKQSLLVHFHNESWGGEKVFVLIERLLGEPKRYLDLIEFIYLCLCLGYRGRYKVSAGQNDEFNHLLRRLQKQIQQLRGNAKPIVLFEKGDNQQSRYRLGKRLGARYILIGTAVFALIIYSIYSSRLNYQTLSIVEQLNTLLG

SEQ ID NO: 5213 - protein, 67 aa, Proteus mirabilis
LPRHPPCTLIRLTSQPESVSFKDYLGGDGCADYISSLGSARNAHILKYAALAVRCPPRTVNCSLIPL

SEQ ID NO: 5214 - protein, 324 aa, Proteus mirabilis
SQGHPTGCPCLSRESAVTTTLSNALLSDILQQIRPLIGQGKVADYIPALAQVPANQLAMAVYTVDGELYQAGMADKRFSIQSISKVLSLTLALTRYDESEIWQRVGKEPSGLPFNSLIQLEMEKGLPRNPFINAGAIVITDMLQSRLSAPKQRMLEVIRALTNTADICYNTVVAKSEMEHLSRNAAIAYLMKSFDNFDNDVITVLETYFHYCSIEMSCVELVRCFSYLANQGICVGSKNQIITPRQARQINALMLTCGMYDGAGEFAFRIGIPGKSGVGGGIIAVVPDAFTVAVWSPELDKSGNSLAGCAALELLANKVGRSIF

SEQ ID NO: 5215 - protein, 69 aa, Proteus mirabilis
LPFNHSDNVEFNDNVYFSKEPIMDSLVINFITLMLHFHEINCIECHRKINLSKVMLSLISLDELFPTLS

SEQ ID NO: 5216 - protein, 96 aa, Proteus mirabilis
IYFLNKECRMFVVIFGRPGCPYCVRAKQLAETLSEKRDDFDFRYVDIQAEGITKADLSKTVGKPVETVPQIFIDEKHIGGCTDFEAYAKEHLGIYN

SEQ ID NO: 5217 - protein, 74 aa, Proteus mirabilis
KRLKVFYDYTNNLIKGTYTIFIIKIKNIYYIYTNNQPYTFIMKIFYIYYIAIYNIDLATILIISSLIKNKTTNN

SEQ ID NO: 5218 - protein, 187 aa, Proteus mirabilis
RKLNMQLRTFSILLLFSSFLILSGCSKPFEAAGKMGKILLDPSTPVGQPKDQPSTVALTILAEPYINPNQEGEAAPINIQVVYLNEDSVFGSVDHDQIDAKEGDLEKVLKKNYIDHQDYTILPGQYKPFPTMTLDPSNRYIGIIAYYSDPDKAEWKKIVKARGKGRHYFLLVHIRENEIEFRQEEDD

SEQ ID NO: 5219 - protein, 199 aa, Proteus mirabilis
LIIKIINRYSYLYYTHNIQFIERVYIMIDLFKLTKKSSRHIGIAIYVGIIAGIFSALVKSGFEDLIPPRTLETTPPPVVLLEKLGLNIDTMTYHWMGYSINWGGNGVHILFSIVIAVTYCVIAEFLPKVKLLHGICFGIGVSVFAHGLVVPLLGLSGWLWTAGYQALISEFVGTAFWIWSIEAIRQNLRYCLTKENDAE

SEQ ID NO: 5220 - protein, 730 aa, Proteus mirabilis
RKIKNLKGSTVSKKIIATNLLLALPFSLLSLQIHAAMTQNSPDKIIVTASPSQDPQGPISGLVATKTLSTNKILSDIDKTPQSISVITRDQMDAQDVSSVSQALRYTPGVFTEYRGSSNRNDEIFIRGYSYAPRFLDGLSYGMGASSSTGAIDPWLLERVELIRGPSSVLYGQLNPGGLVAMTSKRPTSITINHIQARVGNDKLAETAFDFAGSLSDDNRILYRLNGLAKTQHTQIKDYKEERFALAPAITFLPNEQTRLTLLSFIQQEPEAGYRNFLPAYGTVKKTPEGTIPFDFNVNNADYHQSWRQQYGVGYEFEHEFNDRLKLIQNARYSHIKQKYKYLVFGSLRKDNPYILERRAQQEKRETDTFGIDTRLQADFDTEKLAHTVIIGMDYQWSKNKDNLLQAMGPEYDLDWRNPNYHYPIDISLQKPVTNQLQKHDQLGIYLQDQIQWKNWILLGGLRQDWAQVRTYDHIKNSKDQQDDQKLTGRVGLLYAFDNGISPYISYSTSFEPNLQTRRAPGSAPFEPSEGRQLEAGIKYLTPNEQTLATLSIYQLQQRNVTNYNAEKAYFEPVGEIRSRGIEAQINSQLTENISFISSYAYTDTEVRKTITAGTQGKELPRVPKHMASFWGQYDETSGLFNGAKAGFGVRYIGVSQGDTKNTISVPAVTLYDAMVGYSLGELSSSLKGAEVQLNMNNIANKHYVASCAGETACFYGIGRTMTATINYRW

SEQ ID NO: 5221 - protein, 75 aa, Proteus mirabilis
NMIKSTNIMIINGHPASVVYGSEISAFRGQFLDVNGYCDFVADSIEGLQKEGAISLAEFGETCIEEEIAPFKSRR

SEQ ID NO: 5222 - protein, 142 aa, Proteus mirabilis
ITVKIAGQQMRKSMHNWRSGRWLVLITVLLILCCIVQRSMGAHVISERLASAVSQTQSSFSTPIAEQQNASEGKYSLSTCELSAKSLLSIPPLAIEPLFYTWAVLLLFGMAAIYVSRQRSQKKQHHPPPRIRLHLHYCILRD

SEQ ID NO: 5223 - protein, 204 aa, Proteus mirabilis
HFTKEDNMQKVVLATGNPGKVTELASLLADFGLDIVAQTELGVGSVEETGLTFVENALIKARHAAKVTGLPAIADDSGISVDALGGAPGIYSARYAGIEATDQQNVDKLLEAMKDVPAEKRQAQFNCVLVYLRHENDPTPLIFHGIWQGVLTQEMQGDGGFGYDPIFFIPELNCTAAQLTREQKNQYSHRGKALKLMLDALKNA

SEQ ID NO: 5224 - protein, 184 aa, Proteus mirabilis
MFTKIYQYFSTKENIGINLCRISIAIVFMWIGILKFIPYEADSIVPFVANSPFMSFLYNDPENYAQYMNHEGVLNEVNRAWHHANNTYGYSNGLGVVEVLFSLLILAHYLSPKIGFWGAALAFLTPFVTLTFLVFTPETWVHGADAHTGFPYLSGAGRLVLKDTMMIAAGFVAMVHSARCITKK

SEQ ID NO: 5225 - protein, 264 aa, Proteus mirabilis
SSAKKRIVFMSIELTDEETLRYNRQIVLRGFDFDGQEALKSASVLIVGVGGLGCSVSQYLTAAGVGKLTLLDFDTVSLSNLQRQILHRDSTIGQPKVLSAKTTLNAINPHVQIDTVDALLEDKALAELISQHHLVMDCTDNVTIREQLNRLCFVQKKPLVSGAAIRMEGQISVFTYQDDEPCYRCLSHLFGDNALTCVEAGIMAPVVGTIGTLQAIEAIKLLTGYGETLHGKVLIFDAMRMQFREFKLPKNPHCDVCAANLPDN

SEQ ID NO: 5226 - protein, 158 aa, Proteus mirabilis
IMANSIYLKIIGKSQGDISKGCSTLGSIGNKYQHGHEDQIFVYSFDYDLTRAQNLNHSPVVISKPIDKSSPLLGVAITNNELLECELEFYRTSSNGNQEKFYTIKLTKASITNISAHYPNSLTHADAQPYEDITIRYESISWNHICAGTSGYSISKNI

SEQ ID NO: 5227 - protein, 157 aa, Proteus mirabilis
QGAKMSTLTRISVQNEHFNVGDEYQWLSECESDGAVVTFTGKVRNHNLGDEVNTLTLEHYPGMTEKALNDIVEQARARWPLQRVSVIHRVGQLNIGEEIVFVGVTSAHRHSAFESAEFIMDFLKTRAPFWKKEGLSANQDRWVDARQSDYDSAKRWE

SEQ ID NO: 5228 - protein, 437 aa, Proteus mirabilis
SINKHRISMLDPNLLRNELDAVAEKLARRGFTLDVEKIRQQEERRKVLQVETESLQAERNSRSKSIGAAKARGEDIEPLRQEVNQLGEKLEAAKAELDKLQADIRDYALTLPNLPHDSVPNGKDDSENVEVFRWGEPKTYDFELKDHVTLGELTDGLDFPSAVKITGSRFVVMKGQIARLHRAIAQFMLNLHTEQHGYQEMYVPYLVNHATLYGTGQLPKFSGDLFHTKPLEEESESQYALIPTAEVPVTNMVRDVILEEDELPLRMTAHTPCFRSEAGSYGRDTRGLIRMHQFDKVELVQIVHPEKSMDALEELTGHAEKVLQLLNLPYRKVVLCTGDMGFGARKTYDLEVWVPAQNTYREISSCSNCWDFQARRMQARFRAKGDKKTQLVHTLNGSGLAVGRTLVAIMENYQTADGRIEIPEVLRPYMNGLEYIG

SEQ ID NO: 5229 - protein, 107 aa, Proteus mirabilis
LMNKYTELSDFEINKKVYELIFISDEYEVESSLFGHVTVNDEIYDPCNNPSDAMPIIIENKIGLSPMYHSNKWTADCLDYDFMSVNKNPYRGAMEVFLMMKDTENNQ

SEQ ID NO: 5230 - protein, 456 aa, Proteus mirabilis
WGNKRMLSAMKSESLVIKIGGSPLDTPEFIALKTEFNKLSHPARPEISWTLIESLCLSLFKNHGIDLQSGAYYTIARLQQHGLSGFTEGCELLANVIVTYWDSLWPEKPNQRTEVLNWFNTKASALLRQQSYQAKDLRLIYRSERALQLIIDKLAKTTWEKLPKIENLLWFFQNLAKQIEKQEKQTQQDSADPVSVPPLVCIQQPSKTTDKAAPTFVIETPQPASSFTVVAKKMSATRGFIWGCVLSCILFLAVGFGVHLYLKQEMNAITSIPEGAAAKWLFKPQLNSYEYHLALLEKRSPLSNLRLIDTMQEKAKNAWPTDAEQIYFTRNWQNLYQTRLENMPINDSWSETATLLQQLSNKIVQQERNRGSFTLSYLKTAIYDIQKQHNKVEPIEEKLRQLAVQIETGQPISPATLNNIDNKINGLLARYYDLQKQAEQQGLKPGSYSSFGLDHE

SEQ ID NO: 5231 - protein, 427 aa, Proteus mirabilis
MADNKAKLTIGETSVDLDVLSPTLGSKVIDIRTLGSKGYYTYDPGFTSTASCESKITYIDGNNGILLHRGFPIGQLATESTYLEVCYILLYGEAPTQEQYDKFKTTVTRHTMIHEQITRLFHGFRRDSHPMAVLCGVTGALAAFYHDALDVSNPVHRDITAYRLLSKMPTVAAMCYKYSIGQPFVYPRNDLSYAGNFLHMMFATPCEEYVVNPVLERAMDRIFILHADHEQNASTSTVRTAGSSGANPFACIAAGIASLWGPAHGGANEACLRMLEEIKTVEHIPEFIKRAKDKNDSFRLMGFGHRVYKNYDPRATVMRETCHEVLKELNLNDSLLEVAMELERIALNDPYFIEKKLYPNVDFYSGIILKALGIPSNMFTVIFAIARTIGWIAHWNEMHEDGLKIARPRQLYTGYNERKFHSELKNK

SEQ ID NO: 5232 - protein, 71 aa, Proteus mirabilis
GHCNAIQKYLLVYEAFDNTNVFLLKGNAAIKIESGKGIEEILNTFTEVACSEARKIDKYARRVAIVSVIEL

SEQ ID NO: 5233 - protein, 429 aa, Proteus mirabilis
LESKMTPDDIAFDLRHIWHPYTSMSNPLPAYPIVSAKGVELTLANGKQLIDGMSSWWAAIHGYNHPELNTAVTEQLAAMSHVMFGGITHPSAVALCRKLLAITPAPLECIFLADSGSVAVEVAIKMALQYWQAKGEKRQRIVALKRGYHGDTFGAMSVCDPDNSMHSLYKGYLPNHLFVEAPKTGFYQPWDATDIDDLRTTLAQHHQHIAAVMLEPIVQGAGGMRIYHPEYLTQARALCDEFNVLLIADEIATGFGRTGKLFACEHAGISPDIMCVGKALTGGYMTLSATLTTRHIADTISQGDAGCFMHGPTYMGNPLACAVANASLSLLEQGHWVNQVAQIEDQLKTELLPLKQAKSVKDVRVLGAIGVVEMVEPVNMAKLQKYFVDEGVWIRPFGQLIYIMPPYIISPEKLTKLTQAIEKAVNLTN

SEQ ID NO: 5234 - protein, 84 aa, Proteus mirabilis
ICGNELGIGTDRNILLAPRSQKMPRTKTGVLTLMRQNPKTCIFKLIVHDYKKRGTHRVPHLLYLLLNQNILKINFDIYPIISTR

SEQ ID NO: 5235 - protein, 260 aa, Proteus mirabilis
VELNMKKLSGKLLAGAIISFALVSQSMASEKITVFAAASLTNALNEISAQYKQEKQADVVASYASSSTLARQIEQGAPANLFISADQQWMDYVINKNLMVTDSRHTLLGNDLVLIAPKDSKLNNVVINKDTKWKSLLNGGKLAVGDPDHVPVGIYAKESLEYLGAWDVVSPEMARTNNVRSGMALVERDEAPLGIVYGSDAVASDKVKVVGVFPTDSHKPVEYPMAVVKGQDNKAVRDFYDYLKTPQAAEIFKKYGFSPL

SEQ ID NO: 5236 - protein, 688 aa, Proteus mirabilis
GLSKGECVNILSYLQKIGRALMVPVATLPAAAILMGIGYWIDPVGWGNDNALAALLIKSGAAIIDNMSVLFAIGVAYGMSKDKDGAAALTGFVGFLVVTTLCSPAAVSMIKGLPLAEVPVAFGKINNQFVGILVGVLSAELYNRFSSVELPRALSFFSGRRLVPILTSFLMIIVAFILMYIWPVIYGGLVSFGESIKDMGALGAGIYAFFNRLLIPVGLHHALNSVFWFDVAGINDIPNFLAGQQAIDAGLATVGVTGRYQAGFFPVMMFGLPGAALAIYHCARKEHKAKVAGIMMAGAFAAFFTGITEPLEFSFMFVAPVLYVIHAFLMAISVYIAASMEWISGFGFSAGLVDMFLSSRNPLAVKWYMLIVQGIAFFFIYYGIFRFTITKFNLKTPGREDEVAGDETADGYDEDIKAVPTNSKEAVQQEARQYIAAVGGSDNLTGIDACITRLRLNVKDASVVNDAYAKHLGASGVIRLNKQSVQVIVGTRAEIVASAMRDVLAQGPVAAYAGRHTDNAVSTEKTSEKQTNNDAKVILEMVAPFDGEVVALKDVPDEAFSSGVVGDGLAIKPTSNIVMAPAAGTVVKIFDTNHAFCIETDNGVEIIVHMGIDTVALGGKGFKRLVEEGTEVKLGQPILELDLEYLNTNAKSMISPVIISNIDDFDKVSDIASGQVTANNTIIYKVLK

SEQ ID NO: 5237 - protein, 188 aa, Proteus mirabilis
QRVLMNKPISFIICFTTLFIKACTPKEKLQQLETEPRSIILNKNIQIAQPDLYLTTPKVVRYDRYLLINTSPTLAQSDPIEQIIDVHIPTSQQSSVSDAMRYILQPSGYSLCKTTSSNQVLYNQKLPVVHHQLGPMRLKQALQVLAGVAWQLEIDAVQRIICHSLREGYQLPTEILTNSTLSADRMLQ

SEQ ID NO: 5238 - protein, 424 aa, Proteus mirabilis
IIYKGKHMKLRNAIIIGVIYTPSICQAVEQTSYKYISINQDSSTIVKPNEINPKQAEILIAPKNPKGISHNKYDTFDVTDAGIILNNKEVAAETIINEVVNGATSFLAGNIAVAGNAAHVVIANPNGIECHNCSFSNTLQETLTTGKPVINNNNDELIGYRLEKAIAPINKGYRGGKSIEHIGKIVFSNKNDRSSSHSFNKLNIISNNIKLENGFISSKGDISIYSGKRDIIIKEGESILKQEYAMRSNIKRNNLPNQIILGDKNSNSKEQGIISSKNIIINASDTTIYNYGSLESSNRSKNAIQLNLNKTIFNNHGYILARNGYLDLQNKSFFHNMESGTIGMQYWLNTGKNNNNYSETYIGLIPKNTISQMKNLTLDISEDSNLINDGIIMTERLHTRDKNISNIQNNREDIKIYTKLRKIK

SEQ ID NO: 5239 - protein, 132 aa, Proteus mirabilis
KRHNAYQNGDMVMGMGLEIYDEKGRLIIGEDTIIPRHLGQFDLPLSQYGSLTIPEISLGGEVVCHFWLRYRSRWSGEFHVDKPNERTEYSISGNTLNYRVDYNIYRWENNGSGGGQTRANDSFSSHVVVWVV

SEQ ID NO: 5240 - protein, 647 aa, Proteus mirabilis
AGNNMKRFLTTLAILLVVILAGLTTLVLLINPNDFRGYLVERVEKQSGYKLTLQDDMRWHVWPKLSIISGKMSLTAPGAEQPLITADNMRLDVELWPLLSHQLEVKEVMLKGAVVRQTPESKAIPKITPPSVANEDSTRPIIEPKTNRWQLNIAKVRISDSLIIWQTKGGEQLNLRDINLLLKTDDKKQINLEMSTKINRDRRELMLNVVANADMSGYPYQISGNIAQLDYALSGIGLPAQGISGNLTSDFNIKNDSVNVIALNNLNMTANESQLQGSITAELAKKNRYQVELTGDTLNLNTLLPELAQPNSSETASLTLANTPSRSFSFFSHAQAAPSPNATIIARPVITSATIENKAYDLTHWGDIEFSLNLALNKLLYKELEINNVKLTALNNPKSLNIDRLEGQILNGNFSLPTVISTSIVPAHISMNVTMNNIPLQPLLRVFDQPENFSGLISAKGHLEGAGYNRNAFLNSWQGTLDTSLSEFKMLGLNIPQVIQQSIAQTTDQVVYPEDIENYTKADSVIAQFKLAPKGRVTLNQLDAQASAYQISGQGRLDLQRHNLDVMLMVNIKKGWGKENEFIRQLAKIDIPLRLYGNWNAIQYEFNVEKLLRDQLQQKAKQAIDNWLNKQDDSPEVKALNQLLKKI

SEQ ID NO: 5241 - protein, 462 aa, Proteus mirabilis
PRNNLLMSTTNVDFTRPEYKTAAPQWELVRAVCRGGEDIKNYLPELEEQDGERKKKRNKDYQDRAVFYPITGNTRNGMIGMAFKKDPLVAVVEKLSCLKDDADGAGSSIYQLAQSSLESVLEVGRHGLYVDYNSDSKLPYIFQYRAEDIINWRTARINGRTMLTLVVLRETVEEEDGFGFKDEVQYRVLSIEEGKFVCRVYRKPSGSSVFEISSEYIPARAGNGVWNEIPFTFIGAQNNDHTIDEAPLLGLAKINLGHYRNSADYEDSVFFCGQIQPYLGGLGTEWRDYLEKKGVMVGSRSPIMLPEKGFFGYAQAQPNMLAKEAMDSKRDYMVALGAQLVSADSKVKTVIQSVGEQNAQTSILSICCSNVSDACSKSLIWCAEYLGLDTAGISFEINKDLVNHIADSSMIREIVAAWQSGATRKSDLVRSLQKYDVIDPADDVDVVVDELNNQEPTMVGET

SEQ ID NO: 5242 - protein, 123 aa, Proteus mirabilis
YICNEVAMNIYQRGQSTALRMLKKYGVSYQAKRDGKHWVDDEGQEHFEPETLFSVVGVKTQYKPYEIDGTLILSTDIKMILPPDIDIQKGDKVLVDGVWLRVHEPNPVKPADIIICYQSQLRA

SEQ ID NO: 5243 - protein, 269 aa, Proteus mirabilis
VSRKLNLQDCQQNGQKLTNMELRYKRMSSIHTEQFIPAKLAQALANSLFPELDSQLRAGRHIGIDSLDNHAFLMDFQDELTDFYARYNVELIRAPEGFFYLRPRSTTLIPRSVLSEMDMLVGKILCYLYLSPERLANQGIFTVQELFDELRTLADESKLLRLVNQRSTGSDLDLQKLQEKMRTSLNRLRRLGMISFLPNDTQRFSITESVFRFGADVRSGDSPLEAQMRMIRDGEAMPLEQDSEPSDDDEQEDEQLESSEDDDAEEENK

SEQ ID NO: 5244 - protein, 323 aa, Proteus mirabilis
ISGKFLKVSKTIMRNRTLSDLDRVVALGGGHGLGRVLSALSYLGTRLTGIVTTTDNGGSTGRIRKDEGGIAWGDMRNCINQLITEPSVASAMFEYRFSGTGELAGHNLGNLMLKALDNLSVRPLEAINLIRGLLRVNAHLIPMSEQAVDLMAIDDEGNEIYGEVNVDNLPRMPRQLKLYPDVTTTREAIEAIEQADLILIGPGSFFTSLMPLLLLPDLAKALRRSSATTIYIGNLGKELSPAAASMTMSDKIAMMETYIGLQTIDAVIISPETQYESMKGRLIIQAQLEAKDIPYRHDRHLLSKAIELTLQQLGQRNTACTAS

SEQ ID NO: 5245 - protein, 241 aa, Proteus mirabilis
MISLKDVSKWYGQFQVLTDCSTEVKKGEVVVVCGPSGSGKSTLIKTVNGLEPIQQGEILVNDIKVNDKRTDLAKLRAKVGMVFQHFELFPHLSIIENLTLAQVKVLNREKGAAKEKGLKLLERVGLANHANKYPAQLSGGQQQRVAIARALCMDPIAMLFDEPTSALDPEMINEVLDVMVELANEGMTMMVVTHEMGFAKKVADRIIFMDEGRIVEDSPKNDFFDNPKSERAKDFLAKILH

SEQ ID NO: 5246 - protein, 196 aa, Proteus mirabilis
RELKMNKIKSIAVYCGSSLGASPIYKQQAILFAKELVKRNITLVYGGASVGIMGTLADTVLQEGGKVIGVIPTLLEGREISHKNLTELHVVETMHQRKSKMIELADGFVALPGGFGTLEEFSEVFTWSQIGLHQKPLGIFNINDFYQPLLAMIDKMVDEKFLHEKYRHMAIVEQSPIQLLDKFESYIAPSIKTYDK

SEQ ID NO: 5247 - protein, 310 aa, Proteus mirabilis
RCLKSYNSRRLMGDTYMHTRFQAIWSDLSPQLQQALTPYLEQDEFPAMFTAEQVNALKTQLQCNDDELALALLPVAAACAVTPISHFNVGAIASGESGHFYFGANMEFAGAPLQQTVHAEQSAVTHAWLRGESRLVAITVNYTPCGHCRQFMNELNSGTHIAIHLPGRKVATLGDYLPDSFGPKDLNITTLLMDKVNHGYQIDNTSQLAQQALQAINRSHAPYSHSHSGIAVQMKSGKIFQGSYAENAAFNPSMPPLQAALIALNMAGENVMDIESAILIEKADSLLTQWDATQATLTALGCRQIQRVTL

SEQ ID NO: 5248 - protein, 109 aa, Proteus mirabilis
IMINWKEYRKKLFGRIGELGKLTPDTVAGYQTLSNAGKKTAHLDDKTRELISLAVAVTTRCDGCIAVHAEAALKLGLSREEIAEALGVAVAMNAGAAMVYSARVLDSIE

SEQ ID NO: 5249 - protein, 111 aa, Proteus mirabilis
KMINKEILKNLKYFEKTPLIHHINYSLTEDAKKNILNGWLPACMEDKWLSYSIENCVYVHRSWSGHLMYKFTIDNNTIDFIEIAMDDFVDMTNERKIEVFFSLLPYLSQPH

SEQ ID NO: 5250 - protein, 313 aa, Proteus mirabilis
YRIKFMKTPFSWRHIEIFHAVMTTQNLTEAADLLKTSQPTVSRELSRLEQLLSFKLFDRIKGRLQPTTEGLRFFEEVQRSYYGLDRIITAANSIRHFHQAELNITCLPAFAQSLLPSICQQFLSQYPEVNLTIVPQESPLLEEWLSAQHYDLGLTEHTQTPAGTQQETLLTLNEVAILPKSHVLSKKALLQPQDFHQTRFISLSANDSYRQLIDAMFIKQGITRQLIMETQSAASICAMVSKGIGVSIVNPITALDYQYSDLCIRPLSFTIPFTVSLITPSHRPSSQLVRYFIDVMKTTLANYPKQLTHAFTR

SEQ ID NO: 5251 - protein, 391 aa, Proteus mirabilis
MSVNEEKNPPQAPIRNKKRTRRNVLLLLTFIFILAGLAYTAYWFMVLRHHETTDNAYVTGNQIMVMPQISGSVTTVYVDNTDYVKAGEPLVQLDDSDEILALDKAKTALANSVRQMHQQIINGRQLKANIVLRETELAKLQNDLRRREVLGERNVIGKEELQHAREAVATAKAALDVAKEQYNANQAIILTTPIAQQPSVLQATTEVRNAWLALQRTKILSPAEGYVSRRSVQVGAQVAPGKPLMAVVPVTGMWIDANFKETQLANMRIGQPAKITTDFYGKKVIYHGRVQGLDMGTGSAFSLLPAQNASGNWIKVVQRLPVRISLDEKEVAEKPLRIGLSTEVTVDTVNLDGKVLSQSERQAPAYHTDALTIDMSEINSLINEIIEQNAG

SEQ ID NO: 5252 - protein, 328 aa, Proteus mirabilis
IKVNIVVMKLIIEGLSLTTQLLGTHLSVATLTAHTIRTTKMGIDFSSLVEYLKSEGFENTLSQRLLDDIPSLAMPVLLLLKNEESAVLTEVSFDETGQRKYKIQQVDGLSIWLTQSELSEKYLGYCWFIKPRITEDVRSELPEYTMPKAWFFKVIWRFKKYYYQIILATFVINFLALVSSLYVMNVYDRVIPNKSYQTLWVLSIGVIIAILFEFTAKMLRGRLTDIAGKKADLIISSALFRKVTNLKLQEKPISSGSYVNNLRDFESVRDFMTSASLLTLVDMPFLILFVSVIALVGGYLAFVPLTIIPLVIIVGLLAQIPLSKYINE

SEQ ID NO: 5253 - protein, 394 aa, Proteus mirabilis
LRSLYPNILMNESMKESSQRQGLAVEAIEGIETLKTNNAMNWAQKRWDYYTAKTASSSMKVKNISNFVIYFAVMMQQLNTIFLVIIGTYLIHSDDPASKITMGALIATVILSGRALSPLGQIAGLAVRFQQAWVALKGVNGIVERPSEREPSRKYITLKQINGNIKFQNVSFAYNQDSSSVVKNLSFEIKPGEKVGILGRIGSGKSTTLKLAAGLYPAEQGSITLDDVDIRQIDPHYLRNQVLLLEQEPRLFLGSLRENLDLARMDGFSSDQDLIVALKRFGLDKVIKKHPRGLDMSLGENGLGLSGGQKQIVALARMTLRNPKIVLLDEPTTGLDQYSEIQALNAISAWCRSKTLLVVTHRPQVLSIVNRIIVVDNGQIVMDGPRDAVLQQLT

SEQ ID NO: 5254 - protein, 145 aa, Proteus mirabilis
NSSNSALKEQLMQSTAPLIYFSSRSENCHRFVQKLNLQATRIKEDEPLQATQPFVLLCPTYGGGGVKGAVPKAVIQFLNIPENRQLIRGVIASGNTNFGSAYGLAGDIIAQKCQVPFLYRFELLGTPEDVKRVKTGLSTFWSASK

SEQ ID NO: 5255 - protein, 451 aa, Proteus mirabilis
TCANLMIKIKKGLDLPIAGAPAQVIEDGPAIRHVALLGEEYVGMRPSMMVSEGEHVKKGQVLFEDKKNPGVIFTSPACGKVVAINRGERRVLQSVVIEVDGDEEVTFDSYDSSSLSELTREQVETNLVNSGLWTALRTRPYSRSPKLGTTPVAIFVTAMDTNPLAADPTVIIEQNEQAFNDGLIVLSKLTEGKVHVCHGEKAPAKLNDGQISYNQFVGPHPAGLVGTHIHFLEPVSAKKMVWHLNYQDVIAMGYLFTTGSLYTERVVALAGPQVKAPRLLRTCLGADLYELTKDQLVDGDNRIISGSILWGWKSDEAHHYLGRFHNQVSVLREGREKELFGWGYPGTNKFSITRTTIGHFLKNKRFAFTTTMNGGERSMVPIGNYERVMPLDIMATHLLRDLIVGDTDSAQALGCLELDEEDLGLCTYVCPSKYEYGPALRQVLTKIEQEG

SEQ ID NO: 5256 - protein, 321 aa, Proteus mirabilis
HYQNKLKQKSNTKQHINITTTGVIMRMRKLALSLMILGAAGAVQAEELTGTLKKINDNDIIIVGHRESSVPFSYYDNQQKVVGYSQDYSNLIVEAVKEKLGKPNLQVRLIPITSQNRIPLLQNGTFDFECGSTTNNLARQQQADFSNTIFIVGTRLLAKKDSGIKDFADLAGKNVVVTSGTTSEMLLNKLNDEKKMNMRIISAKDHGDSFRTLESGRAVAFMMDDALLAGERAKAKKPALWEIVGTPQSEEAYGCMLRKGDTQFKSLIDETIANAQKSGAAEKSFNRWFNAPIPPKNLNLEFTISDEMKALFASPNDKALN

SEQ ID NO: 5257 - protein, 382 aa, Proteus mirabilis
RSQNLMQCARSSAGDCHSCGWLSLAYSEQINQKQHNLLDLLPKNYAFTQLAPVESQQVKFRNKAKMVVSGSVEKPILGLRKPEGEGVDLCQCPLYPASFEPVFPILKTFIAKAGLVPYNVERRRGELKFILLTESRHNHSMMLRFVLRSEKKLAQLRQALPWLQAQLPQLAVISVNIQPVHMAILEGEQEIVLTEKTFLDEYFNEIPLHIRPKGFFQTNPDVAASLYATAGHWVKELQINRLWDLFCGSGGFGLHCAQKNTELTGIEISPEAIECARLSANELGLEHVEFQALDSTGFALAKESVPELVLVNPPRRGIGETLCDYLNSMKPRFILYSSCNAQTMAKDIQQLSHYRIDRVQLFDMFPHTAHYEVLTLLVLQQS

SEQ ID NO: 5258 - protein, 161 aa, Proteus mirabilis
SMQNNYVLRSVRYMLDLSDGHIVDIMKLADFTATKEQVNQWLKKDDDPAFVECDDMALGHFLNGLIFYRRGKDEKYPTPEVEKRITNNIILKKLRVAFELKDMDMINIYELADFRVSKPELSAIFRKPGHKNYRNCGDQLVRYFLKGLTETLRGKGKAVKK

SEQ ID NO: 5259 - protein, 228 aa, Proteus mirabilis
LMCLSESPMSSTLSKEAQWVHAALVERGLETPLREPKLSPSESKQQIKHHMTEVMKLLNLDLSDDSLAETPHRIAKMYVDEIFSGLDYHNFPKITLIENKMQVDEMVTVRDITLTSTCEHHFVTIDGKATVAYIPKDKVIGLSKINRIVQFFAQRPQVQERLTQQILIALQTLLGTKNVAVSIDAVHYCVKARGIRDATSATTTTSLGGLFKSSQNTRQEFLRAVRHL

SEQ ID NO: 5260 - protein, 476 aa, Proteus mirabilis
MQKNDDKNKKLHFINNYRRQELYMIEILIGALVAVGVGRYIVKGYSPTGVLLTGGLLLLIISVIMGKSVLPASVTSTGYRLIDIVEYVKNLLMSRGGDLGMMIMVLCGFASYMTHIGANDVVVKLASRPLKMINSPYLLMVAAYIVACLMSLAVSSATGLGVLLMATLFPVMVNMGISRGAAAAICASPASIILAPTSGDVILAAQASEMPLIDFAFKTTLPISIAAILGMCIAHFFWQRYLDRKEHIETEMLDVNEIKTHAPNFYAILPFTPIIGVLVFDGKWLPELHIVAIIILCMMLSAVIEFIRSFSAKEVFAGLEVAYRGMADAFAQVVMLLVAAGVFAQGLTTVGFIHALIDGAQSLGSGAIVMMIALVLITMLAAMTTGSGNAPFYAFVELIPRLASNMGVNPAYLTIPMLQASNLGRTLSPVSGVVVAVSGMAKISPFEVMKRVSVPVLVGLVIVIVATEILVPSTLG

SEQ ID NO: 5261 - protein, 106 aa, Proteus mirabilis
PRKKLLTVAEAMYGGMSSKESAEFERAFGFPPDIDDVEVWPDVWDSYQVFSAMNTQWRVGMNGITGLDYNPLNQIMDLLNIKDRATVFSDIRIMEAKALEVMHKRP

SEQ ID NO: 5262 - protein, 357 aa, Proteus mirabilis
TMKKILLLLIIAPLLISCSSKPTKTFEPDYSKDTNAFDILMGQFANNIEMIWGMQEVLIAGPKDYVKYTDAYRTRSHINFEAGTITIETLGGDAPQFQLHKAIVTTLLMGEDPGSIDLYSDVNNIPHSTEPFLLGQVLDNTGQPIRWEWRANKFADYLIANKLQKRQSGLNTIWYVTINLVPNHLDKRAHKYLPYVQQAAAKYGVEPSLILAIMQIESSFNPYAVSSSDALGLMQIMPATAGRDVFRMQGKSGQPSRSYLFDPANNIDVGTAYISILQNSYLGDIKDPVSRRYAVIQAYNGGAGSVLRIFHSDKKKAAAMINNLAPTEVYTTLRNKHPADQSRRYLEKVSTAQRNYR

SEQ ID NO: 5263 - protein, 302 aa, Proteus mirabilis
MMKKLTFTALALMMCGAAWGAAIPQASRYDSRVQQVIYNPQNVTVVNTKPGFMTTLVFDNDEAVISAKPGFDEAWEATPDANRVNVRPVALTQGAPGEDGNTTQVVIPPNSRDWHTNMLVVTSKRLYNVELNVIDDKSTQQPAFQVSYRYPGEERDKASREATARQREWEQKQQQASVQKALNSAQTPRNWSYTKYPGKGSFNIVPDFAYDDGRFTFVGFSPSKSIPSVTKELNGKEHVVNSSIQKKDDFTVLVIQEVTPRLVLRSGNAVVGLENSGFDKVHAADGSTVSRQVERVEKPESN

SEQ ID NO: 5264 - protein, 126 aa, Proteus mirabilis
IVKKQRPVNLDLQTIQFPLPAIASILHRVSGVIMLVAVGILLWLLGTSLSSPEGFQQAADIMTGFFAKFILWGILTALAYHICGGIRHMLMDFGFIDETLVVGRRSAAISMIITVILSILAGVLVW

SEQ ID NO: 5265 - protein, 237 aa, Proteus mirabilis
IWKNSAHEKEKLMAVIVPVITVDGPSGAGKGTLCQALAKAFGWHLLDSGAIYRVLALAALHHHVDITSEDALVPLAANLDVRFIPNDNGLSVILEGEDVSTEIRTETVGNTASQAATFPRVREALLRRQRAFRTAPGLIADGRDMGTIVFPDAQVKIFLDASAQERARRRMLQLQEKGFNVNFERLLSEIKERDYRDRNRAVAPLVAAKDALILDSTSLSIDEVIEKSLAYAKKICN

SEQ ID NO: 5266 - protein, 259 aa, Proteus mirabilis
KRKNNLMFTVIIPGRYASTRLPGKPLADIHGKPMIVRVMEQAKRSGAKRVIVATDNLDVVRAVEQAGGEACMTREDHHSGTERLAEVIEKYQFADDEIIVNVQGDEPLIPPAIITQVAENLANCGAGMATLAVPIVDSKEAFNPNAVKVVMDAKGFALYFSRATIPWERDRFNLSHDEIGEHYLRHIGIYAYRAGFIRRYITWEPSPLESIEMLEQLRVLWYGEKIHVAKALEVPGVGVDTQDDLIAARAAFRALNQEF

SEQ ID NO: 5267 - protein, 377 aa, Proteus mirabilis
SAPLLQLERLMNDSYEGKNGKVKVMYVRSEDSADNKPKKPSRRPNNARGDTDRSHRRDDKRGDNKFSRRDERGAGKSSGRNPSRSGSSSLRDNDSEGGNYSPWKTISRPGDEPLKEHDGITGKSQIDPEQLRRQRLEETRIYGENACQAMFKNRPEAIVRAWFLQEVTPRFREALKWMAANRKAYHVVEEEEMVKAARTDHHGGVCFLIKKRVGHDAQTYLKDAPTKDCVLALEDVGNPHNVGAIMRSCAHFGVKGVISPDSSVLESGAAVRTAEGGAEYIQGIDADNFAQTLEQFKQAGYTLVTTSSHKGSVPLAKAQLPEKMVLILGQEKDGLSDSTLKQGDMSIYIGGTGHIESLNVSVASGVLLAEWWRQHHG

SEQ ID NO: 5268 - protein, 183 aa, Proteus mirabilis
SVRNYCERTTGESEKIMANRLRKWGKELIILALIFVAISFAMDWWRQPTPPELTDLSTLYTVDDKPVSLIALSQEKPLLIYFWASWCGICKLTTPTVNDLAQQGYNVTSVVIRSGDDAKIIRGINSKQLVFPVINDDRGAISQRWGISATPSFVILYKGEMVHFTSGWTSSWGLKLRLWWASI

SEQ ID NO: 5269 - protein, 286 aa, Proteus mirabilis
FVRNYGVTDMTSVSTINVPFHGNNLYVVNFNGEPYVPMKPIVEGMGLTWQSQFEKLKQRFSKGITEIVIPSKGGEQSMLCLALRKLAGWLHTISPNKVKPEIRDKVIKYQEECDDVLYEYWTTGEVKKKHKSTVQERNPLKNAVNLLVSKKGIMYPEAYSLVHQKFNVSSIEELTADQIPDAVEYIHKFVLEGEYIPKQEENILFEPNQNSITVTIPKEGRWLVSYKNGKQQVVSVDGHNVVSVEYIQKLQRDSNALIELLQNFRLRTQVMQGEKSGDILNTPLIA

SEQ ID NO: 5270 - protein, 86 aa, Proteus mirabilis
PRRNVGGLSLYSEDGARVFNTDYLPFTRGQSMALLLRKGSVETPYSLPLVCATSQFVNASYQDDHIDWAKRNTGIWGFVFGENRFL

SEQ ID NO: 5271 - protein, 564 aa, Proteus mirabilis
IYLKIINMTESFAQLFEESLKTIETRPGAIVRGVVVAIDKDVVLVDAGLKSESAIPVEQFKNAQGELEIQVGDEIDVALDAVEDGFGETVLSREKAKRHEAWLMLEKAYEENETVVGIINGKVKGGFTVELNGIRAFLPGSLVDVRPVRDTTHLENKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKANPWQQFAETHNKNDRVEGKIKSITDFGIFIGLDGGIDGLVHLSDISWNVAGEEAVREYKKGDEIAAVVLQVDAERERISLGVKQLSEDPFNNYLSAHKKGAIVSGKVTAVDAKGATVELADGVEGYLRASEASRDRVEDATLVLNVGDAVEAKYTGVDRKNRVINLSVRAKDEADEKDAIASVNNKEEAGFSNNAMAEAFKAAKGE

SEQ ID NO: 5272 - protein, 362 aa, Proteus mirabilis
LAMNTPFDITLLARKNVRQLTPYQSARRLGGNGSVWLNANEYPTAPDFTFNEKNLNRYPECQPVNVINRYAAYAGVQPEQVLVSRGADEAIELLIRAFCEPGKDAVLYCPPTYGMYSVSAETFGVEQRVVPALADWEPDVKAIASQLDNVKLIYLCSPNNPTGNIVDPSLIREVLALAKDKAIVAIDEAYIEFCPQASLVTWLKEYPNLVILRTLSKAFALAGLRCGFALANSPVIELLLKVIAPYPLSTPVADIAAQALTDQGIEAMKQRVTEIVRNRTYLADALKNLPNVEQVYCSETNYILVKFTDADCVFRSLWEQGIILRDQQRQYGLAGCLRISIGTRQECDSVITAIKNRQTANV

SEQ ID NO: 5273 - protein, 390 aa, Proteus mirabilis
NIMNLHEYQAKQLFSRYGLPAPAGFACSTPREAEEAASKIGQGPWVVKCQVHAGGRGKAGGVKVVNSKEEIRAFAEQWLGKRLVTYQTDANGQPVTQILVEAATDIAKELYLGAVVDRGTRRVVFMASTEGGVEIEKVAEETPELIHRAIIDPLTGPMPYQGRELAFKLGLKGKQVSQFAKIFMGLATIFLERDLALIEINPLVITKDDDLICLDGKLGVDSNALFRQPEMREMHDPSQEDPREAQAAQWELNYVALDGNIGCMVNGAGLAMGTMDIVKLHGGEPANFLDVGGGATKERVTEAFKIILSDENVSAVLVNIFGGIVRCDLIADGIIGAVEEVGVNVPVVVRLEGNNAELGTKKLADSGLNIIAAKSLTDAAKQVVAAAEAK

SEQ ID NO: 5274 - protein, 234 aa, Proteus mirabilis
VAMNTIKQNLVNVRSHIDTAAQKCGRSPDEITLLAVSKTKPVSDIEKAIACGQTEFGENYVQEGVDKISYFAENKNLVWHFIGPLQSNKTRLVAEHFAWCHTIDRLKIAQRLSDQRPTTLPPLNVLIQINISDENSKSGISLTELDGLAAQISILPGIKLRGLMAIPAPENDYNKQVEVLEKMHQAFKQLQNQYPDIDTLSMGMTGDMEAAIACGSTLVRIGTAIFGARDYANK

SEQ ID NO: 5275 - protein, 402 aa, Proteus mirabilis
SVMKTNLPSVLAKVTAGMGLLLIISSPTFAVNNPVPPQIEAKSYVLMDYNSGKILASEKPEERLDPASLTKIMSSYVVGQAIKEGRMSPDDIVIVGRNAWATGNPVLKGSSLMFLKPGDRVKVIDLNRGMVIQSGNDASIALAEHVAGSQETFVDLMNTYAANLGLKNTHFKTVHGLDSEGQYTTAQDMALLTAAMIRDVPSEYDIHKEKEFTFNNIRQPNRNRLLWNKNMNVDGVKTGHTNGAGYNLVSSATEGNMRLIAVVLGAPSDKVRFAESERLLGWGFRFFETVTPVKENVPLTTQKVWYGDKGEVALGVAKDASITIPKGELKNLKASFTLTNPELEAPLTQNQVVGTVNFLLNDEVIEQRPLVVKEAVEEGGFFSRIWDFVVKTVSGWFNALFG

SEQ ID NO: 5276 - protein, 181 aa, Proteus mirabilis
RGMNMKVEQSQVTKLVITGVERHDPIHVYLEDYGDNQNGRVTISESGCSWSCFWGSMGSPLIEFIQRINNHYWIGKLDSNLISEIDADNDANAEYAKKQVIELRKDDEIDKYEAREYWDLIEASDSVKDECCNSFLGGKLLSLFGDDAWYNDWPTTPNPQYLRMESRLNAVREALKQIKVS

SEQ ID NO: 5277 - protein, 434 aa, Proteus mirabilis
CEQNFEPHYTIHTDLKSDMANNTNLSETLFKPRAKHAETSTLIQYTHPKSNIDSYSVLNGMSQQNWYRTIQRLQWIWRGISPIEIEEVLSRIAIFDAPRSDDKFIDTVVGYRRGNWSFEWSHQAMIWQQKALRETSEEAAADCWLRAANLYSIAAYPFINGDFLADQAVVLAMKAFENAMKFSSFEVKKLTFKLTGKGTTSGFLHLPKGCKGPYPTVIFCGGLDSLQSDYVNFFRRYLSPKGIAMLTVDMPSIGYSVKQKLSENTCQLHGDILQQLGDIPWIDHTRVGVMGFRFGANIAVRLAYLYPKLIKGVVALGPLIHAFFTQAELQKKIPIMYLDVLASRLGLLNIDENNLRLSLSSYSLKNQGLIGRRMPVPMMSVYWKGDEISPKEDSQLIARSSMDGDIVEIKEKPLYKGLEQALTKSADWIYAKLI

SEQ ID NO: 5278 - protein, 166 aa, Proteus mirabilis
MSKKNLGSVAPKERINIKYTPNTGGAQAEVELPLNMLIVGDMKGKTEETPIEDRKAISVNQNNFNSVMESAGINLNINVRNTLEESSDSELNVNLDVKSLQDFSPDSIARQVPELNKLLELREALVALKGPLGNVPAFRKRLQELLENQETREQLLKELDIAANQK

SEQ ID NO: 5279 - protein, 373 aa, Proteus mirabilis
LGKNMAKKAPKEQQAIRESAEVRFAEELERLTKADANNPKPQGWLRSPRAVRQFILGDDTLGITPKFFGDDALVDRAIVTLLGKQGLMLVGEPGTAKSMLSELFAAAISGDSGLTIQGTAGTTEDHIKYSWNYALLLAEGPTERALVGSPIYQGMLQGKIVRFEEITRCPPEIQDVLVSLMSEKQLMIPEMGDGARISAKPGFNLIGTANLRDRGVHEMSAALKRRFNFETVKPIRDPAFEISLIQSQLENELGTLATEITVPMDVVELLVTTFQELRSGNTQDGGNIKTPDAVMSTAEAVNIAYACALEAHYLGDGVMNAGAIARQLIGVVLKNNPDDIKRIRYYMDNVARERARNSKEWKAFFDASKNFWQ

SEQ ID NO: 5280 - protein, 261 aa, Proteus mirabilis
WTEKIMRKQSPEYITPLNEQNVNKDNANLLVCPFAGASNSAFNSWRSTDISGLNCQLVNYSGHGCRFKEPAFNDIGLLANELITIIKKFYPPRHNSLLLCGHSMGAQVAFETAIQLEKNGWELSGLILSGCQAPHIQARRLLSDLNDDDFIQQLIAIGGCDAELIKQPQLLKQFMPLLRADFLATERYFFQKSTKRLFHTPVLLMYGSHDSEADKSEVEAWQDWIDKHCTINCIAGDHFYPITRPNTFCRFIIDFYHQIYQ

SEQ ID NO: 5281 - protein, 75 aa, Proteus mirabilis
VRWNKMLNNKASGDWNLFKGKVKEKWGKLTHDELDIIEGTREQLIGKLQEHYGYSYDEAKKEVLEWEGSNPYPWK

SEQ ID NO: 5282 - protein, 287 aa, Proteus mirabilis
LERNSPSAILSNYVPYYVSETMPVISISIVAVCAYLLSLVFILPSLLRKEQNGYRGLALLFAVVALVTHAISLKFLIFRPHSGQNLSLTNLGAVVSLMVCVIMTIVASRGRAWFLLPIVYCFSIVNLIIAALMPGEFVTHLESSTSLFIHIGLALLSYATLLIAALYALQLSWLDYQLKNKKLKFSPQMPPLMSIERKMFHITQVGVVLLTLTLCTGLLYMDNIFGKENIHKSIFSIIAWFVYIILLWGHFREGWRGKKVVIFNLIGAIILTLAFFGNRLLQELMLN

SEQ ID NO: 5283 - protein, 208 aa, Proteus mirabilis
RKYLTQFKRCAVMKVVILDTGCANLASVAYAVQRLGYDPIISYEKNIVLSADKLFLPGVGTASAAMEQLKARELIPLIKALTQPVLGICLGMQILASLSEEGHNIPLLGLVDGNINKLDTKGLPLPHMGWDQVLAKPAHPLFRNIDSDAWFYFVHSYGLGLNDSTIAETEYGSRFSSAIQKDNFYGVQFHPERSGKAGAQLIKNFLEM

SEQ ID NO: 5284 - protein, 275 aa, Proteus mirabilis
ISRLSIKESDHILTARNRLEVAWQCIAKLRTLRISFCAFTAQLKTLTEPYRKSNLRKTVNGVFCGAVISGEQVRFSIRIYTMSKSLVFKGNEITPFDNGDNKIWFTSSQMAKLLEYKNEKSVTNLYNANKDEFSDDMTMVTETMTNGINNNLRKKKVRIFSVRGAHLIGMLANTDVAKSLRRWLLDLAEKESKPQTGLANLDMNELKTLTINEMQNRLVAADNWSFENFGRKGSDLMNLRKRHLKKIRKAKKAIKELSQLTLPDMGEFPDGEEPA

SEQ ID NO: 5285 - protein, 334 aa, Proteus mirabilis
LTIDIIRTKNNDEIIERINFRRKNLMDTLSRLLHLSQGELILDVFCRLSGDFLLPHPPSSEKETIFHLVLSGECQVQIENSEPLALSEGAFLMLNRGQSHTIWRGEDIGSTVQLLDNDVLPVKCSVAATDGQSADILCGRMVYAEGSGQLLLNGFPDFVLADLSALPGIEVLEIFTRLIKEEALDRKSGASAMLNGLVQVLFIFALRCYERSGELNYHWLTLQEDPRLSKALNAMISEPHRDWTVISLANLSLMSRATFARRFKACAGVPPGDVLQSIRMMKALSLLKEKKNTLSYIATSVGYQSEAAFSQAFKRILGCRPGEWRKYQGRHNDI

SEQ ID NO: 5286 - protein, 229 aa, Proteus mirabilis
VVADMNVIDLFLKAGLLVKLIMLLLIGFSIASWAIIIQRTKVLNAADREAADFEDKFWSGTDLARLYKESQARRDELSGAEQIFHSGFKEFARLHQANVHAPDAVVNGASRAMRVSFNRELESLETHIPFLGTVGSISPYIGLFGTVWGIMHAFIALGSVKQATLQMVAPGIAEALIATAIGLFAAIPAVMAYNRFTQRVNKLEQSYDNFMEEFLTILHRQAFVSAEKK

SEQ ID NO: 5287 - protein, 286 aa, Proteus mirabilis
KMHDKIINDILDWIEDNLTKPISTIDVIKKSGYSQRYFQDLFLHKTKSTIAKYILSRKLSMSAILLKLTRYSISEISNDYSFTSQQSFSRAFKRYFKVTPEFYRKSKFWDFRYYRPQHKVFDFKKINCQLIYLSKDRLLDNNSDDFKFFDISIPFDFKSNIAIEGLGYKNKKQIEIIKSLVDSSNDNLCVSYNYFLSSKVKNKITVKYNIKYIHDYNFSFNKEGLKYYLFSFLGSWEDYMILSNIIYMRELPLLQAKRRDGYDIEIFTSGKLDKNICSLNYLIPII

SEQ ID NO: 5288 - protein, 61 aa, Proteus mirabilis
EGNDDNFTIKLLNNFFVIFSLLSIAFCSFARNSYPKSVLSKKANIPITYLIFLNKNPARII

SEQ ID NO: 5289 - protein, 94 aa, Proteus mirabilis
YHNDFTGGCMSQKNTRIRDITPYSLRMPDTLKEKLMQRASKNGRSLNAEMVMILQSAVDEDSTHKNLNELSQLDPEKFKELFMETIKKMNEGKS

SEQ ID NO: 5290 - protein, 462 aa, Proteus mirabilis
KGNDSLYFSLFFYRVISESIMDTTKAGSIAQGNTQSDYKTWRKSDTVWMLGLYGTAIGAGVLFLPINAGIGGLIPLLIMLVLAFPMTFFAHRGMCRFVLSGKNPGEDITEVVEEHFGKTAGVLITLLYFFAIYPVLLVYSVAITNTVESFIVHQMHMTAPPRAILSLVLIVGIMCIIRFGEQAIVKAMSVLVFPFVAILMVLALYLIPEWNGAILDTLSFDHASTSGMSQGLLVTLWLAIPVMVFSFNHSPIISAFAVAKREEYGDNAEKKCSRILAYAHIMMVITVMFFVFSCVFSLTPENLAEAKEQNISILSYLANHFEAPVIAYIAPFIAFVAITKSFLGHYLGAREGFNGLIIKGMRGIGKNVEKDRLNKITALFMLVTTWIVATLNPSILGMIETLGGPIIAMLLFLMPMYAIRKVPAMKKYQGHISNVFVVIMGLIAISAVFYTLGNTFINYFFN

SEQ ID NO: 5291 - protein, 715 aa, Proteus mirabilis
KVNEIKNMTHSIEQLDYHALNAMLNLYDEQGNIQFDKDKLATHHFFRQHVNQNTVFFHDLKEKLDFLVQQHYYEAQVLEQYDFPFIKQLFKHAYSKKFRFQSFLGAFKYYTSYTLKTFDGERYLERYEDRVCMVALTLAQGNTKLATHLVDEIISGRFQPATPTFLNCGKKQRGELVSCFLLRIEDNMESIGRAVNSALQLSKRGGGVAFLLTNLREAGAPIKRIENQSSGVVPVMKMLEDAFSYANQLGARQGAGAVYLHAHHPDIYHFLDTKRENADEKIRIKTLSLGVVIPDITFELAKRNEDMYLFSPYDVERVYGVPMSEISISEKYTEMVNNAEIRKKKIKARAFFQTLAEIQFESGYPYIMFEDTVNRANPIAGRINMSNLCSEILQVNSASEYNPDLSYRQIGHDISCNLGSMNIAMAMDSPDFAHTVNVAIRALTSVAQMTKIESVPSIEKGNQASHAIGLGQMNLHGYLAREGIYYGSEEGLDFTNIYFYTVTYYALLASNQLAIETKQRFKGFEQSKYATGEYFDKYLSKQWLPKTQKVHQLFSQSNIHIPTQEDWQKLKLSIMTHGIYNQNLQAIPPTGSISYINHSTSSIHPIVAPIEIRKEGKIGRVYYPAPFMTNENRHFYQDAYEIGAEKIIDTYAQASQHIDQGLSLTLFFSDEATTRDVNKAQIYAWRKGIKTLYYIRIRQTALAGTEIKGCVSCAL

SEQ ID NO: 5292 - protein, 69 aa, Proteus mirabilis
FIDDQPNVLGTSISVATITITSPTNTGTETRFITSKGEIFAIPDTATTTPDTGDKVRPKFDACNIGIVK

SEQ ID NO: 5293 - protein, 225 aa, Proteus mirabilis
RRDEMASVSHVNQENSTKKLHYIYDPLCGWCYGIAPLIEVVSHEYPHVLTLHGGGLFTPTRKVTGGDAWKEHVTPIDERISQLSGQIFSQQYRDNLANTEMTLNSLMPIAAILVARKMGDRDVMLLKALQDAYYLDGLNISDKDVLFFIVQKLGFDITLFSTLFTQVNEYEITQHIQQTQQLMHQVNGRGFPTLCIEDNQTYQLIPVENYFGDTKSWTSFLKQTL

SEQ ID NO: 5294 - protein, 426 aa, Proteus mirabilis
YDCELGSINMLEQMGKAAREASWHLAQLSTEQKNQALLVIADLLEQQEAIILAANEKDMVAARESNINAAMLDRLLLTSERLKAIADDVRQVCHLEDPVGQVIDGRLLDSGLRLERRRVPLGVVGVIYEARPNVTIDVASLCLKTGNAAILRGGKETHHTNQAVVAVIQQALETCAIPAAAIQAIDKPDRELVAKMLKMDEYIDMLIPRGGAGLHKLCREQSTIPVITGGIGVCHTFVDESADLDQALNVIINAKVQRPSACNSLETLLVHEAIAESFLPQLSDAMAAQKVTLHASQRAITALKKGRATVVDVTEADYCDEWLSLDLNVEVVNDLTAAIAHIRQYGTAHSDAILTQSISHADRFVRQVDSAAVYVNASTRFTDGGQFGLGAEVAVSTQKLHARGPMGLDALTTYKWIGYGDNTLRR

SEQ ID NO: 5295 - protein, 173 aa, Proteus mirabilis
RPSEFRKALSDCTLISSVLIMKYGKLYAVIAMVGIIVGSYWVINWQANRINSLTDINKKLAVALEEQKSINTDYQARIMRLNQLDIQYTQELANAKNEISHLRDISERHPERVYIKAECPKVKTTPSTSLAYATTARPTDTAIRNYWLLRERIAESEQMIKGLQDYIKQECME

SEQ ID NO: 5296 - protein, 579 aa, Proteus mirabilis
IMSEIKYIKEKQYLQKLFSEYADKAPHLASVLDPQDPQTSYLLEGFAFLSARLQDKIDDAFPEITLPLLQRLNSQAIKGLPSTTIIQIDQSEILPYPMEINEKHLVIGDNGAQFSFCHNFTIMPYSILDRKITQHPNHSCISLEILYRGDVELTQTNALNVFLGENKTTSDILLLAFSQYFEKIEVVHNGERYEGDPLNYAFEPKIGNDYKIFPQKNNSFSAPQRLLEGLYLPHVHHFIELDIPQIVTQLDWKQQQRFVVNIYFSQQLPLTQEECNQSFFLNCAPAIDSEAKHTLLIDFKKNKSSYLLPIPTHHYLADLDKIELSLEPHELARGIYCHFYPTTELTAASRLMPQFHKAIFYSLTMEKNITGHTLYYLNFFDNKGDPMVTPPSLHFACVYIGFEQYKRNELGLLNKHSEKMPDAVKTGNITLLSSCYPPIVNNHHFWKLLSHYSANGSMLMSLDTIKHMISDYILYRDTDRQITRKCERLLNGLVELKTHLYDYILKGKPYRCLSLSLFIDETQYENRGEAFVFTTHLYHFFPFCLSENMLLEMSVTLNDQKNTTWYLSPSPLRGYKSMI

SEQ ID NO: 5297 - protein, 166 aa, Proteus mirabilis
INGESAKGYLMSLKQKIAVITTAGATAIALVVIAHFEGVRYEPYRDVAGVLTVCYGHTGKDIIQGKRYTQQECDALLQIDFIKTQQQVDALIKVSLDDYTKAALYSFAFNVGTTAFARSTLLKKLNAGDRAGACEEMKRWIYAGGKVWRGLVSRREAESALCHGKL

SEQ ID NO: 5298 - protein, 615 aa, Proteus mirabilis
FKCLLLKRFYKTLQILVYSYKTLCLTHLIFYDSKIITRDEALRTMAQQAIKRAITYSVVIGTLLSGHNVIASESETPPLFTSETPALVPAFTEDVATQDTLNSPSVSKQEVSTKLQSWLPSEYKPLYFKQLVDVYQSNDLALIWQDEQITKQLEQQLAEVALTGIQPQFGRWLTLLETAQLTPEARDIILSDAFLGYISFVEQINQSGTTLLYRAAIQALPAPTVQAVEHFQLNLQQNTLGRFVVSFAPSHPYYPLMKEEVRKQLHQEVIWPVMEGKNSLKPNQSAEEVIALRQILRNLNLLPQLAENEQEVATTIYDEPLIAAVKSFQAAHGLETDGIIGRQTRNWLNMTPIQRAGIMALNIQRLRLTPPIGDTGIWVNIPDYSLYFYANNQLILDSKVIVGRPDRKTPIMSSALNNVVVNPPWNVPTSMTRKDIVPKGKADPSYFSRKGYTIYSGWGNDAYPINPYDIDWENISAANFPYRIWQAPGPTNSLGRYKFNMPNSEAIYLHDTPNHNLFTKNMRAISSGCIRVNKAAQLATILLGDAGWKQDRIDAALKRGSTQYAPIPERIPVYLYYQTAWVAEENAPQYRADIYNYDQSINNATSFLENIKKYL

SEQ ID NO: 5299 - protein, 227 aa, Proteus mirabilis
TECLIMWDYIVDILPGLPTSLSLTFVALLVAFTLSVLMTFILALKVPVISPIVKVYITLFTGTPLLVQFFLIYYGPGQFPSLKEYPLLWELLSTPWFCAMVTLALNSAAYSTLLFHGAVRAIPAGQWQSCQALGMSPLQTANVILPYAFKRALSSYSNEVVLIFKSTSLASTITLLELTGYSRQVFGQNYDVMVFVAAGIIYLAINGILTLLMRLIEKKALAFEHRD

SEQ ID NO: 5300 - protein, 200 aa, Proteus mirabilis
GRYEIMIPSLNYAVLTDALRALKEDNIRHCESLGFTFDEMNTLSQLSLDELFIISRASAPFVSVCVRHDVLHYLLTQARREYQRQQQINRAIRLGGSIALLNQYFGLTSNEVCLRRRLLGVSVPYGRTPEPDEETDSAIWKQWQKCRVENLASPEALRAMMQVTETLLSQTEELPLTTVWKRIAQCERETAVHRRAPHAG

SEQ ID NO: 5301 - protein, 90 aa, Proteus mirabilis
FMSDTIMQSTWQTKELGMVTRKGKSVTPESSFFQTPHIIQTREDGSTVSTVCSRSGKEVTFVTPKGKRIRASQNEVFNTLLKSIKSVNHS

SEQ ID NO: 5302 - protein, 77 aa, Proteus mirabilis
FILDEFSGIENLSNILYETAIILLNSGTLPENKFLLSLAISQGNFDTNCVFPTPLLPINAYTLFFKIDLSLKLKVKS

SEQ ID NO: 5303 - protein, 360 aa, Proteus mirabilis
IIIEWNTGMNYQNDDLKITQINELLPPVALLEKFPATDNAAFTVRHAREAIHQILAGKDGRLLVVIGPCSIHDPNAALEYAQRLNLLREELKDKLEIVMRVYFEKPRTTVGWKGLINDPHMDCTFDINEGLRIARRLLLTINDSGLPTAGEFLDMITPQYVADLMSWGAIGARTTESQVHRELSSGLSCPVGFKNGTDGTIKVAIDAINAAGSPHCFLSVTKWGHSAIVRTAGNKDCHIILRGGKEPNYSAEHVAAVKEGLKKAGLPQNVMVDFSHANSCKQFKKQMEVGADICQQISAGEKALIGVMVESHLEEGNQSLESGEPLVYGKSVTDACIGWDDTETLLRQLADAVATRRNKS

SEQ ID NO: 5304 - protein, 196 aa, Proteus mirabilis
KQSENSITIMNLLNHFLIAMPSLSDPLFQRSVVYVCEHNENGAMGLVINKPIEDISIESVLEQLEIFSADRDSAISLQKPVMSGGPVAEEHGFILHTPVSGFSSSIKISDSTMITTSKDVLETLGTARQPEKTLVSLGYSSWEKGQLEREILENSWLTVEATPQIIFDTPIAERWHKAAELIGIDIHTISPTAGHA

SEQ ID NO: 5305 - protein, 401 aa, Proteus mirabilis
LMSENISQPPLLSKGMKAVLLSQFLSAFADNALLFAILAQFKSALYPEWSQPILQMVFVLAYILLAPFVGQVADRQPKGRVMLTGNALKFAGAFLICIGTDPFLGYALVGIGAAIYSPAKYGILGELTDGERLVKANGLMEASTIAAILLGSVIGGLLSDWSIILALAVCATMYALAVLVNFSIPKLSPAQIGRGWNIKKIFNQFLAACGSLWRDKESRFSLVGTSMFWGAGVTLRFLLVQWVPIALGMTDNTTPTILNAMVAIGIVIGAGLAAKFVTLKTVRRCMPAGVLIGLGVVYFSLQTTIIPAYFILVVIGIFGGFFVVPLNALLQDKGKHSVGAGNAIAVQNLGENTAMLLMLGLFSLVTSMGVSVITIGIGFGAIFALAIGGLWLWDCTRKRAE

SEQ ID NO: 5306 - protein, 71 aa, Proteus mirabilis
PLPEFIHENDQASPVKQAGNAVQQIKRDWRTYACIVQELRSVDAEVIAVADIERVRLVIKHPAELTALRPL

SEQ ID NO: 5307 - protein, 353 aa, Proteus mirabilis
SETDNLTSQMIRLYPEQLNAQLQEGLRQSYLLWGNEPLLLQESQDAIQTVAKSQGFTEHYQFTLDNSTDWNEIYSLCQSLSLFSQKQSILLHLPENGPNAAMSEKLLRLSHELHEDLLLILRGHKLTKAQENSEWFKTLSQQGIYVTCLTPELDKLPNWVARRAKQKGLELDEQGNQLLCYCYEGNLLALAQAIERLCLLYPDGKLTLPRVEAAVNDASHFTAYHWIDALLAGKTQRAWHILQQLKREDIEPVILLRTLQRELMQLITLHRSAKTASLKSVFDQHRIWQNRRPIFTAALQRLSEHQLLTAMRLLTQIEITLKQDHGQNVWPELHALGLLLCGKALPEGFIRHG

SEQ ID NO: 5308 - protein, 72 aa, Proteus mirabilis
MAKEDNIEMQGTVLDTLPNTMFRVELENGHVVTAHISGKMRKNYIRILTGDKVTVELTPYDLSKGRIIFRSR

SEQ ID NO: 5309 - protein, 269 aa, Proteus mirabilis
EAKEFNMNAYIDNTLKFKNIIFSNHILLLIRKDCEISITKDNVKYQIDNDSIVFIKKNSALDIILGKNKMPEFIFLSHEVMMEVLKITINNKKEEVTQDNNKDSFIKQANHEDILFFNRLKNKFNDEVITNNKTSLSQILKIAYLLLNFDIPNLILKSKPELTSVKVKDIIISDLQHSWSLKEISSKLFISESSLRKKLEAEKTNFMTLLTTVRMAHAMNLLATTNLTIGQISSLSGYKNTSYFIKKFKKYYKSSPKKLKCLNYRDKII

SEQ ID NO: 5310 - protein, 374 aa, Proteus mirabilis
MAEELQNLREQIDQVDKTLLSLLAKRMQLVAEVGEVKNRHGLPIYAPDREAAMLASRRNEAEKMGISADLIEDVLRRVMRESYSKENDKGFKTLNPQLGKIVIVGGNGKMGRLFSRLFTLSGYQVESLEADEWQSKSPAIFADAGMVIISVPIHLTVDVIEQLPPLPENCLLVDLASIKQAPLEAMLKAHNGPVLGLHPMFGPDVPSLAKQVIAYCEGRDLSHFEWLLEQLMVWGARVEAITAQEHDKNMSFIQALRHFTTFAYGQHLVKENVDLASLLRLSSPIYRLELAMIGRLFAQDPQLYADIILSSQENINLIRRYHHSLGEAIALLDINTKDEFIGSFNNVSDWFGDYASQFMKESGALLQKANDSRI

SEQ ID NO: 5311 - protein, 114 aa, Proteus mirabilis
PMEEFKWRTQIQDSPSGEFKHRIKEVEFGDGYKQVAGDGINPESQTWPFAYMGLKDEVMPIFKFIRRHTAKSFIWTPPFGEKGLYRVKADSITMLPISDGVMKLTATFEQAFSA

SEQ ID NO: 5312 - protein, 197 aa, Proteus mirabilis
GDREKMKNNIFDPEKYTISIKKILDDGEEIYVASVAELPDIQEYADSADFARDMALDSITTAYEMFKENGMAFPLPIDTTETDNVSGRVTLRLPKSLHAKCIKAAESDGVSLNTYLTTCVVHYSAQNEMMNNINTQFTEVKHWIKAQSKPNFHTYRNANKTGSYWSSSWNSKLVSDGDLSERDSEIELSTKYSECFQ

SEQ ID NO: 5313 - protein, 177 aa, Proteus mirabilis
HSGESAFMESTIYLIGPRGAGKTTVGKALSLSLDYQFIDTDNWITDKYQQTISSMVEAEGWDVFRQLESDALIQVSQPNQVISTGGGIVLAEKNRVYMKNSGVIVYLQASLETLVERLSQDPNEAQRPSLTGKTLVSEIHDVLIKREPLYMQCADIIVDAGLSINDIIEVILAKLAK

SEQ ID NO: 5314 - protein, 274 aa, Proteus mirabilis
ISMEHRNIAFIGAGNMAHAIIAGLVNGGYPAKNITVSSPSEVRREPLEKEFAIQSTCDNINAVENADVIVLAVKPQMMAEVCKPLQHIDFSQKLVLTIAAGIPASRYNDYLATSLRLIRIMPNTPALVGKGLSGMFAQNTITPEDKQFADALMKSVGMTVWVEQESAINDIIAVAGSAPAYFFLFMESMQQEAERLGFSADVARAIVQQAASGSTALAEKQNSLPFSTLREQVTSKGGTTAAALAQFYAGKLPENVALAMQAAIKRAQEMEKQF

SEQ ID NO: 5315 - protein, 347 aa, Proteus mirabilis
NMMDAQQFSQVVLDWYHKYGRKTLPWQQEKTPYHVWLSEVMLQQTQVATVIPYFERFIARFPNVSALAKAPLDEVLHLWTGLGYYARARNLHKAAQHIVDKHQGQFPDTFEDVCALPGVGRSTAGAILSLSLKKPYPILDGNVKRVLARCYAVEGWPGKKEVENKLWEISEQVTPTKGVEYFNQAMMDLGAMVCTRTKPKCELCPLNTGCIAYAHHSWADYPGKKPKKAIPEKTTYFLILQYDNLVWLDKRPPAGIWGGLFAFPQFETKMLLEQWLAEHGLENSKTEQLISFRHTFSHFHLDIVPICVKLSTFTSLMEAQQGLWYNLQTPASVGLAAPVENLLRQLA

SEQ ID NO: 5316 - protein, 194 aa, Proteus mirabilis
DAMELLMPELTIRECGEEAIRLTNELFQQSEQSFMAYLLNESDLAWCIASTRNFPPERQLPWDHAGQTFQNDNGFSFCFKFLDMQNRPAGACICEYCSDNVLNIEMIQNFQIKPSILDGNTLKFMLYTIVFFLLLTQGTGVRLMFPINENVATYYVEKHGFQDLTGDGSKEILYRSAEDLLNWFEQNNRSVDSE

SEQ ID NO: 5317 - protein, 222 aa, Proteus mirabilis
RNTEYKMNVLKIFFCTLLPLLFTSPGKAENNLNQKMIEELTQCRLESSQLIRLDCYDKIALSSTSSSNALPDVTQMGKTWRQATEHEMKRTGNSAGFLVSVPETGDYPVLMTIPAIGFQPPRPILMLSCIDNITRMQIILPTKQDAGSVMVSTDKTQFTAEWFLRENGYVLESSRGIPGIDEIKRLLNAERLTLKLSNNEKLTFNISGISQQIIPLRAACHW

SEQ ID NO: 5318 - protein, 99 aa, Proteus mirabilis
SSTDTPLGVTMRMEKLTNVTYGTAGLTAFFASLSLYEWGFVIGMAFSMVLGLATYFMTRREQRKRTQLFEKLVRHVDPQNPTETLKKLAELMVKAPKDI

SEQ ID NO: 5319 - protein, 391 aa, Proteus mirabilis
VTQESTMFDYEVLRFVWWLLIGILLIGFAVTDGFDMGVGVLLRVIAKDDTERRILINSVAPHWDGNQVWLITAGGALFAAWPMVYAAAFSGFYFGMIFVLAALFFRPVGFDYRSKLESPKWRGMWDWGIFIGSFVPPLVIGVAFGNLLQGVPLEVDSMQRVSYNGTTNALINLLSLLNPYGLLAGVISLMMIVAQGASYLQMRTTGELHERTRKATYITSLITFIAFALAGVWLIYGIDGFIITSAVDTAGPSSPLLKTVSHEAGAWMTNYNNYPILWILPALGLLSPLLAVVATKANKGAWAFLFTSLTIACVILTFGVTLFPFIMPSSTFPDVSLTIWDATSSLFTLQVMTVVAIIFVPIVLLYTIWCYWKMHGRLDKKFIEGNNHTLY

SEQ ID NO: 5320 - protein, 86 aa, Proteus mirabilis
QYKEYHVYVVHQGIHDCDHDDDGRLKEVELGRDGGDHLHDHENAYDQAAHIDDVVHHSQSLYNRHRRARIHQYLPIGYLDKILLNG

SEQ ID NO: 5321 - protein, 68 aa, Proteus mirabilis
IFKEQRMLILTRRVGETLMIGDDVTVTVLGVKGNQVRIGVNAPKEVSVHREEIYQRIQAEKTQPTDNY

SEQ ID NO: 5322 - protein, 424 aa, Proteus mirabilis
FRKECCYKHWIRRHQMSKTNNQANPWETDTQEAATENANTTQNSAQETHNNTDTDNDPWATTDSNTTDTAPWSSSAGGDTGGADADPWGTGSGTDGSDLSSGTDWLDAMPTESTPDHFNIMDPFNHTLIPLDSWVTDGIDWIVLHFRPIFQGIRVPVDLVLGGFENFLTSMPAPVAIILFSLIAWQLSGKVMGISAFISLILIGAIGAWSEAMITLALVLTSLLFCLIIGLPLGIWLAHSDRASKIVRPLLDAMQTTPAFVYLVPIVMLFGIGNVPGVVVTIIFALPPIVRLTILGIKQVPEDLIEAAQSFGANPRQMLFKVQLPLAMPTIMAGVNQTLMLALSMVVIASMIAVGGLGQMVLRGIGRLDMGLAAVGGAGIVILAIILDRLTQSLGQNSRLKGNRRWYMTGPIGLICRLFGKKAA

SEQ ID NO: 5323 - protein, 88 aa, Proteus mirabilis
RSREIFLAVIFQPQCIDVGKINILACDQVDDLALILIERWGNIDAVLQRSTRHICHSLAAVFRIVRIAVFFTRTVGCPCANIGDHADH

SEQ ID NO: 5324 - protein, 246 aa, Proteus mirabilis
TFGDHGNIHSFIYDCGLSVMHDNAVSRLRQYRVSISTRPYKARGFRVKRCTFCLLPEKQCLCDTIIHQTAKSRFCLMMYDTEVMKPSNTGKLIADVLPDTLAFLWSRTEPEKALLDAINDPHRQAYVVFPDSYASPSRKVYHQLPANSKPPLFILLDGTWTEARKMFRKSPYLDALPLFSINEASKCDYMLRQAAREEQHCTAEVAASILANVGDDLASQQLFSHFSYFRQQYLIGKPDRRQAKEE

SEQ ID NO: 5325 - protein, 399 aa, Proteus mirabilis
FLGLRRRKQRKETILMEKHDDDMPKDKIQQAKRWRLILGQYADDALGQATFNADDLKIERTLDFLYRREYQRRGLRQERGRHGSLDASQLTAVNWLNQARKLFPNSTFERMQSQAIERYQISSFLKDPNTLKAMEPTKALAKTLLSLRGRMSEETRDAVKTIIRKVVEDILRQIRNNFRQSLTGRRNRFRRSLVPNSRNFDWRATIAANLKHYDTQNRRLLIETPYFNSRMQQHFPWDVILCVDQSASMSSSIMYAAVCASILASLPAVNVSLIVFDTQVVDLSHLADDPVEVLMTVQLGGGTDIASAMQYCESLVNNPKRTVISLISDFEEGGSLTRLLDCTQRLNSQQVKLLGLAALDDEAQPVYDSTIAQKLADRGMQVAALTPEHFAQWLAEVMQ

SEQ ID NO: 5326 - protein, 67 aa, Proteus mirabilis
FNSLTNKRNMVPGLGIIQLSIKLKVRINFMHTSCQDPCLDPYTYCILIKKVHTNCSAFSPYTLNVSL

SEQ ID NO: 5327 - protein, 175 aa, Proteus mirabilis
VESLTKSLESKYRNKRYNRKRLLIMINLSMDIIDIINKGSIFNSITSNDERIRLLSYSHEEFFRNAKIYTININGFYIEICIAKLSNRSYESICLNQDVNVSDVDINISDKFRIMTQTKEQLLKQKNIPLPDYSIFIDSKIEQVELHYHNGCKLIYENKHSFPSVLINPLFIMSN

SEQ ID NO: 5328 - protein, 105 aa, Proteus mirabilis
CRSLKHCYRRQKSCHSPLSGSVLRSVSVKLLFTGGHHMPDEIDRDQEFNEQQLEEMIEQSRFRPGETSSLFHCRFCGNPIPEKRRQTLPGITTCTECQEKIERRR

SEQ ID NO: 5329 - protein, 1586 aa, Proteus mirabilis
  UNSURE (1576): Identity of amino acid at the above locations are unknown.
PYPLTIYCLFYKDRDMGNEFFAAKQGDKLMHSSIFADIVCGVVKGAVYAAIGTAAVALTIGTGGMATAAGAAIFAGAGLAAGFTIGGLIDDAADWVADGIDSLFGLSNPDGEIDTGSKNVRVKGKGAARAAGKLPSPVLLASIAADNTPPKEEKGTEIALRVLKNTAMMTTGAFSLLAGKVLGSQTNNAAPIALDPSEFPEYPSPEQGFFDSILSPVKAAKHPNAEPMPLDTITCDKWHCASAPYFLAEGSKKVQINSQPACRNGDRSTCEAKISDTQEKGIVRIGGGSVVVRDIMSGRNPFAEMFGEILGGLAVGAASTLFRRGGLKAIKQCLNSVGCTLVSEIASTAVGSMVVASVTQAFNSVRHPVHAATGAKVLNGEDDTDFIIDGVYPLVWSRIYQSRNTGENRLGRGWAMPFDVFLTIDDTGKGLENENIYYHDMSGRRLALGKIALGQKVFYQDEGFTVYRTTNNLFLVESAEGDYQLFEANPHKINTLRLMKSADRHNNALHYRYANDGELVQIHDDAYLTDIRLHYDEITQRLQSVTRHQGQEEKTLVTYTYDAQQRLVQVTNADKRVTRRFGWDDESGLMAMHQYATGVSSHYRWQRFDAFTIEDNEPEWRVVEHWLKDGKRCLEHTELTYDLAQRTLTTVETGGETTFRRWNEQQQIIEYTNALNETWWFEWDTSRLLKKAIAPDGSEWGYTYDERGNLTQWTDPEQQSTCYDWDKDFAFPTAQTLPNGAAWHWEYNEHGDIRRVIDPLGHITRLAWDDQGLCLGQVDAKGNETHYRYNARGQLIEQRDCSGYPTTLTYDDWGQLRSLTNAQNETTTYTFSEAGLLLTECLPDGTENRYDYDATGQLVGITDAGERHILLRRNRRGQVIARRDPAGHWLHFHYDTFGRMQALENEQGEQYRFEYDALHRLTDEHDLIGQQKHYQYDVMGNVTQIKTTPGPSIDTPIPLSPQVTTFGYDKVGRLLFRENADYRTEYLYQPLSVTLRRVPMAVWHEAERTGTTARVEYQDALTFTYDKVGQLVREASARGDYQHHYDVLGNITRTELPHQRAFEYLYYGSGHLQQTQWRDNEQLTVLAEYQRDRLHRETLRTSGALDNETGYDCRGRITHQVARQMNASQFVTPVIDRRYRWDKRNQLIERSVSYGQTGEVFTAGHWYYHSYQYDPLGQLTAHLGSVQTEHFLYDAAANLLTRPHTEAPHNQVQGSDKFDYRYDGFGRMVSRYEKGSSSGQRYHYDSDHRIIAVDIDQGPLGYQRAEYRYDILGRRIEKRLWKASAIANTVTYHQHEPDEVYTFGWVGMRLVSEHSSAAPHTTVYHAYNDQSYTPLARIECTDNPLNPQRAIYYTHSSLSGLPEALTNSEGEIVWQGQYSAWGHLQRQTRPTSTFNREQNLRFQGQYFDKETGLHYNTFRYYAPDLGRFTQQDPIGLAGGINLYAYAPNPLTWVDPWGWSCGSDAKILRENMIERGIITPNYKNSAHHIIMSNAKDVRMRWLRRKMNRLGIDINDAINGVYLPTSSKIKIDVGTSTIAHSKIHTALYKQNVFDRLKNIKDATEFRQELNKIAEEILXGTFSYYFFYK

SEQ ID NO: 5330 - protein, 336 aa, Proteus mirabilis
GMGLKEDTITINSEDDVFRLVAQYAEGHEIPENVTFEGWPNLTFRLTGNKFNKSITPSVMKGFIDMQAHINKAYAAFKYGDQNKRLSKKELESIELVITIDEGSSIIEINIGGFLESLKKSVIKKMTGKQIAITVISAAFIWGASSSYKYYLDTMREIKLAEISKEGEKQTLESIRFMSEQETKRMELVTGVIESIPQLKQQNEIATESKGNLLKNLNKADTIEFDGVVLDAELTKELTSTKRKTYAERRIDGIYKVVKVEPGDPAPFKVTVKNVTTGELVSCVVQDVFLDEKENKEIIQQGEWDREPIKLTINAKVLGDEIKSAIIIKAEKLPQE

SEQ ID NO: 5331 - protein, 97 aa, Proteus mirabilis
MYKLSKLAEEDIYQIARYTIQQFGVTQAKKYHNDLKQTFELLAKAPWIGRECNWVCNGMRRFEFKKHSIYYLPKNDTLFITRLIHHSIDVDFVDFPK

SEQ ID NO: 5332 - protein, 239 aa, Proteus mirabilis
IMKLEFSIYRYNPDVDNAPRMQDYTLEVPEGRDMMLLDALIQLKEKDPTLSFRRSCREGVCGSDGVNMNGKNGLACITPISSLQKGSKKIVIRPLPGLPVIRDLIVDMTQFYTQYEKIRPYVINDDKNPPARENLQSPEQREKLDGLYECILCACCSTSCPSFWWNPDKFIGPAGLLAAYRFLIDSRDTETESRLDDLSDAFSVFRCHGIMNCVSVCPKGLNPTKAIGHIKSMLLKHSA

SEQ ID NO: 5333 - protein, 184 aa, Proteus mirabilis
LSKLTRCLKMESSFTPTEELLNTRATQQKSLNKDIPYQEILLTRLSMHVQSKLLESRNNMLKSQGINETLFMALMILDTTENRSIQPSELSAALGSSRTNATRIADELEKQGWIERRESHNDRRCLHLHLTDAGEEFLNSLLPPQHECLKKIWSVLDEGEQKQLETLMRKLLLQLDTLADNQQE

SEQ ID NO: 5334 - protein, 915 aa, Proteus mirabilis
YFTWLGRIMIQIDLSTLVNRLHPIAKHALESAAAYCVSHQQPEITIAQFLQKLIETPLTDIRMISQKSALDINALSELLDIDIPPHQVITQSYPSFSPLLVEWMKDSWLLASTELNHSELRSGALFLTLLQMPLRYLAKPVADMLAQINRDQLKLNFDQWTEGSAESPFNEKTVSEKGNLAADSLLAKFTHNMTEQARNGELDPVLCRDNEIDLMIDILCRRRKNNPVVVGEPGVGKSALIEGLALRIIAGDIPDKLRGCELLTLDLGALQAGAAVKGEFEKRFKGIMQEVTQSPHPIILFIDEAHTLIGAGNQQGGLDVSNLLKPALARGELRTIAATTWSEYKKYFEKDAALARRFQLVQVKEPSSAEAIIIMRGLRSIYEKSHHVFIDDEALRASAELSERYISGRQLPDKAIDVLDTACARAAINLSSPPKALSSLKTELHQINMEMDVLQREHYLGLDDHSERLETLASQASAIEQQATDLQQAWEQQKELVSQIITLRATLLNNATEATNDDVANDVANNEVVSDIRTYSEAEDAEDNAEDNDEKIATQPPCSSEELKQQLQQLDKQLAQLHDTHLLVSPHVDKKQIAAVIAEWTGVPLNRLSQDALSIVTELPTYLEESIKGQSLAIQCLHKHLLTARADLRRPGRPLGAFLLAGPSGVGKTETVIQIAQLMFGGTQYLTTINMSEFQEKHTVSRLIGSPPGYVGYGEGGILTEAIRKRPYSVVLLDEVEKAHPDVLNLFYQAFDKGEIADGEGRVIDCKNIAFFLTSNLGDHVITAYADKPDELEDALYPELTTFFKPALLARMEVIPYLPLPAEVLRQIVDGKLARLINLLKQRFNAEINVEESVATEILRRASRAENGARILESIIDGALLPPLSLLLLQYSARNEAISHIRLATENDEFIAEVN

SEQ ID NO: 5335 - protein, 67 aa, Proteus mirabilis
ETELTSCASIWSRVMTLIDCGVLSISLSILFVDSVFVATKPEIGPCGSCEGDAVTMILSGEFCVIAA

SEQ ID NO: 5336 - protein, 353 aa, Proteus mirabilis
RAYCMIISKQQLHQLIKNKLHNAGLNENHADIVADVLVHADMKGIHSHGAVRVEYYAERISKGGTNTHPKFTYQETGPCSAIFDGDNGAGHVAAKQAMEHAINMAQEKGIAVVGVRRIGHSGALSYFVEQASASGMIGISLCQSDPMVVPFGGSEVYYGTNPIAFSAPSADDKPITFDMATTVQAWGKILDARAKHSDIPDTWAVDEAGKPTCDPFAVKGLLPIAGPKGYGLMMMVDVLSGILLGLPFGKHVSSMYHDLTQGRELGQLHIVINPAFFTDADLFKKHISQVMAELKSIKPAIGFERVLYPGENSQLAAQRSEKEGIEIVDEIYHYLNSDVLFNQSYDNKNPFAS

SEQ ID NO: 5337 - protein, 465 aa, Proteus mirabilis
RFNCIIFYFYSDAFFKGLMMDFIIQLAIILVCLFYGARKGGIALGLLGGVGLVILVFIFNLPPGKPPVDVMLVIIAVVSASATLQASGGLDVMLQIAEKLLRKNPKYISIVAPLVTCTLTILCGTGHVVYTILPIIYDVSIKNNIRPERPMAASTIGSQMGIIASPVSVAVVTLVAMLGNVTFNGKHLEFLDLLAITIPSTFIGILAIGIFSWFRGKELDKDQRFQDFISIPENHDYVYGDTATLLDKKLPMKNWVAMWIFLGAIAVVAVLGAFSELRPVFNNKPLSMVLVIQMFMLLAGASIIIICKTNPSLISKNEVFRSGMIAIVAVYGIAWMAETMFSAHMKEIEAALGQLVREYPWAYAVVLLLVSKFVNSQAAALAAIVPLALGIGIDPAYIVASAPACYGYYILPTYPSDLAAIQFDRSGTTRIGRFVINHSFILPGLIGVTVSCIFGWVFAAMYGFL

SEQ ID NO: 5338 - protein, 73 aa, Proteus mirabilis
LSNWVIFYHIALFFCEVFVTLFFPIYFREFLDPPYIFIFFGNFILSKKVVLTFLVFFYVKDVNCYYLSFAFLV

SEQ ID NO: 5339 - protein, 229 aa, Proteus mirabilis
FICWSVILPFTITLQMKIFTVQDKTIIIRQLGMKPYLPVSDSMHQFTEKRESHTPDEIWLVQHEQVFTQGQAGKAEHLLNTGSIPVIQSDRGGQVTYHGPGQQVMYVLLDLKRNHIGVRQLVTVLENTVINTLAEFNVDAYARADAPGVYVNGDKICSLGLRIRKGCSFHGLALNVDMDLSPFTRINPCGYPDLKMTQLVDLAPNATSEQVASLLINHFCTQLGFQPQQ

SEQ ID NO: 5340 - protein, 316 aa, Proteus mirabilis
IHCCINRANNMDKIKASEVFVTIVKQGSMIKAADYLGMSRAMVTRYLNEMEEWAGVRLLHRTTRKQSLTSVGELVYQQSLQLLEMAERIPANIPKESHQISGLVRITTAQSLANCALSVAITEFIQLYPLIAVDLQISNQTVNLIEERIDIALRITNHLEPNLIARPLAKCFSVVCAHKDYLAKHGIPNTPDDLTYHQCLTYRFFGSSLWEFSLGDERYSVPVGGNLSANESVVLLQATLQGAGVSLQPYCSAKPYLERGELEILLADYQPQPMGIYAVLASRQNMPAAVRVLLDFLVDWFASSPHWLSLSGERVS

SEQ ID NO: 5341 - protein, 300 aa, Proteus mirabilis
TSCCSSGGKIMSILIDKNTKVICQGFTGSQGTFHSEQAIAYGTQMVGGVTPGKGGTTHLGLPVFNTVREAVEATGATATVIYVPAPFCKDSILEAIDAGIKLIITITEGIPTLDMLTVKVKLDEAGVRMIGPNCPGVITPGECKIGIMPGHIHLPGKVGIVSRSGTLTYEAVKQTTDVGLGQSTCVGIGGDPIPGSNFIDILKLFQEDPQTEAIVMIGEIGGTAEEEAAAYIKDHVTKPVVGYIAGVTAPKGKRMGHAGAIIAGGKGTADEKFAALEAAGVKTVRSLADIGDAVKSLLNK

SEQ ID NO: 5342 - protein, 141 aa, Proteus mirabilis
NIGCWSSFCGNFNDYYRYFINIGGGISMVSNSSTLGRTGIQDWLFLRATAIIIFLYVLYFVGFVATTDITYEVWRGFFSSSLTKVFTLLTLLSILIHAWIGMWQVLTDYIKPIALRLTLQLIIVVALLVYLIYGTIVVWGV

SEQ ID NO: 5343 - protein, 154 aa, Proteus mirabilis
WRGCLVTDDICLHKSNLNSIFKVLSEIVTTGKRYRIKITEWRDLRTIPMNKTWRMWMETTGEWLRARGVVIDIKNGVGEIVLSKPITNEETHEYFVGHWLGRNENGEREKTSKMDKARMLYMMEKHEQWCIEKGIPIIIPRNSEYMSLKRKQEE

SEQ ID NO: 5344 - protein, 200 aa, Proteus mirabilis
SLFWSKNPMYQDLIRGELTEAADTLSRFLQDDANIEAIQKAAVLLADSFKAGGKVLSCGNGGSHCDAMHFAEELTGRYRENRPGYPAIAISDVSHISCVSNDFGYEYVFSRYVEAVGKEGDVLLGISTSGNSGNIIKAISAAREKGMKVITLTGKDGGKMAGSADIEIRVPHFGYADRIQEIHIKVIHILIQLIEKEMEK

SEQ ID NO: 5345 - protein, 72 aa, Proteus mirabilis
PLLCLKIKLTQSIWVSFFVIGTLLLFTSLHFFFIALRQQKSLQYSFYSFCEKKSLLLINKIKKTAIEQFCDK

SEQ ID NO: 5346 - protein, 92 aa, Proteus mirabilis
KVECMCIEDKNYTKNKRSLSIMTLQLRMGRVKWFDNNKGYGLIVAKDLEQDIYVNKKAIANTKNKALTEGQDVEFSVIKTAAGLEAADVIGF

SEQ ID NO: 5347 - protein, 350 aa, Proteus mirabilis
TGECIVSTLKRWTLKEARALFDMPFLDLVFQAQQVHRQHFDPSQIQVSTLLSIKTGACPEDCKYCAQSARYKTGLEKERLMEVQQVIESAKKAKAAGSTRFCMGAAWRNPHERDMPYLEQMVKEVKALGMETCMTLGKLDDSQASRLAQAGLDFYNHNLDTSPEFYGSIITTRTYQDRLDTLDKVRNAGIKVCSGGILGLGEEVKDRAAMLVQLANLPQPPESVPINMLAKIKGTPLADNEDVDPFDFIRTIAVARIMMPRSYVRLSAGREQMSEQTQAFCFMAGANSIFYGCKLLTTTNPTEDKDHQLFRKLGLNPERLSVSMGDQQQEDVLLQAVAEKDTEQFYNAAL

SEQ ID NO: 5348 - protein, 116 aa, Proteus mirabilis
TMECANTRKQFNQFISNHLIASALQALRNKTQSAVARKLGVHDSTILRRTEKYPEICETLVASGIIDFVMEGERKISEEEYRFLWKQMGELSQMKIKENASIAATNEACCSMEFTI

SEQ ID NO: 5349 - protein, 424 aa, Proteus mirabilis
  UNSURE (21): Identity of amino acid at the above locations are unknown.
DWECEMNELNKKHLMSSSHTXEVLSNKDLALLNDLHAALQNEKHHKSFMMITILLIFMVIFVIWAWNSNLEEVTRGQGSIIPSSREQIIQTLDAGILKSMQVKEGDIVEKGQVLLTLDDTRTSAILRESEAKVANLEAIRARLKAEAYSTELSFPEGLSTELVTRETTVYKIRKDALKSGIDNLQQSKALLDREISITKPIVAQGAMSAVELLRMERQSADIQLQIDEKKNKYLTEAGAELVKTEAELAQARENMAGRADPVERALIRAPLRGIVKNIRINTVGGVISAGQDIMEIVPLEDQLLVEAYISPRDVAYVRAGMPALVKLTAYDYAIYGGLEGVVTLVSPDTLHDQKRPSDLKLNQDEAFYRVLVTTQSSHLTDKNGKELPVIPGMIASVDIKTGEKTVFQYLIKPITRMKQALQER

SEQ ID NO: 5350 - protein, 92 aa, Proteus mirabilis
TIGCSNSFLKTTVLAPLDTLYPFVVTPEYIINSPLLIISIAFLLVVINNFSCSTIGFIAVIFNFPEVIKDFELLANMLEKALALSSELANTL

SEQ ID NO: 5351 - protein, 99 aa, Proteus mirabilis
SRLWTANHHFCFTIANAKRLRLFSILKVNLMSKLKGNVKWFNETKGFGFITPEDGSKDVFVHFSAIVSEGFKTLAEGQKVEFEVTDGAKGPSAANVVAI

SEQ ID NO: 5352 - protein, 514 aa, Proteus mirabilis
VMMCRILMNNFSLLNRQWVRTLLAVFFGASGTLAFSPFDFWPAALISLSGLLLIITQRTTRQGAWLGFAWGFGLFGSGVNWVYVSIADFGGMPFAINIFLVILLALYLSLYTALFAGLLNKFFPKPTVWRFVFAAPAVWQLTEFLRGWVLSGFPWLQFGYSQIDGPLKGIAPIFGVTMITFLLTIISGLIAVAIYRKSLYSAVIGAILLLLPISFKSYQWYQPLTDETQEIALVQGNIAQSLKWQPGTLESTLNTYLTLSRPFIGKANLIIWPESAIPDVEIQQQGFLAKLDKQLRAQDTHLMTGIIDARPTLEGYRFYNSVITLGEHYAYQYPATDRYNKHHLVPFGEYVPLESLLRPLAPFFNLPMSSLSQGEYIQPQLTVNDAKITAAICYEIILGEQVRANFKPDTRFLLTISNDAWFGNSIGPWQHFQMARMRSLELGRPLLRSTNNGITAFIAANGDVIAQLPQFEAGALAEKMTPTTGSTPYYKMGSYPVWILAGVFLILAFIKRRS

SEQ ID NO: 5353 - protein, 237 aa, Proteus mirabilis
SRWCDYEWYATSSLIWTTEQTGSLQRLLAGSDGKNSAEERVCMSLKTIRLYGVLGAKFGREHKLDIDSPSEAIKALSVLYDGFEQFLANAHLKGLEFAVFKGKRNIAEDELHLDTKEEIRIAPIIKGSKRGGFFQTMLGIAMIGVATFAPWGAALWASDLIGTIGLGVALGGVYQMLSPQPRGLSMRQDSDNKPSYAFGGAVNSTAQGNPVPLLYGLDRREVGGAIISAGIYTEDQQ

SEQ ID NO: 5354 - protein, 150 aa, Proteus mirabilis
LTRCFLLLNAMIVIEDLKVSNMSKSAKGTTERPGRNVKAKSGLNRAILEQGWYEMRRQLEYKQLWRGGQVVAIPPAYTSQKCACCGHTAKENRQSQSQFECLECGYTANADINGARNILAAGHAVLACGGRGQSDRPSKQEPAEVIQTSV

SEQ ID NO: 5355 - protein, 444 aa, Proteus mirabilis
ILRWVNRVQTNDKKQKDHCCYKSICYELSANRRIIMAIGGVYITQTLISMIIMQSVPTLLRSEGFSLSLIGLTSLFMLPWTLKFLWSPFIERLRLPFGKKFRRSRNLILIGQSLVALLVFLLILINPNDNISKLNNLWIFGIFILCAFLTSTIDIACDGMAVEQIKASNRGWGNIAQVGGGEIGALLGTSGFLLISSYFSLNTAFAISALTIILLTIPTLYFKESDRLTTSETYHIPKLSYAFNRKEVRIGILLVVLLEGGNRITDMITGPLLIDINITLNNIALLIGSFNFCASLFGTLLGGILIKVFGIWKSIFITYGLQGLIFAFISMAIGIKYIPHEILFLLIGFKYILFSAGLVSFYTGLMSLSSLKQAGIDFTIFQCTNAFTAIIATLLGTWTAENWSYHFVFAISSIYTFIAVLISIKLIKKRLKLNISSNNFEQYV

SEQ ID NO: 5356 - protein, 77 aa, Proteus mirabilis
RILLGGHSAVVPPDPMPNSEVKRRSADGSVGSPHVRVGNCQALNKTRKPTQWVGFFAFDIFYSQFYPLTKEKSYFNC

SEQ ID NO: 5357 - protein, 868 aa, Proteus mirabilis
ILNRILLGGVMRLDKLTNKFQQALADAQSLALGNDNQFIEPIHLLSALFNQQGGSIRPLLTSTGVNASQFNERINDALSRLPKVEGAGGEVHPSNDLIKHLNLCDKLAQKKDDEFISSELFLLAAMESGGQVADMLKAAGANKASLELAIEKIRGGETVNDQNAEDQRQALKKYTVDLTERAEQGKLDPVIGRDEEIRRTIQVLQRRTKNNPVLIGEPGVGKTAIVEGLAQRIVNGEVPEGLKNKRVLSLDMGSLLAGAKYRGEFEERLKAVLNDLSKQEGSVILFIDELHTMVGAGKADGAMDAGNMLKPALARGELHCVGATTLDEYRQYIEKDAALERRFQKVYVAEPTVEDTIAILRGLKERYELHHHVQITDPAIVAAATLSHRYISDRMLPDKAIDLIDEAGASLRMQMDSKPEALDRLDRRIIQLKLEQQALQKESDDASKKRLAMLNEELAEKEKEYSSLEEEWKAEKAELTGTQHIKAELEQARIALEQARRSGDLAKMSEIQYGQIPTLEKQLAEANKTEDKHMKLLRNKVTDAEIAEILARWTGIPVSRMLEGEREKLLRMEQELHRRVIGQDEAVNAVSNAIRRSRAGLSDPNRPIGSFLFLGPTGVGKTELCKALADFLFDSDDAMVRIDMSEFMEKHSVSRLVGAPPGYVGYEEGGYLTEAVRRRPYSVILLDEVEKAHPDVFNILLQVLDDGRLTDGQGRTVDFRNTVVIMTSNLGSDLIQERFGTLDYPAMKTIVMDVVGHHFRPEFINRIDEVVVFHPLGKENIAAIAQIQLRRLYQRLEERGYHVTITGAALEKLGEVGFDPIYGARPLKRAIQQEVENPLAQDILSGKLVPGKEIILDLDDNQIIAKQS

SEQ ID NO: 5358 - protein, 219 aa, Proteus mirabilis
LCLLLTTSGEVVLVYPYSEKSAIIHLPLQNKRLSTMPNWIEAVIAYLKQNTSLRFNMFWLLSWFALLIFTPIGYIEFINSKLLQWDNPYIVSSLFFVPVSYFISYFVKLFIKLCIYLNRALTQVRLNKKKKNNINNVTDKEASIIAIFAEIGLDSELSFDSMNEKGVIELFNKGIIEPIKGDYINEPKCRYRITRNYLKDIEYALVNNTKIRKAYEEVR

SEQ ID NO: 5359 - protein, 453 aa, Proteus mirabilis
ISMLRQPESKTMSTSKNKMSVLQLTILTAVNMMGSGIIMLPTKLAEVGTISILSWIVTAVGSMALAYAFAKCGMFSRRSGGMGGYAEYAFGKSGNFMANYTYGISLLIANVAIAISAVGYGAELMDATMTPLGICIATIVVLWICTIANFGGARITGQISSITVWGVIIPVVGISIIGWWWFNLEQYINSWNPHNFPFFEAVGSSIAMTLWAFLGMESACANSEAVENPEKNVPIAVLGGTLGAAVIYIVSTNVIAGIVPNMDLANSTAPFGLAFSQMFTPSVGKIIMALMIMSCCGSLLGWQFTIAQVFKASSDSGYFPKIFSAVSKADAPVKGMLVIVVIQSALSLMTISPSLNKQFNVLVNLAVVTNIIPYILSMAAMIILQKVAKVEPHKARTSNIIAFIGAIYSFYALYSSGEDAVMWGALATFLGWTLYGFVSPRFEMKQNQDLMTK

SEQ ID NO: 5360 - protein, 67 aa, Proteus mirabilis
CKVRRAPALVRRHYAVLATVSSSYPPLSGRSPYITHPSAARQQESKLSPVTARLACVRPAASVQSEP

SEQ ID NO: 5361 - protein, 103 aa, Proteus mirabilis
TDCRRGKVTLSADKTSAIADSTDTVTITLNYTKGSSPVEGATVNWSTTGGKLSVTSSKTGKAGGATVKLTSDSQGEFIVTATVDGVAQNTDAITFTEKTSPDE

SEQ ID NO: 5362 - protein, 219 aa, Proteus mirabilis
METRKMTKGLIFDLDGVIVDTANYHYIAWKKLSNEIGIDFDKEFNHLLKGISRIESLELILSHGNKSDVYSADEKKSFTETKNKYYLELLNNITPKDILPGVLDLIEQANNNHIPCAIASASENAPTILEKLGIKHYFKAIVDPKTLKKGKPDPEIFLRAAEFIHIPPHLCIGFEDSIAGIQSIKQAGMYAIGVTADGPLPEADLAVHSLTEIDIHSLF

SEQ ID NO: 5363 - protein, 102 aa, Proteus mirabilis
TAQRLRYDHLSEAHLEYSGLFYQDLYPDVFYYQSSLYSLSLFLLLYFPIPIPVHLQHHIETSVSNGQSKLPIYFYLMPDKTIILSKFLSIHLAKALSYTLSV

SEQ ID NO: 5364 - protein, 90 aa, Proteus mirabilis
MKKRTNRVYTLEFKQEAVALVSKQGYSVSKAAASLGITDKLLYNWKAKFDAEQSGSSLNSDERAELLRFRKENKELRMEKEILKKAAPSS

SEQ ID NO: 5365 - protein, 82 aa, Proteus mirabilis
SMKRITLSEWNNKYFAKPRSPRQLSRYIKEGRLYPAPEKVGREYELEPWTILTNDKMVREPQYLMEKINGQKQKCKEQGATA

SEQ ID NO: 5366 - protein, 274 aa, Proteus mirabilis
KMKRITIVGLGWLGLPLANALREAGYQVKGTKTTEDGVEAARMSGVDCCLMNLTPAIECDRDDFDYLMETDVLIITLPPSAAGGGYDYVEGIQTLVDSAMSRHVTRVIYISSTSVYGNQSGVITEEVDIRPETQSAKMIAEVENWLHRLPLTTVDILRLAGLVGPGRHAGRFLSGKKQVKGAHQSVNLVHLDDVIFAIEQLLAQNEGGRLYNLCAPIHPKKKDFYSRVAAQLDLTPPEFALEDKPPAREIDGQEICRDLGFHYHYPDPDKMPMS

SEQ ID NO: 5367 - protein, 1485 aa, Proteus mirabilis
MIERGKFRSLTLINWNGFFARTFDLDELVTTLSGGNGAGKSTTMAAFITAMIPDLTLLHFRNTTEAGSTSGSRDKGLYGKLRPGVCYAVLDVINSRHLRAVVGVRLQQVAGRDKKVDIKPFMIQGLPIAENPTEILTQAVDGRQARVLPLNELKEKVEAIEGVVFRQFNSITDFHSVLFDLGVIPKRLRSASDRAKFYRLIEASLYGGISSAITRSLRDYLLPENSGVRKAFQDMEGALRENRMTLEAIRVTQSDRDLFKHLVTEATSYVAADYMRHANERRVHLDQALSLRKELWDQRKAINNEAYRFIEMGKELEEQQALSADLETDYQAASDRLNLVQNAVRQQEKIDRYVADVEEITFRLEEQSEVVEEATSKKEELEARVGSAEEEVDELKSQLADYQQALDVQQTRAIQYRQAVQALERAKAQCGIDDLDETNAELWAERIQAKIQSITHSLLSMEQKLGVSDAAKTQFDQAYKLITSIVGEVERQNAWSVAKSALREWSSHRHQADRVHPIRMQLAELEQRLQQRNNAERQLAEFNKQYGKNVEPDDLFTLQEELEAKIEELSDYVSDSGEQRMQMRQELDQLKQQIEKLRKQAPVWFAAQDALTQLCEQTHQSFETSNQVTEYMQQLLEKEREATVLRDETAARKQQIEAQIERLSQPSGAEDGRLITLAERFNGVLLSEIYDDITLDDAPYFSALYGPARHAIVVQDLSAIEEQLASLEDCPEDLYFIEGDPQSFDDSVFNAQEMEKAVLIKSSDRQWRYSRYPEIPLFGRAARENQLEILSRQRDELSELYATQAFDVQKIQRAHHAFSQFVGQHISVAFDADPEEDIRQLNQRRNELERELSQYEEGTQQQRQHYAQAKESLNLLNKLIPQVNLLLDETLIDRVEELREELYNAEESMRYLQRHEKALTALEPIASILQSDPQEHDQLTQDYQYAKEEQQRYQQQAFLLVEVVQRRPHFSYSDAVEIVSENNDLNEKLRRRLEMAETERATARELYRQQQAQCDQFNQVLASLKSSFDTKSELLRELEQEMKETGLQIDAGAEARAKELRDQRYAAVSANRTRISQLERDIALSEAERENMAKKIRKLERDYGQMREHVVSAKASWCAVMRLVKENGMERRLHRRDFAYLSADELRSMSDKALGALRQAVADNEYLRDALRRSEDAKYPDRKVQFFIAVYQHLRERIRQDIIKTDDPVDAIEQMEIELARLTEELTSREQKLAISSRSVANIIRKTIQREQNRIRMLNQGLQAVSFGQVRGVRLNVNIRESHQILLDVLSEEEDSQYQDLFKNQNLTFSEAMAKLYQRLNPQADFGQRMPQTVGEELLDYRNYLEMEVEVNRGPEGWLKAESGALSTGEAIGTGMSILVMVVQSWEEESRRLRGKDISPCRLLFLDEAARLDAKSIATLFELCERLDMQLIIAAPENISPEKGTTYKLVRKVFNGSEHVHVVGLKGFGQQSEKDNILSENVADS

SEQ ID NO: 5368 - protein, 593 aa, Proteus mirabilis
NSPLFIKSLVIYMNDIDLSTWQTFRRLWPMIRIFKAGLFAAAGALIINAGVDAFMISLLKPLLDEGFGKASNDVLKWMPLAVIGLIVLRGISNFISSYCLSWVSGKVVMNMRRRLFSHIMGMPVSFFDQQSTGTLLSRITYDSEQVASSSSGALITVVREGAYIIGLFGLMFYYSWQLSLILIVIAPIVAVVIRMVSTRFRTISKRIQNSMGQVTTSAEQMLKGHKEVLIFNGQEVENKRFNHVSNHIRRQGMRMVVASSISDPIIQLIASFALAFVLYAASFPEIMDTLTAGTITVVFSSMVALMRPLKSLTNVNAQFQRGMAACQTLFAILDMEQEKDTGTLELKKPTGDIEFRNVTFQYITKDTPALKNLSFTIPEGKTVALVGRSGSGKSTIANLLTRFYDVNEGEILINGHDIRDYTLRSLRNQVALVSQNVHLFNETVANNIVYACEDQYTREDIEKAAKMAHAMDFIQKLDNGLDTEIGENGVLLSGGQRQRIAIARALLRDAPILILDEATSALDTESERAIQAALDELQKNRTSLVIAHRLSTIEKADEILVIEDGEIVERGAHLDLIERKGVYAQLHRMQFGK

SEQ ID NO: 5369 - protein, 432 aa, Proteus mirabilis
FYIFIKGNVHMNDENKVPVPDEAQASPAHAEDDIATLEREARAKREAELLNAQDDEEKDPVQPAVNKLKKRKRGKATAFLAIVAVALIFLAWGGNWVYRNILWQPTEEKKQDTAPQTNKTDYRQRNDLGMSTDTAEEEPEQQDNGQNSAAGTGQAAPAAPPELNKASFLIRRDGSATTQNQVKTRQQEMTLTSATTTGQQDSSAATPPGQPQNAATPSQGQSPAPVRRIPYNPDLYIPENTSIPCSLDRRFVSDRAGKLRCTVTTDIWSASGNTKLIEKGTTASLLYRAIAEEGMKHGQGRAFIIATKLRTRQPPYLDIPLVDTSAAGELGEAGVDGWIDSHFQERFGGALMVGMIPDIGAWASNSAGKKDRNTDYTENSRQAMADMARTTLENSINIPPTLYKNQGEIINLITGEDIDFSNIYTLRLKNDR

SEQ ID NO: 5370 - protein, 65 aa, Proteus mirabilis
KKQRPPAKGNQVTFKTIKQLPSQFPVQKLCKLMKISRSAYYAWLKRPAKLITAEPKLSLNRVEIA

SEQ ID NO: 5371 - protein, 65 aa, Proteus mirabilis
RSKRLQPIVGMPQTVLTGIPVSYRRQAFSLWRNTMLSGARLIEHHVCWLSHQSNQLTAGVMAQQG

SEQ ID NO: 5372 - protein, 408 aa, Proteus mirabilis
FIERSVSYGQTGEVFTAGHWYYHSYQYDPLGQLTAHLGSVQTEHFLYDAAANLLPRPHSEAPHNQVQGSDKYDYRYDGFGRMVSRYEKGSSSGQRYHYDSDHRIIAVDIDQGPLGYQRAEYCYDILGRRIEKRLWKASAIANTVTYHQHEPDEVYTFGWIGMRLVSEHSSAAPHTTVYHAYNDQSYTPLARIECTDNPLNPQRAIYYTHSSLSGLPEALTNSEGEIVWQGQYSAWGHLQRQTRPTSAFNREQNLRFQGQYFDKETGLHYNTFRYYAPDLGRFTQQDPIGLAGGINLYAYAPNPLTWVDPWGWSCGPKLKTEVDYKKAIQNLESQHGALNAHGLRRHGAGTTLEQQQYRARTGNSPDNHYTIVLDRKTLGRSAPSSTRFLSYKDQCLHHGAGRIRDWRI

SEQ ID NO: 5373 - protein, 348 aa, Proteus mirabilis
AKRRLCSATQDAIWQMIERIWSGKSWCYLLLLPFSWLYGAISLFRRFAYKQGWLSSWKSPVPVVVVGNLTAGGNGKTPVVIWLVEQLKAQGFKPAVVSRGYGGKSDQYPLLLSPETQPAVAGDEPVLIYHRTGVPVAVAPSRSDAVKALLAQYDLDIIITDDGLQHYALQRDYEIVVIDGQRRFGNGWWLPAGPMRERAHRLDSVNAVIVNGGDCQANEIAMSLEGEIAVNLKTGEKKAITELGNAVAMAGIGHPPRFFNSLQDKGVKLIATKAFNDHSEYTLQELQILTPHQEPLIMTEKDAVKCQHFAQNNWWYLPVSAVLKDLSVLNQVSQLVTTRKKLVYDLKQ

SEQ ID NO: 5374 - protein, 254 aa, Proteus mirabilis
QWISHMDVSMIPIFIMVSTMIELSSKLKNIIFWVSTASISLIVFGVFVIDIFVTDAHGKDKLSIIFSYLSTIFAFLSSLALFATIGVYWRQKKDSENSEKKRQKEISISYLNIFTKYSDELKTIVSQLVKLHKLLDENNNSFVEYIGGHDIHAFILKDVNGKELGNARMFKFDSSSLSYIYSNSASVNINISEKYQFLYKRSIKINTYIENLILKIHYDNSKENILNYFSTLRLSKSIDKIDLCVKDFEDYCES

SEQ ID NO: 5375 - protein, 288 aa, Proteus mirabilis
ESVSMKADSPFNLLSPADMAKVADDACCYKANKHIPTTYLSAFTAGMFISIAFVFYITATTGTASVPFGLAKLVGGICFSLGLMLVVVCGADLFTSTVLTIIPKATGRISWAKMFANWINVYIGNFIGALFFVALMWFAGQYAAANGLWGLNVLQTAQHKVEHTFIEAVCLGILANLMVCLAVWMSYAGRTLIDKLFALILPIGMFVASGFEHSIANMFLIPLGIVIKNFAPAEFWTTVGASPEQFSNLTVSNFLVDNLLPVTIGNIIGGAVLVGLVYWLMHLRGDKH

SEQ ID NO: 5376 - protein, 147 aa, Proteus mirabilis
WKVSHNLRSIMMKLITISAGYIDSFWAPICEGRIIPNEFIGLNLNNYESAQKLIEEYLIPKAMKFKSKSWHYYFKETLRYAINFWSNERLYNIYMGVLPEIPPPQSKYIKMKDFYLLIWTVMYPNEECVVYTPELYKEVPSVEIGSF

SEQ ID NO: 5377 - protein, 403 aa, Proteus mirabilis
KMSSVDILVPDLPESVADATVATWHKKPGDSIQRDEVLVEIETDKVVLEVPASEAGVLDSILEEEGATVGSRQLLGRIRLGDSTGIPADVKPAQDTTPAQRQSADIVAKESNDALSPTARRLVAEHDINPADVKGSGVGGRLTRQDIESHVANNKSATAATAEVSQAPLSHRSEKRVPMTRLRKRVAERLLEAKNTTAMLTTFNEINMQPIKNLRAQYGEAFEKRHGVRLGFMSFYIKAVVEALKRYPEVNASIDGTDVVYHNYFDISIAVSTPRGLVTPVLRDADAMSMADIEKNIKALAVKGRDGKLTVEDLTGGNFTITNGGVFGSLMSTPIINPPQSAILGMHAIKDRPMAVDGQVVILPMMYLALSYDHRLIDGRESVGFLVTVKEMLEDPARLLLDV

SEQ ID NO: 5378 - protein, 137 aa, Proteus mirabilis
PIIRLEIFYSKGRNMNKILRQYRHMKVPLFESGYIIYCGSWDDWRSLHEKLGIDGGDSFVNGASHTVTNTQCVLHIIGVFNGKLSTLAHECAHIAFDICYRVGVSVETGAANETFCHLISRMVDFCVKPKKADVGRL

SEQ ID NO: 5379 - protein, 98 aa, Proteus mirabilis
FVISIMENTAPQTSLSKGLILLMAVATGMVVASNYYAQPLLDSIANYFHISATIAGFIVTTAQLSYALSLMLLVPLGDIFERRSLIVIMTLIFKRAAY

SEQ ID NO: 5380 - protein, 486 aa, Proteus mirabilis
QIVSTLRLAGLYSDGSYFMSKQQIGVVGMAVMGRNLALNIESRGYTVSIYNRSSDKTNEVIAENPGKKLVPNYSIEEFVDSLEKPRRILLMVKAGEATDKTIAALTPHLDKGDILIDGGNTFFKDTIRRNRELSAQGFNFIGTGVSGGEEGALKGPSIMPGGQKEAYELVAPILEKIAAVADGEPCVTYIGADGAGHYVKMVHNGIEYGDMQLIAEAYSVLKHSLGLTNEELADTFTEWNKGELSSYLIEITADIFRKKDEEGNYLVDVILDEAANKGTGKWTSQSSLDLGVPVTLITESVFARYISSLKDQRVAASKVLSGPAPKAFTGDKKAFIENVRRALYLGKIVSYAQGFQQLKAASDEYNWDLNYGEIAKIFRAGCIIRAQFLQKITDAYNDDANIANLLLAPYFKNIADEYQQALRDVVCYGVQAGIPTPTFSAAISYYDSYRAQVLPANLIQAQRDYFGAHTYKRTDKEGVFHTEWME

SEQ ID NO: 5381 - protein, 249 aa, Proteus mirabilis
GNYRMDNYEDYYTQSAEMYDILSEPHWENRKDTFIKSLKFMGIKTGNWLNIGSGTGQELSIIAQMFPDIHIFAIEPSASMRIGLMTRIMMLPEIQHQVTVIADTFQNTILPKSFSAAIICGCIGYFNQNDRKILWNKLANGLEKKGAILVDTMPFNTPCNISKILLNSKKIGNHIYEIYLSGKPIDQEVIRWNMNFKIIEDDKVIRNFNIERDWYTFGIEQVIKEASKEGLVHENISSSTVPMTILRHK

SEQ ID NO: 5382 - protein, 292 aa, Proteus mirabilis
VLYRIFCNRKETIVDLNLQIDCFIAIYNLVYQQILSLFFDKTMTSHAKQLIIFLTIILTSLFVNAENSSKFLIKPVKKSTGEPIYIQIFKEENLLELYIEKQDGQLEKIRTYPICSYSGGLGPKKYQGDLKSPEGFYQVNQTQLNPNSRFYRAINLGFPNQYDQEQGYTGDFLMIHGACKSVGCYAMTDTVMDEIYQYAELALKNGQQSINIHIFPFKMTAENMKKFQYSANMDFWQQLAPAYQYVEEYKKIPSISVKNGRYLVNNREAISTLNLAKSIDSKWLQNSQPTIK

SEQ ID NO: 5383 - protein, 255 aa, Proteus mirabilis
PLNRITDKTFGLNFMPLAYYYVEKHYRKDLFAMASTNNNPPLIHQAIALYGGTFDPIHYGHLRPVEALSGLIGLKEVIWLPNNIPPHRPQPEASSQQRLAMVRLALQPFSAFKVDTRELEKPTPSYTIETLKAFRQEIGEKQPLAFIIGQDSLLSIDTWHKWEELLDVCHLLVCARPGYQTTFTSPQMQTWLEQHQTKQQADIHCLPAGKIFLADTPLYNISATDIRARHKAGLDCHDLLPESVENYIKQHQLYR

SEQ ID NO: 5384 - protein, 183 aa, Proteus mirabilis
RQCRKALLFLARKGYLMDAVVTIDLDQLKSWLDELQIAFYECDSCQALHLPHLQYINGIFDAKIDVLDDVLVFTAIAELKPSAIVPVMANLSQINASSLFIKTFLEISDENLPKLVLSQSLPIAVGLSFNQFELFLHKAEEQSAEVISEIFNNDFLYGERQENEEDEDLDITSSSTDSSYTVH

SEQ ID NO: 5385 - protein, 516 aa, Proteus mirabilis
TKCRMIKRGVKVIKEPLQGGKLAIMTIALALATFMQVLDSTIANVAIPTIAGNLGASNSQGTWVITSFGVANAISIPITGWLAKRIGEVRLFMWSTALFALTSWLCGISQSLEMLIFFRVLQGLVAGPLIPLSQSLLLNNYPPAKRNMALALWSVTIVVAPILGPILGGYISDNYHWGWIFFINVPFGVLIIMCISNTLAGRETKTEIKPIDTIGLVLLVVGVGALQIMLDQGKELDWFNSTEIIVLTIIAVVALSFLIVWELTDEHPVIDLSLFKSRNFTIGCLTLSLAYMIYFGTIVLLPLLLQEVFGYTATWAGLAAASVGLLPLIITPIIGKFGGKVDLRYIISFSFIMFAVCFYWRAYTFEPGMDFATVAWPQFWQGLGVACFFMPLTTMTLSGLPPEKMASASSLSNFLRTLAGAIGASLTTTIWTQRESLHHETFVEKINPLDPDAQLAFQQMRELGLSDEQTSAYLAKTITEQGLIISANEIFWLAAGIFILMLVVVWFAKPPFSPGK

SEQ ID NO: 5386 - protein, 163 aa, Proteus mirabilis
KKLSSGQAIFLYIMTEIIANIRYDSLIIFDEPETHLHPNAISQLINSIHSLADQFKSYCIIAPHSPIIVQGILSKNIFVIKNENKVLSVTHPSLETFGENLSKITDDIFGARDTPQYFRKKIEDQIKIGYSIDDIRKSIQSDGVPLSLNLSILLQNMEIKNND

SEQ ID NO: 5387 - protein, 66 aa, Proteus mirabilis
RMLRMKLVTCVILVSVIQSGCTSKPSAPKSKPLPPPAWLMQPPPDLLTPLSEIIGYSESELQSQNR

SEQ ID NO: 5388 - protein, 73 aa, Proteus mirabilis
EKLSMETGTVKWFNNAKGFGFITPAAGGEDIFAHYSSIRMEGYRTLKAGQKVNYSTIKGPKGDHADLIIPIIE

SEQ ID NO: 5389 - protein, 83 aa, Proteus mirabilis
VFIRSTKVSWLPATCSANAILASLPDWITIPRFKSITLTRSPGFKNIKDEPFKTGLPVAQALRPTITISSGDIRPSFIACPTT

SEQ ID NO: 5390 - protein, 361 aa, Proteus mirabilis
AEISLDNSVGKKTKPIRSKLSGSVILSTVLHLLIIALLIWGSLTQKWNLGGGGGSDGQVIDAIMVDPNAVVQEYNQQKAQQANVQKAEQERKARAQQQEEELRQQQIKEQERLKALEVERLQAKEAAEAQRREAATAAAKAKEEQKQAEEAAAQAKAERDRILKEQADAKAKAEAEAKKQAELAAKQKAEEAKAKAEAEAKAKAEADAKAKAEADAKAKAAAEAKAKAAAEAKAAAQQQSKAVDSLLDGLVAQGDKQSGASAAGQGGGNRSGANAAGIDRYTGQVKVAIEQKFFDSDLYKGRKCDLKISIAPDGMLVSAKAVGGDPALCQVALQAAKMATLPKPPKDIYEQVKSPTIEFKP

SEQ ID NO: 5391 - protein, 346 aa, Proteus mirabilis
KMIRKTLLASLLTVISGTVFALPNVTILATGGTIAGGGDSATSSSYTAGKLGIDTLINAVPEAKKVANLTGEQVVNIGSQDMNDQVWLKLANKINTDCDKTDGFVITHGTDTMEETAYFLDLTTACKKPVVMVGAMRPATALGADGPLNLYNAVVVASDKASENRGVLVTMNNSVISGKDVVKMNTTEVQAFQPINAGAQGYVHDGKVHYYTAATPRAEKVAFDVSKLTELPKVGIVYNYANASDLPAKAFIDNHFKGIVSAGVGNGNLYSDILNTLADGVKKGVVVVRSSRVPVGFTTQNGEVDDAKYGFIASERLNPQKARVLLQLSLTETQDPATIQENFEKY

SEQ ID NO: 5392 - protein, 712 aa, Proteus mirabilis
RYASCSFNPRTFRTVASRGNAMSWQTVYFHYDEDALTVFANAGLLRRARKDVDNEKVSVTDANTGQFSSDGQKVVLHEAGIQQASCDCSAAGCCKHILAAILWLQANNNSTDDINTDNPIETSAEKIIAPVETPPLLPSLFTLDPELLIKKAGKPACRTAINLIEQWEDKTLVLEDTGTQLKIQLPDVDEPVIFLQASGYDGMLSPFSSSQKKAFHLAIVAKIFEQNTQPWTWPEDLIPLKSSQRPLNDEEIALINTIEQFIDDLLRQGLSHISLSSATQLHLLNMSARAEGLPRLASYLRTLSTQVKRLAERHFTMDESNVLRLLAHISAYLFQLSYATPEQLKTLRGQLRRQYDDKKTSLALIPIDAHWWTAQSGALGTTFTFWDKEAKQFLQATQARPNQLDTLFNRYSVWHSLSLWKQTADKLMRRPFLLQAPRISDEGKLATIGDSFAQNQTDFLDVTDYHQLQTELGIHNWQDLPNYFTDQPEGFLSPLVLHIKSYNPLIWHEVEQCVIWEVVDNNGNSAFLRLYWEGETQNNLEELRFLTKRELEIVAITVQPVRRDFNIDLLPTTIWIKTEQGIEMFYLDFDQFPRKKKQSGFISHIQEYMAKRKRQTAMHHSEPTLAQKFCRPILSVLEAQACTGREQLSAMQKEQLERSKQIADDLGMTLIANQLTRYLALTARDSQALLQLIWLCDNLQQLQSPLPIQLNE

SEQ ID NO: 5393 - protein, 69 aa, Proteus mirabilis
FKQRIYLQGCKQEIDMTIEQLQEENAKLKQAIIDIYSNCEECEYQGYGTFYAVEQDHVNSAYELTQTTD

SEQ ID NO: 5394 - protein, 383 aa, Proteus mirabilis
MEQSSRQRIDALDALRGIAILGILLLNISGFALLRVASFNPMHSGEATFADKLTWMGLNLFTQGKFLFIFALLFGGTLYLLSQRSVAWNVSRLIILALIGIIHTLLLWEGDILFPYSICGLFVLFFIKALPIKRQFILGLVLYLFGAIILAFLFYYYRDFVEIVWYSSDYSAMIETNWKTGSYINSIYWRLDELSDFIFNLVRQYSWFLIGAMLMGAALMASGWLQRRYSQSHYGLIAVCFLVISLLFQGTLVITDYYLDWHYMWSAVVAQPITMVIQIIQSLGYIALLYWAWPYIQHSFIAYALRCVGKMALTTYLLQSIIGTTLFQRMGLFNQFTLLQLMLFVMAIWVINIIFAVTWLRYFSQGPIEWLWRHSSTGLAKRF

SEQ ID NO: 5395 - protein, 172 aa, Proteus mirabilis
FKGLCAPLFFEVSMIDPDKNSPIFNSYASVDDLKKYAEDRNITLADSGLEALLITAMDYLESQKWLGKRTNLNQPLSFPRSGLSRDGVAIPSDQIPKQLIQAQCRLAIESVENDLQPTLGAEITSERIEGAITVQYAEGTNTGAPNFPWLKGLLSGLIDVSDGFAINTFAMR

SEQ ID NO: 5396 - protein, 390 aa, Proteus mirabilis
ITKRKSIMASSTFYIPSVNKLGAGCLADAINSMKDFGFHKALIVTDSVLNQLGVVNKVSELLAKSGIASVTYDGTAPNPTVENVEAGLALLKEHQCDCVISLGGGSPHDCAKGIALVAANGGKIADYEGVDRSEHPQLPLIAINTTAGTASEMTRFCIITDTARHIKMAIVDKNVTPILSVNDSELMIGMPKGLTAATGMDALTHAVEAYVSTAANPITDACALKAVTMISESLRKVVENGGDTAARENMAYAQFLAGMAFNNASLGYVHAMAHQLGGFYNLPHGVCNAVLLPHVQAYNIQAAAGRLKDIAQAMGVDVSAMNDEQGAQACIEEIRKIAKDVGIPAGLKELGVKEEDFKTLAENALKDACAITNPVQGSESDVIEIFRQAM

SEQ ID NO: 5397 - protein, 431 aa, Proteus mirabilis
GSKRNSILEHVSTTTLIIILIGMIFASAYFSGTETSMMTINRYRLRHAAKQGNRSAKRVEKLLQRPDRLISLVLIGNNLINIVASALATIVGMRLYGDAGVAIATGVLTFVILIFAEVLPKSIAALYPERFAYPSSVLLSPLQKIMLPVVWFFNQITLVFMRIFGIKSPVIQGNAVSKEELRTIVNESKSKLSQRNQNMLISILDLEKVTIGDIMVPRNEIFGIDVNDEWKSIVRQLTHSPHGRIVLYRDTLDDVIGMLRVREAYRLMTEKKEFTKQILIKAADKIYFIPESTPLSLQLVNFQRNNEKAGIVVDEYGEIQGLVTVEDILEEIVGDFTTSMSPSLAEEVIPQKDGSLLVDGTTNIRDINKAFACHLPENEARTINGVIIEELGDLPVVGAKITIDGYEFEVLEVQDNVIKKALIRHLTPSRH

SEQ ID NO: 5398 - protein, 319 aa, Proteus mirabilis
IIKSYIYKQLIIFKAEKKMEQDNSSSLTEPEEVFTPVPLQRGASGATEWLGIGWDLVKERFFMWVGAVIIYFLVNLIISSILGFIPLIGPIISPFISAVLVAGLMMIAHQQYETGQLNLDNLFSGFQNKRYLSIMGAYGISVLIILAGFILALLISGSLLMEVAQAALNDAPTYYIQGLLADNLTPITFSSIIIIIFSLISTASYWFAPALILVNDYKAIPAVKASFMAVKNNLFGGFLFFVLLSIIIGLSIIPFGLGLFITIPLSFTAMYGSYRHIFYQKNMGNMTNNHTDNNDNNGDGGNKVSLNKTAESNIGKLVS

SEQ ID NO: 5399 - protein, 803 aa, Proteus mirabilis
IKKSYVMIIIIINMIVLLNVFLAIYLRINNHIKDTIMNFLLIKHEPHFQGMGAVSFSSHAIFLLLTTLASFNSVASQSTEKASQTQQSETVVLDPIYVSGKLNSSVEAGSTALTLKDINRIQPNNIAELVDKLPGISSSGSPRPGGQTLNIWGMGNPEDVKITLDGTPKTFEKYRQGSIFIDPELIKRLDVDKGPHNITQGNGGFGGSVRIETKDPDDLLLPDQHIGMFLKYGHHTNDRQNRYSGAIYGKLMDGTADGLFYFNRRKSDDLRRPDGTKFGYSQSDQDSFLIKTNVYLTDAQTLTLSASRSVSDGWTPWAAKRDELAKPSQYDVDKYGFDGAMKRKLVYRDQKDDTVSVKWNIQPIDSDLINFTLTYGYSNTKQNDKRPDNASSYLSSSMGNQSWVNYKNHQIEVKNESTVMQGATEHVILVGARWHRNDRNVLMFTRDKAKNPNYNYGYYAPPYMPEGTQTTTSFYLQDSISYRTLTLTPGVRYDIVKNQGVGSRAKVYQDPNPYYGHDYSDVTYRGITPHLGILWKATPNIRFFGDITHTWRAPLIDEQYEVQASISSLTGTSRHLDKETVTATRIGAIVDFENVFQQEDQLQLRSTFFDTRGKDEIFRRRGVYCESGKVTGNNGSCPPSLGNYRNLPGYHIQGMEIEAFYDSANLFGRLAYSTMKGKRDQSPRDPWFGQKTWIAEIQPDALHATLGMKIPQINMVAGWTGDFIGAQRRSPMDADPAATYWSLPKSKGYAIHGLFANWKPAFIDNTEIRFTVANLFNRDYYPYLGESVSGTGRDYRFTVVKSF

SEQ ID NO: 5400 - protein, 136 aa, Proteus mirabilis
GNESMIKKLKVIMLAAIVTRCSSPPPPVPVKWDKTAAPLNTRLPQWSDNNVIVPSPRVNGKWTSSISAQSFYDTIWTPAVFYAVAHSTQIVVTAQSGTDFFNAKNWLRQNGAKGVIEYQPVFNCLTCKETTIYFSR

SEQ ID NO: 5401 - protein, 765 aa, Proteus mirabilis
KGRSIMSDLNEKFAEAWKGFSEGEWQNNVNVRDFIQKNYTPYEGDESFLAGSTKATDTLWEQVMEGIKIENRTHAPVDFDTSVASTITSHDAGYIEKDLEQIVGLQTDAPLKRAIIPFGGIRMVESSCHAYNRELDPELKKIFTEYRKTHNQGVFDVYTPDILKCRKSGILTGLPDAYGRGRIIGDYRRVALYGIEFLRKDKFAQFTSLQEKLEKGEDLEMTIQLREEIAEQHAALGQIQEMAAKYGCDISRPAQNAKEAVQWTYFGYLAAVKSQNGAAMSFGRVSTFLDIYIQRDLDAGLLTEEQAQELIDHLVMKLRMVRFLRTPEYDELFSGDPIWATESLGGMGLDGRTLVTKNTFRFLNTLYTMGPSPEPNMTILWSEQLPINFKKYAAKVSIDTSSIQYENDDLMRPDFNSDDYAIACCVSPMVVGKQMQFFGARANLAKTLLYTINGGVDEKLKIQVGPKHAPIMDEVLDFDTVMNRMDQFMDWLATQYVTALNVIHYMHDKYSYEAALMALHDRDVYRTMACGIAGLSVAADSLSAIKYAKVSPIRDENGLAVDFNIEGEYPQFGNNDSRVDDIACDLVERFMKKIQKLHTYRNAVPTQSILTITSNVVYGKKTGNTPDGRRAGAPFGPGANPMHGRDQKGAVASLTSVAKLPFAYAKDGISYTFSIVPNALGKDDDVRKANLAGLMDGYFHHEADIEGGQHLNVNVMNREMLLEAMEDPEKYPQLTIRVSGYAVRFNSLTKEQQQDVITRTFTQTM

SEQ ID NO: 5402 - protein, 177 aa, Proteus mirabilis
NRRRFVAIHSRAGQHTRQSDLINVAQLTAQYYSLKPQANQNAHRVKFGTSGHRGSAKRHSFNEAHILAIAQAIAEVRANNGVTGPCYVGKDTHALSEPAFISVLEVLAANKVNVIIQENNGYTPTPSVSFSILTYNQGHQDIADGIVITPSHNPPEDGGIKYNPSNGGPADTDLPLG

SEQ ID NO: 5403 - protein, 683 aa, Proteus mirabilis
FNGSKILTMSHVANKLLVTCALPYANGSIHLGHILEHIQADIWVRYQRMRGKEVHFICADDAHGTPIMLKAQQLGITPEAMIEEMSKEHQQDFAGFNISYDNYHSTHSEENRQLSTKIYLALKKNGHIKSKTISQLYDEEKGMFLPDRFVKGTCPKCKAPDQYGDNCEVCGSTYSPTELINPRSVVSGSTPVMRETEHYFFDLPAFSNMLQEWIRSGALQEQVANKMQEWFDSGLQQWDITRDAPYFGFEIPDAPGKYFYVWLDAPIGYMGSFLNLCEKRGDLSFDEFWNKESKTDLYHFIGKDIVYFHSLFWPAVLEGSEYRKPTNLFVHGYVTVNGAKMSKSRGTFITARAYLDHFDADCLRYYYAAKLSSRIDDIDLNLEDFVQRVNSDIVNKVVNLASRTAGFISKRFDGKLAASLDDAKLYQHFVDMQESIAQCFENREFGKAIREIMALADEANRYIDEKAPWVVAKQEGKEAELQAICTMGINLFRVLMTYLKPILPSLTERSEAFLQTELTWNALSQPLLNHEITKFKALFNRIEMDKANAMVEASKSTIAPVKEITGPLADAPIQETIKFDDFAKIDMRIAEIKQADFVDGSDKLLKLILDLGGETRQVFSGIRSAYPDPKVLEGRLTVMVANLAPRKMRFGISEGMVMAAGPGGEDIFLLSPDSGAKPGHQVK

SEQ ID NO: 5404 - protein, 156 aa, Proteus mirabilis
VMGSNMSINLDENIIPGKSIGSISLGDNVNDIIKCIEAEYCINVIEFENFGVKYLCYKINDGAISFTVNDTGHIVSLWCEPPYKGSFNGKLYPGITARKLKEISSIQTIIKGYLVIDNNPLIYYGMPDDIDDFNCFSDLDDDVFFNELYVGDLNQS

SEQ ID NO: 5405 - protein, 229 aa, Proteus mirabilis
TVMSEQKLIAESRTFEQQMIERDKRATKAGFVVGGVGLLIAVLALVAVVVMLPLKQTDVELYTVDNHTGRVEHVTRTSKTSLTATEAYQKAMAANYVKVRERYVYPSLQDDYETVQVYNAPQVNDDYLALYAGKNAPDKVYKNGAHTVKVEILSNQITDATAPDRVATIRYKKIIRRLADNSTRNEYWDARFTFHSAPDKEMSDAEREINYFGFTVTSWQTDREIRGGE

SEQ ID NO: 5406 - protein, 295 aa, Proteus mirabilis
NAMSDDQSSSNDNPGPKKGFLTLLNQLFHGEPKNRDDLMELIRDSEQKELIDPDTRDMLEGVMDIAEQRVRDIMIPRSQIVTLKRNQTLDECLDVIIDSAHSRFPVISEDKDHIEGLLMAKDLLPFMRTGAEPFSIDKVLRSAVVVPESKRVDRLLKEFRSQRYHMAIVIDEFGGVSGLVTIEDILELIVGEIEDEYDDEDDIDIRPLSRHTYSVRALTQIEDFNEAFGTHFSDEEVDTIGGLVMQAFGHLPARGETITIDNYQFKVVMADSRKIIQVYVHIPDDAPVPELGNDV

SEQ ID NO: 5407 - protein, 410 aa, Proteus mirabilis
MLMSHNNTETQIGNIDLVKQLNSAIVYRLIDQHGPISRIQIAEQSQLAPASVTKITRQLLERGLIKEVDQQASTGGRRAISIVVEHRRFNTVSVRLGRNDATVALYDLSGKALVEQHYPLEQSTQQEVETLLINAIDDFIKQNQRRINELISISIILPGLVDPNKGIVHYMPHMKVNNWALVDNLEKHFDLPCYAGHDIRSLALAENYFGATRDCEDSILVRIHRGAGAGVIINNKILLNQRGNLGEIGHIQIDPLGERCHCGNFGCLETIASNSAIEAKVRYQLEQGYPSQHLSATQCQIQDICDAAVKNDPLAVETIKQVGLHLGKAIAIAINLFNPQKVVLAGEVTEAAEILLPSIQSCINTQVLKEFREALPVVISELDHRSAIGAFALTKRAMLNGELLQYLFDK

SEQ ID NO: 5408 - protein, 301 aa, Proteus mirabilis
QLERNMEPITRLIDRMLSFALLDPRIEAVVLTGSVGRNKKIDSYSDIDIELIGHGATELAKNQHWLSQFGKHLVSLATECEDPNGIRWPIYLHVLAQGRKMDILMAEPERIINMKQNGLSPVYQRGYRVLLDKTGLCDQLPEISTVTPPALSIEQADALAQEFWFEATQIAIAILRNEFWFAEYRMSDIREWLIRLLEQVALQTSTQDVWYQGKNLREWLPKFYSLRSLESTLAMSTPYEAAAALSIIMAFFIDASKRFGLSIEKATQAQTLISDWFIDNELLTENEYYQITTSIICHYPT

SEQ ID NO: 5409 - protein, 345 aa, Proteus mirabilis
SEERYMLKRKMMHGILMLCALVFLSACGEKQQVLEGETMGTYYSIKYVPSSDSPSQSVLQTEIDRILEEVNDQMSTYRPQSELSRFNQSREINTPFPVSPATAKVVSEAIRINKITDGALDVTVGPLVNLWGFGPEGRFTHQPSADELAKRKKWTGIDYLAVEGNTLIKKIPELYVDLSSIAKGYGVDAVAEYLISQNITNYMVDIGGEVRTQGVNGNDKPWRIAIEKPANDGTTQSVQLIIEPGDNSIATSGDYRNYFEEDGVRFSHTIDPTTGRPIKHNLASITVIVPTCMSADGLSTGLNVLGPEKGLEVANKLNIPVFMIVKTENGFEERYSKAFAPFLKK

SEQ ID NO: 5410 - protein, 261 aa, Proteus mirabilis
VIRRAKMSMLLMAKAMQLQVGSTAQKMVLLKLADNANDKGECFPSYETIARHCEISRQSAINHIKSLCKKGFVRKVTRKTDKVHTSNLYILDLEAKSLDDGSQNTVPPSQNSVLEVVKEFDHGSQTVGLGGSQKFLPRTNQSFNQSINPKKLSSDDSKPAKQISVNRQTKIPYQEIMQAFNESAGDRLPNAESLNDKRKRAISKFLKELKEPTVESAKNYFDYFMETASAWYFGENNRGWRANFDYLLRPETVLKTREGAL

SEQ ID NO: 5411 - protein, 653 aa, Proteus mirabilis
DCRRVIMSALLELNNVSRLYTNGEEDTVVLDQISLTINAGEMVAIIGASGSGKSTLMNILGCLDKPSSGEYKVAGQCVADMESDQLAALRREHFGFIFQRYHLMAHLTAEQNVEIPAIYAGKSTEQRKERARALLTRLGLAERIHYRPSQLSGGQQQRVSIARALMNGGEVILADEPTGALDSQSGKEVMAILKQLNQQGHTVIIVTHDPLIAQQADRIIEIKDGQIISDNNNHHSAPVKKVPPAIQTASYFHQVIGRFTQALNMAWRAMVVNKIRTLLTMLGIIIGIASVVTIIVIGDAAKDRVLADIKAIGANTIDIYPGKELGSDSPEDKQSLTIQDVDALKQQSYIQSVTPQIYFSSRLRRGNQDAPATVSGVNEDYFSVYALKFAQGSTFTPDMIHRQAQVVVIDENTRHRFFPNKQAVIGEQIIIRNIPSTIIGVVAEQKSTFGDNKSLRVWVPYSTLSSRIYNRSYLDNITVKVKEGYDASVAEQQILRLLTIRHGKKDIFTYNIDSFIKAAEKTTQTMQLFLTLVAVISLVVGGIGVMNIMLVSVTERTREIGIRMAVGARASDVMQQFLIESVLVCLVGGLLGISLSFAIAMFASMMLPNWHFVFQPTALISAFACSTAIGVIFGFLPARNAAKMNPIDALARE

SEQ ID NO: 5412 - protein, 147 aa, Proteus mirabilis
RKRRELMARGRSSRRGVKSEINIVPLLDVLLVLLLIFMATAPIISQSVEVDLPQATETQTVSTSDNPPVIVEVAGVGQYNIRVEQEVLELLPQEQIMAEAKRQLEKNPKAVFLIGGAKDVPYDEIIKALNMLRQAGVKSVGLMTQPL

SEQ ID NO: 5413 - protein, 69 aa, Proteus mirabilis
LDFGGNGGNQAGSQKPQQNQGWGQPQQPQAPKQASSNQTPQSEPPQDWDDPIPFAPIGLPYPRHAIYVI

SEQ ID NO: 5414 - protein, 62 aa, Proteus mirabilis
CVFFIIIFRTLKNNMKRVSIYSIFSINRHLLSDNDLGDIFCAYLVMQGYLLASNLSILKRKH

SEQ ID NO: 5415 - protein, 228 aa, Proteus mirabilis
FKFGLENRKANMDTKRVGYTVVDLSQWGRKEHFEAFQSFAQCTFSQTVQLDITSLLKTVKQNGYKFYPTFIYIISQLVNKHAEFRMAMKDGELVIWDSVNPGYTIFHEQTETFSSLWSYYHKDINQFLKTYSEDIAQYGDNLAYFPKEFIENMFFVSANPWVSFTSFNLNVANINNFFAPVFTIGKYYTQGDKVLMPLAIQVHHAVCDGFHVGRLLNEIQQYCDEGCK

SEQ ID NO: 5416 - protein, 754 aa, Proteus mirabilis
RVLGGSSLFCIVPFSLSIFAWRQIMLSKDPKSTPIDPASVLKDEAINQVKNRVQSKVNETLSTPTQKVAGMASAAASLTQSASASANRVTAHPLIHGGGFTGGQTFAENQALQAAHGALLDALGMDSLESGLVFTCTIGGLPDDTFQVTEFNLTEGLSSLFSLSISAVSALPFIDFQRHLGLASSLTVKRDGVLIRKVNGILAGAVQGNTDGVKTWYHFDIRPEMWVMTLNQDSRIFQHQSVPTILKTLLDEAHVKADCQFYREDLHPERLYTTQKRESAFDFWCRLAFEEGINFWFEEEQLFYSDEHMGMTAGIHLTYNPQADTDISDSTAMTWQYGEYLCVDETIHKDNNFVRPSYPLSHENKVEQGGQHSVFESYGRFQLDDEGRPLTQVRFEQLRNGSKVGQATTNCFALMPGKIFTLSQHPHQPMNDRWQVISVSHHGVQPLADNSGGEGTQLSNSVSFIPGTQEWRPPYRYKPTADGDEVATVVGPPGEEIYVNEYGAVKVHFHWDRRGSADHSASCWVRVAMGWSGNGYGFSAVPRIGTQVLVSYLNGDIDRPIITGCTYDGRNAPPIKFPENKTQTTFRSQTHKGEGFNELRFEDAGGKQEVFLHAQKDMNTVVQNDKGTTVGANHTETVMQNQKISVHGTQTTAIQADQKNIVFGNQHSIVDGEVLIASAKGIRLISGNSALQLNPDGTITLVCNNFDFYGHGSGRIGTGELLDLNMDGAGPGNLEMKPDTSTIAQAKDQFFPKK

SEQ ID NO: 5417 - protein, 76 aa, Proteus mirabilis
VLLGVQLPNRFLLMGALLHGHLQLSYHGFPLWQGYGLSNKEPALHQLPEYVYHHQQFLVRNSVPYRNGDRALLRFR

SEQ ID NO: 5418 - protein, 60 aa, Proteus mirabilis; identical to SEQ ID NO: 4746

SEQ ID NO: 5419 - protein, 1282 aa, Proteus mirabilis
VKPGEPSLSQEYTEDKNIRFTKISNRRRIWEALLILIGIGAIFLMISLLSFHPADPSWSQTTWNEPIQNLGGNIGAWLADILFSAFGLLAYAIPIVVVFGCWNALRHQKNREYTDFFSLALRTIGALALVLTSCALADLNFDDIYNFSSGGVIGSLFSKALLPWFNMLGATLALLSVWAIGFTLFTGWSWLTITEKIGAVILGAVAFITNRGQKDIDYDDYEEPADPIQADPEVLVDNNTQPEHQLSAQIEPDSDDILFSAPSALELARQQEMAITPQHDDITETSEVASGSATPTISATETVIAEAHESKERAEHIVDNQQPTHATTHDAEVTPPSIMATHDASPVTEPEPEHYRFEIPSAFLKQQAHSSDSMADNSVVTEEVPTTMPLTENKPIETNEASIVSQKTAADNSDHSASLFTPSATSTDSNSASLTQTAAGVASVATAAIVSHGAQVKQGLGPELPRPNPVRLPTRRELYGIRIPSQREAELRRREEALQQDHEDDLADIQEQANFEQSLRQQFLEQQRERYGEDTSATQNVEPTITMSSATSSSQSTYDEYDESDNQPFIDTHTFSAQETEEESDEYEQHLAEQFKQQLQERYGEDVLQDEDDEVLPSVTTGASETSASAQGYHPHIQHSFASQSTPVTQQTDNSTLYPNSDAFLQVSPRDDEEEEYTPTIELQENLDALGSLSPVDDLLDEEPAEPVFTPMVTPAEPVSSVSSVGQTPIEPQAQMAQHFAQQQQQQQQQQQQQQQQQQQQQQQQQQQQQSLIHPLLMRNDRPLQKPTTPMPSLDLLTSPPMDDEPVDMFELERIGKLIEARLNDYRVKAKVVGISPGPVITRFELELAPGVKAARISNLSRDLARSLSTTAVRIVEVIPGKPYVGLELPNKKRQTVYMRELLDSDAFRDSRSPLTVVLGKDIGGQPVVANLAKMPHLLVAGTTGSGKSVGVNAMIISILYKAKPEDVRFIMIDPKMLELSVYEGIPHLLTEVVTDMKDAASALRWSVAEMERRYKLMSALGVRNLAGYNEKIKEAEAMGRPIPDPLWKPSDSMAPELPMLEKEPYIVVIVDEFADLMMTAGKKVEELIARLAQKARAAGIHLVLATQRPSVDIITGLIKANIPSRIAFTVSSKIDSRTILDQGGAESLLGMGDMLYAPNGYMPERVHGAFVSDDEVHAVATDWKARGRPQYIEAITKCGEEGEGGNGGGYDDGEELDPLFDQAVEFVVEKQRVSISGVQRQFRIGYNRAARIVEQMEMQGIVSAPNHNNTRDVLSPPPAEM

SEQ ID NO: 5420 - protein, 68 aa, Proteus mirabilis
QKYGWGTRIRTWECQDQNLVPYRLAIPHPLIQLSTRILSIRKMAGVPGFEPGYARIKTWCLTAWRYPT

SEQ ID NO: 5421 - protein, 359 aa, Proteus mirabilis
SFHGTTGPARVKCTHAAPLRVRTMPRKRTVRRYEDENHITDGEKTMITSLHTQTSAPNTAAATSVSPLDPSGSSKTKFSKTRTDIYQIVTDRIITALETGVKPWVCPWQRVPGISGLPSNYATGTAYSGMNIMLLWCSASERGFSDSRWMTYKQARAEGAQVRKGEHGTTAIFYTTLEKENGTGEIDHIPMLKTFVVFNVEQIDGLSLTADTVAPQATFDPLPQAENLFRSSGANIIEKGQNAFFMPSTDEVLLPERRFFSDAASFYATGLHEIVHWSGGKSRLNREMKGRFGSENYAFEELIAELGSAFLMADLGIVGEVQHESYIASWLKALKNDKRYIFKAASAASKAHRYLMDKV

SEQ ID NO: 5422 - protein, 239 aa, Proteus mirabilis
PTLGIILLEMLSEYEWQAILLSLKVSTIAVIISLPFGILMAWLLVRVRFPGKSLLDSIIHLPLVLPPVVVGYLLLISMGRRGFIGEWLYNWFGFSFTFSWRGAALASAVVAFPLMVRAIRLALEAVDQRMEQAARTLGASPLRVFFTITLPLSMPGIIAGIVLAFARSLGEFGATITFVSNIPGETRTIPLAMYTLIETPGAEMDAARLCVIAIILALVSLMASEWLTRWGRKRLGGVC

SEQ ID NO: 5423 - protein, 469 aa, Proteus mirabilis
CTLGKMKSNLDKKRMINMSTKNRVIWREGLFIKPQHFQQQQRHQDYMTVSILNNFFSHFWGFSTLKLSDDLYALGRIGIKEASGVMPDGTIFSIPNQDLLPQPIDITNITDSDSSIIYLAFPLMNENVSEISTEHNGSRLLSRYSESTENIRDLHTENGDISAIHVAQLTPILKQGKHGLDAYVALPICRIRERNANGNLTLDNDYIPSLLNIRASTLLSQFLTELEGTLYERGKQIASRIGAPGQQGVADVAEFMMLQVLNRTYPLYSHYAQEPVIHPEKLFRDLLELCGELQTFTNTSRLPENIAKYQHAKLTESYIPLIASIREALSVVLTPRAIPIPLQVQEHGIRVATIHDKQLLQRAEFIIAVKSQMPQEQLRRQFPQQTKVTTINNIRSLVSVQIPGVPLSPLSAAPRQLPYHSGYNYFHFDQQGNEWKGIQQDGNIAFHVSGNFPDLDIQLWAIRDGALYD

SEQ ID NO: 5424 - protein, 232 aa, Proteus mirabilis
KKIGNSLTDRLCYLDTHCFIENINYTTLTQDKYIHSKKWVIDTTLIGYEFVTIQHLLAHSINIPPPITGNQCINYGISVLLSRTLFQAFEKITWKERISQQIMQLPEELKSEVYNKITSNETHKSSDKEYFPIYKLPQDSCFVIRLTELQKLMNAYVNNKHTPTSTRISNPLSRLFWLSCKHNEVISPLIGKPYKLLSIFEQWASTEGITDKFSGDTLKTALERGSPTSVPY

SEQ ID NO: 5425 - protein, 273 aa, Proteus mirabilis
PTTGYRLHRNHVVPPLILIPQHAVSAGSACHLFTEVIMLSTTAFLAVAMQCAASIHPSTALDVARVESGFNPYAIAEIVPKAGPSSRDKHIISHLPASRGDAEHILRRLAAQDRRYSVGLMQITSTNFRHYGVSATELLDPCTNLSIFERILSDCYRRGGTLKRALSCYYSGNFSTGQQPETAFSGTSYIQRIGYAPGSSRYAVPGTREDKSSVSTPLKIAPAGNSSRHHLIWPGVVVRGVPAKLRQEKIFIAPFSAPSVHRSLSLSPRKEEE

SEQ ID NO: 5426 - protein, 118 aa, Proteus mirabilis
FDRGILDMTIKQLQKKIHQQNIEAGWWDIPREKGTLLCLIHSEISEAMEGERKDLMDYHLPHRKMAEVELADAVIRILDYAEEFGYDIESAITEKLEYNKHRVDHQRENRVKKGGKRF

SEQ ID NO: 5427 - protein, 144 aa, Proteus mirabilis
LFMGLLKECKDGIMRFLWPVRVYYEDTDAGGVVYHASYLKYFERARTELLREKGFYQHDLREYDHVAFVVRKLTIDYIAPARLDELLKVESEITTLRGASMTFSQKLINQDGVVLCRADVLVVCVDSLKMKPVGLPKSIIAEFK

SEQ ID NO: 5428 - protein, 63 aa, Proteus mirabilis
PTAGWSTLLFQPSNQFILFSFIHEKRFKSAGEIQSIKNAKNNNYSLTTKLVCYMVKGATEIAP

SEQ ID NO: 5429 - protein, 193 aa, Proteus mirabilis
FHQGQLMNFLNFVILTLIQLYISVLLLRVWMQCVRADFYNPFSQFVVKITQPVVRPLRRIIPSIGSIDTASVILAYVLVLLEIILPSYLSGAGGAIPFSLVLPFAFIELLTAAGKIIFWMIIIRAILSWVSQGRNPIDHLLFQLTEPLMAPIRRVIPAMGGLDFSAMIVILILYALNYLRVDVLQWLITMTLY

SEQ ID NO: 5430 - protein, 248 aa, Proteus mirabilis
LSRGCQMDVISWFSINNILVNIPLGKEGYPLSWIEAIGTIAGLLCIWLASQEKIINYLFGLINVTLFAIIFFQIQLYASLLLQIFFFAANIYGWYAWSRVNDFEQAELKIRWLKPGQQIVLIIVSIAAIIALTFNIDTVFGYLAVIAVDILNVFGANLATPAIEPDAYPFWDSTMTVLSIVAMILMTRKLVENWLIWSVINVISIVIFYKQGVYAMSIEYIILLAIAINGSRLWIKSAKHSNKNNYLS

SEQ ID NO: 5431 - protein, 359 aa, Proteus mirabilis
KIGGRMLEMNFKQTLGSLCLEVNTQLPTESITAVFGLSGAGKTSLINVIGGLTKPDSGHIVLNNHTLVDIEKKIYLPPEKRKVGYVFQDARLFPHYTVKGNLLYGMSPTMKVQFDRIIYLLGIEHLLSRFPITLSGGEKQRVAIGRALLTAPDIMLMDEPLASLDLPRKRELLPYLEKLSQDVQIPILYVSHSLDEIIRLADNVIVMDAGKIKAMGKLEDVWASSALRPWLQKETLSSVANVMVVEHHSHYAMTATAFGNQVLWLPQIEAKIGRDVRVRIDASDVSLTTTRPSNSSIRNILHMKVVEMIKHDDQVDVKLVNDGNYLWARITPWARDELNIQEGQWLYAQIKSISLSRHL

SEQ ID NO: 5432 - protein, 450 aa, Proteus mirabilis
YVFIYPFVSRNFWVRLWVIQFDNWSDPHMLTDSKIRSAKSIAKSYKLTDSQGLYLMVSACGTKLWYFRYRLNGKESRLALGPYPQTSLAEAREKRDAVRKLLASGINPSQLRKAHNNTVDESRTFQYAATTWHSSRLKLWSETHADKILTCLKRYVFPTIGAMDITQIETHHLAQLVKVIDDKGVHDVAGRVRQHLKKIMRHAVQQGVIKYNPAYDLDGIVTPVVFQHHPALLLKHLPELLEKISNYKGRKLTRLALELNLHVFLRSSELRLARWDEFNLKAHIWTVPAKRETVKGVRFSERGAKMKDEHLVPLSRQVASLFEQIKEITGESMFVFAGAHSMDKPMSENTINKALRVIGYNTKTDVCGHGFRTMACSALNESGLWSKDAIERQMSHKERNGVRAAYVYKAEHLEARIEMMQWWSDYLDTSRIEYIAPYIYARQYKSIGAA

SEQ ID NO: 5433 - protein, 283 aa, Proteus mirabilis
EYFMSGSQYKKEDASWGMLLKGRNSLKSLALAGGVALHAINVYITITTLPSIVRDIGGLNLYAWNTTVFILASILSSALTSRLLILLAPRNSYLFATLCFLVGSIICATAPSMPILLVGRFIQGAGGGMLLALAYSLVRVMFPQPLWSRAMALMSSMWGISTLLGPALGGIFAEYNIWRGAFWSILCVGIPYAILLFTILPKENSADIANKKTSLPYLQLTLLILAVLSISIGSLYHVTLYHILSFLLAIIFILLLIYIDKRSHDGLFPKGTFSFSAPLSLFI

SEQ ID NO: 5434 - protein, 2315 aa, Proteus mirabilis
RHFIRELYMNIIFFEKNSNEKVQLQPHAKHTITAKAGDVYQLIDSDTQLSPLDIQAHRKSDDLILSSKEQNIEVVIKDFWQECQPGEQQCYATLNVLDSNGVMGQATITQDGPVLEHLVAGETGTLSDNDDGIGLFLWVAGSIGSALAIFLANRNHGGDNNKGNEADITAPSKPGLTAEDDGSVSIDLPKDANKGDSVDVTFEDEDGNSNTVTLEKGDNGWTSSDPELIPDTDNNQVTIPNDKIKDNSDVTASAKDPSGNKSDDVTVTAKPDPVSDIPVLSIPEVDDGYANAEELKDGLQAEVTLPAGTVEGAEITLTVTRPDNTTETITYTVTKDDVAAGKISIDIPKDAVQNGQNSVDVSITQGNNPAKPGNKVDFAVDGQIPGDTDGDGTVDTTPVVIIPEAADGVNADELKDGVQTEVTVPGGSAAGDTLTLTITKPDGSTDTVEHTLTADEVAAGKADVTIPADKVTADGNYSVTAEITDPAGNTSGQGKPTDFMVDTQIPGDTDGDGTVDTTPAVTIPEAADGVNADELKDGVQTEVTVPGGSAAGDTLTLTITKPDGSTDTVEHTLTADEVTAGKADVTIPADKVTADGNYSVTAEITDPAGNTSGQGKPTDFMVDTQIPGDTDGDGTVDTTPVVTIPEAADGVNADELKDGVQTEVTVPGGSAAGDTLTLTITKPDGSTDTVEHTLTADEVTAGKADVTIPADKVTADGNYSVTAEITDPAGNTSGQGKPTDFAVDTVAPSAPVLKAEDDGSVSVDLPTDANKGDTVEITFEDEKGDKHTVTLEKGDNGWTSDTPALIPDSNGDKATIPADNVKDNSEVTGIAKDPSGNESDPSTVTSKTDGVADAPVLTIPEVADGYANADELKDGLQAEVTLPAGTVEGAEITLTVTRPDKTTETVTHTVTKDEAAAGKVSVDIPKDAVQNGQNSVDVSLTQGNNPAKPGNKVDFAVDGQIPGDTDGDGTVDTTPVVTIPEAADGVNADELKDGVQTQVTVPGGSAAGDTLTLTITKPDGSTDTVEHTLTADEVTAGKADVTIPADKVTADGNYSVTAEITDPAGNTSGQGKPTDFAVDTVAPSAPVLKAEDDGSVSVDLPTDANKGDTVEITFEDEKGDKHTVTLEKGDNGWTSDTPALIPDSNGDKATIPADNVKDNSEVTGIAKDPSGNESDPSTVTSKTDGVADAPVLTIPEVADGYANADELKDGLQAEVTLPAGTIEGAEITLTVTRPDKTTETVTHTVTKDEAAAGKVSVDIPKDAVQNGQNSVDVSLTQGNNPAKPGNKVDFAVDGQIPGDTDGDGTVDTTPVVTIPEATDGVNADELKDGVQTEVTVPGGSAAGDTLTLTITKPDGSTDTVEHTLTADEVTAGKADVTIPADKVTADGNYSVTAEITDPAGNTSGQGKPTDFMVDTQIPGDTDGDGVVDTTPVVTIPEATDGVNADELKDGVQTEVTVPGGSAAGDTLTLTITKPDGSTDTVEHTLTADEVTAGKADVTIPADKATPDGNYSVKAEITDPAGNTSGEGKATDFTVDTVAPSTPVLNAEDNGSVSVELPGDANKGDTVEITFEDEKGDKQTVTMEKGDNGWTSSDPNLIPDSQGNNTAIPSDNVKDNSEVTAIAKDPSGNESAPATAMSKTDVLPTVSISVDTTSVNDNGDKISADASVSGEITEVPATIEDKDDTTGLVYTVALDYVAAQDVTVTITLTNDAGHASAPDYSTLAGSQHDGKIALHGDTGKVTYDGASTVTVVIPAGSKSVSFIVDPTMEANQNAFNAEGMEKVVATITGTSNNATAVTDTVNNAGASATGVIYDGNPISLRNLDGDFTLKYSLSSSVAENGDFGYTIGVDSGKKDPKLTTDYNDTIYVGYYQDGSETSSYSNLANSQDNGPDGTKTDGNQSITTVDLGAGDDLMVIRGNMLTNTRVYAGEGNDTFTMDGMNTALRSMYAGSYLFMESGNDTVTIKRTGVTNAGQIYLGSGSDTFTQGDANDQNNTELSGLLDLGSGTQDKSNMPNEYLSVYQDGSNLSLGNDNNIDAVTDVNTVTIYGSVSGEILGGYGSDNITITKNLTGNVSVGDNTDTLTAGWIYGGATVSMGDGNDTVTVTEGAYNTTISLGAGDDVFDATAGVMGDSVSATLVNGEDGNDTIKLGTIGKNLTVDAGAGDDTVILTKDYDPSPIGNQGYINGGEGTDTLVLSGTITVNMATKTDEGIANFEKVDMTVNSELKVDNSSQTIKLTASDVLGMNANSTIYISGDANDKVDLGADGAGGLGTFTATATTTKATALDGTEHTYTLYSSASGANVYIDNNIIDNGGVI

SEQ ID NO: 5435 - protein, 367 aa, Proteus mirabilis
PIFMLHCPEGDNMAIDENKQKALAAALGQIEKQFGKGSIMRLGEDRSMNVETISTGSLSLDVALGAGGLPRGRIVEIYGPESSGKTTLTLQVIASAQREGKICAFIDAEHALDPIYAQKLGVDIDNLLCSQPDTGEQALEICDALSRSGAVDVIVVDSVAALTPKAEIEGEIGDSHVGLAARMMSQAMRKLAGNLKNSNTLLIFINQIRMKIGVMFGNPETTTGGNALKFYASVRLDIRRIGSVKNGDEVIGSETRVKVVKNKVAAPFKQAEFQIMYGEGINTYGELIDLGVKHKLVEKAGAWYSYNGEKIGQGKANATNYLKEHPEMYNELNTKLREMLLNHAGEFTSAADFAGEESDSDADDTKE

SEQ ID NO: 5436 - protein, 209 aa, Proteus mirabilis
ETFMLKVWGRKNSSNVKKVLWCLKELQAPYEQIDVGGPFGGLHEANYLALNPNASIPTLQDDDFALWESNTIIRYLCTKYENYHLYPTDVKQRANVEKWMDWSNGSLFSPIQQMMINLVRTPKEQQDPQLVQSLKAKLNQLIKIADDQLAKTAYFAGDYFSLADIAIAPLVYPWLEVCQEGANYPHLQRWFAQLSENQIFRDVVLLPVN

SEQ ID NO: 5437 - protein, 884 aa, Proteus mirabilis
SLFIYLSKAELTYSAFSPKKGINTVTLPSISLPTRIDQARLKWTSLQQQHLYFAPVRHHSPACAYAVLSLIDSVKPDYILIEGPDTFNSLIPSLTDKDTLPPIAIMGQAEYCHHDSGLEEREKSLHSAYFPFCEYSPEWQALRGGLRINATTRFIDLPWAAQVNNEEYSDLQSRSLQKERYLAHSQFIAQLAKQCHCRDHDDVWEHLFELRSIEALADWQTLFNDIFIWCALARLDYEPEVLASEGSSQREAHMLTHIKTIKQHEPNAKILIVTGGAHTLALIEGLASSQPHSFAISSSEQKHFTKMQKMGEKEQAWLIRYSFDRLDALNGYASGMPSPAFYQQAWQSLMQQHHDKLENNEAAKQPTQVYRNKMGIAFLSSVAQTIREQQFDNPPSYLTVKLAAEQSLRLALLREHTGMGRYDLLDGLQSAFIKGSLDDSQNELWDEIKTCFSGYLLGQIPLGTATPPLVNETYERAKAFRFKLDDTLAKTTKCDVYRNPQHRLRSRFLHLLAFLEIHFAHRVNGPDFLSGHQLDLLFEEWQYAWTPNVEGELISLSEKGSQLETIALNKLLAMEKQLAEQGQSRSSQSAVTLLIQAALIGLHQRIPTLFKLLDSYIQQDFRLESLTQCGHKLIHLWRGRQYLDITDELTLENRLHQVIPQAFFCLEQLAQGDEQQQESNLQALLSLRELIEFMPSLDHQYDYKSDFYQQLNRLDGQLDTVPLLKGAVDALRYLGSYIDEKTLAAVLNATFSTGSAPEHAIGYFVGIMRTAPELVIRLPLLVNHLNSLLQQWDEERFIQILPDLRFAFSQLNPKQNAELAQYIANDIGLDTQALSLWQSEFSAKQMLEATKLNQKLQQRIKTQGMISWFEAKKTEKGDHTHGEA

SEQ ID NO: 5438 - protein, 328 aa, Proteus mirabilis
KLFMSQQIRLNATVADSQLGQRLDQALAELFPDYSRSRIKEWILDNRVQVNDKIINKPKEKMLGGEKIEVDALIEEDVRWEPQNIPLNIVYEDDDILVINKPRDLVVHPGAGNPDGTVLNALLYRYPEIVNVPRAGIVHRLDKDTTGLMVVAKTVPAQTHLVEALQRREITREYEAVATGRMTAGGLVNEPISRHPTKRTHMAVHPMGKPAVTHYRVMEHFRAHTRLRLRLETGRTHQIRVHMAHIHHPLIGDQLYGGRPRPLKGASEEFRETLRRFDRQALHATMLRLYHPITGIEMEWHAPLPDDMVELIRVLKVDAEQFKDEMDW

SEQ ID NO: 5439 - protein, 896 aa, Proteus mirabilis
IQFIIKLGVDMSQRGLEALLRPKSIAVIGASDKVGRAGTTMMKNLLSGGFNGPVFPVNPTRNSVSGVFTYPSIDKLPQVPDLAIICTHHRRNLELLEQLGQSGCKAVIVLSAQSEQFQAIKTLCQQYHIRLLGPNSLGLLAPWQGLNASFSPLPVKKGKLAFISQSAAVANTILDWAYYRNIGFSYFIALGDNQDIQVDDLLDFLARDSKTSAILLHLEHIHDARRFMSASRSASRNKPILVIKSGRTQKAQLLLGDTPSYDVAYDAAFQRAGLLRVQDTHEMFSAVETLSYMTPLKGEKLMIISNGSAPAAMAVDELFLQSGKLAQLSADTQQQLQAIVQDTSAIRNPLNLGDDTTVERYIRAVNCLLDSHDHDALLLIHTPSAIAPSIETAQKVIEAINKHPRRKWLTLFTNWGGEYSSQQSRKLFSEAGIPTYRTPEGAITAFMHMVEYRRNQKQLKETPALPLEIKMNTQQAHRCIEDALDKKQYRLDTHQVQPIMEAYGFNTLPTWIAHNAQEAVSIAEKIGYPVALKLRSPDIPHKSEVQGVMLYLRDSNEVESAAHAIIERVSELYPQAKIQGLLVQSMANRAGSQELRVAIEQDPIFGPLILLGEGGVEWQIETKAAVALPPLNMALARYLVINAIKSGKLQPRSALQPLNILSLSHFLVQVSHLLLDCPQIVRLDIHPLLVSGNDFTLLDVAMELSPIEGDPHQKLSIRPYPNELEETFFLRDSKPCFIRPILPEDEPLLKTFINQVTKEDLYYRYFSEISEFTHDDLANMTQIDYDREMAFVAIRHPHDDPEIIGVARAMADPDNQQAEFAILVRSDLKGNTLGHQLMMKLINYTKAHGIKRLTAITMPENRNMISLAKKLGFSVEVQFDEGIVNLNLLLDPLSDV

SEQ ID NO: 5440 - protein, 83 aa, Proteus mirabilis
EGFMARVTSVTLGEHFNDFVGSMINSGRYGNTSEVIRDALRMMEIREERLQLVRKMVLDGVNSLESKNDMDDIFARAEKDLNV

SEQ ID NO: 5441 - protein, 235 aa, Proteus mirabilis
GILMPDTHQKKTRGELAKRQLLEAACEIFGKNGPDSATTRQIAQAAKQNIAAIAYYFGSKEGLYLAVAQYIADLIRIDFEPTVAQLDDFLEKPNPTEHLPLLQKLIIDSFLQYARLVLDKSNVHISRIMAREQLVPTEAYSLIHQQALSPLLTRVNRLLALYIGLDPTLPKTMLHTHAILGEVLSFRLVRETILRQTGWDRIGKQEYEIISNTLKVHITLLLDGLREIYTHNNHA

SEQ ID NO: 5442 - protein, 72 aa, Proteus mirabilis
RGFFSNLPCWINTLNGVLVCIVAENLYPSKTSPPGSLSIEEGLLWALNKCSNGEYDFNMYILVPSSLSCPVS

SEQ ID NO: 5443 - protein, 93 aa, Proteus mirabilis
GFIMSRTIFCTFLNKEADGLDFQLYPGELGKRIFNEISKEAWGQWMAKQTMLINEKKLNTMNPDDRKLLEQEMVRFLFEGHDVHIDGYTPPEK

SEQ ID NO: 5444 - protein, 103 aa, Proteus mirabilis
LTIILKYVLRTQKLLIRAYVLSSSPSLMLFYLLQPHSTLEKIMTSHQLLRLKQVEEKTGLKRSQIYLYMKEATFPRSIKVGPASVAWLESEIDEWINLKLANR

SEQ ID NO: 5445 - protein, 302 aa, Proteus mirabilis
GNIMLDKARLRIAMQKSGRLSDDSRALLARCGIKINLNQQRLIAYAENMPIDILRVRDDDIPGLVMDGVVDLGIIGENVLEEELLKRRAQGENPSYITLRRLDFGACRLSLAAPVDFDYQGVECLNNTRIATSYPNLLKRYLDQKGITFKSCLLNGSVEVAPRAGLADSICDLVSTGATLEANGLKEVEVIYRSKACLIQRDGEMDATKQALIDRLMTRIQGVIQARESKYIMLHAPSDCLEDVIALLPGAERPTILPLAGDQNRVAMHMVSSETLFWETMEKLKALGASSILVLPIEKMME

SEQ ID NO: 5446 - protein, 791 aa, Proteus mirabilis
KIIMKKSKLSIILFMLLSSPLYGENNEDKSKENEKSHDVITVKATSIKNKETFSSLLLNNREEIKGKQLDQIKTNTIGNTVSKVAGVQAEGFGPNAARPVIRSLSGNRVGILVNNLPINDVSFISGNMPVPVDMNRINEISISKSSEALLYGGSSSGGAIHLWDDRIMTQFPEKAISGAVTFNGSTNNGNGGSVNIKFSNKENWIFNISGATKRVSKYKIPTRSKVGACYSYQQLKDHFALRDQCQVDMKVFTVRNPEAYPYISEFWKKYQVEYELSEDEKYTFKDKDYFSGIGYVDNEPNSQYKPGSPTSIEHVTPPKHYVENNNNEIPNSFLKSQSGNASLSYIGDDGYLGFSVTDFQTSYGVPGYAYLTTKTTRERYKPVSVSNSNRRIDVQGKHDHLAPFLRDSAFYYSYSESKDEELVGQIASSVFNTKSHQLALETAHTPLFNRLNGAFGINGNYRDLKTSGYDAYLPSVLTKEYGIYWIESLDLSPFEITTGYRKGHTSHHLNIPDNYNRGRGQGANLQNRDFDTSASTLALSFTPIDEWTLKLQKNISYRAPEINELYTHGPHYAYLIEEQGNSKFNTEKSKSIELSSIIEVGDFSNKLNLYKTDYSDFKFRRLTGISRGGVTVMEWDETDLETKGLEYEFKYLYEMPHDHNLTFTLFGDFVENKSKRKLFIAGNYLPNLPNEKHGISIHYQHDELTAFSSATYYKKQKESGGLMYGGDMTFPSYTLVDAGIGKKYHLDKVDVSVDFIINNLTDTEARPASSQLKYLAPLPGRNYGVNVKIDF

SEQ ID NO: 5447 - protein, 611 aa, Proteus mirabilis
RVIIILGVFDTLYLTCRFESFLMDKTKQNELVRWLKQQSAPARRWLRLSMILGVVSGLLIIAQAWLLAILLQAFIMDGLSRDTHTTTFLILISIFILRAVVMAIRERVGYRCGMAVRQQIRKIVLDRLEALGPVWVKGKPAGSWATIILEQIEDMQDYYARYLPQMYLASIVPLLILITIFPINWAAGLILFVTAPLIPLFMALVGLGAADANRRNFLALGRLSGNFLDRLRGLDTLRLFNRGDAEVKQITDATEDFRKRTMEVLRMAFLSSGVLEFFTAVSIAVVAVYFGFSYLGELSFGDYGLGVTLFSGFLALILAPEFFQPLRDLGTYYHAKAQAVGAAGSLVEFLEAEGEQPQPTGNQTINTDQGIEIVAQQLEILSHQGAKLAGPLNFTIHPKQRIALVGQSGAGKSSLLNVLLGFLPYRGSLTVNGVELTQLSPQAWRQCISWVGQNPNLPEQTLLDNIRLSDPNASEAKINQAIEKAYVSDFINELPDGLNTIIGDNAARLSVGQAQRIAVARALLSPCHFLLLDEPAASLDSHSEQRVMQALNEASLHQTTLLITHLLEETMEYDQIWVMEKGQIIETGTYQSLSQQHGAFARLLAHRKEEL

SEQ ID NO: 5448 - protein, 91 aa, Proteus mirabilis
GKIMFNNKKKNTIIKNKSDWLTIPEAVYLANQKKTEKQLTDSDIYRHALSGNIYLSIYFQSPIILRKVTKIKNKIKLKKNRKLSHRSFMLS

SEQ ID NO: 5449 - protein, 259 aa, Proteus mirabilis
SSFFMVSSIKTDKQQIAQCFSKAASHYDHHASIQRYSGDKLMYLARHQAGDRVLDAGCGTGYFSQKWRQQGRFVIALDLSHAMLQVARQQQRANCYLQSDIEHCAITPHSIDIVFSNLAMQWCDDLAIAVNSLMSVVNPQGALYFSTLATSTLQEVRDAWQFLDNHQHVNPFLSYQQIEQACSGFQYQFVTEKVTEQYASLPELFTSLKGVGANFVQGERPKGLMTRQKLRQLEQVWRKTDSGKYLLTYELVIGKISHG

SEQ ID NO: 5450 - protein, 99 aa, Proteus mirabilis
EVVMKIKVEFPLLSNKFSGVEITGDVKRYGIGAIKISEKPILTSEITVTEIVGNNTPDEEPKLQFKYTEDYNPNETFASFMGRAEKYARTMIDRIKAAQ

SEQ ID NO: 5451 - protein, 409 aa, Proteus mirabilis
RLPIIFKAMSYGITMMRNVKNDFDAVIAGGGMIGAAVAIGLAQEGLRVAMVERQSPAPFDASSHPDIRISAISCASVSLLKQLGAWQHVLAMRSAPYLTLETWEEDNAHVIFDAKSLGLPELGYMVENRILQLALWQEAERYSNITLLCPNSLSNMKYLDNKWQVTLADGQKITTQLVVGADGANSQVRQMAGIGSNGWQYRQSCMLITVKTQLPPEKGTWQRFYPSGPRAYLPLFDNWACLVWYDSPQRIRKLQTMSMAQLEKEIEHAFPERLGKVTPIAAGSFPLTRQHASRYVDNGVILVGDAAHTINPLAGQGVNLGYRDVDCLLNLVAQAKQHFEPWHSMALLKKYQRRRMPDNMLMQAGMDLFYHAFSHQLPGLKLARNIGLLAAQHAGKAKEAALRYALGIK

SEQ ID NO: 5452 - protein, 443 aa, Proteus mirabilis
GCTMSDFTQTVPELVSWARKNDFSISLPPERLAFLMAVAVLNSERLDGEMSEGELIDAFREVCKGFDQPAESIQVRANNAINDMVKQRLFNRFTSELVEGNAIYRLTPLGIGISDYYIRQREFSSLRLSMQLSIVASELDSAASAAEEGGDAYHWHRNVFAPLKYSVAEIFDSIDLSQRIMDEQQNIVKEDIAALLNQDWQAAISNCEQLLSETSGTLRELQDTLEAAGDKLQANLLRIQEANMSSGHVDQIDTLVFELQSKLDRIISWGQQSIDLWIGYDRHVHKFIRTAIDMDKNRIFSRRLRQSVQNYFDSPWALTYANADRLFDMRDEELVLRDEEVTGELPEELEYQMFSEVNEQIAQWVEQELAAYKLEQRALDLSSVLVEYLNRYPQQKHFDVARIVIDQAVRLGVAQAELAGLPAKWAEINEYGAKVQAHVIDTY

SEQ ID NO: 5453 - protein, 681 aa, Proteus mirabilis
GVAMVRSFLIALMLMLFSLSSLAADTGWLTMPDNDHAQVRATADKSSTGDVKILLEVQLAPGWKTYWRSPGEGGVAPEINWTQSVSDMIWHWPSPSAFDVAGIHTQGYDKEVVFPIELKSVDSDNLNGVLTLSTCSNVCILTDYSLNLDLNEPAPADFEWQYNQAMAKVPVTSGLISAVSSDYRNSQLTLSLQREQGDWHQPNIYLDPPQGMLYGIPQLTAKGDHLSVTVDVTDDWGDAAGDIVGKPLSFVVTDDGYSRQVNDTIGQGDSVSLPTADSGVGLWSILAFALLGGLILNLMPCVLPVLAMKLGSILHIEKRDTGAIRKQFSVSVVGILVSFWALALFMTVLRYSQEAIGWGIQFQSPWFIGFMVLITAIFTANLFGLFELRLSSNMNTKIATAGGQGYSRHFWEGAFATLLATPCSAPFLGTAVAYALIAPLSELWLIFTALGLGMSLPWIMVAMFPSIAKVLPKPGKWMNRLRVVLGFMMLLSCIWLITLLIPHFGIGIVAAIFVAIALILLFAIAKHYGKKTLFASMVITLILGGTSYLFIAQPDTQTLAGQDHVNWQPLSEEAIHQALAENKRVFIDVTADWCVTCKANKYNVLLRDDVQKALSEPDVVALRGDWTKPSEQITQFLKQRGQVAVPFNQIYGPCNKEGEILPPLLNKDLMLTILSEAKGAQ

SEQ ID NO: 5454 - protein, 462 aa, Proteus mirabilis
GIYMTLSQHVANFITTTTFSQLPTQLIARAKLHLLDTLGVALAGSTQSSSKQGRHGITLLPDSQGKIPIWGSMQTANTTAAALANGIAAHALDFDDTHTDSITHGSAVLTPIAFALGETLNASNEEILTAWVIGWEVAARVGLASHSGFHQRGFHATAIAGIFGATACAASLLKLTSQQAVNALGLTASQAAGIAEYLTNSSSAKCFHAGWAAQSGIIAASLAKGGMTGPETIFEGRYSIYHTHGISEQAIPEQVAQGLGEQWEFLNVSIKPYPVCHFAHATVDCGRRLLKRGISAEEIEQVECVIDPVAAALICEPLETKWAPKTAYGAKFSLPWLFAIGFLDNALTLSSLSAENLQRNDIQLLAKKVSYRYPSENEIPFPSYFPGLIFVRLKNGQQLTERIDIQYGNPENPMVDTDVIAKFYDNAKCVMKKTQADQLIENIMNFENIPISLLTQLLRVEA

SEQ ID NO: 5455 - protein, 416 aa, Proteus mirabilis
IIYMVYQFGIPEKNVSMTQLYNSFWRRNLLVCFIGSFSTVFAMTLMLPFLPLYVEELGVQGHAAIVQWSGVAFSATFITAGLIAPVWGKLGDKYGRKSMLVRASLGMAVTVSLMGMVTNIWQLVGLRLLVGLAGGYSSGATILIAVQAPRERVAWALGIVSCGVMAGNLIGPLAGGWLPDLFGIRNTFFCAGALIFLSFIMTLTLIREDTPKYINTTTKMQVSWSQLPARFVIVSMLCTGLLLMLANMSIEPIITVYVRTLVNDPAQITRVAGYVMAAAALGSIISASWLGKLADRIGHLRIITLALAIAGLLLIPQAFVTSGWQLIILRFLMGLALGGLLPCIAAVIRHHVPEGMIGSILGYSVAAQFAGQFIGPLIGGVIGGHIGMRAVFLATSVVLLLGAAWNFKLHRNSVIR

SEQ ID NO: 5456 - protein, 240 aa, Proteus mirabilis
VIYMNKPIDTLPLNFRILIKSAPLPLISGIIMAIISTMLSLAPLWIIYKISQICFSPSPNIQQINNLVYITVIILILRWGLMAISHIASHRGAFYIQHQLQLAIAKKISKVPLSFFAQYGSGNLRRIINDDIKSLEGFFAHMLPDLVSAIVTPFIAIILLFYVNWPLALLSLTPLPIAFMAQLLMLRRANKQTNEWMNIQKKIANEIGEYIKGIREIKAFNLTSHTFGKLSQSINSSVNG

SEQ ID NO: 5457 - protein, 723 aa, Proteus mirabilis
LLIFIQYYATITLILMTNRVVMSLSQSVKMQISQWYKALPEHIEGFIPRAPQREMIAEVAKTFSDETGRHLIIEAPTGVGKTLSYLIPGIAISREEKKPLIISTANVALQDQIYSKDLPLLKKIIPDLTFTGAFGRGRYLCPRNLEAICATEGEQIDLMFLLEDKVDVATSAEREICQELKHDFTSFGWDGLRDHHKRALTDSLWRKISTDKMNCLGRNCQYYHRCPFFLARREIDEVDVVITNHALVMAAMESESVLPDAKNILLVLDEGHHIPDVARDALEVEGEITLSALNMQLDNMTRHVSQYLAQFIPVKPPKLADPIRFDAHIAKMREAYQDVEHFTRALLPERSENDEYLFPLGQLPEQLLLCCQDLFKLTDGLKMLGESILNDLTERTAKEDVVRLHRAILTTSRMVGYLENMAKLWRLATLEQTSKAPVSKWLTRRYDKKQSHLYLHCAGIRVSEQLTQLLWKNIPHVVITSATLRSLNSFSRIQELTGLSEHFDDRFITLSSPFTHERQGKLVIPKMRYEPTMANEKAHLKEMARYFRQGMVENHHRGQLVLFSSQRAMEGFLEEVKDLRLSLLVQGDQPRYRLVETHCKRIDAGDNSVLIGLQSFAEGLDLKGDYLTQVHIHKIAFPPVTDPVIVTEGEWLKSLKRYPFEVQSLPSASFNLIQQVGRLIRSHHCHGEVVIYDRRLLTKNYGSRLLTALPVFPIYQPDIPKTE

SEQ ID NO: 5458 - protein, 406 aa, Proteus mirabilis
CKHIITFMPFLLKIWIDFFTLHVILSFRHTKITMTDIKKVKIMIMQKDALNNVNISEELVLITPEELKQKYPLSRNDLHAITQSRQTISEIVQRRDPRLLVVCGPCSIHDVDVALDYAKRLKVLASELSDSLYIVMRVYFEKPRTTVGWKGLISDPFMDGSFEMEKGLHIARKLLTELVQLGLPLATEALDPNNPQYLGDLFSWSAIGARTTESQTHREMASGLSMPVGFKNGTDGNLDTAINAMKAASMPHRFMGINQSGQVCLLQTQGNPDGHVILRGGKKPNYHEEDVALCEAHMIKAGLTPSLMIDCSHGNSNKDFRRQSVVVDSVIEQIKKGNQSITGIMLESHINEGNQSSEQPRSEMKYGVSVTDACISWETTESVLRNLHQQISPVLAQRAAQLRKVS

SEQ ID NO: 5459 - protein, 790 aa, Proteus mirabilis
NMILLAKIKYIYRNKIALIKWHYLYAKYIAMLGLKPLNIDYLAVIIILSCLPLLIQRETLSLSLSYTLIIVGILLYLIPFSYLRFLLLLLCFWCYANSTASSLMAKTSQLADTIATIESAILEYRRLPDSNIMIKVAIPKQHLFSAKLYANIYWRHPPKNVVVGQTWLFKIHFRAVHGYLNEGGFDSQKYAVSVRETLSGKILSATLTNSHLPIYTQFIHYLSSYWQATKNSGEITALVLGDKRGISAENKILYMKTGISHLIVISGLHIGLAALFGWLMARGVQYLFPTQWINPQFPLVISLGCGVFYAALSGWGIPATRAIIGLTIWVLLHWRSGLFLPWQWAIWSAAVILLLDPLAILSASFWLSFSAVFAIIVWYWLYPLNKRFSQQKRWFVIRLIHLQLGLLIILLPFQYYLFGGGNLFSLLVNLWAVPIISFITVPLIMCGLFTAFLPVIQPIIWSWVDQSINWAFFCAPYFLAYWQPCGAVPWLFALSGIMTLLVIKMSWWRHHVIILITIATFLYCELSFSKRYDWRITMLDVGHGLAIILEKEGEAVIYDTGIRWKSGGTIAKNVIIPYLTHHRLQPVAMIISHDHLDHTGGIDDLLRAYPKLTIRSSFDNPQHLPCLQGGVWQWKDLTFNALWPLTLSRSPKNNDSCVISLTDGNSVILLTGDLEKEGEAQLLRRKKAYLKADILQVPHHGSQTSSTLAFIQAISPKYALVSAARYSPWRLPSDKVHNRYKKEAIDWLTTSINGQISIEFKHGKIDVVTYRRDILPRWYHQWFGVLTFPE

SEQ ID NO: 5460 - protein, 677 aa, Proteus mirabilis
NYNMNLFYKINVNNFSLNKKGIDMTIIINMKESTNFYLPKGIVTTGVMAGWPQKSPNKITTVTYTFPDHNTYREIIKSKTPITESEEKNTLKNIYEYHRLYNVREQKKQELNTIKDKYSEDSKKRIKELEEEIEKIEDKIINTVDNIHPYFYLTQETIFPHQQEVIEDILQHISDILSIFFYKISPYINADLKFGYYSQFIDMSTHKLISNSRKGNAANPNVEGTPRKEIKPDETHDLPGTIFVNISTQEYYKTINQDGIDEYIKNEAKINDVYYFNNDKTISIARGNNNLFEEYQQNKHKIGSYEYLVFMHEIGHALGLNHSWKYIPNKEHKVLYSYKYSIMSIDFADIEDADFGGLYPMTFMLVDILLLQYLYGPNMTTRLENNTYGFNSNTGRAAYSLNSIEDKLVSCIWDSGGIDTLDFSLYTVNQVINLNEGCFSDIGGLRSNISIAYKTIIENAIGGKGDDTLIGNPFDNNLIGGDGNDLFYGGDGNDLFYGGSGNDVIYGELGNDVLYGDDGDDMLIDYYGANMLDGGKGNDRICVASTDRGLPGRNIILGGEGDDEIYLGTGTHRITGGQGNDTFNFFCYESVESNSFIWDFEKNKDKITLITRDYRKIDISKMKKVDKLSGSKNEFSLNHNKPANKTIIDVSTSSNDNKSIVHIEIVGIFNHDELFAV

SEQ ID NO: 5461 - protein, 263 aa, Proteus mirabilis
RHNIYQIGQVMAWLNQYDHFVPEEHLASVVGIAAEMGKHDSGFHSHDRGQLLFTQSGCMRITLASRVSVLPPMRIAWIPPKLEHRVEMYAAVGYRSVYIADKFHHRFPTESEILTISPLLREILERIAIADFDTQWEVGRYANLLAVFLDEIQQAKRQPNHLSMPSDRRLRKLSFDELPPPLQELAQYIGASEKTITRLFYKETGLSYQQWRQQWRLMKAIELLATHHRYLEISQLLGFASDSAFITFFKKMTGQTPQEYLRN

SEQ ID NO: 5462 - protein, 98 aa, Proteus mirabilis
GGNMTKSELIERLAGLQSHLSAKTVEEAVKEMLDHMADTLADGERIEVRGFGSFSLHYRAPRTGRNPKTGDKVELEGKYVPHFKPGKELRDRVNIYTE

SEQ ID NO: 5463 - protein, 157 aa, Proteus mirabilis
DHNIMSEKYVVTWDMLQIHARQLAQRLLPVEQWTGIIAVSRGGLVPAALLARELGIRHVDTVCISSYDHDHQRDLKILKKAEGDGEGFIVVDDLVDTGGTAKVIREMYPKAHFVTIFAKPEGRPLVDDFVVDIPQNTWIEQPWDMGVMFVPPVCDKK

SEQ ID NO: 5464 - protein, 248 aa, Proteus mirabilis
RMNITADVQKLEPGNKVQLIEVDGSEFDGPILRFHAYNLPHTPEEIEQSNGDIKPKPIWWQGNEYGAWPYEVEGMAKNSDGSPARPSLKVANIDGLISSLCLQFDDMVQAKVTIYETFAHYLDAKNFPEGNSTANPDECFKQVYYIDRKTNEVAGESVEFELSSPFDLQGVMIPVRQIHNLCYWCMKGDYRSGNGCSYSGNKYFDERGNPVDDPALDSCGGLISDCKKRFGENEPLDFGGFPAAGLTR

SEQ ID NO: 5465 - protein, 209 aa, Proteus mirabilis
GKNIMNNTKLAQLDWQKVDNLMPVIIQNAISGDVLMLGYMDKAALEMTLNSGKVTFYSRTKQRLWTKGETSGNFLKLVDIYPDCDNDTLLILAHPIGPTCHNGTESCFAPAQSQWGFLYELENLLRERKSASPDSSYTAQLYASGTKRIAQKVGEEGVETALAATVNDREELKNEASDLLYHLMVLLQDQSLSLSDVIDCLQKRHKKAQ

SEQ ID NO: 5466 - protein, 979 aa, Proteus mirabilis
MADIATISLKADTSDLERGTQKLKEFGDTAEKVSGSSRNLNDQFNRGVDHQKRAADAIKRQKKELDDLLNSINPTNKAFDALDKATQKLIEANKKGILPKDQFADYNAILEQTRDKLTRVNMSLTAEGRALLAQEAATNRAKQAADDFLNSLKNQTEIIGKTRTEILELKAAQLGVSQQAAPMINKLKEQEKAFLNGSITIGQYRNAMRQLPAQMTDIVTSLASGMPVWMVMIQQGGQIKDSFGGVGNSLKALASLITPARVAMFGFAGAAAAVALAAYKGSQEFGEYNKQLILTGGYAGRTAAQLDALARSLSGNGITQYGMADTISKVVGSGAFSGRDVDMVSKTAAAMEKAVGQSVDETIKQFQRLQEDPVKAVTELDKSLHFLTATQLEQITTLQTQGKEQEAAKMAMESYANAMDERTKQIKENLGTLEKAWQWVGNEAEKAWDKMLNIGREKTLEQQIQEYEEALIEAQIKPAGKDILRYKTGLTVDEVKSKLALLKEKQTQIAIKNASEKAARDEEERKKAQFRADQELKRQYETAEEKHQRTLNEIKNNAYASQAAKDEAIRREKERYEKEKAKGKGKTPTYRPDYGTRVDESANQALLSLQAQLKVLKEHKTVSDVISSERKKLWDMEAKISILEEAQKTRQLTKDEKALLAKKDYILASQEALAIAGDEVKLQELHNRELDKQLKRVEEINARSRALELGAGKSDRMYQRDIALEKAKSPDERKALEEYYAKEDSIRANWELGVKKGFAEFQEQATNVYGNVAQISQSAFQGMSNSLSDFVLTGKANFADFTRSFLEMTTKMLMQMAMLNAMKAAFGGNAVGNFFGFASGGYTGGGGKYDPAGVVHKGEFVFTKEATQRLGVDNLYRLMDAGKRGYASGGHVGGSAPMSVTQPTAFIARNPQIAGGGVNVTIDMSGVKIETEQQQSAMPNIDVRAAEQSLKNKVKSLFISEGREGGDLYKIIKAVSGNR

SEQ ID NO: 5467 - protein, 722 aa, Proteus mirabilis
DMDMMLIAFFKTLFKFLFRVRIEGLINQFSQYEKCIITPNHTSFIDGILLRLFLPINPVFAVYTSVANAKHTKWLNRYADIVPLDPANPMAVRQLVKEVDKGRPVVIFPEGRITVTIGLMKIYEGAAFIAAKSGAKVIPVRIEGAEFSYFSRVRKTLNIKAKLFPKITIKVLPAVDLPMPTAEKSAERRRLSGEKLRDIMMDAIMQARPNITLYEAFLQGMSQFGRFSPLISDINMKEDSYQGLLKKMLGVSRIIERYTEPNERIGLLLPNTTVTVAALFGATMRQRVVAMLNYTAGSLGVQNAMKAASIKTIFTSRQFLEKGNLLHIPEQTPDANWIYLEDLKDSITREDKRWIAQHLLTPHKAMLAQKSTDAAVILFTSGSEGTPKGVVHSHSSLLANVEQIRAIADFSPRDKFMAALPLFHAFGLTVSVLAPICLGARVFLYPSPLHYRVVPELVYDQNCTVLFGTSTFLGNYGKFAHPYDFARLRYVVAGAEKLSESTRVLWQDKFGIRILEGYGVTECAPVVSINVPMSAKPYTVGRLLPGMEGRLIPISGITDGGRLQLRGPNIMLGYLRVESPYKLEQPTAINAEGIEEAGWYDTGDIVAIDSEGFCTIKGRVKRFAKIAGEMVSLESVEQLAAKASEGNHAVVAVNDPRRGESLVLFTTDKQLDRSMLSALAKSTGVAEIAVPKDIRFLKEIPVLGSGKTDFVSLKQLAEQENN

SEQ ID NO: 5468 - protein, 203 aa, Proteus mirabilis
GMDMVKRPDWEAIESAYRAGVMSIREIASQYEITHQAISKRAKKEGWERDLKAKVKARAENLVAKREVASLVATEKAISERQLIEANAEVIANVRMEHRGDIRRARELTNNLFDELSAECADVPALRKLGELMFSPDDNGRDKLNEIYHSIISLPERVKSAKALSETLKNLVGLERQAYGLDDVQPNKTASQLSELMDDLSKE

SEQ ID NO: 5469 - protein, 244 aa, Proteus mirabilis
GKDMLKRLIYLFLTLFILVAVALIACDRWIGVKTSPYIFEDIDKLPAKKVGMVLGTAKYYTTGYLNQFYQYRIQGAVNAYNSGKVQYLLLSGDNAQHSYNEPNTMRKDLIKAGIPASRIVMDFAGFRTLDSVVRTKEVFGTDGFTIITQRFHCERAVFIALEKGIDAQCFAVASPKSMFKVRVREVLARAGAVVDLYILKREPRFLGPPEAIPAVQNIPDDIKGYPAVSPQEVEALPLNNGKNS

SEQ ID NO: 5470 - protein, 354 aa, Proteus mirabilis
GDCMRKIIHVDMDCFYAAIEMRDNPTLKEIPIAVGGNASRRGVICTANYPARRFGVRSAMSTATALKLCPHLKVLPGRMALYKETSAKIRQIFARYTDLIEPLSLDEAYLDVSDSKHCHGSATLIAQQIRQQIFAELNLTASAGIAPIKFLAKIASDLNKPNGQYVITPEQMDDFILKLPLNKIPGVGKVTFARLQEMGLETCADVRGTDVISLVRNLGKFGQSLWERSHGIDERLINPERLRKSVGVERTLAEDIDSWDECLALLDGLYDELEKRLSRVKPDLRIARQGVKLKFDDFQLTTQEHSHPILEKTDLIDIAYQAWHERRNGRGVRLVGFHVTLQDPQMERQLLLAL

SEQ ID NO: 5471 - protein, 237 aa, Proteus mirabilis
ATCMLPCRGDSKMMISEITKPKRGRPPKNHSPNTDVKNIVIQSGIEMFAEKGYISSDICKILEKVGIPKGSFYYYFGSKEKFGLVVIQHYDNFISKQLDNYLSYTALPFPKRLLAFCHMIKSEMEKYHWQRGCLVSNLIQDIVNLPISYYKILNNVISGWQKKVENYLLEAQKYKFISKNIDCRQMAIFFWMGWQGAIMQAKLTRSNQPLDIFISIFMAQMFDIPQHELEITKNRII

SEQ ID NO: 5472 - protein, 94 aa, Proteus mirabilis
GLCMPHSPAEKKAALTRVRKIKGQILALETALENENECGQVLQQIAAIRGAINGLMAGVLESHLREGLMDAVASPEDQKNSVDDAISLIRTYLR

SEQ ID NO: 5473 - protein, 235 aa, Proteus mirabilis
FTCMGWAGNKSVGKKGADNYPRGAIVNIEWIRERVSTALMNVCIIENGPLSAMEEQAILVTDRFKRNPIRYAGERKSRYRLPSHPLKIKQKHAKGKSKPLINEVTYRTSSWRRGIHQLPNEMRLWLLYCYGDYQYYREQILIVPYIWHEFQRLNSKKRITKKVKQRLQSLTLLAIQAVKAEINQTAKKYTDVKLAELLGVSADAWRKSYKLYWICLLDCCYQLDRDSLFKISALS

SEQ ID NO: 5474 - protein, 110 aa, Proteus mirabilis
VIGIRPFTAKFMAKEQTDRTTLDLFANERRPGRPKTNPLSRDEQLRINKRNQLRRDRVNGLRRVELKLNEDAVNALNELASAKNVSRSELIEEILLEQLAQTYALKKHQS

SEQ ID NO: 5475 - protein, 100 aa, Proteus mirabilis
CKILARKSLALSDLGLSKKSFFGLSSTIRPSSIKIIRSATFLAKPISCVTTIMVMPSLANSTITSRTSLIISGSSAEVGSSNSIAIGSIHKARAIATRCC

SEQ ID NO: 5476 - protein, 686 aa, Proteus mirabilis
SWIFIQYHKECLRGDKNMSKVFKLHSEFKPGGDQPTAIASLCEGLEDGLAHQTLLGVTGSGKTFTIANVIANLNRPTMVLAPNKTLAAQLYSEMKEFFPENAVEYFVSYYDYYQPEAYVPSSDTFIEKDASVNEHIEQMRLSATKALLERKDVIVVSSVSAIYGLGDPDSYLKMMLHLSNGMIIDQRAILRRLADLQYTRNDQAFQRGTFRVRGEVIDIFPAESDDYALRVELFDEEVERLSLFDPLTGQIHYNVPRFTVYPKTHYVTPRERILDAMEKIKQELAERRKVLLANDKLVEEQRVTQRTQFDLEMMNELGYCSGIENYSRYLSGRGPGEPPPTLFDYLPADGLLVIDESHVTIPQIGGMYKGDRSRKETLVEYGFRLPSALDNRPLRFEEFEALAPQTIYVSATPGKYELEKSGNDIVEQVVRPTGLLDPVVEVRPVATQVDDLLSEIRIRAAKNERVLVTTLTKRMAEDLTEYLEEHGERVRYLHSDIDTVERVEIIRDLRLGEFDVLVGINLLREGLDMPEVSLVAILDADKEGFLRSERSLIQTIGRAARNLEGKAILYGDKITDSMAKAIGETERRREKQQQFNLEHGIVPKGLNKKIGDILKIGQPTQGRNKKGHKAVDTHEDYPLLSTAELEKEIQRLETEMYQHAKDLEFEKAAQTRDKLQTLRAQFIANS

SEQ ID NO: 5477 - protein, 82 aa, Proteus mirabilis
RYILLHLFLFDLFNNIAHNNSLTLGKLILMTLCVRLTLLFFANVPAGILLTALFARQSELGFPEAQVFLARSGPAIVSYASD

SEQ ID NO: 5478 - protein, 82 aa, Proteus mirabilis
INILFKQRINTSNINVVFEVFFILSSIKWSCSLMTDTYFIALFYDAFVSNQSHQIEIAIGLVIAPLNDRANQKLHFLTLHDH

SEQ ID NO: 5479 - protein, 75 aa, Proteus mirabilis
LSLIIKKAGRVIFLSSLAIRCVYSSILGNFKSLFYLMVLLLVFDVFVIYRHGLFRLLRVFTERKRMVRLKKQKSY

SEQ ID NO: 5480 - protein, 411 aa, Proteus mirabilis
EELMDIIILGVAMFTLIVLVLTALILFAKSKLVNTGDIEVEVNGDPEKSFHAPAGDKLLNVLSNEGIFISSACGGGGSCGQCRVKVLEGGGDILPTELSHINKREAKEGCRLACQVNVKNNLKLELPEEIFGIKKWECEVISNDNKATFIKELVLKIPEGEVVPFRAGGFIQIECPPHTVRYEDFDVPEEYREDWDKFNLFRYVSEVKETTVRAYSMANYPEEHGIIMLNVRIATPPPRNPDVPPGIMSSYIWSLKPGDKVTISGPFGEFFAKETDAEMIFIGGGAGMAPMRSHIFDQLKRLHSKRKISFWYGARSVREMFYTEDFDMLAKENENFTWHVALSDALPEDNWTGYTGFIHNVLYENYLKDHPAPEDCEFYMCGPPVMNAAVIKMLKDLGVEDENIMLDDFGG

SEQ ID NO: 5481 - protein, 133 aa, Proteus mirabilis
CFIISVNTERLAFKVLLTQAAFSTIAGLRLCGIVEEPTCPLPKGSESSSISLCANIKISLAIFPNVPLINPINIPYSLNLSRAGCHEISGISNPKRFNTRFSNSSALSLKEALVPTAPTTLPTNRRGSTSLSR

SEQ ID NO: 5482 - protein, 498 aa, Proteus mirabilis
GIIMKPEHLALLRDKLWRLNHLYWITNKEGKPVRFKMTPEQLEYFEGMHTRNIILKARQLGFTTEVCIIQLDAALFEAAKCALIAHTLNDAKRLFREKIKYAYDKLPDEIKAANPASNDAVGELVFSKGGSLYISTSFRGGTLRYLHVSEFGKICAKYPEKAREIVTGAFEAVSSDCFTTIESTAEGRAGYFFDYCQSAEKAQIQNKTLSNLDWKFFFFSWWKNPEYAINPVEPLPQRLVDYFDEIASKHGVQLNERQKAWYYAKEKTLGDDMKREYPSIPSEAFQQSVEGAYYAKQFRFLYENKRIGTLPDNSHLPVHTYWDIGVGDSTSIWFIREVGEEFHIIDHYSNSGEGLRHYMKVLKDKGYTYASHNGPHDIDNREFGSDAKSRRELAREGYEIDGQIYSIRFEVVPKLSVDEGIEAVREILPLCVFDEHKCSEGIAHLEAYRKEWDDKRGCWKDKPLHDYTSHDADGFRYFAVSRRNTKRPAFEINLGTTF

SEQ ID NO: 5483 - protein, 240 aa, Proteus mirabilis
RVIIMDRFSRSNDSIVQRTGTGLQTFMAQVYGWMTVGLLLTAFVALYVASSATLIEMIFTNKIFFFGLIIAQLALVFILSGMVHKMSGALATTLFMLYSALTGVTISSVLIVYTYSSVASTFFICAAMFGALSVYGYTTKRSLTGMGSFLFMGLIGIIIASIVNIFMQSSMMSMVISYAGVLIFAGLTAYDTQKLKDMGSEINQEDKENMRRYSIMGALTLYLDFINLFLMLLRILGDRR

SEQ ID NO: 5484 - protein, 66 aa, Proteus mirabilis
VKIIRFHSEKRTIITNSALFSCFPISAQVAFNLLENPESLRQGYAKAPHLSLFDPFYLSCGGINCL

SEQ ID NO: 5485 - protein, 61 aa, Proteus mirabilis
VSVIKLHDHFILDNIKNTSNTTLIFEVLILCLNKMLIYINPLIFSDYIAWRNISITSLSLP

SEQ ID NO: 5486 - protein, 489 aa, Proteus mirabilis
RRSIVSELSTLSPQPLWDIFAKICSIPHPSYHEEALASHIMAWATEKGLSVERDAVGNILIRKPATKGMEDRKTVVLQAHLDMVPQKNNDTEHDFTKDPIQPYIDGEWVKAKGTTLGADNGVGMASALAVLADDTVKHGPLEVLLTMTEETGMDGAFGLQPGWLQADILINTDSEEEGEIYMGCAGGIDVKTTVDLTYEAIPANHIVKKLVLKGLNGGHSGGDIHLGLGNANKLLARFLAEHADELALKLIDFHGGTLRNAIPREAHIIFAIPADKATQLNSITTEFEALLKSELAIAEKNLAIELTDTSTEKPVFTADCQSRTINLLNAMPNGVIRMSDDVEGVVETSLNVGVVSIVDDKVEILCLIRSLIDSGKTYVVSMLTALAKLAQADIETKGGYPGWKPDADSPVMHLVRDTYQQLFDKVPNIMVIHAGLECGLFKKPYPDMDMVSIGPTIRGAHSPDERVHIKSVGQYWQLLTAILKAIPAK

SEQ ID NO: 5487 - protein, 596 aa, Proteus mirabilis
AAPIFCAQQVSFRMEKTDMGSHLMQRLNAFADAFSFFLLWLQNSPVILSLLAGLTLPFIFHLPREERKNAPFWLKSVACVSIFFFIFGTISPLTIQGLSYFFKSLDNNILFRVPLWIMTIIFTAAGLIFHIAARRLLAGEIDNLKHRMIKKSKLERNTRTDVRKVKELLPDSIEYNPLDYIDLKKGVFIGLNKDDQPQYITIKEFKTQHAAIIGTTGSGKGVTATVLLYQAILLGEAVFVEDPKDDEWAPHVLREACKKAGKKFTLINLNKINFQLDLLADISHEQLEELFNAGFSLAKKGEASDFYRISDRRAARNTSAIYEKGMTLRDLFNTDFVQSLREDVPAFCGELEEIALVNSINATKGFSLKEVFNEGGCCYIIGSTRNQKIISAQRMILTRLIQIAETRDRINSTPRTVAIFLDELKYHLSRPALEGLGTARDKGVHIFMAFQAIDDLRDCPSDLNSDSVIGAIIENAKFKLIYKIQNPETAEWAAKMTGSILVDDEMRKVRTDLSLTEKVDTDRMIRQAESYYVDSNMFLNLPEKVGFVFTSTELPRSTKMFQVQVKKENIELLSFEYKEATPEKNESQEHKPSINL

SEQ ID NO: 5488 - protein, 61 aa, Proteus mirabilis
LNPITSSVMGFFVFIKYGQQVVIYSVRCLFLSIKVQILYYLPAEKIIGNRACPNSNNNQCP

SEQ ID NO: 5489 - protein, 104 aa, Proteus mirabilis
GFTMKKTVITAAVLCLTAGTPIYSFAADPCEVVLCMYGKATGNSGGSECSSAERAFFKINAFKKHHRFNPGKTFDMRKEFLVECNAADPESISKILSKFGRVKG

SEQ ID NO: 5490 - protein, 217 aa, Proteus mirabilis
KVYMKKVNEVIGERLKSIRESRGLSQAQLAKLCGYSAASRIGNYELGERKISADDAIVISEALGISPAELMFGSQSEQVIKNYEYPLFTKVQAGAFSTEFNSYTQKDAVSWIPTAKKASERSFWLEVEGQSMTAPPGGKPSFPEGMLILVDPEEEVEFGDFCVARLLNDEFTFKRLIREGGVEYLEPLNPRYDLIPINGNCTIIGKVIKSQWPDDTF

SEQ ID NO: 5491 - protein, 287 aa, Proteus mirabilis
PMVFILVNFFCSLNKEFFMHKKDISRKQRLISYCVIYLTAIYPLHPAWGSVITSSDKTITINQQNNIPIINIATPNDSGVSHNRFNVFNVNKQGAVLNNSQVDANSQLAKKISANKNLKGNTANLIINEVVGNSRSQLLGKLEVAGQQADVLIANPNGISCDGCSFINTPSITLTTGKPQFSPQGTYSALEVKKGSIVIGKQGMNADLQNYADIISRSIEINGKINAKNLSLMQGNNHIDFGKGTVNSINGEGVKPTVAIDTKALGGMYANQIRLVSTEKGVGVNLT

SEQ ID NO: 5492 - protein, 388 aa, Proteus mirabilis
GTNMEKLDLLAIRDKITALDSELLSLLAQRRQLSTEVAQFKLNTHRPIRDKNRERELLELLIEKGKNVGLDGFYISRIFQMIIEDSVLTQQAILQQHLNATANESARIAYLGPKGSYSHIAARQYAARHFDTFVDCTCHKFEDIFTLVETGQADYGLLPIENTSSGAINDVYDLLQTTSLSIVGEIRIPINHALLTAVKSSLEELHTIYSHPQPFQQCSHYLNQYPHWKIEYCESTAAAMEKVALAQSPHVAAIGSEAGGSLYNLTPLASNLANQQINVTRFIVIARKPIDVSEQVPAKTTFLMATGQQAGALVDALITLKQYSIIMTKLESRPINGTPWEEMFYIDVQANLRDINMQKALHDLSKTSRSLKVLGCYPSENIVPVEIQ

SEQ ID NO: 5493 - protein, 908 aa, Proteus mirabilis
RLNMNYISIILSDTDITIKYLSEKSHYSFNTTNSHYLDWLNMAKAINHKFNSAQGGLIYSTSNKSDSAIIKTIDNKVINLSNFFTEIFNKPFIYINKAQLEHHHDLEEKMVTVANNFAWSIEYSGLETGKDEYCQESLLTTANGYIGLRGTLPEMTISDEHYPATYIAGLYNQASSQIENHQVINEDFVNAPNGQFISLKIGKGEYLHPKQLITHHLTRQLDLKTGVFTSQWRVETPEGQQLDIHCTKFANMADMSHYAILYTFKPLNFSGEITVITRLEGNTYNYGVQRYRSLNPHHYHVLQTGANKQHAFILAQTDQSKIGIGLSSTIRGDFFANEDIVCHVSDTLVEQTITFNAQQNTTYQLEKCVAVTTSTAYPDSWQDVVNWEQQPLHSQLINSQKAWQTLWDSADISISGDLLTQKLLRLHTFHLLSSASPFSNQQHQLDVSVTARGLHGEAYRGHIFWDEIFILPFYIMHFPETARQLLLYRYHRLPAARLAARAEGFQGAMFPWQSGHDGSEQTQTLHLNPLSGQWDADHSCRQRHVSLAIAYNVWLYWLNTHDHQFMEQYGLELLNDITLFWLDQCQWDEGDQRFHINGVMGPDEFHEKYADSLEGGLKDNAYTNLMVVWLFNQIEMFINNDRFSKKLQQLNSQSSVFNKIQEVKNRIAINIDAHEIIEQFSGYFQLKDLDWESYRKKYGNIYRMDRILRKENKSADDYKVAKQADTLMLFNNLDKQTVHSLITSLGYSVSKHFAEKNLHYYLERTSHGSTLSRIVHAYLAEQIQLHDLSWQLYQDALYSDYNDIQGGTTAEGIHTGVMAATLNTTIMAYAGVDIRQDMLTITPSLPQQWQKLSFKLLHRSTLYQINLTHKEISILSDKPSTILINHQTHKLTANTLLVLNLNGDTQND

SEQ ID NO: 5494 - protein, 363 aa, Proteus mirabilis
EQNMKRIFVILFLLTLFPSLAVAGADDYVPSPITINTSTLPVVVIGPADAHTYPRVIGELTGTSNRYIFNGGSLIALMRGKFTPTLPKIGKITYNFRQGNNTQSSDFDIFDTGVPGLGIIIGMAGYWPATPLVPINSSSIYIDPVAANTNPNAYNGATGNFGARLYVAFVATGRLPNGYVTIPTKQLGHILLESNRASLNNKRLTAPVMLNGGRIQVQSQTCSMNQKNYVVPLNTVYQSQFTSLYKEVQGGEVNIQLQCQDGIDVYATLNDATQHGNRSDILTLATDSTAKGVGLRLYKNNEVTAISYGSDTPNKGNQNQWHFSNYRGEINPRIKLKANYIKTENTITPGSVKAVATITFSYQ

SEQ ID NO: 5495 - protein, 462 aa, Proteus mirabilis
TMNIKHLAIATCIGIAVPTIAHANTNELSIEQRLTRLEERTLAAEKRAELAEQRAAKLENALKQNQALNNNLSQTSETITAPPSSLIETNTGYGKLKLYGDVEFNTDIASKKGQLTSINMRSGKEKDYGDYDKWGINGRILIGLDGERLLDNKNYAGFTVQPLANIDGKVSLDDAAFYFGKKERWQFKLGRYEAYDMFPLNQDTFVEYSGNTANDTYSDGFGYIYMMKEGRGRSNSGGSMMFNSQYNNWYFETNLLIEDGTSIFANKEYHGNKLYNNKNVIYFRPVIAWNNNNFKVAVALEKNIINNAYGYDDKKTGEFRDQSKRNGYGLTLGWSNLQQNPENGVTINWNTAYLDANDENDFTTGTNILWRKLQLGYIYAHNNIKSYTINSNDDNNNDIIFGPGKYNIHTLYSSYELPNILDMDNFKIYLGAYYSVINGKDIEIENSDKDRYGVRARFKYFF

SEQ ID NO: 5496 - protein, 196 aa, Proteus mirabilis
GRDMSDQFMKSINIFIDKSNANIETVVKNTGFKILAKLVDMSPVGNPELWEVNRVASNYNKAVFEHNEYLKQDPNNLTPKRRQLKKRVRVNDSMDIYVPPGYTGGRFRGNWQVSFDAPAEGETGRIDKSGNMTKALGNVVIEQFKVGMKAIYFTNNVPYAYRLEMGHSKQAPNGMVAVTAEEFSQFFNSAVSETKS

SEQ ID NO: 5497 - protein, 435 aa, Proteus mirabilis
KGDMMKQALNVIFGLLILCVTTLANAEVRIEITQGVNTARPIGVVPFKWEGTGQMPEDIAGVIAADLRNSGKFNPIDMNRLPQQPVTASEVQPALWTALGIDSVVVGRVQPSADGQYVVSYQLVDVAGSPGAVLAQSEYKISNKWLRYAAHTASDEIFEKLTGIRGAFRTRIAYVVVTNGGAYPYELRVSDYDGFNQDRVYRSSQPLMSPAWSPDGAKLAYVTFESGQSALVVQTLATGEVRQIASFPRHNGAPAFSPDGSKLAFALSKSGSLNLYVMDLASGNMTQVTNGRSNNTEPTWMPDGQTLVYTSDQGGRPQIYKININGGTPERITWEGKQNQNPAVSPDGSFLVMVSSESGRQHIAKQDLETNAVQYLTDTFLDETPSIAPNGTMVIYSSTQGLGTILRLVSTDGRFKARLPATDGQVKSPAWSPFM

SEQ ID NO: 5498 - protein, 110 aa, Proteus mirabilis
IPDILTMQFTVYGNTGKSVVYPLLLDVTSDIIGQLNRRIVIPLLPVEKYPASRRPDRLVPVVRLTDGKEYAVMTHELASVPVRVLGTVFCDASQYRTQVKAAIGFLIDGI

SEQ ID NO: 5499 - protein, 338 aa, Proteus mirabilis
QPCININRVIMKTKKISVFIILMIIIGIIAGIYYYEENKDPELVLYGNVDIRTVNLSFRVAGKLAELQVDEGAPVTKGQLLGQLDDAPYINALNKAYGERDSAIASLALMEAGYRSEEIAQAQSDVSLKRAAWQYAENFYKRQQDLANRKVISANDLDSARNNRNQAAAALKAAQDKLNQYQNGYRQEDIDMARGQVLQAKAAVAQAELNLQDTQLTSPAEGTILTRAVEPGTILSAGSPVFTVSLTNPVWVRAYISENHLGEAIPNREVYLYTDSRKDKPYHGTIGFVSPTAEFTPKSVETPELRTDLVYRIRVVVTDADDALRQGMPVTLKFAPTH

SEQ ID NO: 5500 - protein, 84 aa, Proteus mirabilis
GGCMIKVLFFAQVRELVGVDSLELQNDYPTVDDLRRALINKGDRWALALEDGKLLSAVNQSFVQGTYAIKDGDEVAFFPPVTGG

SEQ ID NO: 5501 - protein, 131 aa, Proteus mirabilis
VSRIINLPTKEIAMRKACFTEHQIIAVIKSVETGRTVKVDDFNRETLSIKIILNLPDLRVIRVLDRVAANCGYPVMLRMNNGPEFISLTLAEWAEKHALKQDVIQPDKPTQNAFIEYFNRTYRTYSIFICS

SEQ ID NO: 5502 - protein, 173 aa, Proteus mirabilis
SRRITDSLDIARSGKSRFRLLPGTEIAGVITTQRSFQRAAAPVAVTENAFKDGQIGTGIKQLCGGHTIMAEIGAGDLHQPDRVTAILCCQAAENMLCISPTGWQVRNNVFIAGRGSGLRDNLSDGIRVKTGFHPCHVECSGRMNTGGALHGYRQKGCGGKHDDLSKQVACRAC

SEQ ID NO: 5503 - protein, 619 aa, Proteus mirabilis
ANSITLDVTTYYCRCAVGLSYLWNNCGVGCVMNLPVREFDAVVIGAGGAGMRAALQISQMGLSCALISKVFPTRSHTVSAQGGITVALGNTHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYSLDLVKNQDGDVVGCTAICIETGEVVYFKANATILATGGAGRIYQSTTNAHINTGDGVGMAVRAGVPLQDMEMWQFHPTGIAGAGVLVTEGCRGEGGYLLNKDGERFMERYAPNAKDLAGRDVVARSIMIEIREGRGCDGPWGPHAKLKLDHLGKEVLESRLPGILDLSRTFAHVDPVKEPIPVIPTCHYMMGGIPTKVTGQAIRMNEKGEDEVIPGLFAVGEIACVSVHGANRLGGNSLLDLVVFGRSAGVHLKESLMEQGTMRDASDSDVEAALTRLHRWENNRSGEDPVEIRKALQSCMQHNFSVFREGDAMAKGLEELKVIRERLQNARLDDNSSEFNTQRIECLELDNLMETAYATAVSANFRTESRGAHSRFDFPDRDDENWLCHTLYQPQTETMTRRKVNMQPKLREAFPPKVRTY

SEQ ID NO: 5504 - protein, 260 aa, Proteus mirabilis
ENGMNNSNFRPLLMSLLLLVGVAAPVAAIAQAPISNIGSGSTDERLAQLERISNAHSQLLTQLQQQLADSQRDIDMLRGQIQENQYQLNQVVERQRNIYQQLDSLNGGNSAPTTDEASTGGNVPSTSDTSTSSSSTGDEKADYNAAIDIVLNSKDYDKAIVALNNFIKSYPKSSYQSNAQFWLGQMYYLKGNKDQAASTFAIVVKNYPKSQKASEAFYKIGLIMQEKGQKDNAKAIYQQVVKQYPNSAGAKLAQKQLAAL

SEQ ID NO: 5505 - protein, 260 aa, Proteus mirabilis
GVLMSDRNFDDIADKFSRNIYGTTKGKIRQAVIWDDLQQLLTQLPDRPLRILDAGGGEGYFSRQLAKLGHQIILCDLSQEMLNRAQEAAIDEGVVNQMTFICCAAQEINQHLDDGVDLILFHAVLEWITDQKNAINVLTDMLLPNGILSLMFYNANGIVMRNAILGNFHLANPEIPRRRKRSLSPQNPLQPEDVYQWLASFSMTILGKTGVRVFHDYLQSRQLQNKDFPALLALEQRYCRQEPYISLGRYIHVMAQKCVN

SEQ ID NO: 5506 - protein, 509 aa, Proteus mirabilis
QVLIKPIFVSILLVIKTRIIIMKYLQLTKTQFRLSDTLCLHIDDLTINEGESWAFVGSNGSGKTALANTLCQEGILLSGELINRFTRPISLSFEKLQKMIEEEWLRNNTDLLSEDEDDTGLTVAQVIQMQVKDNDRCLLLAKQFGIDALLSRRFKYLSTGESRKVLLIQLLMNKPDLLILDEPFDGLDIDSRRTLSELLSSLHQQKLTIVLILNRFNDIPDFVQNAGLLIDCKLVAQGKKSDILSDSVIAQLSHSETLENLILPASDSVDAVPTLPPTLSPIILKDGVVSYNDKPVLHHLTWEVKPQQHWQILGPNGAGKSTLLSLITGDHPQGYSNDLTLFGRKRGSGETIWEIKRHIGYVSNALHQSYRVSSSVKNVIISGFHDSIGIYQAVTDKQQKLADEWLTLIGLTALANHPFHSLSWGQQRLVLIVRALVKHPTLLILDEPLQGLDTTNRLLVQRFIDIMISHSNTQLLFVSHHQEDAPHCITHRLIFIKEGDIYRYQQQPC

SEQ ID NO: 5507 - protein, 519 aa, Proteus mirabilis
KNLINSGYLLSNKKDKDLMVGLCLAVVEGLFATIPYILLYFLLIDLFANKITLAQLFYYFLSILLSIVLRIVIGTYSMPMIFIGAYKMMGQARLRIADHLRKIPIGWFSSQRSGDLASRLTADLEIIENIWSHFLGMFISTLAMPVFLSLFLVWVDWQLTLIILFSIPIALFALSISHKIMLKAAQQAADANANVQSELLDYIQGIMVIRSFGRLGPAWKKLKAALETQNKTQIVLDSKPAPWIALYGFILESGFILLMIIGTSRLISGSLSPSQFVFFLVLALPIYRQFFDLGLSSMLLNYAQKSLQRIEEVMKVVPLSEPKYTQLPIRTDIYFNNVSFVYPYNSQLTLDNISCCFPEKSFTAIVGPSGSGKSTLLQLISRLWDVNQGEILLDDININQINSDKLCSYVSSVYQDVVLFSGTIKDNILMGKTDAHDDEIITAAKLANAHEFIIQKPQNYDTPIGYGGMLLSGGERQRLSLARTLLKNAPIFTDRRSNIEYRLFIRSINSTSFIIVIKR

SEQ ID NO: 5508 - protein, 3074 aa, Proteus mirabilis
RILIMLNFETFYGNSEPIAVIGLSGRFPDAQNIDQFWHNIINKHDSSRLFSEEELKAAGVAEQTYRSPDFVNRGAPLDEAEYFDATLFNYSRSEAELIDPQQRIFLQGAWHALEHAGYAPCNITIKTGVFASARMSSYPAQQDLALHNIGHVRGMQKLLGNDKDYLATRIAYKLNLTGPALTIQTACSSSLVAVHMACESLRSGECSMAIAGGIGITFPQTGGYLYQKGMIFSPDGICRPFDAEANGTFAGNGFGIVVLRRLEDALVDGNTIIAVLRGSAINNDGHQKAGFTAPSVAGQVSVIREAIQLADIKNEDIELIEAHATATPLGDPIEFSALCQVFADRSLTASKCAIGSVKGNIGHLDTAAGITGLIKTILAVNKALIPPSMHFNHPNPQLQIEKSPFYIPKSPKAWSSRIRTAGVSSFGIGGTNCHIIVQSLPDSLVSIKPEQEVDNNFEYSLLLSAATKESLKKLAGDYAPLIKITPANILAHNALQQRQLNLPWRLSIPLTSESDISLLAFSQGSADSLIQYGHTSTNKKIAWLFSGMGSQYPAMGKVMYQHSTTFAETIDRCEQACLQHLTFPLKEVMFSLHSDKLVNASYIQAAIVAYEIAMAAHWRAIGILPEIIVGHSCGEYAAAVIAGFYTIEQMMPLAVYSGQLMESHVNGEMIAVFAKYQDIQIIAKRCHVELAAINGHNNLSFAGQPDDMQKFTQILKAKNIRFREMNNVCAAHTSYIDNILDQLMEFTAPLSATQGKIALVSGYTGQLISQKELQHPSYWAQQLRNTVMYQDAIQTLVNHGVTHAMELGPTSVLSDLGEREGITEISWIPTARMGVDEIQMKQQAATALFIAGYDLSWQSLFKTQGSYIPLPLYPFEKQYYWYEKKDSEKYQPQKSTFDLPISQGRETALKALTTLDLPRLNSFNSTLTTLHNYYVDKMICSCLGHELNTPMSVIDIMRAGRILPRYYQLLVRLLEACVEDGYYIYQQINQHNYYKKIKSISSDKLPLLFHQLQLDSEGLQSIPDTVKRAGEQLYDMMTGVIEPVSVIFPEGASQGVEVLYQDFSFGRYFNQIAAAVLKGLLSHYQPTVAKPLRIIEVGGGTGGTTSWLLPILSTIQHVEYEFTDISPIFTRRAAQKFSQYSFVNYREFNLQQSPEIQGFQSDYYDIIIAANVIHATQHIGDTLTALRTLLRSNGHLLMREITKQARLFDFVFGPLVLPLHDEKIRKGKLFLSPELWHQQCRLAGFQHIRWLPDALPETKDMCEHIILASVSTENDHFDQELPSDTKIQQSSHYQWQLTPCVEQGLIKPKLIFNHQQILPSEITAILSAIGCLSEQGENQLIIANLADPLIIAEQIRQILLSSSNGFVVITQQAWALTAIETVNPAQRSIRSLLKTIQKEYSSRLIAIVDLGINASWSELVPAFIQIEQGNNEIIVRNHCCYLPQLTPLPSSSTIIAQNIMVSPRWHIITGGFGGLGRITASWLVRQGAKRIAILAPRADSSALDWMNNLQKSNQLEIKWLTCDCRDNAQCHAALTQLENEGGIEGLIHSAGILDDALMTQLTPERMSDVFSVKAISAKQFCDALEKTDASYLILYSSAAATIGSEGQAAHSLACGYLDGLAEYARRNIKGLTVISIAWGAWQSVGFVAEKQLHDKLQHKGMSTLTTEEGLAHLDACLLDNTSCRLAMRLATPPLMTQKTPLFHQTNHNDINYDNHELNHTRQLCETPTQTDQTEPVSPNRVDYRVGDNLEQWLTACIKQLLRLGDEHIDTHIELFQLGLDSLSFLDLSAEIKKQFAVNIDAEQSYDDMTIAGLASVIRTAAPEKFTVTEAPHNQDNISHTMESERYVPFPLTPIQHAYWIGRKNLFNYGGVACHAIFEWDCQRQIWEPASLEKAWNKVIQRHDMLRMIIDDDGQQRILKEVPYFHFIQHDLTNLTQQEQQESLTQIREALSYRVLPTESWPLFEVEISWLNNDCYRLHINLDLLQFDTMSFKILFDDLYNAYSGQELIPQTFTFRDYCLKNQTNRNSDEWKMAWCYWQDLLSDLPSAPYLPIKNASITEQPRFTTFQHHVSIAQWDKLKQRWKKHGITPSAGLLTLFALVLGRWTKYPAFTLNLTFFNRQPWHPDVTQLIGDFTSVLPIDIYLDNDCTLNESMAKIQRRLWQHLSKSQVNGVEILREWGRYKGDSSQSLLPIVFTSMLGMTLDGDNIDEALNQLFGQPVYSFAQTPQVWLDHQVMEGKEGLTLNWFCMDDIFADGLLTMMFSDYQSLITQLCQDEDNNQSVDKIIAQLPSYQHLAIDNHFQSRYQQLEQTLENHPQIKRAHVMVKDDTKVESPLQLLFEASSDIPLSVIKQPNWLPNLLSPSASLSDIIEKSWQRFEERARYGICHTLYRNALFTELNTPITLAEIVTRLKAKPQYERLLNQWLDLLCLHHLLTKEGDQFYATTQFIDLCLSAPVFQQPVNDWEYVLWDYLEQSLNQHELLFSGKVSPLSLLFNSDEITTALYAKHPALNYLNQCAKDIVSAMVGATSSLNILEIGAGTGATTQGIVAVLKNTHYSYTFTDISHYFLDKARKKFTAVGEMRYQLFDINAPIQFSHHPDNGYDLIIASNVLHDASHIGHALKRIRSLLKPQGYLLFIEATECQSAMQMATVGFIEGLSAYQDKRILTNKAMLDSESWHDILINTGFETIGQWPQTDSSSLRQTLFLASPTRGGKPYLGKLRDYLSHSLDQNIDSLELFQCENIEATLNGIAASSAQELNEQIQPVTIPDVPTNMINEVIALWSELLGREVNSTNDFFRSGGDSLIATKMISQLHQRGYPATLQQIFTYPCLADFCAHLEQEKQSQREYSSLIPLSAVSAPKPYHYFMVHASDGDPGVYLPLAESLNNTVWGLTVTDASKLTDLDTLLSLHLSSIKTAQQTGPYILIGWSYGAFIASYLAEQLSQQNQSVLLVLIDPVYRHDFIKFCHDDSDSSSDENKQLACTKRLMSFLPESDLPLSDDIACLWLEATNHPTEWTSPEKEWYQRLPPHTQHHYFSGEHWSILQDRATSTHLAEIIDQWVQQKLSNNGYPSEGGN

SEQ ID NO: 5509 - protein, 180 aa, Proteus mirabilis
ITLIESRGETTFMINNDEMTHLSIEVGQALLERKKTLTTAESCTGGWIAKVITDIAGSSDYYHRGFVTYSNQAKHDMIGVDEQTLSDFGAVSEQVVCEMAKGALLTANADYAVSVSGIAGPGGGSEEKPVGLVWFGFAIKTPEGLRVVAKHCIFSGSREEVRAKSVIFSLKSILKEIINN

SEQ ID NO: 5510 - protein, 203 aa, Proteus mirabilis
RGLIAMEHYISLFVRAVFIENMALAFFLGMCTFLAVSKNVKTAFGLGIAVTVVLGLSVPLNNLVYNYVLRANALMEGVDLSFLNFITFIGVIAALVQILEMILDRYFPSLYNALGIFLPLITVNCAIFGGVSFMAQRDYNFSESIVYGFGSGIGWMLAIVLLASIREKMKYADVPSGMKGLGVTFVTTGLMALGFMSFSGVQL

SEQ ID NO: 5511 - protein, 274 aa, Proteus mirabilis
EVLINLLLFITYVHYALWRRDNKEKQDMKNTDLELIINEKLSIENFHDYAPNGLQVEGRPHIQKIVTGVTACQALLDEAVRLNADAVLVHHGYFWKNEPVVIRSMKRNRLKTLLCNDLNLYGYHLPLDAHPILGNNAQLALKMGVKVEGEIEPLVPKGIFDLPVTANELKTRLEKALQRNVLHCGDNAPDVIRHIAWCTGGGQGFIQQAAEQGVDAFVTGEVSEQTIHIAREMGVHFFAAGHHATERYGIKALGEWLAQTHHLDVTFVDIDNPA

SEQ ID NO: 5512 - protein, 847 aa, Proteus mirabilis
GNIMNFNNQLHLISYRYSLPFCVALGIGVITISSFAAEEAEFDPSFLHSVQGKNAIDIRRFNYGNPIPEGKYYADIYLNNEWKGKANVQYLYTDNANTSTLCLTPELLSLIDVVKGTVPENSYKATCYPASEGLPSAKFHFDLSTLKLNIEIPQAQVNTRPRGYIAPAQWQSGVPAAFVNYDVNYYQYNTPDINNEQTYLGLKAGLNLWGWAFRHRGGESWNNGHSTGYQNIETNVTHDIARLRAQFTLGDFYTNGELMDSLSLRGIRLASDERMLPNSLRGYAPIVRGIANSNAKVTIYQNAHILYETTVPAGPFVINDLYPSGYAGDLLVQITESNGQTRTFTVPFASVAQLIRPGFSRWQMSVGRYRYANETYHDLIAQGTYQYGLTNDITLNSGLTTSSKYTAGLAGVAFNTPIGAIASDITLSRTTFNHSNVTRKGYSLHTSYSVNIPTTSTNITLAAYRYSSKDFYHLKDALLANHSEFIDDVSIKSAAFYRPKNQFQVSINQELGEKWGNIFLTGTTYNYWEHKGSRNEYQMGYSHFWKKLGYQIGFSQSRDNEQQRRDDRFYVNFTLPLGERVQSPIFSTVLNYNKGEKNSIQTSISGIAGEDNQFSYGISGNSQESGPSGYAMNGGYRSPYVNVTATVGQDTQHNRQMSLGASGAVVAHPYGVTLSNDLSDTFTIIHAKGAQGAVINNAPGSRLDFWGNGIVPYVTPYEKNQISIDPANLDLNVELSATEQEIIPRANSATLVTFNTQTGRSLLFDIRMPDGSTPPMASEVLDDHEQLVGYVAQAGRLFTRGLPKQGQLDVIWGPNHDDKCSFTYHATHNETDMRPQIIPVQCIPHSN

SEQ ID NO: 5513 - protein, 937 aa, Proteus mirabilis
GIIMQNGAMKDWLDSTFLAGENQSYIEEIYEDYLTDPNSVDESWREIFQQLPVSQGAEQSHSQTRDYFRRLAKESTRYHTSVSDPAMDSKQVKVLQLINAFRFRGHQNANLDPLGLWKRESVPDLDPAFHNLTKEDFEETFNVGSFAIGKETMKLGDIYEALKRIYCGSIGAEYMHITNTEEKRWIQQRLESVNVADQFTKEEKIRFLAELTAAEGLERYLGAKFPGAKRFSLEGGDALIPMLKDLIRHAGKQDTREVVLGMAHRGRLNVLVNILGKKPADLFDEFAGIHKEHLGTGDVKYHQGFSSDFATEGAQVHLALAFNPSHLEIVSPVVIGSVRARRDRLDEARSNMVLPITIHGDAAVTGQGVVQETLNMSQARGYEVGGTVRIVINNQVGFTTSNPKDARSTEYCTDIVKMVQAPIFHVNADDPEAVAFVTRLALDFRNTFKRDVMIDLVCYRRHGHNEADEPNATQPLMYQKIKKHPTPRKIYADKLVEQGLIEANDVTELVNLYRDALDRGDCVVEEYRPMGLHSYTWEPYLNHEWNEEYPHKVEKSRLQDLARRVSTVPSEIAMQSRVEKIYADRAVMAEGEKLLDWGAAETLAYATLVDQGITIRLSGEDAGRGTFFHRHAVIHNQTNGSVYVPLANIHNAQGQFNVWDSVLTEEAVLAFEYGYATTEPRGLTIWEAQFGDFANVAQVVIDQFISSGEQKWGRMCGLVMLLPHGYEGQGPEHSSARLERYLQLCAEQNMQVCVPSTPAQVYHMLRRQALRGMRRPLIVMSPKSLLRHPLAVSSLDELADGKFLPVIGELDELNPADVKRVVMCSGKVYYDLLEQRRANGQTDVAIIRIEQLYPFPHDDMAQILAPYAHVKDFIWCQEEPLNQGAWYCSQHNFRDAIPTGATLRYAGRPASASPAVGYTSVHQEQQKALVEDALKVE

SEQ ID NO: 5514 - protein, 1186 aa, Proteus mirabilis
GSIIMKLPVFSISNITSSVKKLFFADKSKIASFLLFLLALLPALLIIWIWWWGPTFRYQDSIPFSEVTTRWLATVVIVLLVVSWIGLATWRRVKKLEALKLDVELAVVDPVRQDLDFQKRYLNYWKSQFIRHLNGHTKAVYLRPWYFVLGANQSGKHSLLKNTVNPLDIAPSDNIVNEQNIALNIQCLLTDNAVLFVPNGDLLTQPANQADKPQLYHRLWGDLLNWIKTNRPRQPMNGIVLTVDTLSLLTNSKEQNSQLLADLQMRIEEIRMTFNSRLPLYIVLTKLDLLRGFDSMYQSLDVQQRNEVLGVSFNQKAKSNWKKELNHFWSQWVGQMNSALPEMMLQRAEGNQRSDLFSFVRQIEGLQHSVCTLIDALLINNEQHNICLRGVYLTSALQIGQIDDVFSQTASEQYHLPTAPLTTWPINDSHPYFTTQLFSQVLFSEPNIAAENHYWVKKHRTRLLVTTAVSFVGLIAIWNGWSHYYDKNYRAGENVLNEVKAFRAIENNAQKDTDGSLQLPVLNPLREATLAYGNHRDKNVLFSDMGLYQGQKVGPQVEQVYLQLLTDRFLPAVMSGLLNELNSADKGSEDKLEILRIMRMLEDKSGRNNGMVEDFMADYWSQLFTGQREKQLQLKAHLRYALEHTDWKQEREKGFVSATKAFMPFAGPIKNAQAELSVLSLYQRVYQALRLKANQELSAPLNLQHQIGPSFNTVFTAIDDDKLEIPQFLTRSGLLNYFIRQNDKLVELTLLDAWVLNLTTNTQYSESDRKEIQRQISEQYLSDYTAQWRNAMSNLEIRQFDSIQDEITALEQIISGEQPLRRALQVLRDNTVIPTIDENLPLDEQKTLMAEPSYRLLTRLDREFTPQTEILVSNQGENLQNLNQKLNDLHRYLLGIQNSPVPGKAALKAVSMRLNDNNRDAIFELSQMAKTLPEPLNRWVDELSVQAWNVVQKEAIRYMEVEWNENVVKQYNTYIAGRYPFNPAAKQDVPLSEFERFFKPNGTLDSFYQQNLRLFVENNLVNDSDSQSLIRADVLAQIEIANRIRETFFNAQGNLEAQYAIEPLSLSGNKRRSILNLDGQLIDYAHSRSHVTHLVWPNSMRSNIESKLTLVPLSGDKSPRSISFSGPWAQMRLVDNAKLINIKSNSFDIRFTIDGGDMTYRVIVDESNNPFFGGLFTKFRLPETLY

SEQ ID NO: 5515 - protein, 502 aa, Proteus mirabilis
SKIMFIEDYFMSLNAEAQEQQAPASTGSLLDEIMAQSRMSPETEAYDIAKQGVAAFISNIFASESEDQQINRLLIDKMLVELDNKLSTQVDEILHAPKFQEIEASWRSLKLLVDRTDFRENIKINILHATKEELLEDFEFSPEIVQSGFYQHVYSSGYGQFGGEPVATVIGNYAFNNTAPDMKLMQYVSTVGAMAHAPFLSSVSPNFFGINSYAELPAIKDLKSVFEGPAHTKWRSLREAEDSRYLGLTAPRFLLRLPYSPTENPVKMFNYSENVKQDHEHYLWGNTAFLLASCINDSFAKYRWCPNIIGPQSGGTVNDLPVHIFEAMGELQTKIPTEVLVTDRREFELAEEGFITLTMRKGSDNAAFFSANSVQKPKVFPNTPEGKLAETNYKLGTQLPYMFIINRLAHYIKVLQREQIGSWKERQDLERELNIWLKQYVADQENPPADVRSKRPLRSAEIKVLDVDGDPGWYQVAIQVRPHFKYMGANFELSLVGRLDKE

SEQ ID NO: 5516 - protein, 456 aa, Proteus mirabilis
AKIMFENLSDRLSRTLRNISGRGRLTEENIKDTLREVRMALLEADVALPVVREFIARVKESAVGHEVNKSLTPGQEFVKIVQNELVNAMGEVNNDLDLSAQPPAVVLMAGLQGAGKTTSVAKLGKFLKEKKKKKVLVVSADVYRPAAIKQLETLAETVGVDFFPSTVQENPVTIASNALKHAQLQFYDVLLVDTAGRLHVDEGMMEEIQLLHKAINPVETLFVVDAMTGQDAANTAKAFNEALPLTGVVLTKVDGDARGGAALSIRHITGKPIKFLGVGEKTEALEPFHPDRIASRILGMGDVLSLIEDIESKVDRAQAEKLATKLKKGDGFDLNDFLDQLKQMKNMGGMASMLSKMPGMSQVPDAVKSQMDDSILVKMEAIISSMTKKERQKPEIIKGSRKRRIAMGSGTQVQDVNRLLKQFDDMQRMMKKMKKGGLAKMMRGMKGMMPPGFPGR

SEQ ID NO: 5517 - protein, 103 aa, Proteus mirabilis
KIVIRRLMMNLRNEAKGRECQIRIPSVCNGNSETVVLAHYRMSGLCGVGIKSHDLFGAWACSACHDEVDRRTRFTDMEYAKQCHLEGVLRTQAILIQEGKLNV

SEQ ID NO: 5518 - protein, 146 aa, Proteus mirabilis
AKVIRSAMNYQFQEGAITLPDEEYQDNSLNMLRFPTRQGSISITRDVVAPEITLNNYLAGQLSAIKREMKNAVVKAPTDFRTEKGVTGCEIYCETKQKGIPIYQWIAAFRLENKIVVLTYCQIKPFSNTEQAQWQALRDSFTPSPN

SEQ ID NO: 5519 - protein, 78 aa, Proteus mirabilis
PFSIYALVIDLMICCISLNVKHLFIYLDINSFCALLVNKPFLSIFISLIKKQLFTLLFISAKVILLIVNKNSAINPNK

SEQ ID NO: 5520 - protein, 63 aa, Proteus mirabilis
YHSIMTLNQTIFINTSSLPLNQQSIKVGLFVTESPYEQTYFLYNLFHYLIYKGLYSERKTSAT

SEQ ID NO: 5521 - protein, 397 aa, Proteus mirabilis
ITSIQWSLMNTSTHPSHSAQAFHIAFSGFLALVVAMGIGRFTFTPQVPLMIADTQLTLTSASIVAAFNYLGYLAGSYDAMKATKGVGYRLWGGLWGAVIITLLSAVLNDALTHSIARFFIGWASGWTLVLVASWANEVLARLNRPALSVAVYAGTGAGIFISGLLAVFILKWQMSATTGWLIYGVLAFICAIYVSYHLPKPWSINREQVKVEPLILTPAMKKLIWGYTFAGFGYILPATFLSQMATERFPGSLVAQFVWPIFGASAALCIGIAILTRNVLNTQLRLAITLWLQALGIIIAEWLPTITGLAIGAFLVGGGLMCAVQLAFLRGKELAPDHARYMAGLLTTFYAIGQLVGPLVSFLSTALTGRLEPALYVAFVILIIGGILVCMKENNKG

SEQ ID NO: 5522 - protein, 247 aa, Proteus mirabilis
RSPIMKKTLSALVISSLLFGANVQAAALNAAQEKEVRALVRDTLVSNPEILEEAIMALQTKKADEQQAQFRQALASEHDALYNDAASPRIGAKDAKLVLVSFTDYNCPYCKRFDPLLEKITEQYPDVAVIIKPLPFKGESSAKASQAVLSVWKEDPKAFLALHQRLMQKKTMLDNASIEDAMKSTNTSKIKLTDDSLKTLQNNLELSRKLGIQGTPATVIGDTILPGAVDYDQLEIIVKEQLAKVKK

SEQ ID NO: 5523 - protein, 252 aa, Proteus mirabilis
PNTMSNSNLFIDNEVHIWIGNLKTMPCLSKAKSRMHILNNDEISSLFDYPFIKQRNIFLLSRVMLRDILSFYLKISPEDVRFSKNEYGKPFILNESKESIYFNLSHSNNCVALAISNTSSVGVDIEYFNRDIEINSIIDYYFSKKEKKYLSYFDETQKKHNFYKMWTLKEAYIKSRGIGLSEEIIKNLDFYIKRDQFDKLYFIEQYYSAHLSYITKSILDSYKISIITYHHPFNYKFLTWGDIKNNLPHHLL

SEQ ID NO: 5524 - protein, 221 aa, Proteus mirabilis
RLTMAYNIPNGSRVYVASKYDDEIKITEATNAEEAVLTVDDVGDIAKGDIVHVTSGWKKASGAFRVASVIESKVTLEGVDTSDKNVFPVGGGTGTLKKVLSWEVMPQVMTLSTEGGEQQTQEVQFLEDEQAETIDTYKNGVVQVYTFAHDAKLPIRKLLTKLDDSKQVTAIRFFNKRAEEDRYYTASISFQRVPNTAINEVENVTARFSLKSEMQIYTNAS

SEQ ID NO: 5525 - protein, 107 aa, Proteus mirabilis
HITMGQFDFLTETTLGEKVSQLNEPPAMYKVILNNDDYTPMDFVVEVLTMYFFLNEEKATQIMLDVHHKGKGVCGVYSADIAETKVAQVNQYARENGHPLLCTLEKA

SEQ ID NO: 5526 - protein, 104 aa, Proteus mirabilis
GLTMPKFTLVPNPTFKANVKIPVAGKEKPEVVTFTFKHHSVSELDGMREKPISEFFEQIIADWAIEEPYNKENLNILLDNYPSASRAISSTYYNELLGNREKNS

SEQ ID NO: 5527 - protein, 237 aa, Proteus mirabilis
DVAMKIQSILNSQFLVSLGISVLTLSTEGMADQSQHQVLKTEQQALEQSLIAENAQEWKLTEKEWQRYEMLKKGKRGLFSPNLDPLTLLGIEARTYEERRYFAELVVRQEFQRVEAELAFQREANQAWLRLYPEILPIQNEMRESRQALFVKESCSICEVKLAQLIKLNQPIDIYLVGSGGKDDVIRNWAKKHHIPIEKVKNRHITLNHDNGIWLKHGNGIMPVVLQQGTQGWQRVD

SEQ ID NO: 5528 - protein, 594 aa, Proteus mirabilis
GEAINMDNTNYTINLSGVEKRFVGLEKPAVASLTATITGGSVTGLVGPDGAGKTTLIRMLAGLLKPDAGEIKILGMDPQKQSVDVRAILGYMPQKFGLYEDLTVLENLNLYADLKNVIGEERKRVYQQLLSFTDLTRFTSRLAGNLSGGMKQKLGLACTLLGSPKVLLLDEPGVGVDPIARRELWQMVHTLAGDGMLILWSTSYLDEAEQCKNILLLNKGELLYSGVPQTLTAKMAGRSFLLNVEGHQRRKVLQQAIIQPQVTDGVIQGQSVRLILKKHSDQTALLNALGKPDAKLIPATPRFEDAFIDLLGGGPSHKSELAEIMPQIPPAPDETVIEAQQLTKMFGQFSATDHVDFQVKRGEIFGLLGPNGAGKSTTFKMMCGLLVPTSGKALVLGMDLKVSSGKARQHLGYMAQKFSLYSNLKVGQNLKFFSGVYGLYGKQQRNKINDMITAFGLQPMINQITDTLPLGYKQRLALACSLMHEPDILFLDEPTSGVDPLTRREFWLHINGMVDKGVTVMVTTHFMDEAEYCDRIGLVYRGKIIAAGEPDSLKQMVATEENPTPSMEDAFIGLVLDYDKKLEQENHQGSEKHE

SEQ ID NO: 5529 - protein, 166 aa, Proteus mirabilis
YRQINREHIMYQDYLNTPKGFPKPYISITADDDGITSLNFVSEKEALVNSNAIIDLCIKQLKEYFSGKRTLFSVPLAPKGTEFQIRVWQTLQSIPYGEIWSYKKLALTLGSVNYCRAVGMANSRNPISLIIPCHRVIGHNGKLVGYTGGLDIKRWLLHYEKVDIDE

SEQ ID NO: 5530 - protein, 329 aa, Proteus mirabilis
SDKMFTIPIDKKCKLEIINTLATMESELFKNISPLEFFDSILNLRILASEDPRYQDAYGDLNQHYINNNDWTLEYILLERFDFLKSDELFTLLLNTLVSPSIMKIGVNEISYIYNKLNPILIIYNIEYQLNGHDENNIPIYELSNFNNDDEFKDIKNNNIPFIIKNNKNKENEYFKLIEINWNDFGRYNKFLLSYYKNQKEYIIGDLKIISKEDISTTNEIKNNFFKLDNKHCSLGQKFEYYENIFKGNALSILKALNDVAFFTKIQESFEHLSQFKDSLIRYDEQEQLLRQARHRIRKYDLSQLYSFEYIFKPDYIDDEDKLKLTFNF

SEQ ID NO: 5531 - protein, 112 aa, Proteus mirabilis
EGKIMAKQRSRRLRKKMRIDEFQELGFSVKWTFPENTPIEEVDSFVDDFILNVIEPNGLAFDASGYLSWEGLICLQKIGKCTEEHRQLVENYLKEKNMQDVQTSELFDVWWD

SEQ ID NO: 5532 - protein, 279 aa, Proteus mirabilis
GVKMNNIERHACFGGWQEVYQHTSTTLNCEMKFAIYLPPMEDGQKYPVLYWLSGLTCNEQNFITKAGAQQYAAQHGVILVVPDTSPRGENVADNSAYDLGQGASFYLNATQAPWNSHYKMYDYIVNELPKLIETHFPANEQRAISGHSMGGHGALMIGLRNLSRYCSISAFSPIVAPTQVPWGQKAFSAYLGDDMAQWQQYDTIELLNKTQQTVPIRVDVGLDDPFYQQQLQPERLAQVCDKKQFACCLNLHQGYDHSYYFVASFIGEHIAFHAKHLKA

SEQ ID NO: 5533 - protein, 236 aa, Proteus mirabilis
EEKMLILMNIWWSLPLTLIIFYLARKLAARFKWPILNPLLIAIVVIIPILLVTHTAYEDYFAGSRILNDLLQPAVVALAIPLYQQLHQIRAQWKSLISICFIGSIAAMASGTAIALWAGATPEIAASILPKSVTTPIAMAVADSIGGIPAISAACVIAVGILGAIFGHTLFKILRIPTHASRGLAMGTVSHAVGTARAAEIDYIEGAYSSLALMTCGIITSLIAPFIFPFILHLFS

SEQ ID NO: 5534 - protein, 378 aa, Proteus mirabilis
ITKMRGAGMSDKSPEQTTPEILKEKVSGVLSTFEHPTLKRNLLSLKALHQCAMIDDVLHIELVMPFVWKKPFQQLIEEKTAELRNMTGAKAVEWKLKHNIATLRRANDLPGINGVRNILAVSSGKGGVGKSSTAVNLALALAQEGAKVGILDADIYGPSIPNMLGTTMERPTSPDGQHMAPIMAYGLASNSIGYLVTDDNAMVWRGPMASKALMQMLQDTLWPDLDYLVIDMPPGTGDIQLTLSQNIPVTGAVVVTTPQDIALVDAMKGIVMFKKVNVPVLGIIENMSAHICSNCGHLEPIFGTGGAEKLAEKYHCQLLGQIPLHISLREDLDRGQPTVMRDPEGEFADIYREIASTVSAQMYWDGDAIPTEISFRAV

SEQ ID NO: 5535 - protein, 60 aa, Proteus mirabilis
EKKMKKLIIFILSSLFAFYASAYTWDNKIKDTSTVNQYCQHNSNTQQSTRCVWPPCDDEW

SEQ ID NO: 5536 - protein, 741 aa, Proteus mirabilis
KTEIFLLNISARIFYQKKVLKMKNYKIAVSYDMSDYISTHRECVDILHTDFSDVAVIVISLNDIQNGKLNLIEQNSFEQPIFAIINKDEVIPANIINRLTGVIDLNKKNSELYNKQLETAALKYEESLLPPFFGSLKKYVEQGNSAFDCPGHQGGEFFRRHPLGNQFVEYFGENLFRSDLCNADVSMGDLLIHEGAPCAAQQHAAKVFNADKTYFVLNGTSSSNKVVLNALLAPDDLVLFDRNNHKSNHHGALIQAGATPVYLEAARNPFGFIGGIDAHCFEEKYLRELIKEVAPTRANEKRPFRLAVIQLGTYDGTIYNARQVVDKIGHLCDYILFDSAWVGYEQFIPMMKDCSPLLLELNENDPGILVTQSVHKQQAGFSQTSQIHKKDRHIKGQKRYVNHKRLNNAFMMHASTSPFYPLFAALDVNAKMHEGESGKRLWMNCVKTGIETRKLLLQSCKHIRPFIPETIDGRAWEDFDTDEIANDLRFFNFVPGERWHSFEGYEENQYFVDPCKLLLTTPGINAKTGKYESFGVPATILANYLRENNIIPEKCDLNSILFLLTPAESMAKMQHLVAQIARFEQLLEQDAPLKEVLPSVYHANQTRYQGYTIRQLCQEMHDMYVKFNVKQLQKEMFRKSHFPQVSMLPQEANIAFVRGEVELVAVEKIEGRIAAEGALPYPPGVLCVVPGEIWGGSVQQYFLALEEGINLFPGFSPELQGVYIRNDEDGRLRAYGYVIKH

SEQ ID NO: 5537 - protein, 234 aa, Proteus mirabilis
MNEITTLAGATVTTVTLAISALIIGLVLAMLFTAWESAKWKAFAFLGTCWVTLIRGLPEMLVVLFVYYGTLQGVMMLMDGIELGPFTLQFDFGDTESLPFYCGVIALSLLYASYASQTLRGALKAVPTGQWEAGQALGMGKITIFFRFIMPQMWRHALPGLGNQWLVLLKDTALVSLISVNDLMLQTQSIANRTQEPFTWYSIVALIYLAITLVSQYILKWLEMRTTRFERSAS

SEQ ID NO: 5538 - protein, 2037 aa, Proteus mirabilis
GIEMKILSDINNIKELCSKQINIDKNKFSDKDNLIKLGLDSIGFMQCLYIFQKNGYAITLKDLYLNPTIKGWYKILKKSDINKKERKDNIYTHKTIKNAGEFSLTPIQHAYFVGRLNKQTLGGVACQIYQEFDGIPKFTPESLEKALVLLSKRHPMLNIVFHQQGTQFWSPNLNRKYVTYHDFSKLPKDEYEKKLLQLREELSHQVLNVESGQLIDFHMISLPNNRYRLCTNIDMLIADGTSYSLLFTELCLLLSGEILPQLDEHYDFYHYLQDKKQYENKESAYQYWKNKIPNLPDSPLLPLYMDPEKINKIKTKRLSWTFSSKEWKNFSNLAKENNITPSIALATCFSSVLARWTGQNSLLLNFTLFDRKPLAPAVNNIIADFTNVILLEMKTDNRPLISLSKDNQNTFIEAWQHSDYSGIDIIRDLRKNGTHPYGCPVVFTSHINQPLIDKNIESVLGSIGWGISQTPQVWLDHMAINKSGNIVLQWDYNNDLFRNDVITTIFDVYISRIRQLANDPNAWIETQPDLIPKKQLKNRISVIKKDNSLLPHTLHKSIFHNYSNSSKIAVIDIDSQEWSYKKLLSKATILSDQIIQQGYKPEDRIGVCMPKGVGQIISVLAILLMGGTYVPIDVLQPEERINRIAKNAQLSLLIVSDSDPSYSIYATFCNRIVWQKVQPSENKPLHNIDISPHQAAYVIYTSGSTGEPKGVVVSHASAMNTCLDLNRRYNISDKDRVLAISALHFDLSVYDIFGVLNAGGTLVLVKEDERRNPDAWLRLINQHKITLWNSVPALFDMLLTYAEGIGSSIPQSLLLIYLSGDWIGLDLPTRYYTFCPDGQIVAMGGATEAAIWSNYFNVTTLDPSWSSIPYGYPLSNQRYRIVNARGEDCPDWVSGELWIGGAGVALGYLNDPEKTAQQFVKQNGENWYKTGDMGRYLPGGILEFLGRRDRQVKIGGYRIEPGEIDAAFNKLQGVQNAITLCLGNGNKEKALHSFVILNSGNYQNIISSNSTFSPLYYLRSTPINVQQQSQETAIIAGFLYDYLTEQNIDFDNLLSEKKSADNHGIIASYQSLMANWLNLIAQYPQTTLNSPPTNSTQRTLIENLQRHKNNLTDILKGKKSALTLFDDPYWSPEQVTMRIDGMHYSLENLLQQIRELHHSLKRPIKIIQLGARSGISANYILQRLPNNMVTLLLTDESLSMVTQANQNLSDYQNSYAEPLTEVFLHKNRYSADIIWMNNYLHRLDSPQKEIQKFVSLCAPSGMIFIQEVLHAPAQSLISISLLQQNGSDPADELLTAKKCKDIFSASTATYKSEGVNGEILTQLYQAPEKIYLPDKNKLEHDLRQFLPDYMIPKHIYFLTEFPLTANGKIDNQSLKLYCQEYQEEYLNQQPINGKEQIIITIWQKLLGTNKIHRHSHFFREGGDSLVAIRLISDLNHIGYQVELEHIFAYPILSDFAQNIKQSEVFEKQPAISHNEAYRYNPFPLTDIQQAYLVGRQNNFTLGGVGTHFFVHFIAENLDVPKLERTINQLISRHDMLRGVIINGQQQVLKKVPYYSVKTHYIPTEKSDAFLVLRAQLANIVYDPENWPLFAIQVIKTKEQPDHIFISLDNLFLDGMSMQIFFSELKTLYMEPNHQFIPLDITFRDYIDCDAYPINTQNDWEYWLTRLPQLPPAPQLPLIKDPAQIVQPRFSRLQTSLSTSVWQALQQVAQQNNVTPAALLIAAYCATLSAWSKSPELTINLTLFNRHPVHPQINEVLGDFTSLQLLDWYTCDLWSNSISMMQKRLHKDMQHRSVSAIKVMREMAIQRQMSHIEIPVVFTCALGYKHDEGFLSHHSWLKPVWGISQTPQTWLDHQVYESDGELYLNWDFVEQLFDYTTIFSMFQQYEHILTKLATEPQSWQLPLNKLIPRCNNLVITPVFNAKNNQNTHYKQSTDTQKTGQTIQKLQQLVKQVIGITLAPETNFFEAGASSLQLVQLHAALQKNGYSHITITDLFASPNLSTLAQLLWQNTSPTCEQYSDRDKHKNKRKKRLQLRTHSR

SEQ ID NO: 5539 - protein, 303 aa, Proteus mirabilis
GIEMLSGLLIILLPLFIGYLIKLNNRPLLQLANRLLSAMVYVILFLMGVSLAMLDNIGENLFSILAYASVFFICTFGANLLFLWLLDKKDPWHVPAHKQAKPPSRIKMVLESLQLCGVVVVGFFVGLTGWSIFGYASQASQGALIFLLWLVGLQLRNSGMSPKQILINRRGTTIAIVMAISALAGGALAAYLLGLPTKMGLAIASGYGWYSLSGIVLTDAFGPVIGSTAFFNDLMRELAAIMLIPIIVNRYRNTALGICGSTSMDFTLPVLQRSGGVAIVPAAIVHGFVLSLVTPILMAFFTS

SEQ ID NO: 5540 - protein, 459 aa, Proteus mirabilis
TREISTVMLSKLKLAKHQQHLAQLPKLAQSVADVETLYQTSAFRSTLLKYIAQAQKEIFITALYLEHDEAGEEILEALYTAKQQRPELSITVIVDWHRAQRGRIGVSADATNADWYHKVAQQHPDVDVPIYGIPVNTREALGVLHLKGFIFDDTVIYSGASINNVYLHKLDKYRYDRYHIIHNAELANTMKQFIVDSLLQSDAIQRLDSEERVRCAEIKNCIRQFRFNLRTHDGYDIKGNASNNQLTVTPLVGLGKKNILNKTISHLMAVTEEKLVICTPYFNLPAILVRQISHLLRNGKQVEIIIGDKTANDFYIPPEEPFKIIGALPYLYEINLRKFTQRFQRFIDNDQLTVRLWKDGDNTYHLKGMWVDDEWQLITGNNLNPRAWGLDLENAILIHDPHHELHEQRHKELACIREKTLIVKSYQQLESIKFYPLKVKKLIKRLRRIRVDRLISRIL

SEQ ID NO: 5541 - protein, 79 aa, Proteus mirabilis
YGRISRWRRASMNHEQFIEQNVLAELKKLGFSLPVCRRASYMAVDHYRRSSQASRKGRMFDDCLHIAKVWASKFAKEKV

SEQ ID NO: 5542 - protein, 79 aa, Proteus mirabilis
FSRIDTTIALLFVIREEMPTLAFRIYHDKEVIMFELLKSLGFALLMVPVVMVLIMGIIYGLGEIFNLISPSQSKADKKA

SEQ ID NO: 5543 - protein, 180 aa, Proteus mirabilis
CIRIMYGKQIKEQLEMQLNKVFKGLMLALPLVAVAACSSNKNDDQTDTSNNVPVTEQGPTAEELARQQLEQLKQTNIVYFGFDKYDVTSEYAQLLDAHAAFLRANPSVRITIEGHADERGTPEYNIALGERRANAVKMYLQGKGVSADQLSIVSYGKEKPAVLGHDEAAYAKNRRAVLVY

SEQ ID NO: 5544 - protein, 101 aa, Proteus mirabilis
GGRIMILFRKLKAVVSPVSACTLTTFSATPALADGFQRANTVMQKVSTGLHGLAAITITVAVIWIGYKTLWKGESLSQCGYIIIGGILIGGGSEIGALLMS

SEQ ID NO: 5545 - protein, 259 aa, Proteus mirabilis
LFLIKNKEIFGFTLEPEGFQNYNLRERNIYILLRYSSFLFQTRFFIMADTAHQCTIVGIAGASASGKSLIASTLYRELRAQVGDHNIGVIPEDCYYRDQSDLTMEERYKVNYDHPNSMDHALLYQHLCELKAGNAIELPQYDYVAHTRKSETIHFKPKKVIIIEGILLLTDKRLREEMDFSIFVDTPLDICLMRRIKRDVNERGRSLDSVIEQYNKTVRPMFFQFIEPSKQYADIIVPRGGKNRVAIDILKAKIGQFCE

SEQ ID NO: 5546 - protein, 168 aa, Proteus mirabilis
ESLMSLTIFEQLTTLLNNHHARYRVMEHPTAGRSEEVAKIRGTQLGQGAKGLVCHVKGNGIKQHVLAILPADKQADLSKLAIAIGGTRASLASPKEVDELTQCVFGAIPPFSFHPALKLVADPLLFERFDELAFNAGTLERSIILNTQDYQRIAQPELIHFIRQDDND

SEQ ID NO: 5547 - protein, 67 aa, Proteus mirabilis
NCLIVGKHTLIYLYFRMLLMCCMVLFKSVCYYSVRYCAITAIIKGRHDEAGIKCYFRTFDIMRYNAR

SEQ ID NO: 5548 - protein, 247 aa, Proteus mirabilis
RVMIIPALDLIDGKVVRLHQGDYNKQRDYDDDPIRRYQQYQQDGAKLLHLVDLTGAKDPLARQIPLLKQLVACVNVPVQVGGGIRSEEDVKSLLAAGASRVVIGSTAVSQPELVKTWFERYGADAIVLALDVRIDEQGKKWVAVSGWQENSPYTLEEIIALYQPVGLKHVLCTDISRDGTLAGSNVELYKEISQRFPDILFQASGGIGDLQDIAALPGSGVAGIIVGRALLEGKFTLQEAISCWQNA

SEQ ID NO: 5549 - protein, 292 aa, Proteus mirabilis
SYMIKIFIAISFLFYSVFVMASPKIIAHRGGTADAPENTEIAIKTALSNQADAIWITVQLSKDNVPVLYRPSDLKSLTNGQGAISTFTAKELAQWDAGYKYGEAQQFPYRNKGVTIPTLEYILTQFPKTQFYIDLKSPDADPVIQGKALASVLSKHNALERTRVYSTNSAFLDALPDNVQRFESRDVTRDILANITMGHICLLPENLDITRWYGLELHRKVEVVEKYTLGEARSAAVLSWDKDAMSCFRAGGNAHIVLFGINTEKDYLQAVELGADAVMVDSPAKIKAFRKE

SEQ ID NO: 5550 - protein, 237 aa, Proteus mirabilis
CHMMRRNMPLFQLDEHDVTFPAPHLALKEPSGLLAIGGDISPARLKEAYQTGIFPWYTPHETPLWWSPDPRAVLPAGTLHIGRTLRKFLRQAPYTITLNQAFSDVIEACSVRDEGTWIGPDIKTGYRALHQQGEAHSVEVWEGDELIGGLYGVNVGAVFCGESMFSRRNNASKCAFVAFYNHFLRYGGQLFDCQVLNSHTAALGAIEIARDRYLEALSRWKKVIIDKKCWYQQSLEL

SEQ ID NO: 5551 - protein, 440 aa, Proteus mirabilis
GEMMKTAFNTLNFWDKCTQQQQQQLLTRPAISASASITEQVATIISQVRNDGDKALKALSQKYDKAAPDSVLVTKTQIDVACARLNNEIKQAIAQAMSNIRRFHEAQIPKTIEVETQPGVFCQQVSRPIDAVGLYIPGGSAPLLSTVMMLGLPARIAGCRKIILCSPPPIADEILYIAQQIGIDEIFQVGGAQAIAAMAFGTESIPKVDKIFGPGNAYVTEAKRQVSQSLQGAAIDMPAGPSEVLVIADADAHPAFIAADLLSQAEHGPDSQVVLLTPDEALAKAVISETQAQLTQLTRAEIAQQALAESRVIITRDLNQCIEISNRYGPEHLIIQTNDADSLVDSITSAGSVFLGAWSPESAGDYASGTNHVLPTYGYTATYSSLGLADFMKRMTIQKLTAQGLADLANTIEILAQAEQLTAHKNAVTLRVNALAQGDN

SEQ ID NO: 5552 - protein, 76 aa, Proteus mirabilis
GGVMNPYHELDAREERKQEEASWIDAKDAELSNVAFNVVDGLPKDITSQWSDSVFDMTIDGLYKELKNYQERRRMS

SEQ ID NO: 5553 - protein, 108 aa, Proteus mirabilis
CKVMNGDNMEKPSKRDMKTLSDMPKPIIIIELIGIVLLVIAYLYINQYMTSPEWLTTYTGQLTLVVLGVLCMIPPAIHIVWRAIYRLTFLGIDTKATENKKKKPHNEK

SEQ ID NO: 5554 - protein, 88 aa, Proteus mirabilis
VEVIMQISYSYSNGTRVVDGKTVMEFDKSSKLSIEAGSFAELAKLTEIDPVEALQWIMQFDKEEFDRIVNEASKDAPISKLALLRRVA

SEQ ID NO: 5555 - protein, 89 aa, Proteus mirabilis
RSAFGNAETGAAWLSSARVVKCWVKSRNERNPYPLLPARDGGNSKETAGDKPEEGGDDVKSSWPLRVGLHTCYNGRYKEKRPRESKRNS

SEQ ID NO: 5556 - protein, 151 aa, Proteus mirabilis
TNTIYGYGVCKTMSSRRCFENASHIDPRREVERVKVFNIEPVPKPRMTQADKWKKRPPVLKYFAFKDEVKLNKITLPESHYHITFILPMPKSWSKTKRSEMNGKPHQQKPDKDNLEKALLDAIFDDDSRVWDGRVTKVWGKRGQIIIQEVR

SEQ ID NO: 5557 - protein, 258 aa, Proteus mirabilis
ERAMCELLGMSANVPTDINFSLSGLIPRGGKTGPHKDGWGITFYEGLGCRTFKDPQASAVSPVARFVQEYPIKSHAVIAHIRQANRGNVSLENTHPFTRELWGKNWTYAHNGQLKGYQSLDTGRFRAVGQTDSEKAFCWILNQLEKRYQRTPSNWPAVFRFIAILADQLRQKGVFNMLLSDGRFVMAYCSTNLHWITRKAPFGKAKLLDQDIEIDFQQHTKADDIVSVISTLPLTGNESWQKIPVGEFVLFDRGLRIL

SEQ ID NO: 5558 - protein, 94 aa, Proteus mirabilis
EIEMEIWFKEFESHGRQILIKKAHNADESKIGVQYCWPEKLFEVDFGLWIDYDDDDEEGCNKAEEARNKLFDTIDQEAVDTTVSNLIQKLKLDD

SEQ ID NO: 5559 - protein, 87 aa, Proteus mirabilis
RSWIKDHPKSAGSEVGISYPIPEYSMKLIHDFYLYILSIANYGLARVHDQLHAKQLYNDMYLADIYYFLVFQLEYWFFLLSEQYHYL

SEQ ID NO: 5560 - protein, 332 aa, Proteus mirabilis
GERMKQVVYVASPESHQIHAYTLNSAGEMHLLQVVEVAGQVQPMVASADGKHLYVGIRPHFSVVTFEIAPDGQLEQKAITAIPSAPVHLCLDKTERFLFVPSYHQGNLAVLPINQQGIAQAPIQLIEGLNKPHSSNIDWHNKQLIVPCLGEDHIRLFNLSEEGHLSEARSEELTTAINAGPRHLAFNPNGEVFYCLNELDATINVYRRMGDLYRLMQTIDIVPETFNSTRWAADIHITPDGRFLYASERSESLISVMAVSEAGDHLQPVGHYTTQTQPRGFNLDNTGNYLISCGQKSDFVSVSRIDRQTGALTELACYPVGKGAMWVTVVTK

SEQ ID NO: 5561 - protein, 292 aa, Proteus mirabilis
EDGMKKLLLGVALLLIGSNAIAEWEYKKHFDEMRGSESYTASLQSMPINKDIDNELLLLLSSDNNSTSSLAGLHLLSGRFDCDNPNLCKIAVRYGNGAVKSVFVRLNDERNLAFFINSNEVAETLRLSDVMYVEIPIFRKGSAQYKYDTSGFKWTGIEKTGEYLTSLGSIDFTKELPNIPSNTYKNDRGSVCYDINDFSFGIKVKAVGKASVCIDGKFPIYVEVSNVKVNKNDFVKEVNLARKADEDTEGNTHMWLASDDEFLTMILLTKPNKNGYEIFMDYSPRINIYSQK

SEQ ID NO: 5562 - protein, 63 aa, Proteus mirabilis
ISVFKVSPVFSPNPQSNLMPKTNGDVLKLTGFGGLPIFPVNIVSCALAQTLDISDAFIARTLT

SEQ ID NO: 5563 - protein, 311 aa, Proteus mirabilis
KLYLYAILTQCFINPLVFTRFLLSVADISLNLGRFMLFLLKKYLGSLIMPLPLLLIIAFFALILLWFTRWQKTGKSVLTIVIVLLTLLGMQPVADTLLMPSEKAYQARYELRENSPQDVNYIVVLGGGFTYNPEWAPSANLLNNSLFRVAEGVRLYYRYPNASLIFTGGAGVNKISSAEVAAQVAQSLGVPAEKTIALSQPKDTEEEAYEVDKLIGKQPFLLVTSANHLARAERFFLARGMHPIVAPANQLAITTPLHPWEKYTPSAYYFQHSERAWYEFIGSIWQTIKPSEPSSVEAVVENKNEADNGIK

SEQ ID NO: 5564 - protein, 373 aa, Proteus mirabilis
GRVFMFHRLLTLIMKELQSLLQEPQTRIILILPVIFQMILFPFAATLDVTNASVAIFDEDNGKQSIELTQRIAKASAFSETLLLKSEHEIKETINNRKALLLVRFPQNFSANLASHTPVKLQLILDGRNSNSAQIAANYVQQIVQNYQTELAGDTPSLLNKSELVVRNWYNPNLNYKWFIVPSLVALIITIGVMIVTSLSVAREREQGTLDQLLVSPLSTWQIFVGKAVPAMVVAAVQGTIVLIIGIFGYQIPFSGSLLLFYFTMLIYGLSLVGFGLLISALSSTQQQAFIGVFVFMMPAVLLSGYISPVENMPVWLQQATWINPIRHFTDITKQIYLKNADITVIWHSLWALIVIAIGTGSIAYYLFRRKIV

SEQ ID NO: 5565 - protein, 325 aa, Proteus mirabilis
VFHLNRAKFMKKILALVTASLLSVSSFSALSNTSVTYQPNQIVEQQNDKVVIKHLLGETAVSKNPSKVVLFDFGLYDSLVALGLADKVVGLPLGNAPEYIKGRIANDVANVGGMKAPDFERLAELKPDLIIITGRQGASYEKLTNIAPTINLGTNSANYLDSVEANIQLIGELFDKQQATQTQLATLNTVIEQAQKKAAGSDKKVLVLLHNAGNLMPNNQSVIYDVVKAKKAELPPVAEEEKGKRRVVTSEMIAKVNPDVIFIIDRSEAIGAGKLEKNTFENDEVKTTSAYKNGGIVYLQSDLWYLSGGGLESLTQQIEAVQSAL

SEQ ID NO: 5566 - protein, 106 aa, Proteus mirabilis
KQHLNAVLPLQCLIDLTHHYTEIRIKNSKTLNTGLRAFFFTFAYAFLSSPTPLYTGENHDITSVITPETGRRKNRSETLANLSVYERGHFSPFNKGWPCQRSLARI

SEQ ID NO: 5567 - protein, 103 aa, Proteus mirabilis
QKNLKVNGDMSFFNDLKASLEEAVEIKNGDKKASKVTRFEVADVKAIREQLNVSQSEFAHALGTSIDTVKSWELKRRNPTGLTAKVLIAIHKNPNLFKELANI

SEQ ID NO: 5568 - protein, 66 aa, Proteus mirabilis
LTLVRDKMDHRLLEIIACPVCHGKLIFDKENSELICKIDHLAYPVRDNIPVLLENEARELSLEEEK

SEQ ID NO: 5569 - protein, 84 aa, Proteus mirabilis
SHIVCNIGINKEDTHMNNIAEQRKKLGISQAVLASSIGWGQSRIANYELNIRTPSLNDCRAIVEALQKLGANCSLDDVFPPKVA

SEQ ID NO: 5570 - protein, 176 aa, Proteus mirabilis; identical to SEQ ID NO: 4846

SEQ ID NO: 5571 - protein, 114 aa, Proteus mirabilis
KGNLMSHAIEFIETSIFTQQIKLLATDKEIRILQNELISKPDKGDLIKGTGGLRKIRMAVGNKGKSGGTRVIYFLATKEVIYLVMAYPKAIKISLTDSEKIELKKLTKKLKGER

SEQ ID NO: 5572 - protein, 65 aa, Proteus mirabilis
LQVVALLTEFLSPLLSLLLSPYSLNYLEYLAVSYLTSSCRVVDCVSISIAIAIFVSLFIAIFIDI

SEQ ID NO: 5573 - protein, 469 aa, Proteus mirabilis
EISVLTDFTSLGLSEALLRAIDEQGYKTPTPIQQQAIEPILAGKDVLASAQTGTGKTAAFTLPILEKLATSAEKTKGRKPVKALILTPTRELAAQIADNIKAYSRYLPIRSLVVFGGVSINPQMMKLRGGVDVLIATPGRLLDLEHQNAVDLSRVEVLVLDEADRMLDMGFIHDIRRVINKLPKKRQNLLFSATFSKEITGLANSLLNNPISIAVAPKNSAAESVDQYVHLVDKKRKTELLSHLIGLENWPQVLIFTRTKHGANKLAEHLNLDGIKSAAIHGNKSQGARTRALADFKDGKLKALVATDIAARGLDIDQLPYVVNFELPQVAEDYVHRIGRTGRAAATGKAISLVCVDEHGLLADIERLLKREIPRLALEGYDPDPSIKAAPLHKKPKNKARNNKEGGHGRADMRGKDNRHTPRNKNSRNQKESETGEIKQNKSKPARRSRKHDDDRDNQNPWSKARKEF

SEQ ID NO: 5574 - protein, 70 aa, Proteus mirabilis
LPSVFWYLIFIKKITHHESTKIHKTIFPKKIKKHKLNYVEVKYKLQLYFIYHYAFLGTSATLRVYNLKCV

SEQ ID NO: 5575 - protein, 391 aa, Proteus mirabilis
RGTVMSWQNYLDKRLNERRNTPLWRKRQVIQYSNGRYLTTLSGDKYVNFSGNDYLGISQHPDVIQAWQRGANEYGIGSGGSGHITGFTQAHQQLEQQLADWLGYDHALLFSSGYSANQGVIATLLEKEDAIIADKLCHASLMEAAILSPASLWRFLHNSAPSLSQRLHKTSANKSLVVTEGVFSMDGDKAPLAAMAEISQQHQAWLMVDDAHGIGVLGKEGKGSCHEAGIKPELLIATFGKAFGISGAAVLCNKATAEFFEQYSRHLIYSTSMPPAQAVALHAALKVIKQDDEGREYLQQLISFFRQGVSSLPVTLLPSQTAIQPLIIGDELRCQQLSDYLQREGFWVKAIFPPTVPPHSARLRITLTTRHQISDIAMLIELLHGFFNQNR

SEQ ID NO: 5576 - protein, 74 aa, Proteus mirabilis
FLAVFHPFTFCFFKADKRAIADRQEQAVAPEQTDRSVVKTADFICIRVAGIFMKIVGKRIAVVMDIESNGHTFE

SEQ ID NO: 5577 - protein, 113 aa, Proteus mirabilis
LLNVKGCNGCRIFFWCYDKCIKPCRLHVSHDGREAMTVKQRNTQSVTMTVERALLVRAREVGINLSATLTAALDAEVRHHEAKKWQEENRETIEALNRFHDEHGCFSDEYRTF

SEQ ID NO: 5578 - protein, 156 aa, Proteus mirabilis
PHDVRPCLANLRAPPLLFRRRPPQSNYPPDTVPDPVYGPRLEHQTLKGGISRLAPCRLASTLQSLPPILHIKAQCSVSSYSKGSRGLSVLPRVHCIFTASSISLSLGWRQPGHHYAIRAGRNLPDKEFRYLRTVIVTAAVYWGFDQELRLTADPIN

SEQ ID NO: 5579 - protein, 376 aa, Proteus mirabilis
SYFVWRTSAFLRCGVNVRPDIDEILFNSIHGNSGDNKMNMEKLIIYSVKHNASDLHLCCGDVPRLRINGVLYQQNQCKPITSDTLLKWITPYLTTAQLQFFGKEGQVDTAITLAEGQRLRVNLFRQQLGISAVLRVINSQLPTLTSLRVPKSITALLDNVSNGLILVTGATGSGKSSTLAAMIDYLNQHKRQHILTLEAPIEFIYTNKQSIIQQREIGRDVQNIASAIKAALRQDPDVIMLGELRDLESIKMALIAAETGHLVLATLHTQGVVQTLERVTNVFSSNERQWISAQLAGSLKAIISQQLVPATQGGRVALFEVMYMTQGIAHLIREGKYHQVTTLMQTGFEYGMQTFTLSRQQRQYEGLLNEHINEEN

SEQ ID NO: 5580 - protein, 471 aa, Proteus mirabilis
TIFVNLSYPIGRRIAMSYRYQIAIIFLLGFFIDCINIFMSAIALPAIAADMKVSIVSITWVSNSYILGLTLIIPLSHWLSQRFGVRVLMVSSMLIFSASVALVGYSHSFFELILWRFIQGLSGGLLIPIGQALTFQYFQGHERSKVSTLIMAVALIAPAISPIIGGFIVDAVSWRWVFYSNVPFSLLTAFLAFIWVKESKSQENIIPDLKGILLISIIIVSGLCALSAYGEYHSTQLALVISFFAALFSLLYYRHYKQSLSPVINLNLLKNRNLSLSIFLYYCIPGVFTGVNILAIFYLQQYLHFSGQGTGSFMLLYAIGAFISIIVGGALYNKLGMKRLAIFALILHSIGIVLLALVNKENDLPLLILAYLMMGIGGGIGANTAQTTALYDFDKQRLIQASVIWNINRQVVFSVGATLVAMIFNTLSLFVSSQMAYSTTFFICATIGLFPLFLFILLKQKTNLQETNHEH

SEQ ID NO: 5581 - protein, 217 aa, Proteus mirabilis
KKFVKERSMADTKEIKRVLLGPLLDNNPIALQVLGVCSALAVTTKLETALVMTIAVTLVTAFSNFFISLIRNYIPSSVRIIVQMAIIASLVIVVDQVLQAYAYEISKQLSVFVGLIITNCIVMGRAEAYAMKSPPIESFMDGIGNGLGYGVILILVGFLRELFGSGKLFGITVMESIQNGGWYQPNGLFLLAPSAFFIIGLLIWGLRTLKPAQVEED

SEQ ID NO: 5582 - protein, 304 aa, Proteus mirabilis
YLFLMTSPLVLAPLLRLTFVLGEQAQRKQILKHISMILELSEHKQHDKHFTLPKNSDITFKDVCLDHGDKTILEKISFNAQAGTTTAIVGHSGAGKSSLLKLIPRFYDCTSGQIKIGQYDINYWPEIDLLSQISVVFQDVYLFHGTILENLLIANPNALFEDIIKATKAANIHHVIEKLPAGYNTLIGEQGNKLSGGEKQRLSIARALLKNSPILLLDEITANVDAENEILIYRALKSLCQNRTVIMITHNLHTIINADKIIVLDNGKIIDTGTHTHLLNPCPTYKKLWDDYSHTIHWQLIQEN

SEQ ID NO: 5583 - protein, 285 aa, Proteus mirabilis
RIIVLCRHKKCDKQTNQKKPIIMQAEILLTLKLQDKLFADPRRVALLKQIKATGSISQGAKMAGISYKSAWDAINEMNQLADELLVDRATGGKGGGGATLTHYCERLLQLYDLLGQIQQKAFDVLKDDSLPLDSLLAAISRFSLQTSARNQFFGTIIERDHLQVQQHVNVQLADQKTVIRAALTEKSADRLNLKEGKEVLVLIKAPWVNIEKGASVAQQYDNALSGTLTQIETGNENSELVVTLEGGLEVCATCSNQHVTQQKLHINDTVTALFNADQVIIATLC

SEQ ID NO: 5584 - protein, 311 aa, Proteus mirabilis
EDVVTNAVQRIYEVVNPLKNEFEQVCSEPSIAFKRESEFAMQIFANNDYLANVAVNNLVSVRSAIMNVSAIGISLNPAQKLAYLVPRDKKVCLDISYMGLMHIAQQSQAIKWCQSSIVRQNDNFQLTSIDTAPRHEYNAFATQEQRGEIVGAYTVVKTEDGDYLTHTMAIADIYAIRDRSTAWKAWISKKKSCPWVTDEEQMILKTVVKQAAKYWPRRERLDKAIDYVNTEAGEGIDFGNEQQEPRDITPASEDQLKAITDLMLKVNGEWSDAFFTFISKKFNHQISSPEQLTAFEANTIIDMLRKKAEGK

SEQ ID NO: 5585 - protein, 69 aa, Proteus mirabilis
LLFLVTSLARALTSSDALPIATPKPTCSNILKSLKLSPNAITSLIFMPLASTQRCKRRPLLLPFLAIST

SEQ ID NO: 5586 - protein, 69 aa, Proteus mirabilis
ITPVAEAPALFTVSVTAVALLDVPVMVATTFSIPSALNAFWLASIVGSTINETLLDPAGITTVTVEAPS

SEQ ID NO: 5587 - protein, 603 aa, Proteus mirabilis
IITVDISLNSINMSSKSYFTNESEYLNELTEQVAKEKPQLVNLLSHNVKDPDTSRIMDGLSYLSGNLRQQIDRQFPELTNSLANMLWPNYARPVPSMTIVEYHPNYAQCQHATKISAGQPFSAAPLYVQSEETNHETLFQCRFSQSRDLWLMPTKISNILQQTTAIEITFELATKQPLANIGLDKLCFYLNGAPFTTNQLYFLLSQHVQSASLVTDVHTLPLTHFSVTPVGFQKQDALLPYPKNSYDGYRILQEFFCFPEAFLFLDIHGLDDIPLAIEAEQFKLVINFDLEIPDGVILYDDSIKLNCTPIVNLFPIDSEAINLTGKSEEYVLSPNYQLTECFDIFSINEVRGLRYPNDAKPYPITYTAFESFYHQNHQTQNHGYYRLKISQNEQLYGYSHRLSFVRQQEPQLQQCEETVSVALNCTNRYIASQLSTRSIDLDSASMPYGALSAKNLFAPTLPLYPLLDKTLYWSELTNLSLNYQSLLNLDSLKKILQLYDLPSVYNTQVARQSQKRLDALVDLHSEHIEHIYKGLPVRGLKTTLVVHQNAFLSEGSLFLFCTVIAQFFTLYTSINMFHELEVINLDNKEVYRWPAQINQHILK

SEQ ID NO: 5588 - protein, 311 aa, Proteus mirabilis
  UNSURE (14): Identity of amino acid at the above locations are unknown.
CLFFIHTLLSFGGXHNKMSYISREKIDYLSIGHRLRAYRIASSLKAEDVAESLGISRAAVYRLEKGEIVKIETLDNLARLLNTSLSSLLGINTEYYSSANGFFERMRQLETQSSHIYTHFEPFSYLLTSDCYDKTLVEMLTEASPENALTKKQQEVLSILKERKKHQSLHSPHIYNLISQQQIEKFLYVGMLGSVNVSKAIQQERKQRAKQEISHLIEKLEQKNSHLNIAIISDTMPSLTFQLFYQNKAPLSLAVSPFRLGEFPNVSTGIATVSSSTEAIFQYQSLFDTLWAKAIKNDDAITRLKEIISHY

SEQ ID NO: 5589 - protein, 495 aa, Proteus mirabilis
YYYVFSYSGLTMNQQRVLVLGASGHIGQNLIPALIAQGHQVTAGARRVDWMMSQGWQNTRCVFVDLHDPKTLRDVIRNTDIVYYLVHSMGDAHNLIEQERQAALNVVDALEESDVKQIIFLSALQHKDQPYSPHLVARKLTGEVLRTSSIPVTEIRTSMIVGPGSAAFEIMRDMVYNLPILTPPRWVRSKSSPIALKNLIYYLTEIIHHPTHQHRIFDAGGPEYISYQTLFERFINISGKKRLLIPLPIPASIISAGFISLITSVPTSIAKELIQGLKYDLPAKDASLRKLIPQKLISFDDAVRETLADEEAALDDQDWGYSPEVRNRWKPGYGYYPKNAGCTVSTPASAAALWHVVQQIGGEQGYFYGNALWKTRALLDDLVGNKVTYGRPQRETLALGDMIDGWRVIKLEPEKQLTLLFGMKAPGLGRLSFTIHDSGNLRSLDVRAWWHPAGFSGLLYWFAMMPAHLFIFKGMAQTISTYAYRLDKNSPKKPD

SEQ ID NO: 5590 - protein, 247 aa, Proteus mirabilis
GFHVMRIPRIYHPEPLSAGTQTSLAEEAANHVGRVLRMSKGQKLALFDGSNQVFDADIIESSKKSVIVQINEGQMDDRESPLDLHLGQVLSRGEKMEFTIQKSVELGVNTITPLISERCGVKLDPSRLEKKHQQWQKIIISACEQCGRNKIPQLMPVMSLEAWCAQTDDSLKLNLHPRASQSINTLPLPVKKVRLLIGPEGGLSPEEIAMTAKYHFTDILLGPRVLRTETTALTAITALQVRFGDLG

SEQ ID NO: 5591 - protein, 63 aa, Proteus mirabilis
FHCVFIFYHILVIYMLFLIYQYVASQRALKPIIPSDFLTRYVPMNKLISQKNLFIALKSRLTP

SEQ ID NO: 5592 - protein, 1245 aa, Proteus mirabilis
GTGVIKKILDILPIFGKKDVDITEQYLQGSLVLLAIFDESLPKRALDYVLTGTNPEILFELNKLDAAKAAVYFHRAGTLEWWYASNVDTGKYGKVITQGLNARHKLYSKVGESFSLEQVARFAKVIAAACQDINIKVTTTQVPTWVIYLLVDAFYTTYDNARNLNLEHRKHWSMEFIANMVEAEANIGGENALFAIFDRKDVSEYYAANLKRIYELCDLKDYLLSHQEFVRKELVEKLSANGLVELINYLNKNTILRDTFADIIVLLATSSLRTVKKTAEPILNTLPAEIVKENLTHVLMNGTPKQRTQAADLFARQGENRDVLAEALKHETSKAVIKSIESALQRFCVADNANTVEAIKAPDFTPLEDTPLPDSARDILVNNFNEMLVKAKENAEREIEENKTSKHSYNWAQRHYKDLSKIDEKQCRALVDKLNSGQGTIQVNEIQIIKHKNRIPNLPEYTFFHAVRVITNNRQHADHFSSHYFNSDIPERLLSDIELRHVENVLERCHFKRATRITAALCLESYQDGLRRFRKPEQVWPFFSQHTDYIAEALNLMPNQSEHRYRQFETSQGIEVLSRFPTIPAQFVPRIMELALGENKTHRVSAQKLLETLPNIHLSAQEGLTSSKQEIRVTAIEWLARLNNPDSLPALNALLKKEKREVVRAALLTALEQLGEDISSYLSPKTLLAEAEKGLKAKPPASLAWFNFEAIPALTWENKKAVDPAIIRWWIILAVKLKMPGGNALLQRYISLLCVDSQHKLSSFILHTFVAQDIKGPTLEEAMAEAQQNAPSRLTQYKDWAKRYPEYYAKYETYTLEQVVEEIKNEVLRRYLGSAISDKGMLALICGIEGHIAVSVLRNYMRDHYQRRAQIEAMIDAVASSNDPIIIQLLLSLSRRYRTASVQEKARNLVTQIAERNGWSADELADRTIPTAGFDDSGTLVLEYGERTFTAKMDAKQKIVLFNPEGKEVKSLPAARKNDDPELIKEAKKLFTSSKKELKQVIELQSVRLYEAMCAQRQWLSADWQEYILAHPIMHKLIEQLVWQEVKEGEVINTFRPSDDGALLNLEDDEVTLQNDSLIQLAHAALVNEDERKAWIAHFKDYKVKFLFSQMEHKIPDLDLTQTEVEDRKGWITDTFTLRGILTKMGYQRGPAEDGGSFSHYYKFFSSLNYYVNIGFSGSYVPEENIPAVLFDLSFEKDQQNYWDRNNIELKQVPPILLAESYADYLKVAEACAGFDPEWEKKTPW

SEQ ID NO: 5593 - protein, 95 aa, Proteus mirabilis
FYLVFDTINQWCGRRDLNSHTLRRQNLNLVRLPISPLPQQPLRKKDSFNESLFQNMAGVPGFEPGHARIKTWCLTAWRYPKMVAMTGFEPVTPTL

SEQ ID NO: 5594 - protein, 185 aa, Proteus mirabilis
GGLVRYLFSLFFALAVLVTAGCGFHLQGKTQVPAELKTLYLSSGDPYGPLSRVMRQQLRLSGVQLVETPKADIPVLKIVGSSENKETVSVYQDGKSAERQLTFVLDAQVIMPDGTIYPISSQVSRPFFDNPLEALAKDAENDIIKQEMREQATAILVRKLLVVHNAERQKASEAAKAKQIISPAK

SEQ ID NO: 5595 - protein, 102 aa, Proteus mirabilis
IKVVWTFQGFRSAITRNTQMAYCVFRQKIHLKGGRYWSLPTILSHLDKCVVFYHTTNSQAEVSYLAHKKQLYSSAQTDIYVCVFVSGMVLTPKKRWGVITVQ

SEQ ID NO: 5596 - protein, 352 aa, Proteus mirabilis
EITVARHSDYYLLPITTEGKTMRNPVLWATVLSATLISTQLSAADLPGKGVSVQPVQSTISEETFQTLIVNKALEKLGYTVQPIKEVDYNVAYSSIANGDATFMAVSWVPLHNSQYEAAGGDNTFYRKGDYVVNAAQGYLIDKKTAEKYNITNIEQFKDPKIAKLFDANGDGKADLTGCNPGWGCEEAINNHLKAYDLEKSVTHNQGNYAAMMADTITRYKEGKPIFYYTWTPYWISDVLKPGKDVVWLQVPFSSLPGDDKTDTTLPNGKNYGFPPSTMHIAANKKWAEANPAAAKLFEIMKVSVADINAQNLRMHNGQKSQADIERHANAWIKAHQKTFDGWVEEARKAAN

SEQ ID NO: 5597 - protein, 245 aa, Proteus mirabilis
RLTVLDMIKNVISPEFNEEGRALRRVRSFVRRQGRLTPRQEQALEKQWPIFGIEYQPEPIDFSQVFGRNAPVVLEIGFGMGASLVTMAKNSPENNYFGIEVHAPGVGACLASAQEENISNLRVMCHDAIEVLNHMIPDNSLQMVQLFFPDPWHKARHNKRRIVQVPFAELILTKLAPNGVFHMATDWEPYAEHMLEVMTSVDGYQNLSETQDYVPRPETRPVTKFEQRGHRLGHGVWDLMFKRVK

SEQ ID NO: 5598 - protein, 251 aa, Proteus mirabilis
TMAVTKLVLVRHGESVWNKENRFTGWTDVELSDKGRNEAQEAGKLLKAEGFTFDYAYTSVLKRAIHTLWNILDEVDQQWLPVEKSWKLNERHYGALQGLNKAETAEKYGDEQVKQWRRGFAVTPPELTKDDDRFPGKDPRYASLTEAELPLTESLALTIDRVTPYWEEVIKPRVASGDKVIIAAHGNSLRALVKYLDNMSEEEILELNIPTAVPLVYEFDENMKPIKRYYLGNAEEIAAKAAAVANQGKAK

SEQ ID NO: 5599 - protein, 177 aa, Proteus mirabilis
ENKVREKEKESIEMIDNKKRPGKDLDRIDRNILNELQKDGRISNVELSKRVGLSPTPCLERVRRLERQGFISGYTALLNPHYLDASLLVFVEITLNRGAPDVFEQFNMAVQKLEEIQECHLVSGDFDYLLKTRVPDMSAYRKLLGETLLRLPGVNDTRTYVVMEEVKQSNRLVIKTR

SEQ ID NO: 5600 - protein, 258 aa, Proteus mirabilis
VKKVVQYASRRAIMGFKKLVVALVFVASSATAAPSFDCAVTPKDDLRITPEFVEVAGSNGLLVIYPDGTLLRDEKSVTLTPEQQAIAKKYQATVRQDIPWLRKETGIKLQESRKVLDKVVIEAFGQDSRILKRLSDLEKNLNQQMDTVISLKPDNVTFHAQAIKQVETKGREIIESSLGGMLQDSINELGQKQLLAAASGDRKKALSGLLGNLDGFQQIIEKEWKQQEASFNQFGQQACNKITQMENQRVELINSLNK

SEQ ID NO: 5601 - protein, 201 aa, Proteus mirabilis
MKKVLLTVCAIALFGSQAAWADARQDLQQRLNKVNSFQANFSQTVTSNEGALIQKGEGHLKVQRPDLFNWQMTAPDESTLISDGKTLWFYNPFVEQVTATWLESATTNTPFMLIARNDSKEWQNYDVKQNGDRFELTPKTENNLKHFSITVSPNGQIQQFAATEQDGQVSQYQLTAQKVAPIDASAFRFTPPAGVTVDDQR

SEQ ID NO: 5602 - protein, 311 aa, Proteus mirabilis
TVRVLLAPMEGVLDPLVRDLLTAINHYDLCITEFIRVVDSLLPPKAFYRLCPELHTQSRTQSGTLVRVQLLGQNPQWLAENAFRAVSLGSWGVDLNCGCPSKTVNGNGGGASLLKQPETIYQATKAMRGAVPADLPVSVKVRLGWDCSSYCHEIADAVEQGGATEITIHGRTKEDGYRADKINWQAIGEIRQKLTIPVIANGEIWCREDAISCLKITGCDAIMIGRGAMHTPNLSNVIKGIEEKMPWSQVIQLLKRYIRLEKQGDTTYYHASRIKQWLGYLRKEYQDADALFSQIRTLKTSPEIAKIIEAL

SEQ ID NO: 5603 - protein, 311 aa, Proteus mirabilis
DNRVLNALLLTRFFRMLSARHSAKLQVFYPVLLLLLSMLSIQSGASLAKSLFPVIGAPAVTALRLFLGTLILFFIFKPWRLSFSRSAIMPLFLYGLSLGAMNYLFYLALETIPLGIAVALEFTGPLAVAMFSSRRAIDFLWIILVIAGLGLLLPIGDNIHGLDPLGILYALGAGVGWALYIVFGQRAGKGYGAATVSIGSLIAAFIFFPIGMLQSSPELVFSWSILPIGLAIAILSTAFPYTLEMIALTRLPAKTFGTLMSLEPCMGAFIGIIFLHEHLTLIQWVALAFIVLASIGSTATMKRKTKIEKVE

SEQ ID NO: 5604 - protein, 122 aa, Proteus mirabilis
GKRVIMSNIIKQIEQEQMKQDVPSFRPGDNVEVKVWVVEGSKKRLQAFEGVVIAIRNRGLHSAFTVRKISNGEGVERVFQTHSPVVDSITVKRRGAVRKAKLYYLRERSGKAARIKERLNAK

SEQ ID NO: 5605 - protein, 159 aa, Proteus mirabilis
VFGVFSMSFISSIILRSVTVTSNKMDFTRPDIDVTKVAVKFKLRNELEEDKDSKSCKLTFSSDVIGKLTDGEGDDPDFDLVDNEFSFSLTVEYEFEIKDYEKFSSVDEDERTEACANIVYLDFRRRMTVGANNIGISSFRLPLSIMSLNKSKEKEKETE

SEQ ID NO: 5606 - protein, 527 aa, Proteus mirabilis
EQGVKMFDIVELSRLQFALTAMYHFLFVPLTLGMAFMLAIMETIYVLSGKQVYKDMTKFWGKLFGINFALGVATGLTMEFQFGTNWSYFSHYVGDIFGAPLAIEGLMAFFLESTFVGLFFFGWDRLGKKQHLMVTWLVAFGSNFSALWILVANGWMQNPVAADFNFETMRMEMLSFADLVLNPVAQVKFVHTVAAGYCTGAFFVLGISSYYLLKGRDIGFAKRSFAVAATFGIAAVLSVIVLGDESGYEMGDVQKTKLAAIEGEWHTEPAPASFNLIAFPNQEKMENTFALQIPYVMGIIATRSFDTPVLGLHDLMSQHEVRIRNGMKAYDLLTELRSGNTDPAVRAAFNESKKDLGYGLLLKRYTENVSDATEEQIKSAVKDSIPNVAPLFWSFRIMVAAGFLMLLVVAISFWTVLSNRIGNYKWLLRAALFSIPLPWIAVEAGWFVAEYGRQPWAIGEILPTAVATSSLTQADILVSMGLICGLYTLFLVAEMFLMFKFGRLGPSSLKTGRYHFEQKTASSAQSK

SEQ ID NO: 5607 - protein, 174 aa, Proteus mirabilis
KEMVYLIRELVNYQHVGDYMKENIAVKSIENIWQDPQCFCISEFIRDEFFYYFKCLDIVSMKKGSIVDAEYLGCFNIENMLAVKHTRFTKTEIYPVDIDHDYKCYYYEVNDSNWLNNILNERTKNDSDWNKYDTNIYKHFILENKEYWVEVIGSNLIFSKKEKDEAKLVLWDTI

SEQ ID NO: 5608 - protein, 413 aa, Proteus mirabilis
KMVVLAHLLGILLAKYLITLYLETTTPSCLFPRLHRVAQRNNPMTENNKKKSLWTRLHIDPFFMLCIIALLCYSAFIMWTASGQDPDMMERKLGQIATGFIVMIIMAQIPPRVYENWAPHLYVFCVVLLIFVDVFGQISKGAQRWLDLGIIRFQPSEIAKIAVPLMVARFMNRDVCPPTLRNTAIALVLIFVPTLLVAAQPDLGTSILIAASGIFVIFLAGMSWRLITVATLLIAGFIPILWFFLMHDYQRTRVMMLLDPEIDPLGAGYHIIQSKIAIGSGGLHGKGWLQGTQSQLEFLPERHTDFIFAVLAEELGLIGVLILLTLYILLIARGLYLATKAQNTFGRVMIGGLMLIFFVYVFVNIGMVSGILPVVGVPLPLVSYGGSALIVLMAGFGIVMSIHTHRKLLSKSL

SEQ ID NO: 5609 - protein, 147 aa, Proteus mirabilis
RVTVMASNYGWQANAGASLFERIRGKNLGFSHRSRTNTLIESIKQNLNYILNARPDGCQGTPPLGIPDLNDATQSTVDFKSHLEDSISSCIIAYEPRISKVVVKFLEEDADSLSLQFNINAFIDLENKQQLIEFNVYLDNNRRYQLK

SEQ ID NO: 5610 - protein, 187 aa, Proteus mirabilis
SVAVVTMSEQKTFKEPVEPIVMGKLGSPYGIRGWLRVFSSTEHAENIFEYQPWFIQRHGQWESIEIETWKHHNQDIIVKLKGIDDRDAANILTNFEIVVSATQLPDLDGEYYWKDLMGCQVETDKGYDLGVVNDMMETGSNDVMVIKANLKDAFGVRERLVPFLDGQVIKKVDLSAKKIIVDWDPGF

SEQ ID NO: 5611 - protein, 336 aa, Proteus mirabilis
KRAVCQLKRTLLTFIKIIPLAFYFAPQHQLRDNKMTSAKRPIFNLELDLLRTFVAVADGSTFAAAAESVCRTQSAVSQQMQRLESLIGKELFARQGRNKTLTEAGTQLLNYARRILRINDEACLSLLHEEIDGILKIGSPDDTANTILPDLLARFSGAYPRLIMEIIVKRSPFLMSMLENNEVDLAISTEEHVGYPKIVLRVSPSLWYCGKHFRFDLDEPLPLVVLDEPSTYRDMMINHLDQQNIRWRIAYIATTLSGARAAVRAGLGIMARSIELSGDDLRILGEKEGLPPLPAIRYNLYLNANSPSKAAQILFDSLKNEQNEVINHADITLQNH

SEQ ID NO: 5612 - protein, 362 aa, Proteus mirabilis
MSQVYNFSAGPAMLPAEVLRRAELELCNWHGLGRSVMEISHRSKEFLEVAHQAEQDLRDLLNVPENYKILFCHGGARGHFAALPLNLLGEKTTADYIDGGYWAKSAADEAEKYCSPNIIKIKTEIDGKIAVKPMKEWQLSDNAAYVHYCPNETIDGIAIHEEPDFDDKKIVIADYSSAILSQPLDVSRFGMIYAGAQKNIGPAGLTLVIIREDLLGKARKETPSVFDYTVLAENDSMFNTPPTFAWYLSGMVFKWLKEQGGLQEIAKRNYEKATLLYSAIDNSDFYINRIATENRSLMNVPFQMSSPALDAVFLKEAEEQGLVALKGHRVSGGMRASIYNAMPFAGVQALVDFMADFERRHA

SEQ ID NO: 5613 - protein, 353 aa, Proteus mirabilis
LMKVTQILFYNNENSITDNEIKNLFNIFDTQVINNSRVDVNLETAKNQINKLADAVRNGSSIDLDYLVNIMFHDDIKISLYATNQLYLIYPKLNNSIREDIKELVKLLYEIKIKEDQEYFKERPLLSAMACEEAIARQKGKGENVFISAVDNYLNIKCNDSVLANSNESVSNNNRYISSSELESWASFQPYQCDIGSYESILKKIENSKGSAELKNYVVLVNNNHWVALLTYKDSCFLCDSLPSSKKDERHNLLIELEKKGFNTINIEYNLQENVPNGCGLLALNYIDSLHNEWNKFNHEKEDDLISTIETVLQKTGKDFLNLSCGEQTTFNHDVRKKLIMDTLFCIVKSSYE

SEQ ID NO: 5614 - protein, 79 aa, Proteus mirabilis
GEKVMLKIFLFAFILFLLAFFGMALGYIVKRKSIQGSCGGLGSIGIEKECDCPEPCDARKKRMAKEAARQELLQKNRIL

SEQ ID NO: 5615 - protein, 82 aa, Proteus mirabilis
GKRVFNGAAVLSHFTGTGGGGDEHLVTIAANMITLSFFIMLSFPQNIDFDGLDGNKCHSCGGHFRPNRCSQSRPDCPEPYVT

SEQ ID NO: 5616 - protein, 345 aa, Proteus mirabilis
VTRVHGRNARISRIWKGVIMQQLVDAFSRKFFYLRLSITDVCNFRCTYCLPNGYKPNGHKSFLSLDEIRRLTHSFAELGTEKIRLTGGEPTMRRDFTDIIATINENPAIKKIAVTTNGYRLARDVAQWRDAGLSAINVSVDSLDPRQFHAITGQDKFHQVMEGIDAAFTAGYDKVKVNVVLMRNVNDKNLPDFLHWIKDRPIQLRFIELMETGDGSDVFNRFHLSGEVIRQRLLNEGWLQIPRARSDGPAQVFTHPDYQGEIGLIMPYEKDFCVTCNRLRVSAIGNLHLCLFGENGIPLRDLLADDAQQQALQQRIQGGLLHKRETHFLHQGDSGITPNLSVIGG

SEQ ID NO: 5617 - protein, 254 aa, Proteus mirabilis
CLLLSPSVINIKIKGKRMRKVTLTLSAIALALSLNGAAMAKVHMPEVVSPGVTVTELAHQQPIKWVSVAEIEKSLEGQAPMAVGFDIDDTVLFSSPGFYRGKLEYSPNDFSYLKNPEFWEKMNNEWDKFSMPKQVGIDLVQMHLKRGDTVYFITGRTQTKTETVTKYVQEGLNIPADKMQPVIFAGDQPGANNKVSWMRDHKLKIYYGDADADIAAADELNIRGIRILRAANSSYQPLPKAGQFGEEVVINSEY

SEQ ID NO: 5618 - protein, 114 aa, Proteus mirabilis
VQLLEKITISSYTLKVTIFNILSILSLHLGGTMGFLSWIVFGLIAGILAKFLMPGSYDIGLIWTCILGIVGAVVGGVISNFFGKGKVDGFNFGSFVVAVIGAIVVLYLAKIFAS

SEQ ID NO: 5619 - protein, 87 aa, Proteus mirabilis
RLLFISIKINFRINFNQSSLFKKQRAAKITVRCFIMSPLHHYIPFPVLSNYHLLGCFFFLFRQSVVIYLVRFFINKVVFWIFFRQND

SEQ ID NO: 5620 - protein, 60 aa, Proteus mirabilis
FKILNKMPFIYHKKQKVFYIINMLFFYSYLQQITLSTITTREKYGANHPLNRSHVIFCIT

SEQ ID NO: 5621 - protein, 468 aa, Proteus mirabilis
KRFFIILLTGEIIMGTSVFDSVLLKNLWSTEEMRTIFSDKTRMQNWLDYEAALAIEQAELGLIPQKAAEVIVQSAKLEKLDMDYVLEQVRLTRHPLVPTIRGLEHACSEHYGEYVHFGPTTQDVIDTGLVLQLKAAHQTFLRDIKILGRSLLSLSEKHRNTPMVGRTLALQALPITFGHKTAIWLTELARHYQRLKEVEPRLFVGSVVGAVGTKASLSDKADELEKRVLKRLGLDIPEISWQPARDRFSEYGMLIGLISGTLGKIANEILILAHNEIDELSEPFGKGQVGSSTMPHKRNPAIVENAACVSNTLKANLSVLTDMMKHQHERDGAIWKMEWKIMPEMCLMLSVILDNMKTVLGGLNVHVEKMRHNMDILGGFMLAERVMFALSDKAGKQTAHEIVYEASMSGQEEGITFVEAINRDTRIRDHISQEELNALLDPTTYVGNAPEQVDRVVAQTKASGWLND

SEQ ID NO: 5622 - protein, 444 aa, Proteus mirabilis
GCSFGQPYYLIIKLLYLDYIFLLEVISVFSINKLKIITFVILGGVLFNSHANSLKYILNNSLNNAPELLEAKADIDIAVAKVNQTRAQHFPVISVTGNKLLGQYHRDKSDYDNNSFIPGLRGELNIYSFGGIENDVERNEKEQLYYQFKYSETKENVAYTISDLYLKALLAKESIAVKKKSLDRHNKIISELNVIARNDEGRVSEYVQAEARKILVEQDINYYEKELMTTLSTLSKYTGFPVGESDLVNPFDGMTVSDMYSEFTAENNNQNPAYLVSQADIDAKKMGVKVENKKQLPRINLTGNITKDDRQIGIDVTWDIINFSSLYSIDEKVSQLNAAQQRMERVIRDIEEARRLSVINIQKSTQKLKILDAQILSSTKVVDFYQLQFNVARRSLLDVLNAEKELSDVELSYATTLSDLRYGMLDYLYAQGKLSHWALNSHTH

SEQ ID NO: 5623 - protein, 243 aa, Proteus mirabilis
MTSLIYPDWPQPDNIGACSTLRTGGVSLPPYDSLNLGAHVGDDALLVEQNRRIICQQAQLPEMPLWLTQVHGIEVVNLDNQDNHTVEGDALYTSSANKVCAIMTADCLPVLFSTIDGTEVGAAHGGWRGLCQGVLQQTLTQFKASNEKIMAWLGPAIGPNAFEVGAEVRLAFVEKNIAFDSAFIPHNGKYLANIYMLARIILQESGVNQIYGGDFCTVSDKSRFFSYRREHTTGRMASLIWIK

SEQ ID NO: 5624 - protein, 78 aa, Proteus mirabilis
VRSFYCWFCYLIVQSPSLSGIKTKQLLKVLSEKLKTRPTSTFNREQNLRFQGQYFDKDKFVGNKFEQRLRWPVGRVSG

SEQ ID NO: 5625 - protein, 299 aa, Proteus mirabilis
IFPFYYKTWRSKIMINLTPYSDSSISFLRSIINSKNRGDYKDRISNLFNSLNTYYQNYDTSFDNNTLNLIQQSLIFSDLEKKDLLKLYNYSSKPFANFKNQLLKLPNGRDMDTCQYCTLNSVNTLDHIIPKENYPEYAVHPKNLFPACSQCNSKKSNKWLDNNNNFEFINLYSHDLPNLQYLFANINLIGNTFNVNFELRNENNINEDIFMLIERHYINLDLLNRFKSKSNEKIAQFENIIISNIESFDILLSSALNSALVAVNKSRLIFGANHWEQILYLGLINGSAFRTYCNNKGYQ

SEQ ID NO: 5626 - protein, 117 aa, Proteus mirabilis
TLPLVTPIKKAIQSRLIKYQDINKYPLGYFIYSAQRNLPKEWLTYFDGELNMLVSEMAKDIEALQTRTLALEYIIQVMIRNMSDIEKEKLISELNRVSHDSPVTIEAFGIIQSHLHN

SEQ ID NO: 5627 - protein, 886 aa, Proteus mirabilis
FLFFQLDFGIIMSKSTAEIRQAFLDFFHTKGHQIVPSSSLVPNNDPTLLFTNAGMNQFKDVFLGLDNRPYSRATTAQRCVRAGGKHNDLENVGYTARHHTFFEMLGNFSFGDYFKHDAINFAWELLTGKEWFNLPKERLWVTVYATDDEAYDIWNKEVGVPAERIIRIGDNKGAPFASDNFWQMGDTGPCGPCTEIFYDHGDHIWGGPPGTPEEDGDRYIEIWNIVFMQFNRKSDGTMDPLPKPSVDTGMGLERITAVLQHVNSNYDIDLFRALIKSVAEVTNATDLANKSLRVIADHIRSCSFLVCDGVIPSNEGRGYVLRRIIRRAVRHGYMLGAKDTFFYKLVAPLIDVMAEAGKELKNQQEIVEKVLKTEEEQFARTLERGLQLLDEELEKLTGDTLAGETAFRLYDTYGFPLDLTADVCRERNIKVDEEGFEQAMEEQRKRARESSGFGTDYNELIKVDSRSDFSGYDHNEQQGTINAIFHNGQTVTELKAGEEGIIFLDKTAFYAESGGQVGDKGLLIGKDSQFEVTDTQKYGKAIGHIGKVISGSFIVNHKINAVIDVARRDAIRLNHSATHLLHAALRQVLGTHVTQKGSLVNDKYLRFDFSHFEAVKPEQLREIEDIVNAQIRLNSPVVTELMDLEDAKQKGAMALFGEKYEERVRVLTMGDFSTELCGGTHAARTGDIGLFRIMSESGTAAGIRRIEAITGATAIESVHEQSDLISLVAHALKSDGSNLVEKIKTVQEKYRSLEKELQQLKDQQAAQESSSLGSQAKNVKGIKLLVRELNNVEPKMLRTMVDDLKNQLGSAIIVLSTISDGKVSLIVGVTKDLTAKIKAGELISFVAQQIGGKGGGRPDMAQAGGTDVEALPAALASVDEWVESHL

SEQ ID NO: 5628 - protein, 120 aa, Proteus mirabilis
LKQLVILSWYFLKPYVGIFMDINKILGREIKFLRKRSLLSGCELAKAFGISQQHLSRIERGEVQWSVSFLLRVCAFFDIPMIHFIKLIEKETSSFSIVDNNLCQFEFIEINNRRRIGHRK

SEQ ID NO: 5629 - protein, 147 aa, Proteus mirabilis
LNKLVNVMSKEISELQFSLHYASETDSEKNTSIILTANIHTADGETQQLTQLICTTSSAGKKQYRIGLQKISDAGAPLLVAIESYWRKNTQESCVYLLEKAKQFIQGHLQQTNTWISMYGLVIVSNASLEEQLPEGLLKALKVSIPA

SEQ ID NO: 5630 - protein, 60 aa, Proteus mirabilis
LVKFFHHFFVTLNREICYFFSCRHSWVKICKMPDILTCNPHGILNLSHIFLFHCIDSIQC

SEQ ID NO: 5631 - protein, 231 aa, Proteus mirabilis
KDFSMIHYPEYILDIIWQRAKKISADNEIKGFRKDKETKWIKRQLFNQQNEFGWVLSKQPSSIHQLIEDETIVPLHWQTARAYEQKQEASSKRLNMIPLDPPALSRLIQSPTDVLPYWQHAHQISSDNEEKGFRKDYYGRIIQKNAFGDKQHQYGWTLAQLTPANKNNQIVIPINIVPIHINTSKRTYNEKELIVQGSQEAKIKRRRKKLVYEIIDFIVSLPGIIFSSFKL

SEQ ID NO: 5632 - protein, 337 aa, Proteus mirabilis
WRKLMGRSRSAKNKGLPPNLYLRKGIYYYRDVRTKKEFSVGSNKSLAITEAIQANLAIYKPKEPLVDRINNVHCVTLHEWLDTYRGKVNSRGLKEKTLYDYESRIKLIKLHFNDCPIENVTPRDVATFISEYPKKAMAKLLRSTMLDAFNEAIADGVIKENPVSVTKPPKTSVQRSRLSLEEFKYALEHTNDKYRHMFLLAVLTAQRISDIINMKWDDIKNDRLYVTQIKTGSKVAIPLSLRLEPIGYSIKDVLNLMNRNSDKICGNTTAKTLRGKFIEALPEYLENKPTFHEIRSLSARLYEEEKSAEFAKKILGHKSMRMTDKYLDDRGNGYVEL

SEQ ID NO: 5633 - protein, 339 aa, Proteus mirabilis
RLISPTIAQFASSLIKDEVSMSTIKHSKLIILGSGPAGYTAAVYAARANLEPVLITGVEKGGQLTTTTEVENWPGDPEGLTGPGLMDRMFQHAEKFNTEIISDHINKVDLKNRPFRLFGDEQEYTCDALIIATGASARYIGLPSEEAFKGRGVSACATCDGFFYRNQKVAVVGGGNTAVEEALYLANIASEVHLIHRRDSFRSEKILIDRLMDKVKNGNIILHTDRTLDEVLGDDMGVTKVRLKDTKSDKTEELEVMGVFIAIGHSPNTSIFEDQLALDNGYIKVQSGTQGNATQTSIEGVFAAGDVMDHIYRQAITSAGTGCMAALDAERYLDALKSN

SEQ ID NO: 5634 - protein, 117 aa, Proteus mirabilis
KWKFNNYYPWGNKVMTNEAFLKFKDSENKIIIPYLKKVFPSLKSACCLYHMIEQLEDVYTYLINSKDVIFIEVSRLNNSINHTDILSIKDYAIMKKGKQYHRYMKEIIALSNSEIIK

SEQ ID NO: 5635 - protein, 81 aa, Proteus mirabilis
EIISHYLLNLAEIWLGYQDSNLGMPGSKPGALPLGDTPSANSIVNTHIIYQENGWGTWIRTRVCQDQNLVPYRLAIPHLIN

SEQ ID NO: 5636 - protein, 82 aa, Proteus mirabilis
GKISASIHFMQENTMPAYNEYTKKHVLARRTGAVALGIVAFPVMVFHPKRAQFYSYLHRVWSKTSNKPVWLAKSEMALTSHK

SEQ ID NO: 5637 - protein, 115 aa, Proteus mirabilis
DSVSLRLPYAVNLATEYKSLTHYTKGTQSPHKEAPTACTYTVSGSFSLPSLGFFSPFPHGTGSLSVNQEYLALEDGPPIFRQDNTCPALLVEFTITASSDTGLSPFTAGLSRPFS

SEQ ID NO: 5638 - protein, 203 aa, Proteus mirabilis
ALTSSIVKTWFAILWLLRLLSHMKLGKLKIKNAAKQLKQKKRDCREKIMSEVILDLQVATENTQGLPSEAQFITWLEAVLPQFQPISEVTIRIVDEAESHELNLTYRGKDRPTNVLSFPFEAPPEVELPLLGDLIICRQVVEKEADEQNKTVEEHWAHMVIHGCLHLLGYDHIEDDEAEEMEGLETEILQKLGYEDPYLIEKE

SEQ ID NO: 5639 - protein, 287 aa, Proteus mirabilis
QSYSPTYLHRCLTMWLFRRILSGEKLVAKEKNKDSVGRTFLVVFILCLVCSVVVAGSAVGLKSKQEEQKLLDKQRNILDVAGLLVPKMSASEVLKVYDTRIKAKIVNFKTGELTDSKGDFDLNSELRSDETSIALSPEEDIAKIRRRANTAEVYFVLDDQGKTQEVVLPVYGSGLWSVMYAFVAVDIDGVTAKGITYYSHGETPGLGGEVDNPQWKAQWKGKRLLNEEGVPAIKIVRGGASDSPYGIDGLSGATLTSNGVQHMFDFWLGDKGFGPFLKKVREGEING

SEQ ID NO: 5640 - protein, 61 aa, Proteus mirabilis
ATYSFFIASIPFNAKSINTSVLLGHLSSNPEPSLQMPSGEQAIRSCSSLNIIGTSFAVNPV

SEQ ID NO: 5641 - protein, 1398 aa, Proteus mirabilis
NMELIHGAKGGGGGGHTPTESPDSLLSESTAKILLAISEGEIAGGLDDTRIFLDDTPIGNADGTKNFEGVTWEFRPGSEHQEYIQGIPSVDSETSVGLELKDEQPYVRSINNTQLSAVRIRLSVPQLFQQHDNGDTTGYRIEYAIDLSTDGAGYNEVLKSAFDGKTTSEYQRTHRVDLPKANTGWQIRVRRLTKNQNTARIADKVTISAVTDVIDAKLRYPNTALLFITFNARQFNNRIPKISVRPKGGLLIKVPTNYDPINRTYSGVWDGTFKLAATNNPAWVFYDLVLNNRYGCGDRIKASQIEKWDLYKIAQYCDELVPDGHGGDGKEPRFLCDVYVQSQESAYQVLRDIAAIFRGMTFWADNKVNVVADMPDSIFRTFTNANIVGGKPAYSGGSQQNRYTQALVSYTDTNNHSNDAIEAVADIKLQRRYGVRKTEISAIGCTRQTEANRRGRWALLTNANDRVISFATGLEGAIPSPGHIIAVADSTLAGRDNGGRISRVEGRKITLDRRANIKTGDRLIVNLPNGHSEGRTVSLVADNIITVSTEYSQEPEKNAVWTVDADDLALQLYRVVNITDNGDNTYTITGAIHNPSNYDHIDSGARIDERPITIVPPGVQAPPKNIRISSYSHVNQGISFTTLRVDWDAVDNAITYEAQWRRDNNNWVSMPRSSTCGFEVDGIYAGRYQVRVRAINASEISSVWANAQETMLTGKMGNPPKPVNFRTSPLVFGIKLDWGFGENTGDTLKTEIQYSKTNNGEGLMLLSDVPYPSKTYEMAGLAAGEVFYFRARLVDKTGNQSEWTDFILGESEFDASIILDELAGQISRDQLTQDLLGEINSKANQIDITELHELMRINHDKILSELMRHGATIEESEKKWEEAGKLLAERINQVSTATEAQAAAIKQEQQARIEGDKTEAQQRQSLATQLRGDYTGNDLSNVTAGLISAEKQARVSGDQAEAKARQSLETRMNGNVSAINKSLGTLTSKQQAQTQEISTLNSNLKGKADSSAVNALNTRVSNLDGKVTSATSQVQTLSSKLDTVKADLTESVVVDLDLSKLNENTYYPIILPLVTSRRYAFKVFRTLGQYRDNKPSYATHNTKGFAMIVEWQVSGSGWGTQSENRIIDNFDWRWTNQSPVMGPAQLTNGSVEYIYLRGGAKYQLTKHKSVNHQIITRTYTNNKQSVAPKGFVANEVPKSSEQKANATANAVNQLETKVTEVSGKVTSTAQQVTRLESQVGTSSAKIEQTSKVVTDINGKISASWTMKVQQDSKGNKVITGIGLGFNAQGNSQFLVNAQNFAVISSLNGKVVTPFIVKNGQVVVNEAFIGDATITSAKIANVLQSTNFSHANKVGYQLNMRTGEEIKYGNNAQGYWIETNILKRLFDKKGTMRIRMGIW

SEQ ID NO: 5642 - protein, 298 aa, Proteus mirabilis
VMNSEEINEPDPLLRDAIEYVIEKQRVSISGVQRQFRIAYSRAANIIKEMEAIGIISECNHNNSRDVLILDNLSADLLIDEYLEVLQNSENKNEPDSINDDFSSVENQMKREAIINKRIVIWLHDTGQDSDDGTRIYILKSYSPFEHLFNAQRRPSSIDNDPGGDVLEGYRFSATMQTRTPLRVLIQHGRLEKKPLHKLPKIIRSEWEGIWIPHTRSWKDMGIDMKEWNTEGSMASQIGQIPSNGGDYLRFLIFARNIKEAKASSEEKRNMINLGRCMYGEEGTPFKDFIEDYNFSNK

SEQ ID NO: 5643 - protein, 70 aa, Proteus mirabilis
LIFSPPNRLAIWLNKLMLAPITINALLRYIEMLILKASSVREVSIFIYTQVIFIRLSKNRMQDFITPKRY

SEQ ID NO: 5644 - protein, 171 aa, Proteus mirabilis
PFVSIMKNWHLLYCKRGQIARAIEHLERQQVICFTPMVTIEKLIRNKRTLVTEPLFPNYLFIQFDPEVIHTTTINSTRGVNAFVRFGRYPVTVPQEVIDTLQSPTPSSVIYSEENVPHSGDYVLITEGVFQGIKAIYQEPDGETRSILLLKILNNEVKKSVDNKEFKKEPF

SEQ ID NO: 5645 - protein, 89 aa, Proteus mirabilis
ESRLMAHKKAGGSTRNGRDSEAKRLGVKRFGGEAVLAGSIIVRQRGTKFHAGTNVGCGRDHTLFALADGKVKFEVKGPNNRKFISIEAE

SEQ ID NO: 5646 - protein, 78 aa, Proteus mirabilis
NSLSQYIDLSSIINTQVLPSGFNTLGDVSLICLIVYSLCFCCVPLAPFFRCLKYHWRPPVVLNSNSWLTKEISTPLVY

SEQ ID NO: 5647 - protein, 404 aa, Proteus mirabilis
FRPSSTLMAIIRSKIMKFVDEAKILIVAGDGGNGCVSFRREKYIPKGGPDGGDGGDGGDVYMVADENLNTLIDYRFTKSYRAERGENGQSRDCTGKRGQDITINVPVGTRARDLATGEIIADLTVHGQKQMVAKGGFHGLGNTRFKSSVNRAPRQRTMGTPGESREVLLELMLLADVGMLGMPNAGKSTFIRAVSAAKPKVADYPFTTLVPSLGVVRMDSHQSFVVADIPGLIEGAADGAGLGIQFLKHLERCRVLLHLIDIDPIDGSDPVENAKIIISELEKYSDKLAQKPRWLVFNKVDLLDADEAKQKAQAIVEALGWEGDYYMIAAINQEGVKKLCWDIMEFLKVTPREQDIATALAAEEKVDFMWDDYHKEQLENPDFEDDDEDWDEEDDDGVEFIYQR

SEQ ID NO: 5648 - protein, 63 aa, Proteus mirabilis
MITSILHRREKHRLFRQYFVNRVRVSGDILKHVYLFLIPYNKAIFSIHSIFTMMRFLQRVETK

SEQ ID NO: 5649 - protein, 72 aa, Proteus mirabilis; identical to SEQ ID NO: 5059

SEQ ID NO: 5650 - protein, 99 aa, Proteus mirabilis
SITPKIVEEHKMGGISIWQLLIIAVIVVLLFGTNKLRTLGSDLGASVKGFKKAMGDENQKETNNAEKTTNDADFDTKNLAQKTSTEEKSTTESKNKEQV

SEQ ID NO: 5651 - protein, 515 aa, Proteus mirabilis
PGTPLLSFEEATRMNKEILAVVEAVSNEKSLPREKIFEALETALATATKKKYEQEIDVRVCIDRKTGDFDTFRRWLVVEEVTQPTREITLEAAKYEEPEIELGGFIEDQIESVTFDRITTQTAKQVIVQKVREAERAMVVDQFREQLGEIITGVVKKVNRDNITLDLGNNAEAVILREDMLPRENFRPGDRVRGVLYDVRTETRGAQLFVTRSRPEMLIELFRIEVPEIGEEIIEIKAAARDPGSRAKIAVKTNDKRIDPVGACVGMRGARVQAVSSELGGERIDIVLWDDNPAQFVINAMAPADVASIVVDEDKCTMDVAVESSNLAQAIGRNGQNVRLAAQLLKKHRGDDKWELNVMTADELNAKHQAEANAAIEIFTKHLDIDEDFATVLVEEGFSTLEELVYVPIDELLAIDGLDEETVEALRERAKAALTTIELAQKESLGDNQPAEDLLALEGMERSLAFDLAARGICTLEDLAEQGIDDLTDIDGLNSERAGELIMAARNICWFGNDA

SEQ ID NO: 5652 - protein, 65 aa, Proteus mirabilis
SGTPFGSHLLLHPVIKTIEIKGKKTNFILNIVIKRRIKNTNHKTKLITLTIVFENDSHLITGVTK

SEQ ID NO: 5653 - protein, 296 aa, Proteus mirabilis
IQTPGFLGFFYIGINEMKLIARGRELNLSSPQVMGILNVTPDSFSDGGTHNSLNDAINHAAKLIAEGASIIEIGGESTRPGASDVSVDEELHRVIPVVEAIQQRFDVWISVDTSKAQVITESAQAGASIINDIRSLTEPGALQAAAKTGLPVCIMHMQGLPKTMQHSPQYKNVMIEVDAFLAENIQRCIDAGIEKNQIILDPGFGFGKNLAHNYQLLAHLSDFHHFGLPILAGMSRKSMVGQLLNVPPQERVAGSVACAVIAAMQGAQIIRVHDVKETVDAMKVVQATLSAKENNE

SEQ ID NO: 5654 - protein, 510 aa, Proteus mirabilis
LIVFQRGLCPLFSHSLARKIMMKYRDLRDFLSLLEEKGELKRITFEIDPYLEMTEIADRTLRAGGPALLFENPKGFDMPVLCNLFGTPERVAMGMGQDDVKALHEVGKLLAFLKEPDPPKGFRDLFDKLPKFKQVLNMPTKRLSKAPCQEVVLTGDDVDLTKIPVMHCWPEDAAPLITWGLTVTRGPFKERQNLGIYRQQVLGKNKVIMRWLSHRGGSLDFQEWCQKHPGERFPVSVALGADPATILGAVTPVPDTLSEYAFAGLLRGNKTEVVKCLSNDLEVPASAEIILEGYIEPGELAPEGPYGDHTGYYNEIDSFPVFTITHLTRRKDAIYHSTYTGRPPDEPAVLGVALNEVLVPILQKQFPEIVDFYLPPEGCSYRLAVVTMKKQYAGHAKRVMMGVWSYLRQFMYTKFVIVCDDDVNARDWKDVIWAITTRMDPARDTIMMENTPIDYLDFASPVSGLGSKMGLDATNKWPGETEREWGRPIVMTDEIKQRVDTIWEQLDIVK

SEQ ID NO: 5655 - protein, 464 aa, Proteus mirabilis
SFSLGRVNCFLCQRNVMSANQSATTGKLDNYFKLTARGTTVRKEMIAGLTTFLAMVYSVIVVPSMLGQAGFPHTAVFIATCLVAGFGSLLMGLWANLPMAIGCAISLTAFTAFSLVLGQHISVPVALGAVFLMGCLFTLFSLTGIRTWILKNIPIGIAHGAGIGIGLFLLLIAANSVGLVVKNPLAGLPVAMGEFTSFSVLMSLAGLAAIFGLEKRKVPGGVLLVIIAISIIGLIFDPNVKYQGFFKMPQLGEEGLALLFAMDIKGALQPLVLPSVLALVMTAIFDATGTIRAVAGQANLLDKRGQIINGGKALTSDSVSSIFAGAIGAAPAAVYVESAAGTAAGGKTGLTATVVGILFLLILFLSPLSYLVPPYATAPALMYVGLLMLGNVTKLDFSDFVDAMSGMVCAVFIVLTCNIVTGIMLGFGCLVIGRIFAGEWRKLNIGTVLIAIALVAFYAGHWAI

SEQ ID NO: 5656 - protein, 302 aa, Proteus mirabilis
SDLPIQKNKSEEEKKKDNRMSTLTKKLENVRLQGKGTEQRLAHYLLENSDNIASMNAAELAQKAGVSSASVIRFSRQMGYGGYPEFKIDYLSEEKQQKSSSDILYANLAKTDSTEQIIAKTGHLFTTAIQDSIALLDAATIDLLAEKMISAKRIVLFGVGASAIVASDIFHKLIRVNKNTLFSADLHAQLAYSANLSADDLAIAVTARGNTADINRMLKAAKQEGCITVALTRFGQDEATRLANYTLPYFYDEQHSQLGVITPQVLQMVAFDVLFFKYMTLAKGSAEKALLKGRQAVMQGNQ

SEQ ID NO: 5657 - protein, 310 aa, Proteus mirabilis
PVLPPSVSGLLRFLSLIRRNIMTMRQVKQIYSAPNPHWVGNGFSMSTVFSYKENAEQYSPFLLMDYAEPTLFKPVTNARGVGTHPHRGFETVTIAYQGEVSHHDSTGHAGTIAEGDVQWMTAASGILHKEYHSEKMTKEGGMLEVVQLWVNLPSAYKMAQPRYQALKAQDIPHVQLPNAQGYVRVIAGDYANTSGVAMTYSPLNLWDVRLNHAGTSHYAIPEGHNAMLFVVKGAIHLNNSDIVRQHEIAILDTHGDTLTLGSMGDAIVLILTGEPINEPVVGQGPFVMNTQQELLQAFDDYDNGKFGMMD

SEQ ID NO: 5658 - protein, 110 aa, Proteus mirabilis
NRPFSIPTKQKLMMTLNKKQIQHLKGLAHHLNPVVMIGNNGLTEGVLAEIEIALAHHELIKVKIAGEDRDVKNLIVAAIVRESGAQNVQVIGKMVVLYRPSEARKIILPK

SEQ ID NO: 5659 - protein, 85 aa, Proteus mirabilis
DVKPLASCVRFSLALDKGGFYYFPTKRVESYNYFLFIEYIKGQALIKAACVFFCLEKSKVEPFLCVVSIKNQDDTYFLLGIVLRY

SEQ ID NO: 5660 - protein, 295 aa, Proteus mirabilis
ERQLIMWLLVITTLLWAASFSLIGEYLAGQVDSWISVLIRVVLAAIVFLPFLRWKGIRLKVILLYMGVGACQLGIMYLFVFHAYNYLTVAEFLLFTVLTPLYVTLIYDLLERQRLRWGYAFSALLAVLGAAIIRYDHLSDDFWLGLLLVQLANIFFAIGQVGYKRLMEMHPLPQHHAFSWFYIGAVVVVLVGSLCFADWQKIPTTSLQWGVLLWLGIGASGIGYFMWNYGATQVDAGTLAIMNNMMVPAGLLVNFSIWQQHPNWPSFIIGASLIVASLWFHRRWIHQPVLQKADD

SEQ ID NO: 5661 - protein, 60 aa, Proteus mirabilis
ICFTCLIVMMFLLIKERNRNNPDTEGGNTGYRDFLMSMIINCSLYKQNRGNLLMVFKKNE

SEQ ID NO: 5662 - protein, 147 aa, Proteus mirabilis
IMSTPDSIKIIKQYIASHHVFTLCTTRALGDIWCANCFYWFDESNMRLVFLSEKHTRHAQMMQENLFVAGSISTQELSVANLQGVQFTGTVSLLTANDDIRARKQYCLRFPVALAAIHVPLWQLQLQEIKMVNNQLGFGTKLFWQRH

SEQ ID NO: 5663 - protein, 213 aa, Proteus mirabilis
NLEFTLQHKAYHPEHAVIGSTTPLEISANHAVNGHSIREIPENMQIAYFAMGCFWGVERLFWQQPGVYSTSAGYSGGVTENPTYEQVCQGRTGHAEVVRVVFDPTLISYQQLLAIFWENHDPSQGMRQGNDIGSQYRSAIYTLTPEQYAQAIESKQRYQQAINSEGAHKEITTEIQPAGPFYFAEDYHQQYLFKNPQGYCGLGGIGICFPPAN

SEQ ID NO: 5664 - protein, 133 aa, Proteus mirabilis
KQEFYMSYEINTEKAPAAIGPYVQGVDLGNLVITSGQLPVDPATGEFVSDNAAEQARQSLENVKAIIEKAGLTVANIIKTTVFVKDLNDFGTINAAYEAFFKEHNAAFPARSCVEVARLPKDAKVEIEVIAIR

SEQ ID NO: 5665 - protein, 91 aa, Proteus mirabilis
VRSTEIVSAKVSPFLPKEVLLPSAKPTTDAPKRWIAVSKDKRVRVEASKKQLAITLSFNNWLLGCCFNLSATWRTDSRSSRFRSLMEIICL

SEQ ID NO: 5666 - protein, 81 aa, Proteus mirabilis
TKVTPITDFTLPALTLSPVSPYEADSLKLTLLFVTLPNLTGVLAGITPLLFDILIPTPLAGELDDILVKTVLFTSDVDPVK

SEQ ID NO: 5667 - protein, 223 aa, Proteus mirabilis
LHYTKGLNSKMEKATFSHDIASQVLYPLITASMETALNHVLYQENVLKPARNRLAGKVLALSINEFPQSIYLIFSEQQVDVLTQWNDETDCTIKTKLLTLIKLTDRQKLSELINRGDITIEGDMQVVQNWSALLDMAPWEPAQYLAPYIGDLAAEGLSLAASKGLKLFTTLFGRQKAYLRDALIEEWKTAPSTLETVHFYDEIEQLAQQTAELEKRLSTLEKK

SEQ ID NO: 5668 - protein, 288 aa, Proteus mirabilis
IYDTGKRLSGKSAIKRATSCNARKSIMLFITILAVGAAIGLIISTTGVGGGVIVLPILTYFFGMNALMAVATANLLSMLMKVTSSYMHFRLGNIPFKRAMIVLAIMLPSTFLASLLVNYLGSLAQYQQQVEWGINALVVAAIIFSLFLFIQRMFFSSPVIAKQITPLAPLNIKALLLPAIAAGVVLGATGVGGGVVVLPLLLRYANLSIKQAIGTSIFTTTLLSGSSALAYMQDGHTDIHLALLLFLGSLISIPLSKWLLIKMPDRVFQYATLFLILCSAFMMLARLF

SEQ ID NO: 5669 - protein, 157 aa, Proteus mirabilis
TMRTPSKQEDLVKAFKALLKEEKFSSQGEIVTALQEAGFDNINQSKISRMLTKFGAVRTRNAKMEMVYCLPTELGVPTASSPLKNLVLDIDHNHSVVVIRTSPGAAQLIARLLDSLGKAEGILGSIAGDDTIFSTPAPGFSTEELRDAILNLFDQEL

SEQ ID NO: 5670 - protein, 65 aa, Proteus mirabilis
FNLTSLYFNIYSSSLFKNIIILIDGNINMSNIEKNEITRKKAIMKIFSLEIIELKNKSNHPILFK

SEQ ID NO: 5671 - protein, 242 aa, Proteus mirabilis
RSITMNILIVDDEPLARENLRCLLEEEKDIHIIGECSNAIEAIGEIHRKKPDVVFLDIQMPRITGLEMVSMLDPEHRPYIVFLTAFEEYAIQAFEEHAFDYLLKPLEQERLAKTLSRLRQGNKQNIDLLSPPEERLKCIPCTGHSRIWLMPIDEAVFATSRLSGVYVTNNQGQEGFTELTLRTLETRTPLVRCHRQYLVNMDYVNEIVFGDNGQAELILHNNKQIPVSRRYLKPLKEAIGLI

SEQ ID NO: 5672 - protein, 252 aa, Proteus mirabilis
RVTTAMSEDIIYGIHAVKALLERDPTRFKEVYVLKGREDRRLMPVIHALEEQGILVQVANRQWLDNQTEGAVHQGIIAKVKPSRQYQEQNLPDLLAEVGTPFLLVLDGVTDPHNLGACLRSADAAGVHAVIVPKDRSAQLNATAKKVACGAAESVPLIRVTNLARTLRLLQEENIWIVGTAGEADHTLYQSKLTGPLALVMGAEGEGMRRLTREHCDELISIPMAGSVSSLNVSVATGVCLFEAMRQRISVK

SEQ ID NO: 5673 - protein, 567 aa, Proteus mirabilis
NRTTGTANSRVRKTVKHLGEKIMLLSELKRLYHIIKVFLSYGLDELIPKHRITLPARLGCRALFWIKNQHADKPLGERLRLALQTLGPVWIKLGQMLSTRRDLFPPHIADQLALLQDKVAPFDGKKARQYIEKSFGGPIDKWFDDFDETPLASASIAQVHTATLKENGKEVVLKVIRPDIQPVIKADIRLMYRLANLLPFLPDGRRLRPKEVIREYEKTLLDELNLLREDANAIQLRRNFENSSMLYIPEVYSDYCHENVMVMERIYGIPVSDIDALNAQNTNMKLLAERGVKVFFTQVFRDSFFHADMHPGNVFISYDHPENPYYIGIDCGIVGSLNKEDKRYLAENFLAFFNRDYRRVAELHVDSGWVPADTNVEDFEFAIRTVCEPIFEKPLSEISFGHVLLNLFNTARRFNMEVQPQLVLLQKTLLYVEGLGRQLYPQLDLWKTAKPFLEDWLHSQIGITALVNGIKSKAPYWIEKMPELPELVYDSLKQHKNMKLTLEKLTEQISSQRVKQRQSYFLLGMGTTLFLCGSLFFVSGFKTLFSVFISLGLLAWIWGWFKSGNAQ

SEQ ID NO: 5674 - protein, 296 aa, Proteus mirabilis
EMKTFLRGCSIAVFIFISGCSTSPEWRKNAIFATPLQPSLQQEVILARIEQILASRSLTEDEYAQLLYERGVLYDSLGLRALARNDFSMALSMRPDMLEIFNFLGIYFTQAANYDAAYEAFDSVLELDPTYNNARFNRGIALYYGGRLKLAQDDLQAFYQVDPNDPIRSLWLYLVEKEIDSDSAKKQLKQRYLQANKTGQWGWNIVEFYLGDISEKTLMERLNETSTDNTSLAEHLSETNFYLGKYYLSLGDMDSAEALFKLTVANNAHNFVEHRYALLELALLGQQEDLAESDQQ

SEQ ID NO: 5675 - protein, 397 aa, Proteus mirabilis
HQRTRLRREEMEKVVIIDGVRTPMGRSKGGAFRHVRAENLSAQLMQALLKRNPDIDPNDIGDVIWGCVQQTLEQGFNIARNAALLAELPHKVPAVTVNRLCGSSMQALHDGARQIMLGESQVALIGGVEHMGHVPMTYNADFNPALNLSVAKASFSMGLTAEMLAKSFQISREEQDKFAYRSHHLAALATQKGYFDNELVAINGHDAAGDFIRVSTDEVIRYNPSLDELAQLRPVFDPATGSVTAGNSSAVSDGASAMFITSESYAKQHHLKPRAIIRSMAVTGCDPAIMGYGPVPATEIALKKAGLTLSDIDIFELNEAFAAQSLACMKKMNLLDSIDDKINLNGGAIALGHPLGCSGARITTTLLNIMERKDAQLGLATMCIGLGQGIATIIERV

SEQ ID NO: 5676 - protein, 436 aa, Proteus mirabilis
ARMTIEILDKAEYIRLLRKKLGLGPTEMANLLGMNATGERTIRGWENGEHTPTPAKWQSILDLEKSLAKHSKNAPFKQKSLEEADFTFIDLFAGIGGIRLPFQNLNGHCVFSSEWDKFSQRTYLTNYGEMPNGDITQISAKDIPDHDILLGGFPCQAFSQAGLKQGFNDTRGTMFFEIQRILAEKKPKAFLLENVKQLQGHDKGRTLQTIINILQGKHNQAIPDDVPMSEEARHALSIKLNYWVDFKILRAADFGIPQNRERIFIVGYDRDYFKNIDFDSLFKWPIPPKSDTRVGDILQPQEELEAEIKKIGKDKYTISDQLWNGHKKRKEEHKIKGNGFGYTLFNSESEYTNTISARYYKDGSEILIDQSHLGKNPRKLTPRECANLQGFPKNYIVDAVSQGQIYKQFGNSVCVKVVEAVATKMIETLLVLSKKN

SEQ ID NO: 5677 - protein, 408 aa, Proteus mirabilis
DGKTSHKGATNTKNMNVHEFLSNSMKLVTILTIKKQIRNGLTFESCDSLDKLATNKETFFLFIFYPFTFRTHVMKTLGEFIVEKQQDFPHATGELTALLSAIKLGAKIIHRDINKAGLVDILGTNGVSNVQGEAQMKLDLYANEKLKAALKARGEVAGIGSEEEDDIVIFEGDRAENAKYVVLMDPLDGSSNIDVNVSVGTIFSIYHRITPIGQPVTLDDFLQPGNRQVAAGYVVYGSSTMLVYTTGCGVHAFTYDPSLGVFCLSHESVHFPPTGNMYSINEGNYIKFPLGVKKYIKYCQEQDAATNRPYTTRYIGSLVADFHRNLLKGGIYIYPSTASHPNGKLRLLYECNPMAFLAEQAGGKASNGKDRILDIKPTELHQRMPFFVGTKAMVEQAEAFMAQYPDEE

SEQ ID NO: 5678 - protein, 258 aa, Proteus mirabilis
VIETKQHERLRRLSECIKRSGRIHLKDAARILEVSEMTIRRDLSSDVENPYPMSLLGGYIVALAQPHSNLITSTSDIITPDQTQELHIPNLAAGMVSEGDVLFFDNGQLIPTLIELIPESLHFTGICYSHRVFLALSRKKNATVLLCGGEYRPKSDSFYNPLQPCYLDNINPKKAFISAEGVHLDFGVSCYNIDDLHMKRKAMDKSIRKILLTKYHAFDETATGNMGDLAQFDVVITDRKLTDDYEAYCRKSSVKIIY

SEQ ID NO: 5679 - protein, 81 aa, Proteus mirabilis
ILETSHMARYFRRRKFCRFTAEGVQEIDYKDIATLKNYITESGKIVPSRITGTRAKYQRQLARAIKRARYLSLLPYTDRHQ

SEQ ID NO: 5680 - protein, 340 aa, Proteus mirabilis
SRRTIIMRKVIAVVAVIILALLYSSVFVVQQYERGIILRFSKVVRDGENKPVVYEPGIHFKIPFIENVKKLDARIQTMNIQQDRFLSGENKDLLVDSYLKWRISDFSTYYLATGGGNTMQAETLLRRKFSDRLRSEIGRMSVNQIITDSRGRLTIDVRNALNEGTPSRDKSDADDAIAIAAKKVAEETKGKAPAINMNSMAALGIEVIDVRIKQINLPMEVSEAIYQRMRAEREAVARRHRSQGQEEAVKIRAAADKTVTETLAESERESLRIRGEGDAQATKLFADAFSQDPDFYAFIRSLRAYENSFNKDGNDVMVLSPDSDFLRYMKAPTKARAIEE

SEQ ID NO: 5681 - protein, 409 aa, Proteus mirabilis
ILFADNLKSNPFFLLSANHVIFYPLQYMDWNMDKCVHYLSDRVCYIASDKTWIESKAIQQLVTTAQLPEMAYVTGMPDLHPGRGYPIGAAFFSVNRFYPALVGNDIGCGMTLFQTEFNHSKLNLDKIEKKLSEMSDIAPIEWLIDNLPADMQNHPFAHSLGSIGGGNHFAEFQQIDQVINQALFTNSGINKKQLLLLVHSGSRGLGQSILRAHTEQFGHQGLVANTDAANDYLQAHDHALNYAKLNRHLIGHRMMEQIHTQGTVITDVNHNLVEPCELYNQQGWLHRKGATPAHHDIVVIPGSRGDHSYLVKPIISELSLHSLPHGAGRKWMRTECKGRLSHRFTPLQLSRTALGSRIICANKQLIYEEAPQSYKSIETVIESMRSLGLIEVIARLKPVITYKTSGEIA

SEQ ID NO: 5682 - protein, 108 aa, Proteus mirabilis
KRFAHTQVCPALRNFAPIAPATAFSISASLKTINGAFPPSSSETFFTLSAHWRINKRPTPVEPVKLNLRTRLSDVNTSPILTASPVTILITPAGIPACAANSANARAV

SEQ ID NO: 5683 - protein, 141 aa, Proteus mirabilis
RNNALIVIGASMSLFNQIASLLGGEKINQFKTVLEWVETQGGIEGLVKQFNSAGLSELIQSWISTGSNLPINAEQIVQVFSSPVINELAAKINMNTAEASDMAAQYLPKLVDKLTPEGVIPKELDLMSAGMDMLKAKIFGG

SEQ ID NO: 5684 - protein, 192 aa, Proteus mirabilis
RCCAFLLKLTEFKVSIVTVQDIIHTITLFVKEHEIWAVPIVFLLAFGESLAFISLLIPATVILLGLGALIGESGLLFWPIWLAAALGAFFGDWISYWVGYHYKEGVRNLWPISRSPQTLVRGHQFFNRWGVWGVFIGRFFGPFRAIVPLVAGICAMPQRYFQLANLASAMIWAFGILAPGAFGLQWLAKWIG

SEQ ID NO: 5685 - protein, 162 aa, Proteus mirabilis
RPTASISSIKMIQGAAFLACSNISRTREAPTPTNISTKSEPEIVKKGTFASPAIAFANNVLPVPGGPTIRIPFGILPPNFWKRPGSRKYSTSSLTSSFASSQPATSAKVVLIWSSVNMRALLLPKDIAPLPPPPCIWRIKKIQRPISKSIGNQDTKICVRRL

SEQ ID NO: 5686 - protein, 213 aa, Proteus mirabilis
LENAMANKKRSASSSRWLQEHFSDKYVQQAKKKGFRSRAWFKLEEIQQSDNIFKPGMTVVDLGAAPGGWSQYVVQQLGNKGRIIACDLLPMDPIVGVDFLQGDFRDELVLKALLDRVGDNKVQVVMSDMAPNMSGTPAVDIPRSMYLVELALDMCRDVLAPGGSFIVKVFQGEGFDEYLGQIRSLFTKVKVRKPDASRSRSREVYIVATGRKL

SEQ ID NO: 5687 - protein, 177 aa, Proteus mirabilis
CMSALLLYCSTDGQTKKIMTHIANELRQQGYECDVRDLTAVHHSLNLSAYNKVLVGASIRYGYFNKVLDKFITQHLSQLNSMPSAFFGVNLTARKAEKSTPETNAYMRKFLDKTPWKPRLTGVFAGALLYPRYKWIDRVMIQLIMKMTKGETDPTKEIEYTDWNKVSEFATKFSKIE

SEQ ID NO: 5688 - protein, 216 aa, Proteus mirabilis
FVYLLLIFTSKGNLYGKKRVLLKTFRYTTSHVKLIFHRKFFMSLNHVPAGKELPEDIYVVIEIPANADPIKYEVDKESGALFVDRFMSTAMFYPCNYGYINNTLSLDGDPVDVLVPTPYPLQPGSVIRCRPVGVLKMTDESGEDAKLVAVPHTKLSKEYDHIKDVNDLPELLKAQIKHFFEHYKDLESGKWVKVDGWEGVEAAKAEILSSFERAKK

SEQ ID NO: 5689 - protein, 106 aa, Proteus mirabilis
TVIYTTNTAFNFIEKGLKMISRKSDWHPADIIAALRKRGTTLAAISRQAGLSSSTLANALSRPWPKGEKIIADFLGVAPSEIWPSRYFHPETGELLERKIRDKTNN

SEQ ID NO: 5690 - protein, 119 aa, Proteus mirabilis
VLIYMRIIVYGSLRRNQGNHHWMTYAQLLGEYKLAGYKLYDLGFYPAVVEGDGEIECEVYRITPSILTELDELKKNDQDYKRQLISTPYGSAWIYLYQKPVDGLREIKSGDWLKRHEEE

SEQ ID NO: 5691 - protein, 461 aa, Proteus mirabilis
CEPYMLNSLLIVLLLCAISAFFSLSEISLAASRRIKLKQLVDEGNINAARVLKMQETPGMFFTVVQIGLNAVAILAGIVGESAFSPALKDLFSRFLEAPLAQQLGSVCSFIIVTSMFILLADLTPKRIGMIKPEVIALKIVNPMRFCLALFRPLVWLFNGMADLIFKLFKIPMVRNEDITSDDIFAIVEAGAVAGVLRKQEHELIENVFELESRTVPSAMTPREDVVYFDREETEEDIKHKIATQPHSKFLVCEGDIDHIIGYVDSKELLNRVINGQSLNLKEGVHIRKALIIPDTLTLSDMLESFKTSGEDFAIILNEYAMVMGVITLNDVMTTLMGDLIGPGQEEQIVSRDEHSWLVEGGTPIDDVMRALDIDDFPDSSNYETIAGFMMFRLRKIPKRTDYVKFAGYKFEVVDIDNYKIDQLLVTKIDDIPPVKPVLQEAIPAPQTTTEVPFEHEEHKA

SEQ ID NO: 5692 - protein, 80 aa, Proteus mirabilis
MSLLSLIHFIPVNKKHILKKVMWHALISVLADLLIREEKMQVLSSLKSAKLRHPDCKVVRRRGRLYVICKSNPRFKAVQG

SEQ ID NO: 5693 - protein, 167 aa, Proteus mirabilis
LSRYYLTIDCMNMKEWVVTLENEAATVKLGHSVAMATNNQGLIIYLFGDLGAGKTTFSRGFLQALGHQGHVKSPTYTLVEPYMLTPRPVYHFDLYRLASAEELEFMGIRDYFAQDPLCLIEWPSQGEGFIPNADLELHLSYENEGRKAHFIALSQRGNAVLSRIQSA

SEQ ID NO: 5694 - protein, 166 aa, Proteus mirabilis
NDILITHYLSFNFFNWEFYFSEVIVQLTSFTDYGLRALIYMASLPEGKMTSITEVTQVYGVSRNHMVKIINQLSHMGFVEAIRGKNGGIRLGKPAADIIVGEVVRALEPLSLVNCSAEFCHITPACRLKLVLNQAIEQFLKELDRHTLAELVENNSPLYKLLLEDV

SEQ ID NO: 5695 - protein, 314 aa, Proteus mirabilis
LKYYFIKIITMKDDALSLCLQNESNQETTQFSELSTLALVSLINSADITVAYAVKKELPAIAKAVDKICERLRQGGRIFYVGAGTSGRLAVLDSAECPPTFGVSPSLVQAIIAGGHDAMLQAVENIEDNQQAAIEELQRREVNSNDVVIGIAASGRTPFTVAALQYAKQINALTLSITTRGKGMMSEIADLSIAPDVGAGVLTGSTRMKSGTAQKMILGMLSTSVMTRLGKVHKNLMVDVVASNEKLQRRAEGIVSEVCGITTQKAAELLKMVNYHPRKAILMYELHLSVEKVEQMTQRYPYHSLQQQLALFNE

SEQ ID NO: 5696 - protein, 230 aa, Proteus mirabilis
QSSLKETIMRPLANYIDHTLLAADTTEAQIKQLCAEAVEHGFFSVCINTSYIPLARTCLTGSDVKVCCVIDFPFGAGLTATKAFEAAEAIRQGAQEVDMVINIGMLKSGRFDFVKQDIAAVKAACGNTTLKVILETCLLTDDEVRLVCEMCCEVGVDFVKTSTGYSTMGATEHHVALMRQTVGDKMGVKASGGVRDRQTALKMIKAGATRIGASASVAIVTDSDAPESNY

SEQ ID NO: 5697 - protein, 747 aa, Proteus mirabilis
LTLYSHSNYLVIPVYTLGRIQMLYQSENIQADWVKQGIVELVFNASGSINKLDTKTVAMLSEALTVLENTSDLKGVILRSEKPAFIVGADITEFLSLFDAPVEELTQWLHFANHIFNRLEDLPVPTVSAINGYALGGGCECVLATDFRIASPDLRIGLPETKLGIMPGFGGSVRLPRLIGVDNALEIITAGKDINAETALKNGLIQAIVPVDKLKESAISLIEQAIDGKFDWQAARQPKTVALRLTELEHKMSFAVAKGMVMKVAGPHYPAPMTAVNTIEKAAFLDRKAALELETENFVKLTRTDVAKALVGIFLNDQYVKGITKKRHASLPKQAAVLGAGIMGGGIAYQSALKGIPVTMKDINANSLELGMTEALSLLQKRQEKGRMSAVDMAKTLASIHPTLNYASVADAQIVVEAVVENPKVKASVLAETEALLADHAVLASNTSTIPISLLAKSLTRPENFCGMHFFNPVHRMPLVEIIKGEKTSEETINRIVSYASKMGKTPIIVNDCPGFFVNRVLFPYFAGFSLLLRDGADFIAVDKVMEKAFGWPMGPAYLLDVVGIDTANHAQAVMAQGFPDRMGSIDKDVIALLYQQQRYGQKNNHGFYDYTIDKRGKKQKQVDNDIHSLIEHHVGKKQEFNQDTIIARMMIPMINEVIRCLDEGIIASPAEADIALVYGLGFPPFRGGVFRYLDTIGLAQFVANAEQYSELGPLYQIPESLKQKALRNETYYPKPAKVDVNIRELA

SEQ ID NO: 5698 - protein, 182 aa, Proteus mirabilis
IMALTDAKVRAAKPLDKSYKLTDGDGMHLMVHINGSKYWRLQYRFGGKQKMLALGVYPDISLAEAREKRDTARKLIANGFDPSEKRKEVKEEQQKEFNTFEKVARDWHATNKKWSEGHSHRVLKSFEDNIFAAIPQWLKIESVIFHTLDQLCPDYHGVFGRFVLYQIKGLTFTLIYRKSTCF

SEQ ID NO: 5699 - protein, 245 aa, Proteus mirabilis
RGFQMEVFLLSNGKIAGDPQWLSYAKDNIDSMIKKRGIRSAVLIAYAVIRSDHDQRARELSEVLGIEVTCIEHFDSEVEAINNAECILVSGGNTWLLNQMLHEKGLVVPIQRAVRERNIPYIGWSAGCNVATPTIRTTNDMPVRCSVVMPSLGLFPVQINPHYIDATISGHMGETRDERIAEFCAMNPDEIVVAIREGSYLYIQGEELRYYSAKNEGFKIFQHGKTFPEQFDTKMLAKWVPFRCL

SEQ ID NO: 5700 - protein, 446 aa, Proteus mirabilis
VDIQLLYGIIGLLGGVLVGGIAVWWLIQQRLAEKENLLRENYTQLAVAQQKALVIPSLQQQIAHLEQELRAQREIITSQEAELREVTTRWEESRISAEEKQRLLLNSEQRLATQFENLANRIFEQSGRKAQELNRQGLTHLLSPFREQLESFRRQVQEGFGQEARERHTLVHEIRQLQQLNVKMAQEAVNLTNALKGDNKIQGNWGETVLARILESSGLREGHEFETQVSIRHENGSRYQPDVIVHLPHRRDVIIDAKMSLIAYERYFNSSDENEQKQALHAHVNSIRAHIKGLSLKDYHKLPGVTSLDYVLMFIPIEPAYLVAIGHSPDLLEEALKNNIMLVGPSTLLVALRTIAALWRYEYQSQNAQEIADRAAKMYDKLRLFVDDMQGLGNSIQKAQSGYLLAMKKLSEGRGNLISQAEGFKSLGVEIKKTIDNDLVEKSASD

SEQ ID NO: 5701 - protein, 496 aa, Proteus mirabilis
PSAQYQYICSERYEVKITDNPYFREQGYIDGIWCDAKSKDTVEVIDPATNQPIGTVPNMATEEAKAAVDAAAKALPTWRALTAHQRSTLLQRWFQLIQDNKRQLAELMTFEQGKPVAEAEGEITYAASFIEWFAEQGKRTNGEIIPSPSSDKRLMVIKQGIGVCAAITPWNFPAAMITRKAAPALAAGCTMVIKPANETPYTALALAELAAQAGIPAGVINIVTGDAVKIGEVFTSDNRVRKLSFTGSTGVGRLLMRQCADSVKKVSLELGGNAPFIVFNDADIEKAVAGAMGAKFRNAGQTCVCANRFYIHKDVYQQFSERFVAEVKKLKVGNGFTEGVTIGPLINHKAVEKSQSLLADTLQRGATLLCGGERDKAGENFFQPTVVGNVPADSHILEEEIFGPVAPLVIFDNEEEVVHLANNTIYGLAAYFYSEDPQRIWRVAENLEYGMVGINTGLISNEVAPFGGIKQSGLGREGSEHGIEDYMEMKYLCQGL

SEQ ID NO: 5702 - protein, 159 aa, Proteus mirabilis
HMNQIPMTVLGAEKLREELEYLKSVRRPEITAAIAEAREHGDLKENAEYHAAREQQGFCEGRIQEIEAKLSNAQVIDITKMTNNGRIIFGATVTLLNVDTEEEQKYRIVGDDEANIKENLISVNSPIARGLIGKELDDVVVINTPGGQVEYEVLNVEYI

SEQ ID NO: 5703 - protein, 104 aa, Proteus mirabilis
PNTHGHSAKNTEDKKSQIGISADSAPKYTANGGFPFGVPLTAILTRTQAINNECCNNITNKPGKKMAAKLTPGLYMAIVSLWIGFNNIFDCVALKPAFCKIRPL

SEQ ID NO: 5704 - protein, 70 aa, Proteus mirabilis
QVAQQFGLLNENAFSDFLGSNDYSFGSKHINCILPRLISRSLLSTFSLSTAGNDSSKVTLSVYSLERIFP

SEQ ID NO: 5705 - protein, 471 aa, Proteus mirabilis
NSDQLHAIGKKFMHIHILGICGTFMGSLAILARAKGHKVTGSDANVYPPMSTLLENQGIELIEGYDPQQLEPAPDMVIIGNAMTRGNPCVEAVLEKGLPYTSGPQWLHDYILPERWVLAVAGTHGKTTTAGMLAWILEDCGYQPGFLIGGVPGNFQVSAQLGESPFFVIEADEYDSAFFDKRSKFVHYSPRTLILNNLEFDHADIFDDLTAIQKQFHHLVRIVPGSGKIIMPDNDLNLKQTIGMGCWSEEEYTGETGDWQAKKISNDSSHFAVFHKGEQVGEVCWGLSGEHNMQNGLMAIVAAHHVGVLPVDACAALNKFINARRRLELRGEVNQVSVYDDFAHHPTAILATLEALRSKVGGTARIIAVLEPRSNTMKMGISKDDIAPALGRADEVFLFQPPNIQWLVSDIAEKCVQPARWSTDIDTLVEMVAKEAKPGDHILIMSNGGFGGIHEKLLAKLATPKSSVDQY

SEQ ID NO: 5706 - protein, 717 aa, Proteus mirabilis
LRSQIVKTIVIKRDGCKVSFDQTRISDAIKRAAEACQITDDDYCEFVAQSVSQSLAGRSNVDIREIQDAVENQLMAGEHKDIARAYIEYRHDRDVAREQRGRLTQEIRGLIEQSDVSILHENANKDSKVIPTQRDLLAGIVAKHYAKLHILPRDVVLAHERGEIHYHDLDYSPFFPMFNCMLIDLNGMLTNGFKMGNAEIEQPKSISTATAVTAQIIAQVASHIYGGTTINRIDEVLAPFVKASYDKHYKVAQEWQIADKEAYANARTEKECYDAFQSLEYEVNTLHTANGQTPFVTFGFGLGTSKEARLIQRSILENRMAGLGKNRKTAVFPKLVFAIKDGLNHKFGDPNYDIKQLALECASKRMYPDILNYDQVVKVTGSFKTPMGCRSFLGVYEENGEMLHEGRNNLGVISLNLPRIAIEAKGDEAAFWSLLDKRLELAKKALMTRIARLENVKARVAPILYMEGACGVRLKADDSVAEIFKHGRASISLGYIGVHETINALFGTQKHVFDDETLRAKAIAIIQRLREATDQWKAETGYGFSLYSTPSENLCDRFCRLDAAEFGIIPGVTDKGYYTNSFHLDVEKKVNPYDKLDFEAPYPPLANGGFICYGEYPNLQHNLKALEDVWDYSYTRVPYYGTNTPIDECYDCGYTGEFSCTSKGFTCPRCGNHNPARVSVIRRVCGYLGSPDSRPFNAGKQEEVKRRVKHLANGQLG

SEQ ID NO: 5707 - protein, 82 aa, Proteus mirabilis
RLGQISEGATPRKSAMIFSPFGQGRDSALASVEELKPAWREMAASVVPRFLSAAIISAGCQSDFLEIIFNPFSIKLNAVLVV

SEQ ID NO: 5708 - protein, 160 aa, Proteus mirabilis
PLGLNWNLKACRRFILPIIFWSMKNETNILRGRHCIFLMHVHLVFVTKYRRKIFDQDAIEKLRGYFASVCADFDVELVEMDGERDHVHLLINYPPKLAISNLVNSLKEVSSRLLRRDRPDIAQRDYYKGVLWSPSYFAGSCGGAPISIIRQYIEQQETPS

SEQ ID NO: 5709 - protein, 265 aa, Proteus mirabilis
FNEHWFCPIEESDMSDVFHLGLTKNDLQGATLAIVPGDPKRVEKIAKLMDNPVHLASLREYTSWRGEIDGKAVIVCSTGIGGPSTSIAVEELAQLGIRTFLRIGTTGAIQEHINVGDILVTTAAVRLDGASLHFAPMEFPAVSDFECMNALYKAAKDNGSTVHVGVTASSDTFYPGQERYDTYTGRVVRRFKGSMKEWQEMGVMNYEMESATLLTMCASQGLRAGMVAGVIVNRTQQEIPDAELLKKTENNALGIVIEAARTLMK

SEQ ID NO: 5710 - protein, 654 aa, Proteus mirabilis
YEVNPLSDMAKNLILWLVIAVVLMSLFQSFGPSDSNSRKVDYSTFINELTNNQLREVSISGYDINVTKTDNSKYSTYMPMRDDNLLTTLMNRNVKVTGEPIEGQSLLTQIFVSWFPMLLLIGLWIFFMRQMQGGGGKGAMSFGKSKARMLTEDQIKTTFADVAGCDEAKEEVSELVEYLRDPGRFQKLGGKIPKGILMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLSPDVDPAILARGTPGFSGADLANLVNEAALFAARGNKRVVSMVEFEKAKDKIMMGAERRSMVMTEEQKASTAYHEAGHAIIGRLVPEHDPVHKVTIIPRGRALGVTFFLPEGDQISASRQKLESQISTLYGGRLAEEIIYGPEHVSTGASNDIKVATNIARNMVTQWGFSEKLGPLLYADEDGEVFLGRSVAKAQHMSDETARTIDEEIKAIIDRNYTRARQILMDNLDILHSMKDALMTYETIDAPQIDDLMNRREVRPPAGWEGNNGNSGANTATAQPTQTHVTNEPNNKSGSESDTPSDNNTH

SEQ ID NO: 5711 - protein, 181 aa, Proteus mirabilis
IMTNNIKGILTTLWLFFLSLSPNVAYSADSIIQITGYMRDNTCAVAPESQYQTIDLLNNEVKRLYKVGETTPFIPFHIILEPCGESVIAVKFYFNGISDRNNPSLLALDPIATSASGVGIQILDSERSPIPINPSSDQLKWIPLVAGKSNTVFFYSRLMASDMPVLAGKIKASATFTLEYQ

SEQ ID NO: 5712 - protein, 159 aa, Proteus mirabilis
FFNKEHTMTHDHKLKVEAIKRGTVIDHIPAQVGFKILSLFRLTETDERITVGFNLPSENLGKKDLIKIENVFLTAEQANRLAMYAPQATVNIIDDYQVVNKMALSLPELLEDVVPCPNSNCISHNEPVQSSFRVKKFASDVVLTCKYCEKEFERHAVIR

SEQ ID NO: 5713 - protein, 255 aa, Proteus mirabilis
RANNMTQQSKETTDFGFQTVDKDEKQTMVAKVFHSVASKYDLMNDLMSFGIHRVWKRYTIEASGVRRNQRVLDLAGGTGDLTAKFSRLVGENGEVVLADINDSMLKMGREKLRDHGIVGNVSYVQANAEELPFPDDYFDCITISFGLRNVTDKAKALRSMFRVLKPGGRLLVLEFSKPVLDPLSKIYDAYSFHILPRIGQVIVNDADSYRYLTESIRMHPDQETLKGMMEEAGFDQVSYTNMTGGIVALHKGFKF

SEQ ID NO: 5714 - protein, 399 aa, Proteus mirabilis
KQNNMLQQNYRQSELFAITTITVSIAVIGIVIGLTIPMVALRLNLAGISESIIGLISAAPAMGMLIISPFARYIVQWLGKRLAMLLATIISAISLLPLMGSLPLEFLFPLRLITGIASGVMICLGETWINELVPDNKRGRILAIYTTVFTISQLLGPSIIALYGVADKTPILISVLLHIISIVLFLMMDQKVGDKLAKDSEESHFSILRFIKVAPAICGGIIFFAFFDGTVLSMFPIYGLSVGHSEAIAAMMISAILAGDAIMQMPFGWLADHMNRTRLYRICGVITLLASLLLPIAMPHTLVIWPLLLVLGATAGAIYTIALVQIGQYFSGNDLMIANASAAMLWGIGNLSGPILAGAMSEISPSALPFLLVVMTGLFLISTMDRFNLHVDTLNRHTS

SEQ ID NO: 5715 - protein, 674 aa, Proteus mirabilis
TWDKVMAINLLPPQLANQIAAGEVVERPASVVKELLENSLDAGATTIDIDIDKGGAKLIRIRDNGCGISRDDLKLALARHATSKISTLDDLEAIMSMGFRGEALASISSVSRLTLTSRTASQEEAWQAYAEGRDMTVAVKPAAHPVGSTVEVLDLFYNTPARRKFLRTEKTEFGHIDEVVRRIALSRFDVSINLTHNGKRVRQYRAAKETHQHHRRLSAICGNHFVDQAMQLTWEHGDLAIKGWVEHPLAPVQSSEIQYCYVNGRMMRDRLINHAIRQAYEGYLQGEQQPSYVLYLTVDPHQVDVNVHPAKHEVRFHESRLVHDFIYQAVLSVLRQVTEDTLSLDEEDNGALTATTFPENRQVAGENVFSQPYQAPVTSSTQKKSTGAYQGSAGKGLTDTQKSPQKTLDTRQFGESYQRTQGMLYQKMMQESASDVENKEKIPLFPPRPPLNLVDVGHTTNNNETNVISVVPRSVNASAAQTDYTFGRVLAIYQQKYALIESSQGLGLLALEEADFLLKCAQLLPENENLKPQPLLVPLKVTLSKDEINTFKQFQALISDFGIVIDISHGKATIHAVSLPLRQQNLPVLLTKLLAYLATEKLCSKQQIGHWLAKQLSHESGVWSQAQAVGLLADIERLCPQYVRQPSKNLLQLIELQPVVAALNNERSKNANKT

SEQ ID NO: 5716 - protein, 172 aa, Proteus mirabilis
TELNFMLIRVEIPVDIPAIDDLLRQSFPTGAEADLVGHLREEGLLTLGMVAINDEGRIVGYIGFTPVDIEGKDCQWVGLAPLAVAPQYRGQGIGRQLINEGLDSLNEFGYGAVVVLGEPTYYQKSGFIPAKSQGLHCKWPNTEEAFQFYALDNGNVDDIHGLVNFSPLFDEV

SEQ ID NO: 5717 - protein, 84 aa, Proteus mirabilis
FKINRLRVCRFESGLRHHKNIEGRQRTSFFVSEIPVLQGFSSLFSLPKYTKVNPHQVPAVGICVGISRLDNSLYQRKEINHGSY

SEQ ID NO: 5718 - protein, 151 aa, Proteus mirabilis
NWINNDNRVITTLSGRDKMARDFSRAQRVSQEMQKEIAIILQREVKDPRIGMATVSGVEISRDLAYAKVFVTFLNLSAGEESDEEMVENGLKALNEAAGFIRSLLGKAMRLRVVPELTFAYDNSLVEGMRMSNLVSNVVKDDEKRRHKEEE

SEQ ID NO: 5719 - protein, 216 aa, Proteus mirabilis
KYDKRLTFSLMKAYLIPAETVEFSEEIKKSRFITFIAHTEGIEAAKAYIQSIKAQFPDARHHCWAFVAGRPDDSQQLGFSDDGEPTGTAGKPILAPLLGSGMGEVTAVVVRYFGGIKLGTGGLVRAYGSGVQQALKLLPTKTKIPQRRFLVECEYSLVSLLEQVVAEYQGKILSSEYTDKVTFELSLPAVESEKVESKLRDISRGSMQLICLEPNE

SEQ ID NO: 5720 - protein, 199 aa, Proteus mirabilis
IADKVELNNRTITMHKITLAALLLSTSTWVFAHNITEETLLPAISVSDKGELLYDGAKDKFSYQNWNSGLLSGKVRTIQHIAGRSKAKEMNAPLIEAIKQAKFPQNSYQTTTIINTDDAIFGTGPFVRGSVEDSKKEFPWSQFIVDADGVAQKGWGLEKESSAIIVLDKQGKVRFVKEGVLSGAEITSAINLINDLIKE

SEQ ID NO: 5721 - protein, 88 aa, Proteus mirabilis
FMDKLNDITQLYNNPPKDVKHNIVNHRFTDMMLQTKTVATEALDKLAYLAGIKNAPADDKYLKLNTTSLDALLKSAKSLGYDIEVVSL

SEQ ID NO: 5722 - protein, 555 aa, Proteus mirabilis
IVLKNLNDVIHQCRASFDNLNHRSDIHIDSVLALLLKNALAEVEPRSSFEIQPFSILLINENGLRTDLPSSLLWYGATFWELDEALCEYQQKIKELREFLKNKEHSSASIKDFLNKLPSEELNNATEIANDTKLFLKAMEPSDATLFERFLTDRDWWFQPLKKTDQMNGKTLDRGDAFQSSFDLAARVIVANSSRLLTIVKAFTASEDLRRYFETLSKEPVKYLDEDTSSIIHLLSTKPAKVGCNYIYYGAPGTGKSHQLNELTEGDRKIVTVFHPDTQNSDFIGSLKPTNVSGSITYAFRPGPFTTALLEALKNPEQNVYLVIEEINRAPAAAVFGELFQLLDRENGASKYEIDFTDPDMQAYINDQLKAEGLDERSKLSIPANLSLLATMNSSDQAVMPLDTAFKRRWSFRYMKLDFENPAVSSQKLRIMTTQGVYYITWKDFANKVVNHQLKEMKVPEDRLIGPFFLSSTELSNSETSNEAISGKLFVYLWDDVLRHKGRNIIFDKNIGTFGELHEQFIEGKKPVFSEVIESLIISNGNTADDTTGVTEGDE

SEQ ID NO: 5723 - protein, 236 aa, Proteus mirabilis
WIIKMNSILTFSKIKLLFLMLLTLCVINQAYAAVSLGATRVIYFAGEKQVKLPVINNDEKRYLIQSWIENSEGKKDNSFVITPPLFSMQGKKENTLRIIDATNNKLPKDRETLFWLSVKSIPAVEKSLANENMLQLAIISKIKFFYRPKDLTISPDENYKKLQFKRNNDTLIIKNPTPYFITMTELELGGKKLENTMVPPFEDKSISIPTSAYGKLSFQTINDYGAITPKTIVDVR

SEQ ID NO: 5724 - protein, 89 aa, Proteus mirabilis
HYIKRASMKENIHPQYRTVIFHDTSVDAYFKVGSTIQTDKTIEYEGQRYPYVTLDVSSQSHPFYTGKQKTHSQEGNVARFNKRFGRFVN

SEQ ID NO: 5725 - protein, 222 aa, Proteus mirabilis
LWVKFLMDLPTNQKITEEDRHLLRSYIPFLDNLGQFLGDYCEIVLHSFEDLRHSVIHIVNGHVTGRGLGAPVTNIALEKLSKFNRTDQMWEVYFNTKSVRPFKSSSTLIVNNAGTPIGMICMNFALDMPLNALIDSFTDTNNLKHENFSQDVNNLVQNHLEPIKKRVYGNKNIPSKYKNLEIIKELNESGLFEFSATHKIVSAELGISSATIYKHLRNLSKK

SEQ ID NO: 5726 - protein, 312 aa, Proteus mirabilis
RNTNNIRCLPPEMAIIRDNNMKYALGSVLYYWQKETLETFYQQAKQSDADIIYLGETVCSKRRETKPQDWINLAKEVAKSGKQVILSTLALLQAPSELKEIAKLVDNGEFLVEAHDFGVINMLYERHLPFVAGHGLNCYNAYALRLLQKQGMIRWCMPVELSREWLNNLLIQCEELAIRDKFEVEVFAYGHLPLAYSARCFTARSENRAKDDCETCCQKYPQGRQVLSQENQQVFVLNGIQTQSGYCYNLGNDLTSMAGLVDIVRLSPQSDEVFTTLKQFRQNEQGAHPINTIHHHDCNGYWRKLAGLELVE

SEQ ID NO: 5727 - protein, 439 aa, Proteus mirabilis
IKTKSNAIKQSSIYVMADLFCSLFFHLTRYVDHKMKKHLLKYLLIPVALLTLNACSQRATVTPTLPAKFNQHNVPELSQWPTTLSPKANNSREIFDKYAQQIYQKSNPQGMVIVMINNTQSLNRAFGTTSPDSRQTPSMNSLIRIASITKLMTSEVMLKLQDDGKLLVTDPLQKYSYYGVDIPLVNNQSPIRLYHLATHTSGFPREQPGGKWGRPVFIWPTHGDRWNWLKKASLTTPAGQSASYSNLAYDLLADALVKASGKNYPQLLKQYVTQPAGMRDTTLTPSSTQCQRLLIGYRPSPCSETIAAAGSGGVYSTPADMQRWMQGFLNSNNTMRKATASKEQSIYFPRQRLSSIEGMDVAGRADGIGLGWVYMAPANGVPAIYQKTGGGGGFNTYMATIPELNIGVFVVITRKANGTKFSEVTRGTNALVRALAQSF

SEQ ID NO: 5728 - protein, 100 aa, Proteus mirabilis
VAQKGKKMADTQWSIYIVRNRLGSLYTGITTDVERRFNQHQNGTGAKALRGKGPLSLEFYCQVGDRQQASQLEYRLKQLKKIQKEKLIIDQPSDVAQYLA

SEQ ID NO: 5729 - protein, 216 aa, Proteus mirabilis
PMQKPILSCLLIMGFLGSAMSVLAHGHHHEKVRTQAQIDAANGIFEDKDVLNRSLSDWDGVWQSVEPYLRSGELDIVLQKKAETKQDKTVEQYRAYYTQGYKTDVDMIGIENNIVEFHRGDKVDSCEYHYDGYRILHYQSGKKGVRYLFRCDDANSQAPRFIQFSDHIIAPEKAQHFHLYMGNSSQDELLKELTNWPTYYPYSMKGEDIVHEMLYH

SEQ ID NO: 5730 - protein, 67 aa, Proteus mirabilis
TRRNSPLPSVSLYTLSSDFAERTLVSESAILTILAAELRVQNFIESTYTRKCTHIINLMSVELSIRW

SEQ ID NO: 5731 - protein, 421 aa, Proteus mirabilis
KIGNMIMNKWGKLCFLILGGGTIFKLSSMKDVFYVPMQQDWGLSNTQIGFGFTIYAIIQTIGLFSSLYIADRFSKKILLPAGLIGVGLCGAYLSTLPPFTGYLIAFGAMAFFGEVVYWPVLLKSVRLLGNKEEQGRMFGFLEAGRGVVDVLVASGALYIFVLFGEGKTGMQAGLIYYTLATIIVGIITYFIVDNDDKKETSSASEANRQVLEGIKNVVKCPNLWLASMSIFFVYSAYCGLTYFIPFLKDIYALPIALIGAYGIINQYALKMIGGPLGGFLADKVAKSPTIYLKWTFLLSAIAMAIFIMLPHDSMNVYLGMTATLGFGAIIFSQRAIFFAPMDEIGTPRQYAGSAMAFGCIIGYMPSMFAYALYGSLLDNFEGIQGYNYVFSIMVTFSLLGFICATILAKRIKMINNTLNIA

SEQ ID NO: 5732 - protein, 1272 aa, Proteus mirabilis
VMMKWLKRITLTLLIIILLVLGALAWILGTQSGLHFAINSAARWVPGLTINSVNGGWQDLRLTGVEYQMPGVDVNVGELSLGLNLSCLKDKQLCVEALGTRDVIVNVDTSALPPAQETPPSEPLTELNAPLPIYLNSLSLANTRVQIDDMALSLNEFTTAAQWEGRQVTLKPTVINDLLVALPKTPEDGSVAAMAQDVKEVAATMPQAEPKTPQEQALADTIKTIFAKPLLAQLPEIIIPVDINVEGIEGKQLQVSGDTPVTINQLSFQANTQGQQVNLTRLSIDAPEGKASLNGQITLDKQWPVNLDMQAMLREMAGLEEFKDQQATLSLQGAILDELKLALSLTGTVTASLDAQAELAKAHLPLKLTLESQKVRWPLTGDVQYQLNDTRLRLNGQTDNYDLSLRSNIEGQEIPPAKLTLDAKGNEEKIALTRLRLAALQGHADITGVADWSKAISWNALLTISGINTAKQYPDMPAKLDGRIATTGSLYGGSWQLRVPEITLDGNLKNNLIKARGNAYGNDSGQWNIPQLTLILGKNNLDIAGHLGEQWALDANINAPGLNGLVPGLAGVIKGKVNVRGDINKPKIIADINAQGIKWQDQLSVGSVVVKGDIQSDDVISGKLAITARQLKQADLIIRQLTLDAAGTEKQHKLTLKMDGEPVSGGLTLAGSFDKEKQQWQGTLNNTAFDTPVGEWRLNKAMALNLLAEKQQVTIGSHCWVNPNAQLCVPKEITVGESGSAAITLTRFDLAMIKPFLPPETALRGVFTGDATATWNAKGGLPKASVNLKGQGVGVKQNVDGTVLPIDFDAVTLNAGINNGKATLQWLISIAGNGDFKGHVNVADLEKTRQLSGTVDIDNLTLDLIKPFLGKGEIAQGSVGAQLRLGGNAQSPLLFGQFGINQLKVVGHWIPFDITKGNVDIRFNGATSDLSGRIETPEGYLNLTGNADWRKLDEWRAVVAANGNKLRVSLPPMVRIDVNPDLVFEANPHLLKLDGRIDIPWARIVVQELPESAVSASSDEVMLDKELQPIAPKQTSIPIQSNLAINIGDDVTLDAFGLKARLTGALKVAQSKQGLGLNGQVDIPRGEFKAYGQDLQVRKGQILFSGPVDQPYLNIEAIRNPDNTADNVIAGVKVTGLADKPKVEIFSEPAKTQQEALSYLLRGEGLASGDSDSAQMTAMLIGLGVGQSGQLVGRIGETFGISDLALDTQGVGDSSQVVVSGKITDDLQVKYGMGIFDSLATLTLRYRLMPRLYLQAVSGMNQAIDLLYQFEF

SEQ ID NO: 5733 - protein, 335 aa, Proteus mirabilis
REVKMELLCPAGNLPALKAAVDNGADAVYIGLKDDTNARHFAGLNFTEKKLQEAVNYVHRHQRKLHIAINTFAHPDGFERWQKAIDMAAHLGADALILADIAMLEYAAERYPQIERHVSVQASATNTQAIAFYQRNFDVARIVLPRVLSIHQVKQLAQSSPVPLEVFAFGSLCIMAEGRCYLSSYLTGESPNTVGACSPARFVRWQQTPQGMESRLNDVLIDRYAPDENAGYPTLCKGRYFVDKHCYHALEEPTSLNTLALLPELMAMNIASVKIEGRQRSPAYVTEVARVWRAAIDQCKKDPQGFKTQPRWMSALGKISEGTQTTLGAYHRKWQ

SEQ ID NO: 5734 - protein, 921 aa, Proteus mirabilis
AGRNRMTDETVKSLAEEIQTPVERLVQQFADAGIKKTVSDSVSQKEKETLLAWLNRDKESTSQPEKLTLQRKVRSTLSVPGTGGKNKSVAIEVRKKRTYVNRDAVEKAQAAEQAQREAEEKARREAEEKAQREAQEKAQREAEEKAKREAEEAKKKAEEKAKREAEEAKREAAELAKREAAEKDKVKQNEKPKADKADQEKARRIAEQAELKRKTEEAQRRKAEEEARIAAEKARRLAEENAEKWTSDTSSETEGTDYHVTTSRYARDAEDESDAEVEGGRGRGRAAKAPRPKKNNRHSEKADREEARAAGRSNKKGKGRKNSTLQQGFNKPAAAVNRDVVIGETISVADLANKMAVKGSEVIKTMMKMGAMATINQVLDQETAQLVAEEMGHKVILRRENELEEQVMNDRDTSDEMAVSRAPVVTIMGHVDHGKTSLLDYIRSTKVASGEAGGITQHIGAYHVKTDKGEITFLDTPGHAAFTSMRARGAQVTDIVVLVVAADDGVMPQTIEAIQHAKAANVPVVVAVNKIDKPEADPDRVKTELSQYGILPEDWGGETQFIHVSAKQGLGIDELLDAILLQAEVLELKAVKEGMASGVVIESYLDKGRGPVATILVREGTLNKGDIVLCGFEYGRIRAMRNELGKEVQSAGPSMPVEILGLSNVPSAGDEATVVRDEKKAREVALYRQGKFREVKLARQQKSKLENMFANMEEGKVSELNIVLKTDVQGTCEAITDALVKLSTDEVKLKIIGSGVGGITETDATLAAASDAIILGFNVRADASARRIIEQESVDLRYYSVIYSLIDEIKSAMSGMLEPEYKQEIMGLAEVRDVFKSPKFGAIAGCMVVEGNIKRNNPIRVLRDNVVIYEGELESLRRFKDDVNEVRNGMECGIGVKNYNDVRVGDMIEVFQVIEIKRSID

SEQ ID NO: 5735 - protein, 198 aa, Proteus mirabilis
QYFELAMNPQSPKKTNEYLGNKVKQLRQSRNLSLNELSRKSGISKAALSKLESGDSNPRIDTLEAIAIALGFPLGDLFSFTREEYPRLERHKPIVGDYAQEFKFRIGIGNITEIWHIEMKHGAIINSPAHADGTQEHIMVYSGKLMMRFANDETVLLETGDFYAFHGNAPHSYICVEGHMRASVIMSSPNQQHYHHRP

SEQ ID NO: 5736 - protein, 177 aa, Proteus mirabilis
TVFDIGFSQLLLVMVIGLVFLGPERLPVAVKTIAGWVRALRSLAANVQNELTQELKLQELQESLKKVEEKANLQTLSPELKASMDELKEAAQSLKETYQAPTTPGSTETEQSVKTDSTEPTPSDLAALAEANEANDDVQHSSKTVTENTEHVIKPDVPVTKTVTVEKKTTDQANGEH

SEQ ID NO: 5737 - protein, 385 aa, Proteus mirabilis
IYNEVSDFPAKRQVFTGITSVIIIRYLARETLKSQIAILFILMLIFFSQKLVEILGAAVEGNIPTNLVVSLLWLGIPEMAQLILPLSLFLGLLMTYSKLYVESEITVMNACGIGKKALVQAALLLSLLTSVLAAGNVVWLIPWSSVHQEQVLEDAKANPSLAALMEGQFKMSSDRNMVLYLGSVKGNQFQDVFLAQLRPTQNQRPSVVVADKGYTKELPNGNQVVVLSEGTRYEGTAVLRDFRITDFTDYQAVIGHRESTISRNRVEQKTMNELWHSTEPESIAEFHWRLTLIFSVVIMALMVVPLSEVNPRQGRVLSMLPAMLLYLVFFLLQSSLRSSGEKGKVDPLIAMWTVNGIYFALALLLNAWDTLPMRKLRARFKKGVA

SEQ ID NO: 5738 - protein, 720 aa, Proteus mirabilis
ISCDNKIKDIILLNPTVRKFQYGQHTVTLETGMMARQATAAVMVDMDGTAVFVTVVAKKKVKEGQDFFPLTVNYQERSYAAGRIPGSFFRREGRPGEGETLIARLIDRPLRPLFPEGFLNEIQVVATVVSVNPQVNPDIVAMIGASAALSLSGVPFNGPIGGARVGFIDGQYVLNPTVDELKISKLDLVVAGTAGAVLMVESEADLLSEEQMLGAVVFGHEQQQVVIENINALVAEVGKEKWDWAPEPINQSLHDRIAQLAQTRIGDAYRITEKQERYEQIDAIRDEVISTLLAEDESLDEGEIIEIFSGLEKKIVRARVLAGEPRIDGREKDMVRALDIRTGLLPRTHGSALFTRGETQALVTATLGTARDAQTIDDIMGEHTDTFLLHYNFPPYSVGETGMMGSPKRREIGHGRLAKRGVLAVMPTIEEFPYTVRVVSEITESNGSSSMASVCGASLALMDAGVPIKESVAGIAMGLVKEGENFVVLSDILGDEDHLGDMDFKVAGSRNGVSALQMDIKIEGITREIMQVALNQAKSARLHILGVMESAISQPRAEISEFAPRIHTIKINADKIKDVIGKGGSVIRALTEETGTTIEIEDDGTVKIAATSGEQAKQAIARIEEITAEVEVGRIYNGKVTRIVDFGAFVAIGGGKEGLVHISQIADKRVEKVSDYLTMGQEVPVKVLEIDRQGRIRLSMKEAQATQQETAETSSEDPAN

SEQ ID NO: 5739 - protein, 314 aa, Proteus mirabilis
IMSEVKTQIKPKAIFLMGPTASGKTALAIALRQKLPVDLISVDSALIYRGMDIGTAKPDETEQSLAPHRLIDILDPALPYSAADFRKDALKAMEEITAAGRIPLLVGGTMLYFKALLEGLSPLPSANPEIRAEIEKKAAEQGWEAIHHELASVDPVAAKRIHPNDPQRLSRALEVYLISGKSMTELTQISGEALPYDVYQFAIAPKDRNVLHQRIEARFKQMLTCGFEDEVKSLYQRGDLHEDLPSIRCVGYRQMWSYLSGEIDYDEMVYRGICATRQLAKRQITWLRGWHDVHWLDSEDFEQSLNTVLQVVSA

SEQ ID NO: 5740 - protein, 131 aa, Proteus mirabilis
ICVEFAPYVNILIVHSNYTYWECAESGVYMYAVFQSGGKQHRVSEGQTIRLEKLEVATGETIEFDTVMMVADGDNIQIGAPILEGVKVKAEVVAHGRGEKVKIVKFRRRKHSRKQQGHRQWFTDVKITGIA

SEQ ID NO: 5741 - protein, 507 aa, Proteus mirabilis
YSGERMEFNVKSGSPEKQRSACIIVGVFEPRRLSPIAEQLDKISDGYISALLRRGELEGKVGQSLLLHHVPNVLSERVLLIGCGKERELDERQYKQIIQKTINTLNETGSMEAVCFLTELHVKGRNNYWKVRQAVETAKDCLYTFDQLKSNKTELRRPLRKMVFNVPTRRELPSGERAIAHGLAIASGIKACKDLANMPPNICNAAYLASQARQLADSSANVSTRVIGEEQMKELNMNAYLAVGQGSQNESLMSIIEYKGNQDPESRPIVLVGKGLTFDSGGISIKPADGMDEMKYDMCGAATVYGVMRVVAELQLPINVIGVLAGCENMPGGKAYRPGDILTTMSGQTVEVLNTDAEGRLVLCDTLTYVERFEPELVIDIATLTGACMVALGHHYSGLMSNHNPLAHELMNASEQAGDRAWRLPLGEEFYEQIESNFADLANTGGRLGGAITAGCFLARFASKYNWAHLDIAGTAWRSGKAKGATGRPVSLLSQFLLNRAGLNSDE

SEQ ID NO: 5742 - protein, 446 aa, Proteus mirabilis
LVMEKLLSLYQEHIKTLQNRTRDALSRHHLDNVLIHSGEPIGVFLDDSDYPFKVNAHFKAWVPVTDVPHCWLLVDGVNKPKLWFYSPVDYWHSVEALPSSYWTHEIELIHLKNVDDIQKELAPFINKNTAYIGPNTQRADSLGVSLDNVNNQSLLNYYHYYRAYKTGYELACMREAQKMAVNGHIAAREAFQAELSEFDINMAYLMATGHRDTDVPYGNIVALNEHAAVLHYTKLDHQSPDEYRSFLIDAGAEYNGYAADITRTYSAKENHEFTALVKDMNDAQQALIATMKAGVRYSEYHIQMHQRIAGLLHKYGIVKGISEEEMVSEGLTTPFLPHGLGHALGLQVHDAGGFMQDDKGTHLAAPAMYPFLRCTRIVEPGMVLTIEPGFYFIDSLLAPWREGKYRSHFDWHLIEHFKPFGGIRIEDNIIIHDNKIENMTRDLHLA

SEQ ID NO: 5743 - protein, 138 aa, Proteus mirabilis
IRKEQYQMRHYEIVFMVHPDQSEQVPGMIERYKTAITNANGQIHRLEDWGRRQLAYPINKLHKAHYVLMNVEAPQEVIDELETTFRFNDAVLRNMIMRTKHAVTEASPMVKAKDERRRDVAEDLDEEEVDDVAEDSEE

SEQ ID NO: 5744 - protein, 326 aa, Proteus mirabilis
EFEEEIMKLGIETESYHLFFQQGVMDVFDFINKATELGLDGVELNIIPDEGLHPEFGVLTSDSPEYLAKVRQAIEDKNLYCELDTRFTTPKALTKAIDIARGIGADVIRTYMFRRGQYNPKQYPKIIQDIKSIVPLLKKYRIRLAIENHEDETADEILNIVKDIDSIWVGAHCDIGNGMMAWEDPIVTVSKLAPYTYSTHFKDHIVTHDDETLVITGMPLGEGSIDIDECFRLLVEHSPVTRINLENCFPYTSHFARDKGTGGVFELSGSFEVKSPPFDTQLINPLEYYYPAKISPVALKTLMDAQERCVQVSVNKLKELRKKYCY

SEQ ID NO: 5745 - protein, 155 aa, Proteus mirabilis
LVEDKVMQIILLDKVANLGSLGDQVNVKSGYARNYLIPQGKAVSATKKNIEFFEARRAELEAKLAETLAAAEARAAKITALGSVTISSKAGDEGKLFGSIGTRDIADAVTAAGVEICKSEVRLPNGVLRTTGDHEVHFQVHSDVFAELNVIIVAE

SEQ ID NO: 5746 - protein, 126 aa, Proteus mirabilis
YISLYLDIKRFFMIGALNLSPSCVKTLSAVEALPSSSNQHELNGVSQLRSILGRERKTFPVKFSLRGEDGYVESLVTWYDARENHESRSEYRLYFQTNTVMDQARAGSTLVFGIGSDDKFWAELIL

SEQ ID NO: 5747 - protein, 95 aa, Proteus mirabilis
FMSLQSQPIALELIVRNHPGVMTHICGLFARRAFNVDGILCLPMKNSDKSRIWLLVQKDERLMQMVSQVEKLEDVKEVRFSDDLRVFEQMESYLN

SEQ ID NO: 5748 - protein, 364 aa, Proteus mirabilis
ERSCLMFGVLDKYIGRTILQSILMTLFLLVSLSGIIKFVDQLRKVGQGDFTTLDAGIYAVLNILKDVQIFFPMAALLGALLGLGALATRSELVVMQASGFTRLQIAGSVMKTAIPLVLLTVLIGEWGAPQGEQYARNYRAEKIMGNSLVSTNRGMWAKDGNQFIYINRIKSQNEMQGITLYNFDNNRKLETVRYASSATYDPDKKVWLLKQVEQSDLTSPQKITGKKQVSLEWQTRLTPEKLSVVALDPDALSISGLYQYVKYLKQSGQESANYELNFWKKIFAPISVAVMMLMALSFIFGPLRTVPMGLRVVTGIAFGFLFYIVNEVSGRLSLVYGIPAVVAALVPGMLFLVLSLWLLMRRNR

SEQ ID NO: 5749 - protein, 446 aa, Proteus mirabilis
VGRLYLCFSCFYKVHEVSPLFDRYEGGELAVLVHVFFSQEKDIDDLQEFESLVTSAGVKPVQIITGSRRAPHSKYYVGEGKAEEIAEAVKASGADVVLFNHALSPAQERNLERLCECRVVDRTGVILDIFAQRARTHEGKLQVELAQLRHLSTRLVRGWTHLERQKGGIGLRGPGETQLETDRRLLRGKISQILMRLGKVERQREQGRQARSKADIPTLSLVGYTNAGKSSLFNRITCADVYAADQLFATLDPTLRRIQVDDVGTVVLADTVGFIRHLPHDLVAAFKATLQETREATLLLHVIDAADSRFEENIHAVENVLEEIDAHEIPTLYVMNKIDLLEDFTPRIDRNEDNLPVRVWVSAQTGEGIPLLYQALTERLSGEIAHVELRLPPEEAGRLRSRFYQLQAIEREWIEKDGKVGLITRMPMVDWHRLCKQEPTLLDYVV

SEQ ID NO: 5750 - protein, 65 aa, Proteus mirabilis
HTAWFVGLYHLKCELAQIILLNEQTSPHPMQMMAFKLIKEMFVSYCWSDSARSSCWPNSANSNNA

SEQ ID NO: 5751 - protein, 425 aa, Proteus mirabilis
NMAWNQPGNNGQDRDPWGNRNGGNNNGDGNSNGNQGGRDRKASDLDDLFRKLSAKLGGFGGKKGGNTSSGQNGGPRGNAGNVLVSLALGAVVVVWAASGFYTIKEAEQGVVTRFGKFYQIVEPGLNWKPTFIDEVQPVNVKTIRDLTTGGMMLTSDENMVQVEINVQYVVSDPEAFLFNVTTPMNSLGQATDSAVRGVIGRSEMEKILTSNRSEIRDQTRQELEETIRPYKMGISIVDVNFQVARPPEAVKAAFDDVIAAREEEQKTIRQAEAYKNEVLPLAKGNAQRMIEEATAYKTSVVMKAEGEVASFAKILPEYRAAPEITRERLYIETMEKVLSKTRKVIANDKGNSMLVLPLEQMLRQQPKAPTSVNSVTEVPARISTPTPSTNTTPTQKPATTYGNGGYGSNNSGGYGQPYGSNQGGQ

SEQ ID NO: 5752 - protein, 483 aa, Proteus mirabilis
MHFRSITRIVGLLVILFSVTMIIPGIVALIYRDGAGRAFSQTFIVALIIGLMLWIPNRNNKSDLKPKEGFLIVVLFWTVLGSVGALPFIFSEQPHLSITDAFFESFSGLTTTGATTLVGLDSLPKAILFYRQMLQWLGGMGIIVLAVAILPLLGVGGMQLYRAEMPGPLKDNKMRPRIAETAKALWLIYVLLTIICALALWIAGMDVFDAISHSFSTIAIGGFSTHDASIGYFNSPTINVIIGVFLLISGCNFALHFSVLTGRSLNIYWRDPEFRMFIFIQLGLVIICSLILWLYSVYDSGWTTINQAFFQVVSMATTAGFATDSFAQWPTFLPLLLLCSAFIGGCAGSTGGGLKVIRILLLFLQGSRELKRLVHPNAVYTIKLGHRALPERIIEAVWGFFSAYALVFIISLMLLIATGVDEFSAFSAIATTLNNLGPGLGIVADNFTTMNPAAKWILVVTMLFGRLEVFTLLVLFTPTFWRD

SEQ ID NO: 5753 - protein, 390 aa, Proteus mirabilis
LLFRLLMSSLDLHHLAQNIKRWGTELGFQQTGICDTDLSLEEPRLQAWLDKQYHGEMAWMAKYGMTRARPHELVPGTLRVISVRMNYLPTDAAFARTLNNPEQGYISRYALGRDYHKVLRQRLKKLGEKITQYCQQFEYQGIVNFRPFVDSAPIMERPLAVKAGLGWVGKHSLVINNQAGSWFFLGELLINLPLPIDSPVEEQCGKCVACMTTCPTGAIVEPYTIDARRCISYLTIELEGAIPEEFRPLMGNRIYGCDDCQLICPWNRFSSLTEEDDFSPRRALHTPELLDLFQWSEEKFLRITEGSPIRRIGYLRWLRNISVALGNAPYQDKIVLALQERFGLGEVLDEHLHWAIAQQKAKREEKTLKIQTSQQKRLVRAITKGLPRDA

SEQ ID NO: 5754 - protein, 68 aa, Proteus mirabilis
VLLRRRGTFSLLPPSLTIYLNNLLNPLEQERLAKTLSRLRQGNKQNIDLLSPPEERLKCIPCTRYSRI

SEQ ID NO: 5755 - protein, 975 aa, Proteus mirabilis
QWLRRQPIEYVKNMENKSAPKEPSLDTTYNPTEIEQPLYQHWEKNGYFKANGDTSKESFCIVIPPPNVTGSLHMGHAFQQTIMDTMIRYQRMQGKNTLWQAGTDHAGIATQMVVERKIAAEEGKNRHDYGRDAFIDKIWEWKAESGGNISNQMRRLGNSVDWDRERFTMDEGLSKAVKEAFVRLHKEDLIYRGKRLVNWDPKLHTAISDLEVENREVKGSMWHLRYPLADGVKTAEGKDYLIVATTRPETLLGDTGVAVNPEDPRYKDLIGKEVILPLMNRRIPILADEHADMEKGTGCVKITPAHDFNDYEVGRRHQLPMINIMDFDGNIRVSAEVLDTNGVESDVYSTEIPKAYQGMERFAARKAIVAEFERLGLLEEIKPHDLTVPYGDRGGVVIEPLLTDQWYVRAAPLAKPAVEAVKNGDIQFVPKQYENMYFSWMNDIQDWCISRQLWWGHRIPAWYDNEGHVYVGRDEEEVRRENNIAADVALRQDEDVLDTWFSSALWTFSTLGWPENTEALKTFHPTNVLVSGFDIIFFWIARMIMMTMHFIKDDEGKPQVPFKTVYMTGLIRDEEGQKMSKSKGNVLDPLDMIDGITLDKLLEKRTGNMMQPQMAERIAKRTKKEFPEGIEAHGTDALRFTLAALASTGRDINWDMKRLSGYRNFCNKLWNASRFVLMNTEDQDCGYQGGEMTFSLADRWILAEFNNTIKAYREALDNYRFDIAAGILYEFTWNQFCDWYLELSKPAVHKGNDAQKRAARHTLIEVLEGLLRLAHPIIPFITETIWQRVKEVKGIEGETIMLQAFPEFDASLVDEQALNDLEWIKEVIVAVRNIRAEMNIAPGKPLDVILRGADETAKRRVSDNIGFLKAMGRLADIRPLAEGEEAPLSVTKLVSGAELLIPMAGFIDKDAELARLDKELEKVEKDITTLDSKLSNEGFVNRAPEAVVAKERERLASCLNAKEKLIAQKVSIAAL

SEQ ID NO: 5756 - protein, 105 aa, Proteus mirabilis
LYQRILNSTDIKLMMWVHLRVYVDSIKFCTRNSAARIVKMALSDTKVRSAKSEDKVYKLTDGNGLFLLVHSNGSKYWRFCYRFGGKEKMLVFGVISYFYRLLIMI

SEQ ID NO: 5757 - protein, 445 aa, Proteus mirabilis
MSERKYFGTDGIRGKVGDSPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDEVEEAIEAEMEKPITCVESAELGRANRIVDAAGRYIEFCKGTFPNENNLNGLKVVVDCAHGATYHIAPNVFRELGAEVITIGCEPTGININDECGATDVRMLQKRVLEEGADVGLAFDGDGDRIIMVDHKGLKVDGDQILYIIAREALRQGQLRGGAVGTLMSNMGLEIALKQLGIPFVRAKVGDRYVLEKLQEKGWRLGAENSGHIILLDKTTTGDGIVAGLQVLSAMVRNHMSLHDLCSGMKLLPQILVNVRFTGNHDPLQSTEVQQVAKEVEAELGGKGRVLLRKSGTEPLIRVMVEGENEEQVTAMANRIADAVKHVG

SEQ ID NO: 5758 - protein, 768 aa, Proteus mirabilis
TSRRLKTGFFIMTIRNHTLGFPRIGLNRELKKAQESYWAGNISQAELLAVGKELRARHWQQQANAGVELLPVGDFAWYDQVLGTSLLLGNIPPRHRNEDGRLDLDTLFRVARGRAPTGKPAAASEMTKWFNTNYHYIVPEFQQGQSFTLAWQQLLDEVDEALALGHNVKPVLLGPITYLWLGKVKGPEFDRLSLLDAILPVYQQVLSQLQQKGIEWVQIDEPALVLDLPIEWQNAYQVAYQALTGQVKLLLTTYFDGITHHLDIIKNLPVNGLHIDLCAGQDALQVIHQALPKDWVLSLGVINGRNVWKADLTTRYQQVVALKGKRPLWIGTSCSLLHSPIDLSAETKLDDEVKSWFAFAVQKCAEVALLAKALNAPEGEYDEQLAQYSAPIRQREHSSRVHNAKVAARLQAINAQDSERTSPYQQRAKVQRARFNLPLWPTTTIGSFPQTTEIRTVRLDFKKGRIDTTAYRTNISEHIKQAIDEQERLGLDVLVHGEAERNDMVEYFGEHFEGYVFTQNGWVQSYGSRCVKPPVIIGDISRPAPITVDWATYAQSLTDKPVKGMLTGPVTILCWSFPREDVSRETIAKQIALALRDEVDDLQKAGIGIIQIDEPALREGLPLRRDEWQAYLDWAVDAFKLSAAIADDETQIHTHMCYCEFNDIMEAIAALDADVITIETSRSDMELLEAFEHFDYPNEIGPGVYDIHSPNVPNVEWIVGLLRKAQSRIPAERLWVNPDCGLKTRGWSETRAALANMVEAAKYLRQNV

SEQ ID NO: 5759 - protein, 442 aa, Proteus mirabilis
SNIFRRYFVTKTKWTCIRNIQCLPRRILVSFFMDQNIIGNMKRLQAFKFQLRPNGQQEREMRRFAGACRFVFNRALARQNENYEAGNKYIPYTKMASWLIEWKSDTETQWLKEAPSQPLQQSLKDLERAYKNFFQQRTAFPRFKKRGKNDAFRYPQGVKLDQTNSRISLPKLGWMRYRNSREVVGEVRNVTVSQSCGKWYVSIQTEYEATEPQPESTSIVGLDAGVTKLATLSDGTVYPPVSSFKVNQRKLARLQRKLSRKIKFSANWQKQKRKIQRLHSHIANIRKDSLHKVTSEISKNHAMIVIEDLKVSNMSKSAKGTTERPGRNVKAKSGLNRSILEQGWYEMRRQLEYKQLWRGGQVLAIPPAYTSQKCAYCGHTAKENRQSQSQFECLECGYTANADINGARNILAAGHAVLACGGRVQSGRPSKQEPAEVIQTSV

SEQ ID NO: 5760 - protein, 103 aa, Proteus mirabilis
TFFRLNLVLLIEVDMRYSEQIKPISYLKANVAEVMTKLTESGAPMIITQNGEAKAVIQDITSYEETQETLALLKILALGQQQVEAGEVKDIKSVVQRLKSKRK

SEQ ID NO: 5761 - protein, 849 aa, Proteus mirabilis
IVIRRCLSRQFHHSDSLEVIMSKDPFQDREAEKYASPIASREFILEEMKKRPAPMSREDIAQALKISGEENLEALRRRLRAMERDGQLVFTRRQCYALPERLDLWKGKVIGHRDGYGFLRAEGQKDDLYLSQDEMKKTMHGDVILAQPLGMDRKGRREGRVVRVLEPRNSQIVGRYFIESGMGFVVPDDSRLSFDILIPKEDIMGARMGNVVVVEVTTRPTRRTQAVGRIVEILGETMGTGIAVEIALRTHEIPHTWPPKVEKEIADLKEDVPESAKQGRVDLRDLPLITIDGEDARDFDDAVYCQRKKGGGWRLWVAIADVSYYVRPQTALDTEARSRGNSVYFPSQVVPMLPEVLSNGLCSLNPQVDRLCMVCEMTVSEQGRLSSYKFYEAVMSSHARMTYTKVWKIIQGDEELREHYQPIVKDIEHLYELYQALDKAREQRGAIGFESEEAKFIFNAERRIDRIEPVVRNDAHKLIEECMILANIAAARFVEKNEEPALYRVHDKPKEESVMNLRSVFNELGLTLPGGLTPEPGDYARVMKEVEERPDHEMLQTMVLRSMKQAIYDPENRGHFGLALKSYAHFTSPIRRYPDLALHRAIKYQIAKQQGHGSQRWTPTGGYHSDMDTMLQLGEHCSLTERRADEATRDVADWLKCDFMLDQIGQQFTGIITSVTGFGFFVRLNDLFIDGLVHVSTLNNDYYQFDNVGQRLIGESSGQVYRLGDEVEVKVEAVSMDERTIDFSLISTTRKARNPGKTARVRALKGGKDKKNASSSKSRRRDASKDKNFEPDSAFRKGKSSKEKQSKDKVIKEKIAKDKASTKRKKASAQTKKIEAKLKAKRAAKRTKA

SEQ ID NO: 5762 - protein, 110 aa, Proteus mirabilis
RVISVVTANRLVLTGTVCKALIRKVSPAGIPHCQFVIEHRSTQEEAGLKRQSWCRMPIIASGKALQTDTHSITVGSKVTVSGFISSHQARNGLFKLVLHAEQIELIDSGD

SEQ ID NO: 5763 - protein, 317 aa, Proteus mirabilis
LNYRKNIMISYKKTMRFLLYLSCGLFSNPVLSFTCKVASTGQIVGDGAANIRVNLTPRVEVNQNLVVDLSQQILCKNDSYGGPRDPIDVDHVNLVSGTTFGGALNNFDGSLLWYNSYYPIPLYYDTKVINIKDRNFIPLNLRLYLKSIGAAGGKQINKGDLIAKIEMYKIADWDGGHPRFFTWNIYALNDVIMPTGGCDLSSRNVTINLPEYPGNAQPIPLSIFCPRQQNISYYLTGSTSDVNNTVFTNISSNSPAKGVGIKISNNNGVIPANTPVKLGNVTNNSVSLRLSASYGETGERVRAGNVKSVIGVTFVYE

SEQ ID NO: 5764 - protein, 100 aa, Proteus mirabilis
GKHRMAKGQSLQDPFLNALRRERVPVSIYLVNGIKLQGQIESFDQFVILLKNTVSQMVYKHAISTVVPSRPVSHHSNTGTNQAGTNYSGGNATQQDDVAE

SEQ ID NO: 5765 - protein, 228 aa, Proteus mirabilis
KEFREQVRIMVRASMATRNKKEVTISDSDSQFNHEVNMGKFPGLHRRAIVVIAIILLVVFFWPTSENTTPPQPSSSTQDLPVPVAPSVSNETQNVPNTLPPAQDSLNAEQETEDLPEEGEANNTNNNTPVNTTPQAPSTATENWQTYTIKEGQTLAQLFRDNQLLVNDAFTMAKSEGPQKPLSQLRAGQTIRLQRGSQGEVSMLEVTDNTGTVITFTRLSDGSYYRTP

SEQ ID NO: 5766 - protein, 569 aa, Proteus mirabilis
KGHRTMGAQQDNATGKTFTGAQLIVYLLERQGITTVAGIPGGAALPLYDALSQSQSIRHILTRHEQGAGFIAQGMARANGQPAVCIASSGPGATNLVTAIADAKLDSIPLVCITGQVSSAMIGTDAFQEVDTYGMSIPITKHNYLVRDIAQLPEIICDAFRLAMSGRPGPVWVDVPKDIQQATITLDQLPPIPQKDAAPAFNTDLVIQAAQMINQAKNPVLYLGGGIISSEACKEAIELAEKNSLPTTMTLMGLGLMPPTHPLYLGMLGMHAARSTNFILEEADLLIVLGARFDDRAIGKAEKFCPNAKIIHVDIDRAEISKIKRPDIAIHADAKAVLSLLLPLININQRNEWIDRVNTLKQEYPLEMKNSHNILSGYGIVLAAANCVDDEAIITTDVGQHQMWVAQAYPLNRPRQWLTSGGLGTMGFGLPAAIGAALAEPNKKILCFSGDGSIMMNIQELATAAEHQLDVKIILINNQALGLVHQQQTLFFDERIYAAAYPYQTDFIRIAQGFGLDTCDLNQEADPQAALQAAIAKPGPCLIHAMIDINEKVFPMVPPGAANIEMIGA

SEQ ID NO: 5767 - protein, 616 aa, Proteus mirabilis
MRHSDMTTETDMTFADLGLSAPILTALNDLGYEKPSPIQQQCIPFLLDGNDVLGMAQTGSGKTAAFSLPLLHNLDESLKAPQILVLAPTRELAVQVAEAIEDFSKHLPKVNVVALYGGQRYDVQLRALRQGPQVVVGTPGRLLDHLNRGTLDLSKLKGLVLDEADEMLRMGFIEDVENILSKIPAEHQTALFSATMPEAIRRITRRFMNDPKEVRIQSSVTTRPDISQSYWMTYGARKNEALIRFLEAEDFDAAIIFVRTKNATLEVAETLERNGYNSAALNGDMNQSLREQTLERLKNGRLDILIATDVAARGLDVDRISLVVNYDIPMDSESYVHRIGRTGRAGRAGRAILFVDNRERRLLRNIERTMKMSIPEVELPNAELISQRRQEKFAQQIAQQLETSNLDQYRALLPKLAPQGEEALDMETLAAVLLKMAQGERALILPPDPVRRPRREFNDRDDRRNDRERSPRRERRDAGEMDLYRIEVGRDDGVEVRHIVGAIANEGDISSRYIGNIKLYGSHSTIELPKGMPGDLLSHFTRTRIMNKPLNMQLVGDAQPYRERRNSSRRDGQPQGGRRFSKGDQPPRRGNGERGNFRGRGNNENAPRRRSSSHNQ

SEQ ID NO: 5768 - protein, 129 aa, Proteus mirabilis
KGISLMEPIYIKVYINRIEVRDLHTKKEFSVERHFTHSRMLIGDFYPAIEAIRTALTQIGINPLSFFCRKRNVVIHPLERTEDGLSQVEIRLFNEVIAGGLNNKYKKIVISAKLTPLMDAEVIELINKS

SEQ ID NO: 5769 - protein, 353 aa, Proteus mirabilis
PVVSALFFPKSYFLKPLSLRGFFWSVEKHISHHLSYHQRRTLMTNPLYHKHIISINDLNRDDLESVLHVADKLKQHPNSQLLKDKVIASCFFEASTRTRLSFETAIHRLGASVVGFADGSNTSLGKKGETLADTISVLRTYADAIVIRHPQEGAARLASEFAGDIPVINAGDGANQHPSQTLLDLFTIKETQGRLDNLNIAMVGDLKYGRTVHSLAQALAKFTGNHLYFIAPKVLAMPEHILHLLEEHGVEYSQHETVDEVMSELDILYMTRVQKERLDPSEYANVKAQFILTSADLVNVKDNLKILHPLPRIDEITTDVDNTPYAYYFQQAGNGIYARQALLALVLNKNLVL

SEQ ID NO: 5770 - protein, 183 aa, Proteus mirabilis
MLRSPKVFNKIRTRLVKDGPRFLRYPLQITPFALQRDILEQFLSWQFREALAEGDLHFLEDKWLKVEIKDLHLQWFISVCDDKLIVSRSEKEDVSFSGNANDLILIAARKEDPDTLFFQRRLQIEGDTELGLYVKNLMDAIELDSMPSVLRFGLLQLADFVKSGLQDEVEDTAHSHELSSTSC

SEQ ID NO: 5771 - protein, 274 aa, Proteus mirabilis
GLDGLNNTTMRRGIMTDILQTHPSVLPLTGGINFRDLGGKKLSNGGIIKPGLLFRSGSLDRLTDTDQALLIDKNLFQILDYRDTGEIVDKPDRVWEGAQYYHAPANPLSKEVSANLEKLTPEILEQFDAKAFMFQLYKLLPINNPAYKQLATLLKQPEKGGVIQHCAVGKDRTGVGSALVLFALGASLDVVMEDYLLTNETLAPFRAYLLEEHAKTLSENVVNKFAYVYSVQEEFLQTALASINQHYGNIDTWLEKDIGLDAQSRESLQNYFLE

SEQ ID NO: 5772 - protein, 72 aa, Proteus mirabilis
KRVGPSHHKNIKRRQQTSFFVSKIPVLQGFPRILTLPTYTQLNRHQVNDVGTFAGICRFDKVLYSQFGCEDS

SEQ ID NO: 5773 - protein, 460 aa, Proteus mirabilis
TLAGTIMANKIEHLDTLASEIEKQAGGFSNIATLTHCMTRIRLILKDSSLFNTEALKQVEGVKGVVFNGEQHQVIVGMGTAAKVYSIMNKRMQKNTDNSEETPASTPVKKGFSIRRMLNTLAAIFVPTIPALIGCGLIMGLINIIRLVAPGLVDQFPELFKLFKLIGSTVFAYLSIMIGINTAKELGASTSIGAVMAGLLAMPGLADITLFGEKLQPNSGGIFAVLMVVVFSSKLELWFRSIVKESLDLILTPFVTILVSALVAIMVFQPIGHYLNQLLAQGVSLSLLNHGGGAVVTGAALGGSFLFLLLTGLHQGLIPIHTEILNTFGLNYLFPILAMGGMGQVGSCFWVYLRTKNQRLKKTLMGALPVGIFGVGEPLLFGVSLPLGKPFIAGCIGGAAGGALMAYFQVGIIIPFGTAGLSLISLVGDGQIIKFLIAVLGAWVVGFIASILIGFTDPEK

SEQ ID NO: 5774 - protein, 554 aa, Proteus mirabilis
ACKGSMEIFFTILILILVVSVSGVITKVIPFRIPLPLIQIVIGALLAWPQFGLHVTFDPELFLVLLIPPLLFVDGWKTPTREFIQNGREIFILVLVLVMVTVVGIGYLIYWIMPSIPLISAFALAAVLSPTDAVALSSIVGKGRIPKRIMGVLEGEALMNDASGLVALKFAVAVAMGTMIFTVGGATFEFFKVAIGGLLAGIAVTLVYSKSLRLMSRWSGDDPATQIVFMLLLPFASYLIAEHIGFSGILAAVAAGMTISKSGVIRNAPLAMRLRADSVWSMLEFVFNGLVFIMLGLQLPVIWTSSVIQADLDPEVEVWMLFAAVFVIYFALLILRFTWLWLMKKISHLFMKKHPLDFATYTTRELWLSSFAGVRGAITLAGALSIPLFLTDGSTFPGRYQIIFIAAGVILLSILVGIISLPFLLKGIKATDKEADKNEVRYAKKVMAEVAIVSLNKMEERLAASTEEQLDAEEINEVASRVAGYLRRRTADQDEMMHNMLVEDLERRFRLTALRAERGELYHLRATRKISNETLQLLLHELDLMEALLVEKDS

SEQ ID NO: 5775 - protein, 210 aa, Proteus mirabilis
NQWGDSIMLLQFSSAQGPEECCIAVEKTLNYFLTVTEQRQVDVIILEQEPSRYGLKSVLVSLKGAEAKAIAQQWSGTVQWQCTSTLRPKHKRKNWFIGIAYFDPPQEIQDTEILFETMRANGPGGQHVNKTSSAVRATHIATGISVKIQSQRSQHANKKLAKQLIAWYLTHYLSQQQASFNNQRHLAHHRVIRGNATHCFYGREFLPITK

SEQ ID NO: 5776 - protein, 91 aa, Proteus mirabilis
LSRGFWSFCTLSNQGAYLYPDLSEEHMLLINSHNRHESQVSPQVMGIVVCLLVSSVWSFKTEREVMCERFYQLQDFASQHPEAEAIFYLID

SEQ ID NO: 5777 - protein, 311 aa, Proteus mirabilis
GERGTMDIAVIGSNMVDLITYIDRMPKEGETLEAPAFKIGCGGKGANQAVAAAKLNSKVMMLTKVGDDIFADNTIMNLESYGINTRYVEKVPGTTSGVAPIFVTSQSSNSILIVKGANQHLSAEDIDRAAVSLKKCRMIVLQLEIPLETVYHAIEFGNKHHIPVLFNPAPASKALDLTIAAQCDFFVPNETELEILTGMPINTLDEIREAAYFLLEKGFKNIIVTLGEKGALWVNGEIEKYIPAIEVNAVDTSGAGDAFIGCFSHYYVHTGNIEEALNKAVMFSGLSVTGKGTQSSYPSIEEFSEFLSSAK

SEQ ID NO: 5778 - protein, 340 aa, Proteus mirabilis
SFFINYNALIGEPKSKNMNLESIIKLTSADMAAVNDAILYQLNSDVSLINQLGYYIISGGGKRIRPMIAVLTGRALDYQGDKHISVAALIEFIHTATLLHDDVVDESDMRRGKQTANAVFGNAASVLVGDFIYTRSFQMMTDLDSMRVLKLMSSATNVIAEGEVLQLMNCNDPDITEDDYMQVIYSKTARLFEAASHASAILCGATPEQEKAFQDYGRYLGTAFQLIDDLLDYDADNTQLGKNTGDDLDEGKPTLPLLHAMHHGNETESQLIRQAIEKGNGRHLLDTVLKTMKQCGSLEYTRQKAEEEADKAIEALAIIPDSSYKDALIGLAHVAVQRQS

SEQ ID NO: 5779 - protein, 394 aa, Proteus mirabilis
AIFIKDQDFIFIGASMKRYHKVITLFLTSSTFISFLALMANWFYLNKIGWLDLFLSSIISSENIFIIAFFLVISFFSILLIFMLPSINIIMFLNKDDEYILKYNEVRLNYVKIFLIIATVANLFFIVSLFFSNDYYSLYLKLFLLFVLVFTGWALYYRGLKKIVSQDLSFKKSSKARWKKIEIYVLIPFILLLILAFYSFSFYMVTKGLKSNGESAWIQAVYLFFIFEFIIVNSVIPCFIYFRGMNEKSWFSIITSISGCLVLFIFIISMLIPSIPSIIINATMKLSGIKNESPRTYVVDNKEYPEELFELDLWNKRTIKDSNRFTIEGVSMYSFGETNLVCPKDIVTPYGNSLSNYFFDKKEDDKVSNELKRLAETCIPFDKKSLKNIGMSKN

SEQ ID NO: 5780 - protein, 600 aa, Proteus mirabilis
VILIPNFITPRIASFYLRFFNLLNKHRKWYTQLMYEFDLILLLLQQMCVYLIIAWFLSKTPLFTPLLQVTIKLPHKLMCYVIFSIFCIMGTYFGLHINDSIANTRAIGSVLGGLLGGPYVGFLVGFTGGLHRYSLGGMTALSCMVSTIAEGLIGGLVHRYYVKHGQMHRIFNPWTAATVTFFAEIIQMSIILLLARPFDEALSLVKNIAAPMIVANTIGAAMFIRILQDRRAIFEKYTSAFSAQALKIAVCTEGILRKGFNQDNSTRVAKVIYQELKVSAVAITDRDKLLAFIGIGADHHLPGTPISSEQSKQAINNNEVVYADGNETPYRCTLSPHCKLGSTLVIPLRGENNRVIGTIKLYEAKNRLFSSINRTLGEGIASLLSAQILAGQYERNKQSLLESEIKLLHAQVNPHFLFNALNTLQAVIRRDSDQAKQLVQFLSAFFRKNLKRPEAIVTLSDEIEHVTAYLQIEKARFQESLQIDIQIPEHLATARLPAFSLQPMVENAIKHGTSQLLGIGKITIRAHQEDHLIVIEISDNAGLYHSQGASHQLGLGMRLVDKRIKLRYGDLYGVLVECQPDNYTKIKICLPLEKNMDNAA

SEQ ID NO: 5781 - protein, 123 aa, Proteus mirabilis
EIIMKEKNSDGITQKDELYSLDKAGINYIELNITKSHFYDLNNNFHQLESFVNWDNGNSTLITDVLLHQKPNTDNNKISQQLMNNIINEMASFSSLGNSESIPINQFINSIESTVSLIPNLLR

SEQ ID NO: 5782 - protein, 133 aa, Proteus mirabilis
LVFLILLFMTIFNMKFVFLPLISIVLITGCSSKWEPKGVPDYTLQEAKLICDLDANTRYPIRKEVLQHTVYRDVEKTCRKDDKERCGDKKTYTERVPMTESYVADINQEDRKTFYTSCMSLKGWEQKNYYFWQ

SEQ ID NO: 5783 - protein, 340 aa, Proteus mirabilis
DNAISECSTSLLRSNRYMKKRAIYLILLMLILIALAVLFRAHNQYLLLQGEVDAPEVIVASKAKGRVIERHIERGDDVKAGQLMITLDSPELNAQVAALEAAKAQAQAQLDLSIHGTREESIRNLQAILSQAQAQATNATKDYQRLSAVANKGYVSANELDSARSRRDVAVQQAKAAQAELDEAKNGDRIELREKYRAALQQAEQQLIELKVQQQDLQVKAPVDGEVGPIPAEVGELFNANSPLATLIRLPEAYFVYNLREDILADIRKGDRITITVPALGDKEVEAEVRYIAPMGDYATKRATRATGDFDLKTFEVRLYPTSQIEGLRPGMSALWRWDK

SEQ ID NO: 5784 - protein, 88 aa, Proteus mirabilis
GAYMMINTVVGKRIQNRRKELNISSSKIALQLGMTEQYYLKLENGYTKITVDELICIAIILKVSPQSLLLKSTVSQQNRDSQLNNYYH

SEQ ID NO: 5785 - protein, 872 aa, Proteus mirabilis
KSDIMSFSTGINSLSGIKINNVKLFIFILALLFSVDSKSEEEFYYNPYFLSDNPESVADLSSFEKGLEVPEGNYLVDIYLNDIFLKTQYINFIENKGQLSPCITKAELKSWNVNLNLITDEQNKDKNNELDEHCQSLTSLISQATANFDVGSQKLNLTIPQVYLVNQSRGFIPPELWDDGIVAGFITYILNGSKTRNDGSPDTHFTHLNLQSGINLGPWRLRDNSIYSYDSINKSSWKHLNTYIERGINKLYSRLIIGDSYTQSEVFDSINFRGFQLSSDEVMLPDSQRGFAPIIRGVARTNAEVTIQQNGYVIYRNSFPPGPFVIDDLYSTSNSGDLEVTITESDGSTQTFTVPYSSVPLLQREGHTKYSVTVGSYRSGNDEQERPYFLQGSVIHGLPAGWTIYGGTQLSKNYQAASIGVGKNIGRFGALSFDITEARSILPDDSTHRGQSIRILYNKSINELGTRVQLAGYKYATSGFYTLAETTYKKMRGNYIQTEDGVVEVSGLPQSYYDLIYNKRQRIQLNITQKIGDQSTLYIIGTNQRYWNSKKQDNQLQIGLNTIIKGINLGLNYSLSKTSWNDSKDQMLAFNTSIPFSNFMRSDNDSIWQNASLSTNSSHNMKKRFNNTIGLNGTLLEDKNLSYNIQTGYSHEEESDSTGYASLSYNGSYMNSNIGYNYTDTSHQINYGMSGSILAHSGGITLSQPIYQTAVLVKVPEVKNIKLENNSGITTDSNGYAVLPYVSEYKENRIALDTNSFSNNIEIDNAVKSVVPTRGAISAITFEPSVGIKAITTLTHKGKPVPFGAIVDSGNNTGIVADEGKVYLTGLSPSGQLKVNWGSKKEQQCLVNYTLPPQDPDKLYVEYSAECHPIKE

SEQ ID NO: 5786 - protein, 87 aa, Proteus mirabilis
LEFIMKKSTLIAATLALSAISFGSIAADSVATSHTSTGEYITITGNDTLDGLTTKIAQIAKDEGATGYKVIGATGDDYLTVNAEIYR

SEQ ID NO: 5787 - protein, 320 aa, Proteus mirabilis
RFLMIEIKHLKTILALKQTGSLANAANQLHQTQSALSHQFSELEHRLGYRIFVRKSQPLRFTPQGEVLLRLAQEVLPIVRRAIEECNELGNAHLNIAIECHSCIQWLTPALQQYRQTWPDVNVDFHSGVTFDPQPALLQRELDVVLTSDILDNQRLHYTALFDYEVKLVLSPDHPLANRLHIQPQDLISETLFIYPVQRERFDIWRHFLQPAGITPHFKHVDNTLLLIQMVAAGMGIAALPHWAVENFEKQGLVVTKTLGEGLWSRLYAANRTGEQHQPAIREFIRLAGQHAVNHLPFVKQVGVSNADGTKVMQQSGSRL

SEQ ID NO: 5788 - protein, 167 aa, Proteus mirabilis
SRLIEGYCNAIPFYYRDIMKNATFYLMEHPSIHQDLQAHEWLACQLAAEHWRLGKRVLLVCDSQPQAELLDEALWAREPHQFVPHNLAGEGPRYGAPVELCWPGKRGNAPRDLLINLQSQFADFATAFHEVIDFVPIDEQLKQLARERYKIYRSVGFTLTMATPPTY

SEQ ID NO: 5789 - protein, 141 aa, Proteus mirabilis
DEIMKKEWYTAKELVGLAGLPNSPQGVNLMARREGWENRRKRGVQGKAVEYSVKSLPEEVVSVLAAHEPPAEYLSKRQDAFLIWVEAYYQLTKSEREKIVKFVLREGLAKLISYIDADNQEEIERENEEVVQKLKSPPEST

SEQ ID NO: 5790 - protein, 76 aa, Proteus mirabilis
VNPIWVHPIVQVQRAPALVRRHYAVLATVSSSYPPLSGRSPYITHPSAARQQESKLSPVTARLACVRPAASVQSEP

SEQ ID NO: 5791 - protein, 86 aa, Proteus mirabilis
IKVLSLNKKPSIKIDLFILMINSLLFYYGDVLLSFYLYAFLSSCYVLFLFNHFPLLILLIRLYSHLVFSCRFDEIILSFICMFHNN

SEQ ID NO: 5792 - protein, 236 aa, Proteus mirabilis
RNNMAILNCKVSLVEPITDTVYRVRLLPDGPFDFQAGQYLLAVMDERDKRPFSIASIPENKDFIELHIGASDLNLYAMAVLDLILETQQLKIDIPHGNAWFRQQSQRPLLLIAGGTGFSYTHSILLAALQENPQRAITLYWGGREQVHLYDLNELQDLTEKYPSLSVVPVVEQPDDAWRGRKGTVLTAISEDFGDLSSYDIYIAGRFEMAKIARDRFCNERNADRERLFSDAFEFI

SEQ ID NO: 5793 - protein, 250 aa, Proteus mirabilis
VRCIMLEQVSELARQAGQAIMQIYQQSAPIEVQEKSDHSPVTAADLAAHQIIKQGLASIAPDIPQLSEEDPPAWEERRHWQRYWLIDPLDGTKEFINKNGEFTVNIALIEQGVPVLGVVYAPVQNILYSAANKQAWKETCGQRLPIKVSRAEPPVIVISRSHQDDELKEYLSQLGEHQTVAVGSSLKFCLVAEGKAQLYPRFGPTHTWDTAAGHAIAIAAGAHVTDWKGVTLDYSPRESLINPGFRVSIF

SEQ ID NO: 5794 - protein, 288 aa, Proteus mirabilis
YFLILLYCTKLNFMDIDIVQNGIHLSEKILNAFPTRALTLSPLKGDGGLFRTLFLVIAMLGMTVFSAYQIPNIVYDYQISKNPVFIDADVDGSCRSKLFVLTNCSVDLRYKGNEVSRNFTFLDFGNKDILVEPVADENDLTKMTVDVAIDNIWLRLISALVFTALFAFCVIFFIYRQMISNKVKKALLSVGTKPLKLTAIPAKVVVSNKQFIATYKTNVAGKETSITYSGNKKTPPITLEMEGKTYVLAVYEPQQNIPYVLDVPLARIQATEEEKQRFHEALIEEGIL

SEQ ID NO: 5795 - protein, 308 aa, Proteus mirabilis
VLLIMAGINSMGAGHEHGDVKALPESRLLIAFALTGSFMVIEFIGGYLTESLALISDAMHMMTDAFALLLALIAIHAGRKAADLFRTYGYARFEILAAAMNALILMAVAFYILYEAYQRLSSPPDIQSMGMLVVAIAGLIINFISMKMLTSAKDESLNVKGAYLEVWADMLGSVGVIIGAVIIWLTGWQLVDSIIAVLIGFMVFPRTWILLKECLNILLEGVPKGINLTEVTDTINNTAGVASSHDLHLWALTQSKLILSGHIVYQPNVDSETLRLAIDKQLREQFHINHITLQMESEDKQHLEDNHH

SEQ ID NO: 5796 - protein, 253 aa, Proteus mirabilis
DNIMKIFNILFFGLLIISNSSIGDEYPIITEKMLNSGYNKLELQYDPQLPLITPYPENKELVYPLIEKAKKNNNSNDSYLIASIFFVGCTNLKYKITHESDKNQCELSRNFLKKTLALNPKHGAALFYQAVIFENGYGVEKDINKAIKYYDKACRIKGNKVIIACENLFSIYLHGNKGVPQDLNKAKEYAKWIAENGSQKYQEYIKRWDYILFSLELSLKLKECKKSGINASICIRKSNNALLEYANKMYPIE

SEQ ID NO: 5797 - protein, 113 aa, Proteus mirabilis
KEIIVMASYKVVMTKDAETDLEDINNYIADHDSIDNADYVLDELLKVTNTQANFPMKGSIPKELQSLGIREYQQIFFKPYRVIYHTIAKQVVIFIIADGRRDMQALLTRRLLG

SEQ ID NO: 5798 - protein, 384 aa, Proteus mirabilis
GRIMRVKAAWRGFNSAFSRETHMAVRSPVFHWLSWLFPLMLFTLISANFSEGTLLNLPVSVINNDNSPLSKTLIRDLNAGSHAKLSALDTNPRTALEQLGSAKDYAILMIPRHFEKDVLAGKQPTTRMYYNGLYYAAGSYAIQDFSGLIAELNAQYRTVLAQEMNKPVPPLAKVTLSYDSLFNASGSYIYYQQFAATIHMLQLFVVTCTIYSLSRGNMLLNLKPFTFALIGKLAPYTLFFLTLLMVELAALVHFSGAKVNGNPLYMILVGFFYIIAAQSIGLLLFTFTNSAITAYSMIGMLVSIALAFSGMAVPELSMILPARIISNLEPLTHALNAMFDIFLREVSLQGILYVCTLLLIYPFAIALLVRKRIFKRLELQVGVV

SEQ ID NO: 5799 - protein, 205 aa, Proteus mirabilis
KIVIKCVYYFLGIKVIYMKLNYLKLFVISALSVGSVFAVSAEDPVGNGPVTVNGGEIFFKGELVNAACAVDSSSDGQIVKLGQVRTAKLAKAGDFSENTNFTIQLNDCDSKVASTAKVAFTGVSAAGQDDVLAVSSSSAGGAKNVGIQILDSKSAPMSFDGAGFGNATKLHDGKNIIPFQARYYALGATEPGIANANATFAVQYE

SEQ ID NO: 5800 - protein, 118 aa, Proteus mirabilis
RNVMKKEWYTAMELTGIGGLPKSPQGVNAKAKRESWLKQKRTNKQGNGVEYHYSCLPEETLIALELYEPLAHYKLNKEEPLVIWVKAFQQLNDGEQKTVTELILRDGIRSFLEKIVKD

SEQ ID NO: 5801 - protein, 81 aa, Proteus mirabilis
IEVIHIELTGGYMPLSDNKYVSFSEDHELNYHLKKWGKKQSKANRDQLVKLGSELKKKLGVKHLQHTEIDAEIEKNLSLFE

SEQ ID NO: 5802 - protein, 173 aa, Proteus mirabilis
RESMMKYKWRGVKNVIFAILCCNTSFAMAADATITVNGSVIARPCETITKTANVDMGDLYTFDFMIPGSTSKWYPVDLELRNCPIGTTSIEATFTGLDDSTGYYRNQGSAKNLHLELQDTAGNKLRNGSKKVVEVSEYSFAAIFPLRVRAISVNGRPTQGSVQAIINVTYVFM

SEQ ID NO: 5803 - protein, 434 aa, Proteus mirabilis
KEAIVNKDINELNKDINIVGLHWIERWRVNNGKHQSYVIPFATTYPINIVYHGKSEFKYGQYGIHLGQQDTLTFLGDKKQKILAKFIDCRKNSPTFKSELSLEITPSSARTLIIPPGVAHTFSHLENVFTLNSYSLFLPTIEQLANETLNWSPNNDVINLPEDIDINEIEGYEPMTEEASALVYYRVAEIQQQWLSQHRFLHSETRKIRLDNGDEINVRLREKIADVQKQSLPTSTILGVEFREMATLHTGKESGIVPLTRQSPMYLVEHGQEAYDFDSYGLHLGQEDHLTFLGNTSGKITIKLVDMREDSPTLFYEDEMVFDPAPNIELVIPCGVAHALFNMANIITVNRPVIYLDEEKEYIPGHDVIDWKIANKNYQAYRVNKIAADLTYYQFLVSKQQALMKHKPTHHTPKSIIVYDENNQPIKVLIKEKV

SEQ ID NO: 5804 - protein, 117 aa, Proteus mirabilis
VTQMYTALIVILIIAATGLVGLILLQQGKGADMGASFGAGASGTVFGSSGSANFMTRMTAVLATVFIVLCLILGNLSANKTVREDSKWMSIEQTAEEAKKAEQLAAPVAPANTDIPQ

SEQ ID NO: 5805 - protein, 64 aa, Proteus mirabilis
HSKIKKEFLMKNFVKIALIASFVTVMTGCTGSVYNKEKDCNYDYLLHPAVSISKIIGGCGDTNK

SEQ ID NO: 5806 - protein, 137 aa, Proteus mirabilis
YIKIVIKYWSDLMIINTTSAPEAIGPYSQAIKVENHIYISGCCPFNTHDGSVMGNDIETQTLKAMNNLKAIIEAAGASMDDIVKTTCFIKDIKDFPIFNNIYSSFFTSGKYPARSCVEVSRLPKDVLIEIEAIAYKK

SEQ ID NO: 5807 - protein, 471 aa, Proteus mirabilis
AMKMKVVKPILLPFHREGMLFYPVFSLHKGILIMSSLITIVSQCQRYIATFLLVVLSLFVVQIAQAATVTEVKAENGDVATTLTFSFSGGKPSYRYYSLKNPDRLVMDFKQGSQITGLPVTLNRQQLAQKIRTTQSKDSQYQSMVVELAKPVVVTERLLNSNGEYKLVLTIKPINARQNNNTSTTVSVVALSANKATNTVANQQMAPLVSTPKQPVAPVVPVKPRTTSNKPASSDRQIIIAIDAGHGGQDPGAIGQKGNREKDVTLRVAKKLEAILRNDPMFKPVLTRNGDYFISVAGRSEVARKQGANMLVSIHADSAPNRSARGASVWVLSNRRANSELGKWLEQSEKQSELLGGAGDALAEGVDPYLSQAVLDLQFGNSQRVGYDVAVAVLSELRKVGSLHKKTPEHASLGVLRSPDIPSILVETGFISHAAEEQLLISDAYQEKLAASIYAGLKNYFLAHPLQNGPK

SEQ ID NO: 5808 - protein, 435 aa, Proteus mirabilis
LSRMATRLMILQGLQKEMSNLQFYRDRSIISQLPDELSCKMREMGLIAPDHYKVRFCGFFSWSGTTAVFLPVNSVLTDNKELAAHYLFQSLNRYYSDKLTGIQDTDGDTLIGGNLIFTSISIFEDYITNGLYVRRHKIQSVNKGKTNWSRTVSRHMPFISNSSPVYLELESSQIKNISDSETARIHAAIIRDIKKKFGVLINGEEIHFDVNLEEMPVPSGDQETQLAHLNRELTLSYSERDINLIRLLKQYIENMDGTNNNILIVGTRHFQNVWESMLHKVLLGEKAYNQKLPVPYYLQNSKYHEVAEKGQRADIVISDKSNQRVAVVDAKYYTALTPKDAPGWPDLVKQFFYEKAVKSTVNNGVKVTTHFVFPGVEQKLISVHVGKRGQGGTDLFIAELEYPVIYCHYCEPISVMKAYINHKICYEFRKQIFEV

SEQ ID NO: 5809 - protein, 397 aa, Proteus mirabilis
KIGITGRCRMMQMYFQTFKRVLLGMLEKPMWMLLLVSLCIMSLVYAKPVLWDLPVAVINQDHSPASYALIRSLDATPKLSLKGYDNLDEARHDMIMRELFAIIIIPTDFEKKLLNGKNVTVPVYGDATNRLASGQIQQELMQAYQQLLDNYNGRILQNAGFSATQSKILLKPIQSETIAMYNPGVSFAAIFFPGLLVMLLQHSLLIACVRVSIAVRGTPKGKPPLAVYLGALSALIPIWLFLSSVFFALWPWVLGYRQEAPLYQIWMLTFPFLLAVLGLGKLITECLRSVEMIYLTLAFVTTPVFYISGTIWPLQAMPDWVLAISSALPSTWAVNAMAGINQMGLSFQSILGDIVMMLVLGVIYTILGVLVGMLRNGELRKITHQFKHWARHYHRSK

SEQ ID NO: 5810 - protein, 68 aa, Proteus mirabilis
TSMILIKTVDYKYASPFRVIALLKQFNQRRNISLFSSFLFSANTRMSFYDIFAKKVFFFLDSYPKSTR

SEQ ID NO: 5811 - protein, 278 aa, Proteus mirabilis
GLMMSRLASRFGRANSIRRDRPLTMEELFCTVPSVFSEEKHESRSDRYTYIPTITLLDSLQKEGFYPFFACQTRVRDNSRKMHTKHMLRLRRHDQITGIQVPEIILLNSHDGSSSYQMLPSLFRAVCQNGLVCGDSFGEVRVPHKGDVVGKVIEGAYKVLETFDSVAEKREQMQSLLLPPPAQQALAQAALTYRFGEEHQPITEEQVLQPRRWEDKKDDLWTVYQRLQENLIKGGLSGKNAKGKRARTRSVNGIDGDIKFNKALWVMTEKMYECFRIS

SEQ ID NO: 5812 - protein, 355 aa, Proteus mirabilis
GLMMNIYCIKLNINSIIGYLSMNPFYQRSFLRLLDFSSAEIQQLLALSLELKQAKKSGHEQQYLTGKNIALIFEKDSTRTRCAFEVAAFDQGAKVTYLGGGSQIGHKESIKDTARVLGRMYDGIQYRGYGQKTVEMLAKYADVPVWNGLTDEFHPTQLLADLLTITEHQTKPLSETIFAYLGDARNNMGNTLLEAAALTGMDLRLVAPKACWPQAELIAECQNIAQQNGGKITLTENVAEGVKNADFLYTDVWVSMGEPKDVWKERITLLKPYQVNMDVIKLTGNPDVKFLHCLPAFHDEETTMGQALAEEFGLYGGFEVTNEVFESKHSIVFDEAENRLHTIKAVMVATLANPF

SEQ ID NO: 5813 - protein, 167 aa, Proteus mirabilis
MHQIEIRHGEPEDAIAIQQLYTHPDLYICTCQFPYPSVTMWKKRLIEFSEQNIPHFVASFDGQIAGHLALIIDNHPRRRHIVSFGIGVGAEFSGKGIGKALINTAIDYAFNWLAATRIELEVYADNERGLHLYKKLGFEVEGIRRNAAFREGKYCDVVMMAQLKNIE

SEQ ID NO: 5814 - protein, 209 aa, Proteus mirabilis
SIKMFSVALSATFNEEVPFRCSLNTLSKNILLISKTMSATMTANPNATQNIIIRAIEKRDNAGIARVIREVSAEHGLTADKGFAVADPILDTLFEVYHQPRSAYWVVEMDGEIVGGGGVAPLAGGDGETCELQKMYLSSKLRGKGIAKKIVQQSLEFGKQQGFSRCYLETTDILKAAIGLYEKLGFEFIDKALGNTGHSDCEIRMLKSL

SEQ ID NO: 5815 - protein, 69 aa, Proteus mirabilis
KMKIFNRYNPEKIALYVKTLFRGRFYIKGMGAFEFDYGKILLPKIKDKLHFNVMSEVNQQVVLLKAEMG

SEQ ID NO: 5816 - protein, 98 aa, Proteus mirabilis
KFYFYWSFIMSLSTEAKAKIVAEFGRDANDTGSSEVQIALLTAEINHLQGHFSEHKKDHHSRRGLLRKVSSRRNLLDYLKRKDVARYTALIERLGLRR

SEQ ID NO: 5817 - protein, 157 aa, Proteus mirabilis
VNTVNYHQYYPVDVVNGPGTRCTLFVAGCVHQCRGCYNKSTWSLTSGKPFTQEVEDQIIADLQDTRIKRQGLSLSGGDPLHPQNLSAILKLVKRVKTQCPEKDIWVWTGYLLADLTPEQQEVVSYINVLIDGKFVQELYDPALLWRGSSNQVIHKLK

SEQ ID NO: 5818 - protein, 223 aa, Proteus mirabilis
LTTVILGTNFHKNRYFFMSKPSFDSIESQASYGIGLQVGQQLTESGLQGLEPAALLAGLTDALEGNTPSVPVETLHNALRTMHERAEAVRQERQAALAEAGKVFLAENVKKEGVQVTESGLQYKVLKAGDGAIPARTDHVRVHYTGRLIDGTVFDSSVQRGQPAEFPVNGVIAGWIEALTLMPVGSKWELYIPYQLAYGERGAGAAIPPFATLVFEVELLEIL

SEQ ID NO: 5819 - protein, 292 aa, Proteus mirabilis
NTHVYSKNPTTENSNITIWRKGDNRAPHKPLLLLLALSEYRKGHPRLFNYGNEIHQQLLELLMNFGPSRREHYPNLPFWRLVRDGFWELQLPKESDLSKDNKQPSKNKLIQQNVLGGFDQESYQLLIKKPSLINKLAQQILSEHFPDNVQEVIANRLDFPLQEIRQNRDPTFRKNILRAYNYQCAICGYNLRYDSAVVGLEAAHIKWKQFGGPCTINNGLALCTLHHSAFDMGAISIDDNMKLLVSSGVNGNQMVEQLFWQFSNKVISLPKNTKEYPKDTFIHWHREQVFKL

SEQ ID NO: 5820 - protein, 166 aa, Proteus mirabilis
LWSVYSPCGRITKISFRLLRSGIMADSKELAEQREETRLIIEELLEDGSDPDALYAIEHHISCENFETLEKAAVEVFKLGYEVTEPEEIEIESGEILVCFDAVSESGLNAELIDAQVEQLMNLAEKMGVYYDGWGTYFEDPDAEYDDEDGENEDDESESDKSSRLH

SEQ ID NO: 5821 - protein, 400 aa, Proteus mirabilis
RKGVTSIMRIVFFYMLFLVLSADGLMVFLTPVIVYQLTTSIEYAGLTYALWWLPRIFLIPLIGQYIDGLGVRPVSVISDSCKIIGCLFLLIVDFSSDLVIAISFGLVGSLISIGNSQTLISYEKIIALMSRHKEHHINIMSRMDFLGMIIGPLIGMLFIDYGYHYLLIIPCLFYFINAVFFLFFYLVPKQRQSATQLHSLTETLQVTKRIVVIFTSPILVFSILIAIGNNMFDGLIESSGAALIDQSMNLPIKYYGFIDISAGICGVIGTYLYGYLTHYLNRKLLMSLSICIITISSFLLVIFQHDITAFILFYALSIIGKVFSGNILRMLRIEIIPVTQLASISSLIILFNQLILPIVGGLLFFSTGNISTVYILMIIAMAITLVGGVMLIMRLNHKKR

SEQ ID NO: 5822 - protein, 63 aa, Proteus mirabilis
RLNVESNFFWVIAIEDLHLSVSLPCSVVNLISHKDRSLYTKFKDLIISTRFHLFKFLIYFYTY

SEQ ID NO: 5823 - protein, 583 aa, Proteus mirabilis
GENVPRYSVIYVLCLSSITSFAYGANLRLKVEGLEGQLEKNVRVQLSNITTEEVAPDGRFRARVEKAIKEGLRPLGYYQPTVTFSYQENTPPTRPVLTAKVELGIPVLLKGVNIVLEGGAKTDEQYAKVIKENTPPLDSVLNHAEYEKLKGSLTGLAIRRGYFDADMEKSQLGVSLDNHASYWDFVFNSGERYRFGKVNYTGSQIREDYLQNIVPFKEGEYYSSEDLAEFNRRLAATGWFNSAVVTPNIAKARSEGNYLLPMDAVVTPRSRNYMELGGGFATDVGPRLNMQWDKPWINSRGHSLTSNMSISKPEQSIGANYKIPLKVNPLEQYYGIQGGYKRTDLNDTRSDTTTLNVSRNWDMSTGWQYSINTRWSLSHFTQGDVTNTTMLLYPGANASRVRQRGGMMPYWGDSQRYSVDYSNKIWGSDVEFLALQAQQVWIRTPWEGHRFVVRGTFGWIETNQFEKVPPELRFFAGGDRSIRGYKYQSISPEDSKGKLTGASRMLTGSVEYQYNVTGNWWGAVFVDSGEAVNDFTKSDFKTGAGAGVRWASPVGPVKFDLAVPVNSGEERKLQFYIGLGAEL

SEQ ID NO: 5824 - protein, 262 aa, Proteus mirabilis
NMAVNDTQPLISHLIELRKRLMYSLVSVLVVFLALVYFSNDIYQLISAPLLDKLPQGSNMSATDVASTFLTPIKLTIMVSVFASVPVILYQVWAFIAPALYKHERRLMLPLLVSSTVLFYLGMAFAYFVVFPLAFGFFVNTTPEGVNFIPDISKYLSFVMTLFMAFGAAFEVPIAIILLCWSGVTTPDALKKKRPYILVGAFVIGMVLTPPDVFSQTLLAIPMYLLFEIGVLVSRFYVNNGRRKTPEEEAEEAEAQATEQQK

SEQ ID NO: 5825 - protein, 322 aa, Proteus mirabilis
RGRVMGRRRKGREINGVLLLDKPQDISSNDALQKVRRMFNASKAGHTGALDPLATGMLPICLGEATKFSQFLLDSDKRYRVIAKLGERTDTSDAHGQVIQQRPVQFNQQALDAALESFRGETLQIPSMYSALKHQGKPLYEYARQGIEVEREARPIIVYELQFIRWEDDELELEIHCSKGTYIRTIIDDLGEKLNCGAHVIFLRRLEVADYPKECMVTLEQLRAIIDDAQQQDESPFPALDALLLPMDTAVAHFPVVHLTAIMAGYLKLGQPVRVNHTLDEGEWVRVTEGDEKKFIGLAIIKDGLVAPKRLVVDYHALNNPE

SEQ ID NO: 5826 - protein, 443 aa, Proteus mirabilis
NPFLSNRVYFEMSNNVVVLGTQWGDEGKGKIVDLLTERAKYVVRYQGGHNAGHTLVIDGEKTVLHLIPSGILRENVVSIIANGVVLSPEALMKEMTQLEERGIPVRSRLLLSEACPLILPYHIALDNAREKARGEKAIGTTGRGIGPAYEDKVARRGLRVGDLFDKKAFAQKLKEIIEYHNFQLVNYYKVEPVDYQKTLDDIMAIADILTGMVVDVSDLLYKATQKGELVMFEGAQGTLLDIDHGTYPYVTSSNTTAGGVATGSGLGPRYVGYVLGIIKAYSTRVGAGPFPTELFDETGDFLREKGQEFGATTGRSRRTGWLDIIAIRRAVQINSLSGFCMTKLDVLDGLKEVKVCVGYRLPNGEVIETTPLAADDWEGIEPIYESMPGWNESTFGVKDKAQLPQAALNYIKRVEELTGVPVDIVSTGPDRSETIILRHPFDA

SEQ ID NO: 5827 - protein, 339 aa, Proteus mirabilis
LFSLLGVLRNSEYIKGVPLSRKLRSIRMKVAVLGAAGGIGQALALLLKNQLPAGSELSLYDIAPVTPGVAADLSHIPTQVRVKGFAGEDPSPALKDADVVLISAGVARKPGMDRSDLFNVNAGIVRNLIEKVAQNCPKALIGIITNPVNTTVAIAAEVLKKAGVYDKKRLFGVTTLDIIRANTFVAELKGKDPQTTNVPVIGGHSGVTILPLLSQVAGVSFTDEEVAALTKRIQNAGTEVVEAKAGGGSATLSMGQAAARFGLSLIRALNGEKDVIECTYTEGDGEHARFFAQPVRLGKNGVEEYLPIGQLSDFEKQSLNGMLDVLKKDIILGEEFINK

SEQ ID NO: 5828 - protein, 68 aa, Proteus mirabilis
NVLFKYYYTFWRKYLAASTIFANAARVSLHPRVFKPQSGFTHKRSAGIRDCAFLNNPTIHSTFGTLGE

SEQ ID NO: 5829 - protein, 68 aa, Proteus mirabilis
LNIFLYFFYKIRFYTTILINFRIRYYSAIHLLSKIPMYTQKILQQKILISRSGVKVITERPINHCYSY

SEQ ID NO: 5830 - protein, 522 aa, Proteus mirabilis
VIFSDNQIITRVTVYFCPHCPLVLASGNQHYSVKLIVTDREIMRLLPIFRGIFYTLSLLSFSTLAIPVEKYIELLPDGTQVGLITQTVGASSPNLTYNDNQLSLPASTQKVVTALAALLQLGGDYQFTTTMETEGKIKNNQLEGDLIFRFSGDPTLTRQQLRAMVAVLKQSGVTKITGNLLIDTSAFSSHDKAPGWVWNDMTQCFSAPPSAAIVDKNCFSVLLQSGQKEGDIATIRKASFYPVTVLSEVETYEKGSTRTRFCELDVTVRDLNTYVITGCIPKREEAMPLMFSIQDGAHWAGILLKEELQRADIELDGYVKRRSQPKAPVTVLAQTQSKPLHTLLTTMLKESDNMIADAVFRTIGREYYGVAGTWRSGADATRAILKQKAGIDLANTIMVDGSGLSRHNLIAPATMMQVLQYVGQHDSELNFISMLPLAGHDGTLQYRGGFTEAGVNGKVSAKTGSLKGVYNLAGFMTTANGQKVAFVQFISAYSPPTQNRNAGRAYLVRFETNLYKDIYNNK

SEQ ID NO: 5831 - protein, 177 aa, Proteus mirabilis
SPEFRGFLLSENRILGYKPFFYALGVGLSTLEQKLTAMVSAPVEALGFEFVGLEFIRGRVSTLRIYIDSEEGITVDDCADVSHQVSAVLDVEDPIQTFYNLEISSPGLERPLFTTTHYEQFIGEEVAVVLRIAMQNRRKWQGIIKSVAGEMITVTVDGKDEVFALSNIQKANLVPHF

SEQ ID NO: 5832 - protein, 72 aa, Proteus mirabilis
YQHSLYIHIQGTRIDFVTGGFPLLYDHSKRTSDWCRPVVLPVPDHLARAACTQAVGAFHTSPAPVLSGLNQI

SEQ ID NO: 5833 - protein, 99 aa, Proteus mirabilis
ATCSMNIEKLPLSIIQLLEIGSVIRTSRLDVSPLRKQNIDQKVKILSASRVHCAKSTNVPSSAPSTKGNSLIPRVSVQVLHNLTGTFCAVKISNICWRL

SEQ ID NO: 5834 - protein, 215 aa, Proteus mirabilis
KTFSIIRNLFVKLDYIGLNVLDRIKVCFTESIQTQIAAAEALPDAISRAAMMMVQSLLNGHKILSCGNGSSAATAQRFAASMIHRFETERPSLPALSLNTDSVVMTAIMGNQQHDEIYAKQVRALGQAGDVLLAISTHGNSRSIIKAVEAAVTRDMTIVALTGYDGGELAGLLGPQDVEIRIPSQRTVRIQEVQMLTVNCLCDLIDNTLFPHQDD

SEQ ID NO: 5835 - protein, 556 aa, Proteus mirabilis
EGISMMSGSPVTETDVIIIGGGATGAGMARDCARRGLRCILLERHDIATGATGRNHGLLHSGARYAVTDPESARECIEENMILKRVARHCVEKTDGLFITLPEDSLEFQQTFIQSCQAAGIDAQAISPEEAIRLEPSVNPNLIGAVKVPDGTVDPFRLTAANMLDAREHGAQVLTYHEVMGLIREGDRVKGVRVYDHQSKNMYEIRAQIVANAGGIWGQKIAEYGDLKVRMFPAKGALLILGHRINNMVINRCRKPADADILVPGDTISLIGTTSTRVPYDEIDNMYVTPEEVDILIREGSMLAPKLAQTRILRAYAGVRPLVASDDDPSGRNVSRGIVLLDHAQRDGLEGFITITGGKLMTYRLMAEWATNKICEKLNISAKCTTAEEPLPGSRQSAEQALRSVVSLPAPIRGSAVYRHGDLANKLLSNERIDKSLVCECEAVTAGEVRYAVNSLTVNNLLDLRRRTRVGMGTCQGELCACRAAGLLNRLQVTTPHGSEQQLAHFLNERWKGIRPIAWGNALRESEFTSWVYQGLCGLDADMIDKTASVEADDEI

SEQ ID NO: 5836 - protein, 250 aa, Proteus mirabilis
CASSPDERKSYVLLGSLTPITKKVQFMYRFTSRQKAAALLWLSLFHILIITSSNYLVQLPISIFGFHTTWGAFTFPFIFLATDLTVRIYGAPLARRIITAVMIPALAISYLISTLFFQGSWQGFASLNDFNIMVARIATASFMAYVLGQIMDVSVFNRLRQQQKWWVAPSAAMFLGNFLDTVAFFFIAFYRSTDAFMAANWVEIALVDYTFKLTICMLFFLPAYGVLLNFILRYFFAQENQQQSYAQIRP

SEQ ID NO: 5837 - protein, 82 aa, Proteus mirabilis
TYASPRSTKYSFINYRYFTAWSRVQSQDKQSVLIVKKCGFVKSINPLFLLIKKQGIRVLQKKGSNNKEVTNKVTGTYQSFRG

SEQ ID NO: 5838 - protein, 242 aa, Proteus mirabilis
LIDSKSTAMIKYRTAQQCGKADYGWLQARYTFSFGHYFDPHFLDYGTLRVLNQEVLAPNSEFKAKTYPHVDVVNLILRGEATYLDNMGRTLTAKQNECLLISPHNTETYIERNSSPDTPLTRIQLWLNACPQQESIASQKLALNEDLKYQLLASPSGDNGSLMLRQNIWLYHINLAQGDEITLPIQGQKGYLQSIKGGVHFQTSEQELGEIRCGDGAFIQDSNMLALRCQKAFRGLFIDIVS

SEQ ID NO: 5839 - protein, 687 aa, Proteus mirabilis
HARLQYRKVFSKKNNKNRLTMSQQNEITPKKIRMKINPPVFYTSAILIMLVVGFSALFPELANDKLGHLQENLFTNASWFYILAVALVLLSVTYLGLSRFGEIKLGPDHARPHFSYFAWFAMLFSAGMGIGLMFFGVAEPVMHYLMPPTGDAQTIEAAKEAMRLTFFHWGLHAWAIYAIVALILAFFSYRHGLPLTLRSALYPIIGDRIYGPIGHAVDIFAVMGTVFGVATSLGFGVLQVNAGLNHLFDIPINPTVQVVLIVVITGLATISVVSGLEKGIRFLSELNLGLAVILLLLVIILGPTVLILKSFVENTGGYLSEIVSKTFNLYAYEPKSSDWLGGWTLLYWGWWLSWSPFVGMFIARISRGRTIREFVVGVLFVPAGFTLLWMTVFGNTAIYLIKDKGAEVLANIVQQDVSLALFEFLNYFPFSSVLSFVAMLMVIVFFVTSADSGAMVVDTLASGGDSETPVWQRIFWAALMGISAITLLLAGGLSALQTVTIASALPFAIVLLASIYGLIKALRVDVYKRDSQQMTTIAPPASRNPIPWQRRLRNIAYFPKRSHVKRFMEEVVNPSMEMVSAELSKQGIQCYIHDEEEDRIGFEVDLGEDMNFFYEVRLRFYTQPAFALAGLTDEEKDEEHKYYRAEIHLKEGGQDYDVMGWTKEQIIHDILDQYEKHIHFLHVLGKR

SEQ ID NO: 5840 - protein, 130 aa, Proteus mirabilis
EILSAISNKSIAANVSPPPAIEKASLSAIALAITSVPLRKLGNSKTPTGPFHRMVLAFFRISAKRSAVTSPISNTCSSSLMSFADFSTAGAVSENSVATRTSVGTGISHFSINFFASSTRSASYNERPTE

SEQ ID NO: 5841 - protein, 209 aa, Proteus mirabilis
PPLSAEKTAELLNRDTIMIKNLLCAVFALTMLAGCATPSNKLSIEPVMSVPPSDPTMRPITLSITSQDKRPSKNLAEMSRNGKLEVLVPTRDLAFLMQEIVQKQMMARGYTFGSPAAADVIVVINKLNADISEGSLRHNISAKADISVVVSMPNGSTNTKTYRTSYNVQGPFGASNDKIAAAINNVLSELVSDMAKDPSVSQYIKSNAR

SEQ ID NO: 5842 - protein, 63 aa, Proteus mirabilis
INASSLSSPNVATTGKRPINSGIKPNLIRSSGSTCANNSPSLAFSFWLFTSAPKPIPEWVFRR

SEQ ID NO: 5843 - protein, 71 aa, Proteus mirabilis
RTGFYGALDNQSMINALKKIAAQHETENFEDGSTGRAYRKAAFIFNKGDSLFSTHPSIENRIAVLEGKKTF

SEQ ID NO: 5844 - protein, 165 aa, Proteus mirabilis
GGGLFRKCVCRRSIMQEGQKRKTSSMSILAIAGVEPYQEKPGEEYMNEAQLAHFKLILESWRNQLRDEVNRTVTHMQDEAANFPDPVDRAAQEEEFSLELRNRDRERKLIKKIEKTLKKVEDDDFGFCESCGVEIGIRRLEARPTADLCIDCKTLAEIREKQMAG

SEQ ID NO: 5845 - protein, 348 aa, Proteus mirabilis
HNMSFLKKLPGILFCALIGGLLTLSGLPMALMFGPIVVVIIAYRFKWQLSVPKHTLTFIQLTLGTSVGLMFNQVHLGSADNLVLLLIILVICLAIQFVVSFLWFHRHIGWTKEEAMLGAVPGAMAAILALTDHTKTPPQKIVISHTIRLIVLIIMAGFIVGSDKATLTEFTLPEMTLLSSMWLLLIVALGLVSGLLLQKIHFPAPFMLTSLGSAILVQSFVSEPIAFPMLLNELSMVLIGMNIGAHFVVFPFASLIKNAFSSVQVVIINVILTVIVALSAAYLTGAPWTTLVLAWAPGSMEAMTFAAITMNVDAAFVMSNHILRMLIIQSIPSIALFYSERKQKRKRE

SEQ ID NO: 5846 - protein, 211 aa, Proteus mirabilis
ILMSDTHHRPILDIGLSRLEFLRISGKGLAGITIAPALLSLLGCKQEEIDSGVIQLTTTPKGVLVTNRARCTGCHRCETACTTWNDGSVGSFFSRTKIHRHFYFGDKGIGSGGGLYGDLNFTTDTCRQCKTPECMNVCPVKAIRYQEEFGCIVVDTRRCIGCAACTTACPWMMATVNPQTKKSGKCNLCGECASACPTGALHIIEWKEITV

SEQ ID NO: 5847 - protein, 790 aa, Proteus mirabilis
NCTLLNEERRMSKHAHQHDNHKHTDACCSSSQCCSNQADNSSMHSHTESGHTHSKIDKSDPECEEEHDHAHGCCDSNAPVSNVEPEKIAQQRFSWKVQGMDCPSCAQKIETAVLKVVGVKQAKILFATEKLVVDADTDLRTDVISAVKSAGFELFDISSAGSQPPAKQSLLKESSFVIILAILMAISWGAEFIDPQAGRAAFIATTLIGLFPIVKKSLRLIRSGTPFAIETLMSVAAIGALFINATEEAAMVILLFMIGEMLESYAAGRARRGVSALMALVPEEAVVIKEGKKQTVPVAQLRPGDIIEIAPGARLPTDAELITAFASFDESALTGESVPVERLQGEKVAAGCLSVDRSVQMKVVSEQGQNAIDRILQLIEEAEERKAPIERFVDRFSRYYTPLIMLFSALVIIIPPLLFAQPWETWFYRGLTLLLIGCPCALVISTPAAITSALAAATKRGALIKGGAALEQLGTVNTVALDKTGTLTEGKPQVTDVIANAGFNEKELLMLASSVEVGSHHPLAKAIINKAQEQQIDVVEADNRKALAGKGIEGYLNNQHILVSAPTQLSETTPLSTQWQQQVARLEDEGKTVVVVLKEDQFIGVIAMQDTLRNDAIESMKVLKSMNINAVMLTGDNPRAAAAIAQKLSMDFRAGLLPEDKVTSVMEISQTHNTMMVGDGINDAPAMKAATIGVAMGSGTDVALETADAALTHNRLTGLPEIIQLSRATRKIIRENITIALGLKAIFLVTSLFGITGLWVAVLADSGATALVTANAVRLLKVKLKSPHQD

SEQ ID NO: 5848 - protein, 69 aa, Proteus mirabilis
KSGSAQSTSSSTVLKTLICYLLDINLMLKNPSLQAGFFIFKIVLKMWCCGRKKHGLKADQKYVFLEFNP

SEQ ID NO: 5849 - protein, 248 aa, Proteus mirabilis
VFLLQETFKYVMAIGVYTYKWVTSNLLQMEKDMKSIAVILSGCGVFDGSEIHESVLTMLALSQNKAEVHYFSPNDFQPTVINHITGEEKAEKRNMMEEASRISRGKISPLSDAKAENFDAVIIPGGFGAAKNLCNFATKGVQCEINQQLLTFVQKMHQQKKPLGLMCIAPVMLPKMLNAPVKLTIGNDAKTAEMITEMGGIHINCPVDEIVVDDEYRVVTTPAYMLAESIAQAQVGIEKLVKKVLEMA

SEQ ID NO: 5850 - protein, 60 aa, Proteus mirabilis
IIAPIPAISSRFVNEDPIAVPIAISGKLWMAASVATKSSGNEVPIPTITIPITAGGSFND

SEQ ID NO: 5851 - protein, 774 aa, Proteus mirabilis
EKLFMSRKKKPVKKTNRRRSWFWLFVKIAIVVAVLVGIYGVYLYSQIKERLDGNVWELPAAVYGRTVNLEPGMNYSQKEMVSLLEGMQYRHVNKITRPGEFVVKNGTIEMLRRPFDFPDGREEQILAKLTFEQNSLVSITNMNNQRQFGFFRLDPKLITMMQSANGEQRLFLARDKFPQLLVDTLIATEDRRFYEHDGISIYSIGRAVLANFTAGRAVQGGSTLTQQLVKNLFLTNERTLKRKLNEAYMAIIMDASYSKDRILELYLNEVFLGQSGDEQIRGFPLASLYYFGRPVDELSLDQQALLVGMVKGASAYNPWRNPKAALERRNVVLKLLQTQQIIDQELYDVLSARPLGVKPRSEALTPQPAFMQLVRQELQTKLGDQVKDLSGTKIFTTLDPVSQDAAEKAVETGVADLRKTRKINDLEGAMVVVDRLSGEVRALVGGSQPQYAGFNRAMSARRSIGSLAKPATYLTALSEPERFRLNTWLADEPISVPIPGGKPWQPRNYDRGYKGRLMLVDALATSRNVPTVNLGLEVGLDQVIKTWIKLGAPAENLEKVPAMLLGALNLTPMEVAQTFQTIGSLGNRAKLSALRSVINQDGTVLYQSYPQAETTVSPQAAYMTLFGMQQVVNSGTAARALKPKFGQYNLAGKTGTTNDLRDSWFAGIDGKEVTIAWMGRDNNGPTNLTGSTGALILYRHYLENQTPLTLNPPVPEDIAQMSINAEGNFVCYGGGVRTLPVWTADPDSLCTPLPQESGDDDSAAPKWLRDLFSE

SEQ ID NO: 5852 - protein, 619 aa, Proteus mirabilis
LGLLPNTICHWRGKSLLTLKFVLTQLLYFKNIDRSMPLMITTNQKQRVKHRVLIANRGEIAVRIIRACQDYGATSIAIYADDDIDALHVRLADEAYGLKGNSPKESYLAIDKIIEIAHKSKATMIHPGYGFLSERADFAKAVQQAGLLWIGPDPQTIEVLGDKVQARKIAQSVGAPLVNGTADPVSDAKEVLDFAKQYGLPIAIKAAFGGGGRGLKIAHHMAEIEELYHSAVREAVTAFGRGECYVEQFLDKPRHIEAQIIADKLGHVVVVGTRDCSLQRRNQKLIEEAPAPYLTDEQRQRIHQSAKNICAKAGYIGAGTVEFLLSANGTISFLEVNTRLQVEHPVTEETAGIDLVIEQLRIAEGLPLSINETPEPRGHSFEFRINAEDPAKGFLPTPGLISQFSQPAGPGVRVDSGVAENDQVSRQFDSMMAKLIVTGASREQAIARARRALAEFNIAGVASVLPFHREMMEHPDFIDNFSVHTRWIESDFQAKNSHFPRSIPAENEPLVRTFIEIDGRRHQLALPAQLLSLSAVIPTAISEHKECQVRENAVTAPISGILHSWLLSDGDKVNQGDVIAIMEAMKMEVQVVATCHGVLQQKAKAGDYFSADSLLAEIN

SEQ ID NO: 5853 - protein, 343 aa, Proteus mirabilis
LRTFNMVFSKVTDLIGNTPIIRLPLLQSDTRLYIKVEKNNPGGSMKDRMARNMVVAALKSGKIKPGSTIVESSSGNTGIGLAIAAIEFGLRFIAVVDHHAAQDKIAIMRALGAEIRYVKGDYGENEVAVVERQRMAAEIANEIPGAIFMNQSDNAANAGGYADLVRELISQIGKIDAWVGCVGTGGSMTGIAHGLRVHNPELVTIAVEPEGSIVFGKPGKPYYQSGTGTPQGDTVGLVLDYSCIDYGEQVSDVCAFETARYLARRFGLLVGGSTGGVVYKALELINNSTICGNVALAMADGGEKYLQTIFNDTWLKERNLISESVWEQLDNWFSLPTCLGDRR

SEQ ID NO: 5854 - protein, 155 aa, Proteus mirabilis
NLFPYISPLIIKLRNIENSLLVKGFSMNSFNSIKKPTYFYLPDGKIVINYMYGWPKQPHSNITKITYIFPDYDKKRNYSNKKYSVTEKDRIESIKHTAKVYELTYLKEKKEKEIASLKYYRNKYSISKIAELEKDIEDIENSINKNKNSIHPYFL

SEQ ID NO: 5855 - protein, 453 aa, Proteus mirabilis
KVMFSLGKWFSMNNTDQVKQLEEAVSLALEIAAKQCDGAEVAINKSTGISVSTRYGEVENVEFNSDGALGITVYQQQRKGSASSTDLSPDAIKRAVQAAVDIARYTSVDPYAGPADKALLAFDAPFLDLYHPTDITADKAIELASRAEQAALDSDSRIVNTEGGSFNSHSGTRVFGNSLGLLKSYSSSRYSMSSCVIAREGEDMERDYAYTISRRFEALQSPEWVGQECARRTLSRLAPRKLSTMKAPVLFSAEVATGIFGHLVAAISGSMIYRESSCLLDSLGKQIFPQWLNIQERPHIVGGLASTPFDSEGVRTSDADIIKDGVLQEWLLTSYSARKLGLKSNGHAGGIHNWRIPGQGLSFDELLKEMGTGLVVTELMGQGVSTVTGDYSRGASGFWVENGEIQYPVSEVTIAGNLKEMWANIATIGDDIETRSNIQCGSLLLPEMSIAGQ

SEQ ID NO: 5856 - protein, 218 aa, Proteus mirabilis
NIIPRGSESMFKRLLMVALLVITPFAMAVDKTNPYALMEDAAQKTFDKLKTEQPEIRKNPELLREIVQQELLPYVHIKYAGALVLGPYYRNATPAQRDAYFAAFKDYLAQVYGQALAMYEGQEYRIEPAKPFADKSNLTIRVTIIDKNGRPPVRLDFQWRKNSKTGEWQAYDMIAEGVSMITTKQNEWSDILSAKGVDGLTKQLEISAKTPITLDEKK

SEQ ID NO: 5857 - protein, 833 aa, Proteus mirabilis
KIVFWLQFSECSPLRQCIFKVSFSRFNLLEFSMKLLKGLAQYYVDLMMRLGLIRFSLLLASALVVLAMVVQMAVTFLLAGDVTSIDLVRSIFFGLIITPWAVYFLSVVVEQLEESRRRLSRMVDKLGVMRQRDLELNSQLKENIEQLNLEIQEREKVEKAHLELLEKLKSEMKRRELTQIELEQQSSLLRSFLDASPDLVYYRNEDNEFSGCNRATELLTGKSEKQLIGLTPLDVYDEDIAVKVMETDEKVFRHNVSLTYEQWLVYPDGRKACFELRKVPFYDRIGKRHGLMGFGRDITERKRYQDALENASRDKTTFISTISHELRTPLNGIVGLSRILLDTELSPEQLNYLKTIHVSAITLGNIFNDVIEMDKIERRKIQLDNQPIDFTEFISDLENLSGLLVQPKGLKFTLEAQETLPHKITTDGTRLRQILWNLIGNAVKFTQEGEIKVRIWQEAPDKLFFEVKDSGIGIPQGELEKIFAMYYQVNDSQGGRSATGTGIGLAVSKRLAQHMGGDIHVESELGHGSIFTLSIVAPAIKEQSDFEEDDELLLPALNILLVEDIELNVIVACSVLEKLGNTVDVAMTGQEALQMFKPGEYDLVLLDIQLPDMTGFDISRKLRQEFDSSELPPLIALTANVLKDKKEYLDAGMNDVLSKPLSVDALTAIINKFWGDEAVSVTSSESPQLLSKNEELLDIDMLNQYIELVGPQLITDGLDVFEKMMPSYLSVLESNLTARDQKGITEEGHKIKGAAGSIGLKHLQQLAKQIQSPELPAWWDNVQEWVDELERDWRKDVESLRNWWQTLEKNNPNRRLGCANTAPTPGKLFYSLF

SEQ ID NO: 5858 - protein, 62 aa, Proteus mirabilis
PETPYSFLYGVLFLLLIFVVTYYPSCLTTLYIYLLLILFSHYFFQLMGWQLNAHLRLCRPLR

SEQ ID NO: 5859 - protein, 79 aa, Proteus mirabilis
RLVFLSPILIKTPTAQYKVLRRRFMFIARFLLCLENEFPTQFHYFCFCFNFGKTELSNKYPTTAAMVEPTKIPSLEYVL

SEQ ID NO: 5860 - protein, 337 aa, Proteus mirabilis
YTRPCSHSLALFSSMRIGQYQLKNCLIAAPMAGVTDRPFRSLCYDMGAGMTVSEMLSSNPQVWKTDKSRLRMVHSDELGIRSVQIAGSDPVDMATAAKINVEGGAQIIDINMGCPAKKVNKKLAGSALLRYPDLVAEILSAVVNAVDVPVTLKIRTGWSPDERNCVEIAKLAEDCGIAALTIHGRTRECLFKGEAEYDSIRTVKQSVSIPIIANGDITDPLKARAVLDYTGADALMIGRAAQGRPWIFREIQHYLDTGELLPPLPIAKVQQIMQKHVRELHDFYGQGKGTRIARKHVSWYLKEHAPDDQFRRSFNAIEDASEQLEALEAYFENFLRK

SEQ ID NO: 5861 - protein, 114 aa, Proteus mirabilis
TLIPKMTMCIRHLVPLLINQLCFGGLVTALARYLQADTNYERWRFHINNIILQLILLDTITQTIRTVMTMFIHIKEKLFAYNSITIADGHKQGTILMEHIFLPRQPLLSGKIIR

SEQ ID NO: 5862 - protein, 79 aa, Proteus mirabilis
LRSPQTCSCSTAAARKVSPAANITDLPSAWYWRANLPIVVVLPTPLTPTIKMTKGFLPSIFNGLSTLFKISPISSRNLP

SEQ ID NO: 5863 - protein, 211 aa, Proteus mirabilis
MLSPVGLLVIHQITLPAYSATGIFIMAKQPEEWHYLNPEFDNTPLEEEEEEEIIWVSKSEIKRDAEALKKLGTELVELSAQELERVPLDEKLLASIKLAQKVQREARRRQIQYIGKLLRNVDEEPIRQALDKLKNRHNQQILVLHKLEDLRTRLIDGGNEVIEEVVALYPMADRQQLRTLIRNAKKEKEANKPPKSFRLLFQYLKDLSESA

SEQ ID NO: 5864 - protein, 446 aa, Proteus mirabilis
SMEPTLWVLGTLIISILLIVFTIIKLKFHPFLALLLASFFVGMAMKMNPLEMVSAIENGIGGTLGFLAAIIGLGTILGKMMEISGAAERIGITLQKCRWLSPDVIMVLVGLICGITLFVEVGVVLLIPLAFSIAKKTNTSLLKLAIPLCTALMAVHCIVPPHPAALFVTNELGADMGTVIVAGLAVGLLASLVGGPLFLKVLGERLPFKTVPEAFSDMEIRQEKDLPSLGATLFTVLLPIVLMLIKTAAELNMEKGTSVYIALQFIGNPITAMFIAAFVAYYILGIRRNMGMSTLLKKTEDSFSSIANILLIIGAGGAFNGILKGSGLSDSLAVILSNLDMHPILLAWLVAIILHAAVGSATVAMMGATAIVAPLMPMYPDISPEIITLAIGSGAIGCTIVTDSLFWLVKQYCNATLSETFRFYSIATFIASFVALGGTFMLSFVI

SEQ ID NO: 5865 - protein, 393 aa, Proteus mirabilis
YIAFFIRGEHDVKEIKIVIAPDPFKESLSAKEVAEAIKQGFSRYLPDADYCCIPMADGGEGTVTSLVDATHGRFITTPVCDPLGKQVTATWGVLGDNTTAVIEMAQASGLHLIPSSQRNPNLTTSYGTGELICAALDLGVKKIILGLGGSATNDGGAGMMQALGLGLKDKSGTSLPFGGHALSQLHSIDINQLHPKLASVDIETACDVTNPLCGELGASKVFGPQKGATEQDIAQLDSALHHFGTYLEKMTQRTLINIAGSGAAGGLALPLLAFTQATLSSGIDLVANAVELEKQLIDADLVITGEGRMDSQSAQGKTPIGVAKLAKKYHRPVIALVGGYLPDYDVVHQQGIDAVFSIMPGVATLQQAFDNAKQNLQETAYNIARLYALSLHK

SEQ ID NO: 5866 - protein, 71 aa, Proteus mirabilis
VNAFNFLINFLFFILLNLTAIFQNNLLVLKSIKNNLLVFYSEKSSLLNNKSYNIVYFLYLYVNLWLFVFLL

SEQ ID NO: 5867 - protein, 204 aa, Proteus mirabilis
LIAFIANITAIYNKQQENMMNRFIIADPKKCIGCHTCEVACVVSHQQASQDNLAIDQISEQNFQPRIHVVKGFSISTAVVCHQCEDAPCANVCPNGAIIHNKDYYYVDQDKCIGCKTCVLACPYGTMEVVSRPVMRKLTALNTIEAFKAEANKCDLCHHRAEGPACVEVCPTQALVCIDRDALEDMVKERRRKAAFETGADLLF

SEQ ID NO: 5868 - protein, 370 aa, Proteus mirabilis
TSAPVFYESSRLIMRVSDFRFDLPESLIAHYPHPQRSGCRLLSLEGKTGNLSHGVFTDVLDKLNAGDLLVFNNTRVIPARIYGRKASGGKIEVLVERMLDEHRVLAHVRASKSPKEGASLILGEDESVQATMIARHDTLFEIRFDDERDVLTILNSIGHMPLPPYIDRPDERSDKELYQTVYNERPGAVAAPTAGLHFDEPLLEALRNKGVEMAFVTLHVGAGTFQPVRVDNIEEHTMHSEYAEVPQEVVDAVLACKARGNRVIAVGTTSVRSLESAAKAAKDALIAPFFDDTQIFIYPGYQYQVIDALITNFHLPESTLIMLVSAFAGYKNTMNAYNVAVEQKYRFFSYGDAMFITRNPLAINEKVGEE

SEQ ID NO: 5869 - protein, 637 aa, Proteus mirabilis
LFKPYFFGRKMMETVEKKSIAGQQTAIQTDFSTRNALARIIRCLFAEKLLDDNKLQVFNDENNVKYPLSDGIHILQFNQTTVFPANTVINRGDIILKSMDGRHRMVQSHEELMGILKNELSFTPTTEGMTKFNKDVANSIHNDRLARAHRSKWRDTISNEMAQEGTSCFIEWITRHYSRRDGATFLDQWGALEGHSYYPTWKSRPGLSDDDIVALSAEFGARVNLRIAAIQTDMVYCEKMPHIQDIHQWFSSAFPTVWNKWCEWLTSQYQNPQKWLPIPLHPWHLEHWIIAHFSKEIDEGILLPLGPQLETAASMSFRTMLPTASRSPFIKLPVAIWMTSEMRSLQAKSIHMGPRISTIIEDILRVDKDFDGKLDFFREEVAWHFRHNVRMDDAEGKFLSVVFRDTQAWERNDNLIAITVASLFTELPHKPQPLISELIALSGDLPETWFRNYTKVILKPVLAMYLIYGIALEAHQQNTQVLFDDSGRAVTMLIRDFGDGRSWAPALRQQGYELQPYIWPGILPTVFEDDIEPVRTFVVDACLVSHLHEIALCLTQLYDIPDTRIWTVIGEELELVFKALQPRVEADFWHKEREHFLHHPWYTRSLMSMHLQQYTDYRLQHGLNNPLAGEQVDNSKI

SEQ ID NO: 5870 - protein, 379 aa, Proteus mirabilis
CKEPLLKALLIRRNNMTTVTLTNLEKRYPNGYQAISTLNLSIEQGEMVVLVGPSGCGKSTLLRMIAGLETITDGDLLIDNRRVNEHEPSERDIAMVFQNYALYPHMSVYDNMAYGLRNRKIPKAEIIARVDRAAHMLEISHLLDRKPKELSGGQRQRVAMGRAIVRDPKVFLFDEPLSNLDAKLRVQMRLEIKKLQQKLATTSVYVTHDQVEAMTLADKLVVLNQGHIEQVGSPLEIYESPASVFVATFMGSPAMNILTTHINRGIIEIADGHLAISAHSLPNGEIQLGLRPEHLLINQQNPLFHANVDFIEALGADVLIYATTCDQQSIVIRAANDHGVNVGNRIGVAIYPENLHFFDRQTQKRIERPTMLLSERLVS

SEQ ID NO: 5871 - protein, 453 aa, Proteus mirabilis
RGRPMLEKILIANRGEIALRILRACKELGIKAVAVHSTADRDLKHVLLADETICIGPAASAKSYLNIPAIIAAAEISGAQAIHPGYGFLSENADFAEQVERSGFIFIGPKAETIRLMGDKVSAIEAMKKAGVPCVPGSDGPLGNDTAKNIEIAKRIGYPVIIKASGGGGGRGMRVVRSEKDLAQAISMTRAEAKAAFSNDMVYMEKYLENPRHVEIQVMADGQGNAIYLAERDCSMQRRHQKVVEEAPAPGITPEIRKNIGERCANACIEIGYRGAGTFEFLYENGEFYFIEMNTRIQVEHPVTEMITGVDLIKEQLRIASGLPLSVTQDQIHVHGHAIECRINAEDPKTFLPSPGTITRFHSPGGFGVRWESHIYAGYTVPPHYDSMIGKLITYGETREIAISRMKNALAELIIDGIKTNIELHQFIMNDEQFQKGGTNIHYLEKRLGLTEN

SEQ ID NO: 5872 - protein, 444 aa, Proteus mirabilis
RSKLHNYVTCSILMSIITIKKHMVKNKTLFKSLLTIPVNHHKRTTLKWLGGSLLLASMGANAIEKSKCSPTLRYQRAINYLGKHQAGVITPEQKHASFIALDLTVTTPEEVEKIFRTLTQRIAFLTQSRELKESHNPHLPPAGSGILGSQLYPDELTITVALGDSFFDNRFGFQAHKPKRLEAMKPFPNDRLDPKWCGGDLLLQLCANSQESIIYALRDILKYLSGQVHARWKIDGFLPARDIDNQQTPINLFGFKDGTGNAPATDTHLMDDLVWITDKQNEPQWCLGGSYQAVRLIRFALEFWDRTPLEDQENNFGRHRATGAPIGMKQEMDSPEFEQDPHGDRILFDSHMRRAEPRTPERYSAKLRRRSYSYSLGLTPSGQLDMGLVFVSFQNNLKKGFIDTQKRLNGEPLERYIKPFGGGYYFVLPGVTQASDILAKGLFT

SEQ ID NO: 5873 - protein, 316 aa, Proteus mirabilis
QKKLANINLTETSGVNMQFSSEHIAIFLAVMDKGSFSAAARSLKRVPSAVSMAIANMEAELGYALFERSSREPRPTEKAKALEPHARMIAEQLKLLQVHAQELSMDLESILNIGVAADINPDYLLPALSELTQRYPLLKVNVVTAAQDDIIEMLHARKIQLCLVYGGLYVNGDEQFQYLGSESLVATISASHIALAHPAGVFIEDLVNVRQIMIASHTQEIRDVRSLVATNYWQTDNFQMALGMVEAGMGWGNLPYSLIYTQLQKGKLKQLQFKNTKNELRLPVHAMWLKGESLQKGAKELVELMNIHQPIVPNFD

SEQ ID NO: 5874 - protein, 106 aa, Proteus mirabilis
LKELLMSHQRSNEDLRSELKSLADTLEEVLNSSADKSKEELQSLREKAEYALRGSRAKLSDAGREIVDNTKEMAGKADNYVRENPWTGVGIGAAVGVVLGVLLSKR

SEQ ID NO: 5875 - protein, 184 aa, Proteus mirabilis
QVITKLSVRDYSYSRGRLLLFFVGAYVKGVFMLDKIDRKLLTLLQEDSSLSLNTLAEAVNLTSTPCWKRLKRLEDEGYIRKRVALLDSEKIGLGLTVIVMIRTQQHNSEWYEQFVSFVKQMPEVLTFYRMAGECDYLMHVEVVDMKSYDQFYKRMVNGVPGLIDVTSNFAMEKIKYTTAMPIPE

SEQ ID NO: 5876 - protein, 154 aa, Proteus mirabilis
KITTRAYRSWFMGSNHRRDCRYSGSGANCLTQEEIMNQNQLPKRSDEPIFWGLFGAGGMWSAIVSPAIIILLGILIPMGIAPEAFTYDRIMAFSQGFIGRIFLLLMIILPVWCALHRIHHTLHDFKVHVPASNWVFYGAAAIISVIAIIGVFTL

SEQ ID NO: 5877 - protein, 615 aa, Proteus mirabilis
LLTTLILAYTHLLSLISIETNPLLLMDIIMITIKKMHLLLLTTLFSPALYAAYEPAVEAQQGMVVSSQHLASQVGKDILQKGGNAIDAAVAVGYAQAVVNACCGNIGGGGFMTIHLADGTNTFINFRETAPTAASKNMYLDKDGNLIKEASLYGYLASGVPGTVKGLDAALEKYGTLSRQEVMAPAIKLAREGYILTRADTDVLDTTTERFKQDPESAKIFLKPDGTPWQPGDRLIQTDLANTLELIANQGADAFYQGEIPKKVEQASKQHNGLLTKEDFANFTITETPPITCTYRGYEFISAPPPSSGGVTICQTLNILEGYDLKSMGFNSAEYVHTLTEAMRHAYMDRNTFLGDPQFINNPTEKLLSKAYAAELRQQITPNKATPSEKVQPGIAPHESPETTHYSVIDKDGNAVSTTYTINGRFGAVVIAPGTGFFLNNEMDDFTTKVGEKNLYGLVQGERNSIAPLKRPLSSMSPTIVTKDGKPFLVLGSPGGSRIISITLQTALNIIEFGMSPQEAVNSPRIHHQWLPDEVYYEQRGLSKDTLEKLSAMGYKMVEQTPWGAAELIMVGLPGEQGVIPASSGNDSAVSGAIREGYLYGSNDVRRPAGKAVGY

SEQ ID NO: 5878 - protein, 665 aa, Proteus mirabilis
KMTTRKTLANAIRFLSMDAVQKAKSGHPGAPMGMADIAEVLWRDFLNHNPTNPHWADRDRFVLSNGHASMLIYSLLHLSGYQVSLDDLKNFRQLHSKTPGHPEYGYTPGVETTTGPLGQGIANAVGFAIAERTLAAQFNRPGHDIVDHYTYAFMGDGCMMEGISHEVCSLAGTLQLGKLIAFYDDNGISIDGKVHGWFTDNTAERFEAYGWHVISGIDGHDAASIKAAIETAQQITDKPSLLICKTTIGFGSPHKAGTADSHGSPLGDAEIAETRKALGWEYGPFEIPQEIYKEWDAKEAGKAKEAAWDAKFAEYAAQFPELAAEFKRRMSGELPANWEKESTAFIEQLQHNPASIASRKASQNTLEAFGKVLPEFMGGSADLAPSNLTMWSGSKALNEDKAGNYIHYGVREFGMSAIMNGIALHGGFVPYGATFLMFMEYARNAVRMAALMKIRSIFVYTHDSIGLGEDGPTHQPVEQMASLRVTPNMSTWRPCDQVESAVAWKYAVERKDGPTALIFSRQNLAQQPRTPEQLANIEKGGYILKDCDGTPELIFIATGSEVELAVNAYDQLTAEGRKVRVVSMPATDAFDKQDADYRETVLPAAVKARVAIEAGIADYWFKYVGLDGVIVGMHSFGESAPANELFAEFGFTVENVVTQAKTLLK

SEQ ID NO: 5879 - protein, 165 aa, Proteus mirabilis
RGNTMNKLQSICLIILLNSTAVMAADSPNLKLFGTLLVPPPCVISNDERIEVFFGKNVGINKVDGINYTESVNYTLVCDANLKGWDLGLSIIGPKTQFDEAALQTNIPDLGIHLTQDGKPFKLNERIAISPDSPPVIQAVPVKRPGSTLPEGAFEVSATLLAEYQ

SEQ ID NO: 5880 - protein, 550 aa, Proteus mirabilis
TFRFSMKTNYIFVTGGVVSSLGKGIAAASLAAILEARGLNVTMMKLDPYINVDPGTMSPIQHGEVFVTDDGAETDLDLGHYERFIRTKMTRRNNFTTGRVYSEVLRKERRGDYLGATIQVIPHITNEIKERIIRGGEGHDVVLVEVGGTVGDIESLPFLEAIRQMAAEVGREHTFYLHLTLVPYLAASGEVKTKPTQHSVKELLSIGIQPDALICRSDRVIPANERAKIALFCNVPEKAVISLKDVDSIYKIPALLKSQGLDDYICKRFSLDCPVANLSEWEQVIYEEANPEGEVTIGMVGKYVELPDAYKSVIEALKHGGFKSRVAVNIKLIDSQDVETRGVEILKGLDAILVPGGFGERGVEGKIMAARYARENKIPYLGICLGMQVAMIEFARNVANMEDANSTEFAPDCKYPVIALITEWRDENGNLEVRTENSDLGGTMRLGAQPCHLSGDSLVRTLYGKNTITERHRHRYEVNNLLLKRIEDAGLRIAGRSVDNKLVEIIENPNHPWFVACQFHPEFTSTPRDGHPLFAGFVKAAFDYQKGLLK

SEQ ID NO: 5881 - protein, 280 aa, Proteus mirabilis
RLRFYMFIFKRFPAIFILIAGLFSAPAMASIFSYITESTGTPSNATYTYVIERWDPETSGILNPCYGWPVCYVTVNHKHTVNGTGGNPAFQIARIEKLRTLAEVRDVVLKNRSFPIEGQTTHRGPSLNSNQECVGLFYQPNSSGISPRGKLLPCSLCGIAPPPVGACKISEGAVNLNYGDIDEASLSGAKRSETINVTCNLAMKVLVIASGSDSGRVPLRADKSLYADLYLNNYPGEKGVTVNVPAGGSAPVSVSSTLRTNGRVAPGRFSGSGSIILTMP

SEQ ID NO: 5882 - protein, 68 aa, Proteus mirabilis
RSLTLSLFFQAIPQESSQIVIQHVYIRANSIFLHVEWGPLLRVNLATNVWDIAPSSLFVLVYSFRPKK

SEQ ID NO: 5883 - protein, 312 aa, Proteus mirabilis
LTLTYYKNINNPWSILPMNDLLTNKINKIKEEYKNNKYVFIPQKIVIDLIKQLGATEKDIDTLIEYGDYLAQDPTLSFRHSRTGRYLFDNEAKTISRLEYQPFVLTEEDGFIREDSGAQRHFRAIDDRWQSNTAYQALLKLKMLLIEGNRFTPRRLTDQQSPKSISTVFHLRLIAEPNSLSELSIEGVHKDGVDHTMIVMMNKNNVKNNSGALRVHSHQEAIGTPWQDINPNNVLYEHNNAQYLDILLIADNELNHSGTPIFTHDNHHFAYQDFIVLLSRYPTVDTHPSHQFDSTQLHPDLPLTLHLNKQVA

SEQ ID NO: 5884 - protein, 89 aa, Proteus mirabilis
IKITIEGIMLITISPAKTLDFESPLATTQFTQPELLKYSQQLITECRKLSSSDIASLMKISDKLAGLNGGSLLVNGNLTLHPIMRDKPF

SEQ ID NO: 5885 - protein, 216 aa, Proteus mirabilis
LKATKKSCSLAFCCILTAYCIDSIVSFFIMALIMTANAQQLQFIKDSIETIPDYPKEGILFRDITTLLDNPAAYQATIDLLVEHYQGQGITKVVGTEARGFLFGAPVALRLGVGFVPVRKKGKLPRETLSETYDLEYGTDTLEIHKDSITDKDKVLMVDDLLATGGTIEATARLIRRLGGTVTEAAFIICLPDLGGIERLEKEGIHSFTLVNFPGH

SEQ ID NO: 5886 - protein, 525 aa, Proteus mirabilis
IMQTKKQGGSRFLRTVEWLGNALPHPVILFIILIAILLVSSAVGEYFGVTVQDPRPEGAKGRAEDGYIHIISLLDADGIRRILANIVTNFTGFAPLGTVLVALLGVGIAERAGLLSAVMRLVVMKAPRKMTTLAIVFAGIMSNTAAELGYVVLIPLSAIIFHSLGRHPLAGIAAAFAGVSGGYSANLLLGTIDPLLSGITQQAARIIDPSYIVGAEANWYFMFVSTFLITFLGYIITEKIVEPQLGPYNGNELDDEETDLKNAAQVTPLEKKALWAATGTFIVMAIILAFTVVPENGILRNQETGLIGNSPFLKSIVVFIFLFFAIPGIVYGWIAKTMRSDKDIVDAMANSMSTLGLYLVIIFFAAQFVAFFGWTNIGQVIAVKGAALLNSIDMPSGLLFLGFILICAFINLMIGSASAQWAVTAPIFVPMLMLAGYAPETIQAAYRIGDSVTNIITPMMSYFGLILAVATKYKKDTGIGTMISMMLPYSIIFLIGWSLLFYLWVFVFHLPVGPGSPIYYSPHAG

SEQ ID NO: 5887 - protein, 211 aa, Proteus mirabilis
NIKTRQNSRLNDIYQKNMAKKPQKTPMGQIRIIGGKWRGRKLPVLDSQGLRPTTDRVKETLFNWLMPVIQDARCLDCFAGSGGLGIEALSRYAKETTFIEFDRKVAQQITANLALLGADNGHVIQDSALNYLAKQGTAYDVVFLDPPFHQGMLANTLQLLENNQWLAEGCYIYIEEEVNAQVYSLPENWRLHREKIAGQVAYRLYIRNLSA

SEQ ID NO: 5888 - protein, 167 aa, Proteus mirabilis
WRGLRLIEGISMSMQILNNSAVLLNFTLKLADGSVAESTQAHGKPALFRLGDESLSPALEAELVGLKEGEKKTFTLAGEHIFGKYNPDLIQYFMPSDFAQSGIPETGTIMLFTAMNGNEMPGIVQEVTEDSVTVDFNHPLALQDVTFDIEVVSIDPQEETTNANIAG

SEQ ID NO: 5889 - protein, 570 aa, Proteus mirabilis
AMKTIKQFFYLVSPFWGRRTALYCWFLLILSLTLTLSSVWFNVKMNEWNGSFYNALQQLDGQALYKLLQQFVIIIAGLITVVVMGDFLRQKMIIRWREGMTEQVLERWLSKNSKHYMLRLTSQEPDNPDQRIAEDIRLLIESTMRLTVTFLHSLLTLISFATILWSLSGALSFSLAGKEWNIPGYMFWACIIYTLIGITITQLIGSPLRKINMDKQRKEADYRTALITRKQHGDAIAGQRGEMSDRHELMGRFLGVIRNWNNLIRYERNLAFFTVGYQQATAMAPIIFALPKFLAGELMLGGLMQLRQAFSSVAGALSWFIFSYKEIAAWQATVTRLYHFVVLLEHDHQPEITELDDKQTKLTANLSLFMQDDRLLINNIHFSLKAGELAVIEGSSGIGKSTLLRALSGHWPYFKGDIQRVTNISWLPQRMYLPVARLDSLLAYPCQASQFSQQEYQEVLHWVGLDKIKNQLSLETDWTTRLSGGEQQRLIFARLLLNKPDLILLDETTSALDEQNALHMLLLLKQHLPTSGIVLVSHQRFTHAIAEQVISLQAPTASSSQSAGVTEYVS

SEQ ID NO: 5890 - protein, 446 aa, Proteus mirabilis
KRMTMTTIDINKLKNDYPLVRDLVDLKEVVWFNPNVTSTDQGLPYVGLTQNDVMDAQARLQRFAPYLMKAFPETASTEGIIESAVVDIPQMKGALEKRYNTLIEGQLRLKKDSHLPISGSIKARGGIYEVLTHAEKLAIEAGLLTTEDNYEKLFSDEFRKFFSQYSIAVGSTGNLGMSIGIMSAKLGFSVSVHMSADARQWKKDKLRAHGVNVVEYEQDYSIAVEQGRKEAEKNPRCFFIDDENSKTLFLGYAVAGLRLKHQFETLNIPVDSEHPLFVYLPCGVGGGPGGVAFGLKLAFGDAVHCLFAEPTHSPCMLLGVYTQLHDGISVQEVGIDNITAADGLAVGRASGFVGRAMERLIDGYYTIDDQELYNLLSLLNKEEGIQLEPSALAGMTGAIHVSQAKDYLQGLLLDSQKMHNATHLVWATGGGMVPTDEMQKYLAQGE

SEQ ID NO: 5891 - protein, 159 aa, Proteus mirabilis
VNKTMNNDTKMNISDVLTLACTHNNVHCTSKKRALEIISENAAQALNLPETLIFEALLTREKVGTTGIGGGLAIPHGRIESDETEKVVGVFLHLSEPIAFDAIDNQPVDLLFALLVPATQCKEHLHTLSLIAKQLADKNLCRRLRSAQSDEELYQIITE

SEQ ID NO: 5892 - protein, 186 aa, Proteus mirabilis
TPETMTSDKSLAQKISCAYQSTYGQLVRFFQKRTGNHHDADDLSQDVFTLWLNRKEQTPVQEQRAFLFKIANHVLIDHWRKNQKQKNIYQEDYQLEDAVQTYTTELDPGHVLEHQQRLDLLTQAIDTLPPRRREAFILYRFDGLSQSEIAEQMEISISMVEKHIAAALLHCKRYVDAGQEKCTNDE

SEQ ID NO: 5893 - protein, 207 aa, Proteus mirabilis
IGRTKWRLAFGEWQPDFTPDNARQAILAFKGDVYTGMQAAELFTDDDFQFAQQHLRILSGLYGVLRPLDLMQPYRLEMGIKLNNKKGSDLYQFWGNIITETLNNALEAQGDNILVNLASDEYFKSVNPKKLNAEIIKPVFLDEKNGKYKVISFYAKKARGLMSRFIIQERLSDKAQLKEFNLEGYQFNAAESEGNTLVFKRAEHLAK

SEQ ID NO: 5894 - protein, 274 aa, Proteus mirabilis
YHFASSRENIMNTGLNAGLRIEKLSTGYAKREIIKELTVSLLPRGKITVLLGPNGSGKSTLLRALAGLNSAQGKLFLGDDELLSLSFSKRAEQVVYLPQTLPAGVHLSVLESILVARRALGEHRSHSANDEVIDILEQLGISHLAMRYLDELSGGQKQLVGLAQSLIRRPSLLLLDEPLSALDLNYQFHVMELIARETKKRNMITVVVVHDINIALRHGEYVLMLKNGELVANGLPTEVITPEILADVYRVSARIERCSRGHPQVLIDGRINDI

SEQ ID NO: 5895 - protein, 70 aa, Proteus mirabilis
  UNSURE (55): Identity of amino acid at the above locations are unknown.
ILIANKQQKRCYTQEAESLSLHALPTLSPLLIVSPLEFCTPNTLLMDANHARALXFGAKLLFSFRSNRYC

SEQ ID NO: 5896 - protein, 138 aa, Proteus mirabilis
KGVAMVWVYALIGLVVGLIIGALAMRYGNKTMRQQDAIKAELDTKKEELDTYRNELVSHFARSAELLDNMAKDYRQLYQHMAKSSNELMPDMPVQDNPFNYRLSESEAANDQSPIKMPPRDYSEGASGLFRPTDKKDD

SEQ ID NO: 5897 - protein, 274 aa, Proteus mirabilis
IMSATELRLAVVGAGGRMGRQLIQAINQQQGVVLGAAFERTNSSLIGADAGELAGIGHIGITVTDNLLAQVGQFDILIDFTRPEGTLSHLAFCVEHHKGMIIGTTGFDEEGKKAINCAAQTIPIVFAANFSVGVNLVLKLLEKAAKVMGSYSDIEIVEAHHRHKVDAPSGTALAMGESIAETLGRDLKDCAVYQRVGHTGERDPRSIGFATIRAGDIVGEHTAIFADIGERVEISHKASSRMTFANGAVKSAIWLSEKKSGLYNMKDVLSLEEL

SEQ ID NO: 5898 - protein, 66 aa, Proteus mirabilis
NCAAFGMIFIALIRYLPLVHEVQHVDKDAVFLLHQVDRDSSHVFLAIAEFVGYLLYQRVGRFVGKR

SEQ ID NO: 5899 - protein, 80 aa, Proteus mirabilis
MYYFHNNQQGYHLHHHQRVYHYLYFHRGNHYPYYHGEYHYPYHHGEYHHLYLHRDNHCLYHHREYHYPYHHRGDHYPNHP

SEQ ID NO: 5900 - protein, 323 aa, Proteus mirabilis
SNYFHGIEPVMELIRGIQNIRAQHHGCVLTIGNFDGVHRGHQALLKHLKQEASRRGLPTVVMTFEPQPLEFFLPEKAPARLTRLRDKIKYLAECGIDYLLCVKFDKQFAAQTPEEFVSSLLVDKLGVKFLAIGDDFRFGKNRAGDFHFLQQAGARYGFEVANTESYCDKGLRISSTAVREALFNDDLALAESLLGHPYSVCGRVVHGNQLGRTIGFPTANIPMKRLVAPVAGVYAVDVYLADHQSPLAGVANIGSRPTVKGKGVQLEVHLIDVNMDLYGRRIDVVLRKKLRNEQRFASLDALKQQIANDVAAARDFLLQRSES

SEQ ID NO: 5901 - protein, 309 aa, Proteus mirabilis
SNYLIEISIMSKDKAITLESLRVMDAIDRRGSFAAAADELNRVPSALSYTMQKLEEDLDVVLFDRSGHRTKFTNVGRMLLERGRILLEAADKLTSDAEALARGWEPHITIVCEALTPASRLFPLVEKLAEKSNTQLSLVTEVLAGAWESLESGKCDIVISPDMHFRSSSEINFRPLYNTTSVYVASPDHPIHNEPEPLAEETRLKYRGIAIADTARERPVLTVLLLDKQRRLTVSSIEDKRRALIAGLGVATMPIDLIEDDLKEGRLRVVGPEYHHENNIIMAWRRDSMGEAKSWCLREIPKLFATDKK

SEQ ID NO: 5902 - protein, 194 aa, Proteus mirabilis
ACYAFIRIKMNTMIETCYGAVSKQIMQKAEKVQLLICDVDGVMSDGLIYMGNNGEELKAFNVRDGYGIRCLLTSGIEVAIITGRQSKLLEDRAKTLGITYLYQGQHNKLLAYQQLLDTLNLKPEQTAYIGDDLIDLPVMEKVGLSVAVADAHPLLTPRADYVTHILGGRGAVRELCDLILLAQGRLEEAKGLSI

SEQ ID NO: 5903 - protein, 111 aa, Proteus mirabilis
RCNAHKTNRDRIGVVMCLGIPGQVVEVGKTITENALVDVCGVKREVNIALVCEGEPDTMIGKWVLVHVGFAMSIVNEQEAQETLNALMAMGEVEDDVSAFLYGEESTAKRA

SEQ ID NO: 5904 - protein, 266 aa, Proteus mirabilis
RMSAINIMPNAAQFQASLKQYVLIYTPDYLPLWLIVAGVLFVGMLLVLALHGFLRYRFATPHGEHHQEEKLYLYSKAVRLWHWSNATLFILLLLSGGINHFALLSAHDTALLVNVHEICGYLLLVCWLSFVLINLVGGNGKFYRIDSKNWLQRVLMQTRFYLYGIIKGEDHPFPATPKVKFNPLQQMAYLGVMYALVPLLLITGILLQNPMFIPADAVLFKAWLLIIHQILAVCSVFFIFGHLYLCTTGRTPFQTFRSMVDGYHRH

SEQ ID NO: 5905 - protein, 484 aa, Proteus mirabilis
VILAVQSLNYAFRHNRRKMMGQNVYQFIDLNRVEPTKKPLAVRKIEFVEIYEAFSAEQASAQADRCLDCGNPYCEWKCPVHNYIPNWLKLANEGRIIEAAELSHQTNSLPEICGRVCPQDRLCEGACTLNDEFGAVTIGNIERYINDTAFALGWRPSLSQVTMTDKKVAIIGAGPAGLACADVLIRQGVKPVVYDKHPEIGGLLTFGIPSFKLEKSLMVRRRELFSEMGITFCLNTEIGKDISLKTLTEQYDAVFLGLGTYQSLSGHFAHENAMGVYNALPYLIGNTRHLMGYAEDPQSPYIDLNKKHVVVLGGGDTAMDCVRTAIRQGATKVTCVYRRDENNMPGSKREVKNAKEEGGEFLFNRQPLDIEVDANNNVIGVRVIKTQTNGELKYIEGSEHILSADAVILAFGFKPAHYPWLDENNIQYASSGRIIINDDPLLPLQTTNPKVFAGGDIVRGSDLVVTAIAQGREAAEGILRYLSC

SEQ ID NO: 5906 - protein, 100 aa, Proteus mirabilis
SVYAKKLICWSFCLSHLLGKSVCSHLRISIDNNMDCSHYKMLRFIESNYLNAKRFRKTKVAKNRITTQAESFNMSILWHIGESIVFSYYYDLTYLPNNLL

SEQ ID NO: 5907 - protein, 287 aa, Proteus mirabilis
RSHAMLIIETTLILRREIKRLKQEGKRIALVPTMGNLHQGHLKLIEEARIHADVVIASIFVNPMQFDREADLANYPRTLQEDCELLRDKHVDIVFAPSAKEMYPNGMENQTIVEVPVLSSVLEGASRPGHFRGVTTVVSKLFNLVQPDVALFGEKDYQQLQIIKKMVSDLCFDISIIPVPIVRDKTGLAFSSRNRLLSDNEKQQAPVLYQAMQQIAEQLKSGNLDVNQLLQTAKATLEQQGFRADECFICDAQTLAPLSEESRCAVILMAAWLGNTRLIDSQQVSLV

SEQ ID NO: 5908 - protein, 307 aa, Proteus mirabilis
LSNATLCTDAFRQKLHSAHQRVDEALNQALQTLPFSDMPLSQAMRYGALLGGKRLRPFLVYAVGEMFNVPVANLDVPAAAIECIHAYSLIHDDLPAMDNDDLRRGKPTCHIEFGEANAILAGDALQTLAFEILAKNAMPDVAIADRVAMIAELATASGLAGMCGGQALDLDAEDKSIDLVALEKIHLHKTGALIRAAVRLGALSAGQKGHDVLPALDKYAHSIGLAFQVQDDILDVIGSTEETGKRQGSDQEAGKSTYPALLGLAQAQKKAQELYNEALDALAFLEQYEYDTSTLKQLANFIVERKN

SEQ ID NO: 5909 - protein, 68 aa, Proteus mirabilis
INIATGRIACFFLFSRFSKQTVLNDLTINYPTLIHLIVFQLKAQRRTVIPRFWRIVIFDYSSLVQQCH

SEQ ID NO: 5910 - protein, 238 aa, Proteus mirabilis
TMKAARSGKPICMPSSWRNIPWGEYYRMAIELRLQNWWPKIYGFHMLKLGQLSAELDTKSSMVSHQVNVTTTTTNTDVMASLNYLPFENKSVDVCLMAHVLDYSADPHWLLREADRVLVDDGWIILSSFNPISLLGIGKCTPILRHKQPYYCRMFSLRRQVDWLSVLNYEVITQQNFQIMPFSRPVKRDGNRYHVGGCLNLILARKRTLPLTPTAMKFALPRMSVKGRVLGATRNRPD

SEQ ID NO: 5911 - protein, 243 aa, Proteus mirabilis
HFMALLKAENLAKAYKGRTVVGDVSLNVNSGEIVGLLGPNGAGKTTTFYMVVGIVARDAGSITIDDEDITLLPLHERARKGIGYLPQEASIFRRLSVYDNIMGILEIRHDLTAEQRKDRAEELLEEFNVSHLRNSLGQSLSGGERRRVEIARALAANPKFILLDEPFAGVDPISVLDIKKIIQHLRDYGLGVLITDHNVRETLDVCERAYIVSQGHLIAHGSPEEILANEQVKRVYLGEGFRL

SEQ ID NO: 5912 - protein, 380 aa, Proteus mirabilis
SRMAKRDFYEVLGLSKTADEKEIKRAYKRLAMKYHPDRNQGDKDSESKFKEIKEAYEVLSDPQKRAAYDQYGHAAFEQGGFGGQGGGGFGGADFSDIFGDVFGDIFGGGRRQQRAARGSDLQYNMDLTLEEAVRGITKEIRIPTLETCDKCHGSGAKEGTSAETCSTCHGAGQVHLRQGFFTVQQPCPTCHGRGKVIKEPCSKCHGDGRVERYKTLSVKIPAGVDTGDRIRLSGEGEAGEQGAPAGDLYVQVHVRQHHIFERDGNNLYCEVPINFAVAALGGEIEVPTLDGRVKLKIPAETQTGKMFRMKGKGVKSVRSHGVGDLMCRVVVETPVKLNEKQKQLMEQLGESFGGKGGEKNTPRSKSFLDGVKKFFDDLTK

SEQ ID NO: 5913 - protein, 507 aa, Proteus mirabilis
LSEANMEALLELKNIDKSFPGVKALSGATLRIYPGRVMALVGENGAGKSTLMKVLTGIYQKDAGEIIYQGERCSFNGPKSSQEAGIGIIHQELNLIPELTIAENIFLGREFTRAFGAIDWKKMYAEADKLLARLNLPYRSHRLVSELSIGDQQMVEIAKVLSFGSKVIIMDEPTDALTDTETRSLFSVITELRNQGCGIVYISHRLKEIFDICDDVTVLRDGQFIGEKPVSSLQEETLIEMMVGRKLEDQYPRIHIPAGKTKLNVSHLSGADIHDVSFSLHENEILGISGLMGAGRTELMKMIYGALPKTQGSVALEGKICQIKKPADALAQGIVYISEDRKRDGLVLGMSVKENMSLTALPYFSRTMGILNHKEEQLTVSDFIKLFNIKTPSINQIIGFLSGGNQQKVAIARGLMTRPKVLILDEPTRGVDVGAKKEIYQLINKFKQEGLSIILISSEMPEVMGMSDRILVMHEGRISGEFSANNVTQEMLMAAAVGKQYGATVGV

SEQ ID NO: 5914 - protein, 545 aa, Proteus mirabilis
FFRAIGGVMKLSSNNAETMESLRSERNQYRILVDITNSVLAHLDMDGLISEVSKEIHRFFGLNHISLMLCRTSSQNSHEGILYSSRYQTGKSVIRQQRKFSSANNKAEEIIHQNKPVLIDINKEDQDDVLIKRLVKQNMQTALLLPLAFNRKPLGLLILAHEISSVFTEETCQLLQQIAARIGIAIENAAAYEEITHLKDSLKNENIWLNEQINRNGSFSEIIYQSDAMHNVLEQIELVAQSDSTVLILGETGTGKELIARAIHRLSHRKNKTMIKMNCAAVPSGLLESDLFGHDKGAFTGATHAHVGRFEMADKSTLFLDEIGDMPIELQPKLLRVLQEREIERLGGNKVIPVDVRLIAATNKDLCELTDEGEFREDLYYRLNVFPIIIPPLRERPEDIPLLAKYFTQKIARRMDRKIDCIPTHALEQLTHYPWPGNVRELENIIERAVILTRGSTLNLQLKELNINKPSRLKQVLSQPSAIEKKMQTSAPESDDEERERIIQALRETNGVVAGARGAALKLGLKRTTLLSRMQRLGISIPEIL

SEQ ID NO: 5915 - protein, 533 aa, Proteus mirabilis
PLNFLIIRFNYSRCHIFNRVAHFCRNLLGRQTTSSDTESVASERPVTASDRPKKETQTTVRRRPALSADRPRKNKSNNEKANGSDLPMTVIPRDQHPISRKDISDNALKVLYRLNNSGFQAYLVGGGVRDLLLGKKPKDFDIATNATPEEVRRLFRNSRLVGRRFRLAHIMFGPEVIEVATFRGSHEDHETSDRNQSQQAQSGMLLRDNIFGSIEEDAIRRDFTLNSLYYGVDDFAVRDYVGGLADLKSGTIRLIGSPETRYREDPVRMLRAIRFASKLDMRIAPETAEPISQLAPLLRNIPSARLFEESLKLLQTGHGYKTYRLMRHFQLLEPLFPLVASRITEQQDTPMERMIEQVLKNTDYRISKEMRVNPAFLFAAMLWYPLVEHAEKLAQESGLSYYDAFSMAMNDILDEQCRTIAIPKRITTTMRDIWQLQQRLPKRQGRRANKLLEHPKFRAAFDLLELRANVQRNPDLEALAAWWADFQISNNTQQRSMVSELGPGPVRKRTRPRKRPRHPNAKNNAPRQENKHE

SEQ ID NO: 5916 - protein, 112 aa, Proteus mirabilis
WINLFNHRSLPYHAKSCTLMKQIIFDFSTLADRDAFYHQFAQQFQLDEAFGNNLDALWDVLTGEIELPVNIVFRHAPHHSRTFQPIIEIMQEAQETLGKDLFRFHCEHKKAK

SEQ ID NO: 5917 - protein, 285 aa, Proteus mirabilis
RINFVYADRLKDVLFMNAQPDNLIEVRNMNFTRGSRKIFSQINLDVPRGKVTAIMGPSGIGKTTLLRLMGGQILPDSGDIWFDGDNIPKLSRSALYQSRKKMSMLFQSGALFTDMNVFENVAFPLREHTNLPEALIHTTVMMKLEAVGLRGAANLMPSELSGGMARRAALARAIALDPDLIMFDEPFVGQDPITMGVLVKLIDELNHALGVTCVVVSHDVPEVLSIADYAYIIAEQKIIAQGSAKELQENPDRQVRQFLDGIADGPVPFRFPAGNYQDDLLGRGN

SEQ ID NO: 5918 - protein, 294 aa, Proteus mirabilis
LIFYCIINNKQYHLCLYYAYNSLERKSEARIMSSMSATFPRRWSFSIGGLTASIVFHVTLVVVAIGWITTKDEQYAVLPPAMTMQVGLYQLAKAEPKEVPVGPEQVMSVPEAAEPEPMKEQLDVPKMPVVEQGTYQRVAEKPKVKPVVKPKPVVVKVPDDLPVSQAPADTTTAPLSGENATSSADFTSTASSSRSGQMGWESLVHSHIDMYKRYPRAALRFKATGVTQVEISLNAKGELLDVSIQTSSGNRILDKEAINTIKRASPFPAPESHRLVNGSFSFIAPLSFDYRQSS

SEQ ID NO: 5919 - protein, 565 aa, Proteus mirabilis
NLFYNQRVIIVAQYVYSMLRVGKVVPPKRHILKNISLSFFPGAKIGVLGLNGAGKSTLLRIMAGIDTDIEGEARPQPGLKIGYLPQEPKLNPQQTVREAVEEAVSEVKNALNRLDEVYAAYADPDADFDQLAKEQGQLEAIIQSHDGHNLDNQLERAAEALRLPDWDAKIEHLSGGERRRVAICRLLLEKPDMLLLDEPTNHLDAESVAWLERFLHDYEGTVVAITHDRYFLDNVAGWILELDRGEGIPWEGNYSSWLEQKDARLEQEAATEAARHKSIQKELEWIRQNPKGRQAKGKARLARFEELNSVDYQKRNETSELFIPPGPRLGDKVLEVSHLTKSYGDRVLIDDLSFSIPKGAIVGIIGPNGAGKSTLFRMISGQEQPDSGTVTLGETVKLASVDQFRDSMDDSKTVWEEVSGGQDIMRIGNFEIPSRAYVGRFNFKGVDQGKRVGELSGGERGRLHLAKLLQVGGNMLLLDEPTNDLDVETLRALENALLEFPGCAMVISHDRWFLDRIATHIIDYQDEGKVEFFEGNFTEYEEYKKRTLGNEAIQPRRMKYKRITK

SEQ ID NO: 5920 - protein, 226 aa, Proteus mirabilis
EAFYMEIVRELFLALWHQDYETLANPSLLWIIYILLFSILFLENGVLPAAFLPGDSLLILVGVLIAKGTMDFPLTLLILTAGASLGCWLGYLQGKWLGNTRLVRSWLSHLPEHYHQRAHGLFHRHGLAALLIGRFLAFVRTLLPTIAGLAGLQNGRFQVFNWLSGLLWVGILTTLGYLLGNSPLFRQYEHHLMNFLMLLPVCLLVIGLIGSVWVVIKKKSKQSNQP

SEQ ID NO: 5921 - protein, 397 aa, Proteus mirabilis
NVIYYSLEGVLIKSAILVLEDGTEFHGRSIGAEGAAIGEVVFNTSMTGYQEILTDPSYSQQIVTLTYPHIGNTGVNSSDEESATIHAQGLIIRDLPLVMSNYRAEESLADYLKRHQIVAIADIDTRKLTRLLREKGAQNGCIIAGTHLDAKQALEKAKAFPGLKGMDLAKTVTVKQPYQWTQGSWTLTGELPATQSPQDLPLHVVAYDFGVKRNILRMLVDRGCRVTVVPAQTSAQEVLALSPDGIFLSNGPGDPEPCDYAIDAIQTFLTTDIPVFGICLGHQLLALASGAKTVKMKFGHHGGNHPVKDLDNNSVMITAQNHGFAVDEASLPDCLRVTHKSLFDGSLQGIHRTDKAAFSFQGHPEASPGPHDAAPLFDHFIELIEQYRQNLQSVTNK

SEQ ID NO: 5922 - protein, 528 aa, Proteus mirabilis
PRVYHLSQKHDITQRIRFIDTRKRIEMIDFKLKLNYQRKYNSSDIDIDDEMQISRQFESDRGRIINSAAIRRLQQKTQVFPLEQNSAVRSRLTHSLEVQQIGRYIAKQIIGELKKHNKLEEYGLNERIDSVESLIEMACLMHDIGNPPFGHFGEAAIKHWFRKVLAPDASIEFDNCPFLPIRYSADRHLNELKQTLRQDLCHFEGNAQAIRMAHHLLKLNLTYAQIGCVLKYTRPAYWQGATPKEFSYLMKKPGYYWSEAEFVKEVQEKLAMKDFCRFPLTYIMEAADDISYCIADLDDAVEKGIFDINRLVQLLKNAWSESGAVTEGDLFDITVNRAFKKVDQNEAKRSMQDQFFMYLRVYITGKLVPYTAYRFIKNLPQVYEGSFNHALLEGKSAEHRLLATLKRVAQKWVFSHPEVEELEMKGYRVISGLLDIYKPLLLLSTDDFLRLHKYNEHPHYVIETRLYHKLSIKHKLAYNEALEKIYDINSEEGKTLEFYYRTRLIQDYISGMTDHYAYEEYRKLMVCD

SEQ ID NO: 5923 - protein, 286 aa, Proteus mirabilis
LEVYMLIPKRQLIFYLFTSMLIYPASSIAAIFSYITESKPVGNEGTGADYTFIIQRWDPEPPTALNPCYKKKPCYITINHRHQPNQSGGSATRTILSDGHKYRRMEDLRIAVMKELGGFPYGPGVAIHRYVDTSTIQECVGIFYQPNAYGFAEDGYLLPGSICAIAPPPVGHCDVLAHSVELDYGNVGENELDNAVRSQTVNVTCNRDVSLQVVATGMNNRQVPLRNDNSLYADLYINDKSGEEGEAIFVAKGKMVSIQVSSKLRTNGHVAPGYFSGSGALILTLP

SEQ ID NO: 5924 - protein, 112 aa, Proteus mirabilis
IRNFLLNCSKMITIIQLTCFIIKNIMAKKTTSINQDTTQTPSFEASMQELEQIVNRLESGELPLEEALNEFEHGVRLARVGQKTLQDAEQRVRILLKEDDDATPDDFIQEAE

SEQ ID NO: 5925 - protein, 94 aa, Proteus mirabilis
HFYYFNKFKSHSTSRYYGFLFYYAANVCFILSRARLYHRLFSFYLSMQVLLHQQIVNTLSEAFLDFVAHFSAIVPKTHYYFVFVSIKHQFATNI

SEQ ID NO: 5926 - protein, 172 aa, Proteus mirabilis
FWYYFLKYFFQGNKMTKQQVTTQELLNGLSELLHLKEANNDEGHKKVLAEKGLENYSLTELHVIHCIGEESMRNLTTISDYMAMTRGAVSKICRRLQSKGAIEKIKLADNQKEIFFILTTEGEKLFHTHELLHQQSQAKWITLFEQYDQNERLAIKRFLADVANRFRHKKKA

SEQ ID NO: 5927 - protein, 133 aa, Proteus mirabilis
IYSYFYKKEMIKMDKKTLSAFMASICLTLGLGLSPLSYADDISPSTSTMLIEKGDQKESAISEVNASAQGKLDINSATLDELMTLKGIGKAKAQAIIDYREKVGRFASFDDLAKVFGIGMKLIEQNKDLIIIN

SEQ ID NO: 5928 - protein, 205 aa, Proteus mirabilis
DAILMQTSPLLESLMEALRCLPGVGPKSAQRMAFHLLQRDRSGGMRLAQALTRAMSEIGHCCDCRTFTEEERCTICANARRQQNGQICVVESPADIHAIEQTGQFAGRYFVLMGHLSPLDGIGPMDIGLDRLEERLSQEPISEVILATNPTVEGEATANYIAEICAQYDIAASRIAHGVPVGGELEMVDGTTLSHSIAGRQKIHY

SEQ ID NO: 5929 - protein, 355 aa, Proteus mirabilis
QNLLTIMFFISPVLLVFSLFFTHCWKTDGMLITLSLLIVGLMLLVYASDRLVYGASVFAQSLKLPPAVIGIVIVGMGTSLPELFVATDAAIHNLPEIAIGTAIGSSLTNLLLIAGIGAMIYPMNIQSAVLKKELPLMIIVILLAGLVVSNSHLGLREGCLLFFIGFASLFLMIKMLHKTLTQVRHVLPLETLSRFELQTNPRNSVALFWVVIALLIIPVATRMIIDNVFIIMQQYHLSGFLVGLTLLSIGTSLPELATTVVAALRRENELALGNIIGANIFNLTFVLGMPALLSPSTFNMQAFYFSFTVLVVAGLLFSLFSLGRKQRLNRGKGIFLLVCFIVYITVLCVAHSLLT

SEQ ID NO: 5930 - protein, 219 aa, Proteus mirabilis
KSSLYKNKEDIMSWPFLAVLFSGWLYIDAAYRGPNWQRWLFRPITLLLLLLWAWQVPEHSINSYLIVGALLATLLSDVLKMFEGKYLLPSLALLFLSYILYLISFALPLQISFYLPLLGFVIVAAIIVLAIIWTKLDKFAIPVLLTLLAAFAMFWVAGEKFFYLSNDYNFSIMIGSLLLVIAYSIWLINRFRFSFSASKGLVSACYFIGHFFIVRALFL

SEQ ID NO: 5931 - protein, 73 aa, Proteus mirabilis
RIDFVFFRYQSQQEYLLVIYVTCCFNLINFKKILPVRYRGEGKFCYYSGGCLDRFGSSIALEPKRQKPRILFS

SEQ ID NO: 5932 - protein, 382 aa, Proteus mirabilis
KSSYQERYMALGNNVFSQHGINRRDFMKLCAALSATMGLSGKAAAQMSQAMTSPERPPVIWIGAQECTGCTESLLRATHPTLENLVLDVIALEYHEVLSSAFGYQAEENKHNAMEKYKGKYVLVVDGSIPDKDGGIYCMVAGKPILEHIKEAAEGAAAIIAIGSCSAWGGVPASGGNPTGAKSLEAILPGKTVINIPGCPPNPHNFLATVAHIITFNSLPKLDSKNRPLFAYERLIHENCERRPHFDAGRFAKEFGDEGHRQGWCLYHLGCKGPETYGNCPTLEFCDIGGGIWPVGIGHPCYGCNEEGVGFTKGIFQLANVYQPTPKAQVPDVNAKEGGGVSYGAAGLLGAVVGAVAGVSVMAVRQLGRDKNTTGASQEDKR

SEQ ID NO: 5933 - protein, 242 aa, Proteus mirabilis
YIKYQLNNLSLLILVMRDIIDMFWIHSLERNMNKKLLASLILAGLVTITAGCDDSSKKVDEGIDKAKETATQVNETAQDKAKELTDQAKEKAADLKESASATADELKQDAAKLKEQAEDKAAELKAQADQKTDALKESIAQKTDELKDSASAKADEIKQSLNNESDKLAGKAEEVKQNANTTADNLKQNASDKAAQLKEDAAKTSDDVKQQAQDTKDKALDKADELNDQAKQKIDSLKADNK

SEQ ID NO: 5934 - protein, 173 aa, Proteus mirabilis
NIKYEDDRFFLMVKETFKGNNPIRAIIIRYLEHLFTNLNDDEMNNLKTLLRGVFLTSGALVTTGGVRVYIATAASELIYNTVLRNAIAHKLIRGGGNIAMAFVGGYGIIEMASQAKERLRYSNPTLYYDLVLMNLEMGYFIVEPNISKWLYMIGSEKKSVDEVYRAINGLIYN

SEQ ID NO: 5935 - protein, 225 aa, Proteus mirabilis
EMEYYLLVVIKFIIGFTIILAHMNISGKTQLSQLTPIDFIGNFVLGGIMGGVIYTDAIPLYQYVIVFLIGVFFISFLNYISKKFNFFRAVAIGNPIPIIKKGRFIMENITEKKNKIDILNITSRLHAQGIHSFQEVNYAQIEPDGQITVVCDGAKMPSIIIMKDGVIRTSELEQIERDENWLNEEMKKQHIDNPEDVFLAEFWDGKVNFILQDGKIKHDFIPTAE

SEQ ID NO: 5936 - protein, 233 aa, Proteus mirabilis
FARYGSTKMNYVNMLFFDIYPYIAGAVFLIGSWLRYDYGQYTWRAGSSQMLDKKNMRLASNLFHIGIIGIFAGHFLGMLTPHWMYQSFLPIEYKQIMAMVGGGTCGVLMLIGGIMLLKRRLTNARVRATSSFGDIMILTLLVVQVALGLLTIPFSAQHMDGSEMMKLVAWAQAIVTFHGGASANLEGVALIFKLHIFLGMTIFLLFPFCRLVHIWSVPIEYLTRRYQIVRNRH

SEQ ID NO: 5937 - protein, 181 aa, Proteus mirabilis
LIMYHVIAATTNPAKINAIKLAFEQVFGKDTFDIEDINVDSRVPQQPIGNTETRTGARQRVMAARQVRPEADFWVGVEAGIEDDMTFAWIVIEHEQIRGESRSASLMLPEQILKGVREGRELGDEMAFLTKIDNIKQKGGAIGYFTDGLLSRTSVYQQAIVLALVPVTHDIYKQLNKKDDE

SEQ ID NO: 5938 - protein, 582 aa, Proteus mirabilis
GVALFSQLSWYFISEWRRYVGAIFLLMVIAVLQVIPPKIVGIIVDGVDSHSLSFQQIMGWIGIMVLIALAVYLLRYIWRLWLFGASYQLAVKLRMQIYRQLSLQSSAFYQRYRTGDLIARTTNDVDKVVFAAGEGVLTLVDSMVMGLAVLVMMSIQLSWQLTLISLLPMPLMAILIKRYGDKLHHRFKSAQALFSSLNNQAQESLSSIRMIKSFGLEQQHASRFETVAKETGRQNMRVAKVDALFDPTIFMAIGFANLLAVAGGSYFVLNGTMTLGELTSFVMYLGQMIWPMLALAWMFNIVERGSAAYSRINALLNEQPAMVDGQLSPMHQKGTLAVDIKAFHYPKQQVDVLKNIHFTLSPGEMLGICGMTGAGKSTLLALIQRLYDVSEGDIRFQSVPLYQLKLDEWRGRLAVVNQTPFLFSDTIAGNIALGRPDATKEEIEAVAKIANIHDDILNLPEGYLTQVGEKGVMLSGGQKQRISIARALLLDAEILLLDDALSAVDGQTEYQILQNLAQWRKEKTIIISAHRLSALVDATNILVLKQGEIIEQGTHQTLIAMPGWYQDMYHYQQLEAALDDDK

SEQ ID NO: 5939 - protein, 94 aa, Proteus mirabilis
IKKYDLFKDKNSLFLISIWNYGDGYLEEGKYDRLCFTEIKSNKKCIEKDKVMSIMYSLNEEEIRIGNSAYIKDKNGSFIKKDKDANTTITAILD

SEQ ID NO: 5940 - protein, 330 aa, Proteus mirabilis
NKWYKKMTGFDFQQAGKKVLQIEQEGLAELAQYINDDFSLACEKIFHCQGRVIVMGMGKSGHIGHKIAATFASTGTPSFFVHPGEASHGDLGMVTEKDIVLAISNSGEASEILALIPVLKRKQILLICMTRSPQSTMGKAADIHLCIKVPKEACPLGLAPTTSTTATLVMGDALAIALLRARGFTAEDFALSHPGGALGRKLLLHVSDLMNKEDDIPRVSKEATLREALVEITRKKLGMTVICDDNMLINGIFTDGDLRRIFDLGIDLNNAKISDVMTKGGIRISPDSLAVEALNLMQAKHITSLLVTEPDSDILLGVLHMHDLLQAGVV

SEQ ID NO: 5941 - protein, 436 aa, Proteus mirabilis
FSRYTAYSKIKKRVLQMDKFRVQGPTCLSGEVTISGAKNAALPILFAAILAEEPVELTNVPKLKDIDTTIKLLNRLGTKVERNGSVFVDARHINEFCAPYELVKTMRASIWALGPLVARFGRGQVSLPGGCAIGARPVDLHITGLEQLGAEITLDEGYVKARVDGRLKGAHIVMDKVSVGATITIMTAAVLAEGKTIIENAAREPEIEDTANFLNTLGAKISGAGTDSITIEGVERLGGGTYQILPDRIETGTFLVAAAVSRGRVVCRNAKPDTLDAVLAKLREAGADIETGEDWISLDMHGKRPKAVTLRTAPHPGFPTDMQAQFSLLNLVADGAGMITETIFENRFMHIPELIRMGAHAEIESNTVLCHGVDKLSGAQVMATDLRASASLVLAGCIAEGTTIVDRIYHIDRGYENIEAKLQGLGAKIERLHSND

SEQ ID NO: 5942 - protein, 187 aa, Proteus mirabilis
QNRYKAQMKKTDPLSLFKKQIDNLAETLAPIANKKIAAPCFDTALFHHRSDSLGGYMQQIRDNFTQLITCVEAQRSQQVKFLATQMLQQIEALTRELSTQTLRKQENQLSQRKKSVDLYQKLAQHQDYERRLQSMIQDRELALTQAQGFVRQQELQKEIAALENRLARCKSALVSIEKSIERQEDKY

SEQ ID NO: 5943 - protein, 676 aa, Proteus mirabilis
KRYLMAHYSYLFTPLDLGFTTLKNRILMGSMHTGLEEDPHDAPKLAEFYAQRAAAGVALIVTGGISPNKQGVLLPHAATLMSEDQLASHQLVTDAVHKQDGKIALQILHTGRYSYQPNLVAPSAIQSPITPFMPQAMSHEQIEQTIEDYIHCAKLAQKAGYDGVEIMGSEGYLINQFLVSHTNQRDDQWGGSIENRCRFALRILAGIREAVGEHFIIIYRLSMLDLITEGANASEVFYLAQAVEKAGATLINSGIGWHEARIPTIATMVPRGQFAYVTRQLMGKINIPLITSNRINTPQVAEAILAEGCADMVSMARPFLADPQFVLKAQLGREDEINTCIACNQACLDEIFSGHPASCLVNPFACRETELILTPTQAPKKIAVVGAGPAGLAFAITAAKRGHHITLFEKEDRIGGQLNIASQIPGKEEFKETLRYFKRQLQITGVIVKNNTEATLSHLQHFDEIILASGVIPHIPEIDGHDNPIVKTYLDVLKYHQPTGEKMVIIGSGGIGFDTGLYLTQTGQCSSLSPCAFNKEWGIDPTLTHRGGITSAHPFIKKDKQIVMTQRKSGKFGLSLGKTTGWIHRLTLQKKGVKWLTGCHYQKITEQGVIIEHNEQQQLLAADSVILCTGQQSYRPLLQALQQENKTVHLIGGAKEAKALDAKRAIKQGTELALTI

SEQ ID NO: 5944 - protein, 509 aa, Proteus mirabilis
IYFQYENKLNLNLYLEDIMGSFLLKKAVGLSNISDLLDKSGIFYNYSTKVLPSFDYDTAGKHIAREDSTWNGKYVIGQPAEVTYSFPKWEGKFNQFGNKNPYEFNELQKEHARKSLDAWSDIANIKFTEVAVGNVDGMKASDVKTDITFGNIYDPNGTFQAYATLPNTYAYGKDLSGQAWFSDYHYAGNTTPELGNYGRLTIIHEIGHTLGLMHPGDYNAGQNVPGYLKSDYAEDSRQYTVMSYWDEYETGAHFQGAYAGAPLLHDISAMQYLYGANTTTRTGDDVYGFNSNTGIDYYTATDSNDKLIFSVWDSGGNDTFDFSGFYQDQLIDLRAGNFSDVGGLQKNVSIAQNVTIENAIGGFGNDIIHGNDADNTLIGGEGDDIIYGHSGNNTIYGGRGQDTLHGGTGSNTFIYKEIADSLVSAADKIMDFKTGIDKIDLSTLIQDTFSSKILNFVDNFTGNAGEATLSYNEVTNASELAINAYGYNYNPDFKIDIVGFVNYETDFIV

SEQ ID NO: 5945 - protein, 391 aa, Proteus mirabilis
VTLQKTLTKNRLLIMILRFIFSIVLLYSSMAYAYSQQVVTPVTDLLGRTVNVKLPVQRVILGEGRQLYLVAMFDKENPAQRIVAWRKDLIQSDPATWQQYRQQFPQLAKIPTFGGSEQGTFDIEQAINLQPDVIIMNMDARNTIVDAGHEAALARAGIPIVYVDFRYDPIAHIPPTVTLFGKLFGQPDRAEAYLTFRDKELQRVTSRVEQLQGALPKVFLERLGGYSEECCMTFGKGSFGRFVKIAGGDNIADNLAPGTFFTLNPEKVVVANPDIVIITSGNFQAFVPGGKWIPLGPGINIQQSKHRLAWFTTRPAYVDSNARRRGAFFAIWHQFYNSPYDVIAIQQLAKWIHPQLFADLDPDDTFRRLHQEFLPISYQPGYMIDLEKEGR

SEQ ID NO: 5946 - protein, 334 aa, Proteus mirabilis
ALLHMKLIMPCGEFSLIKQYFTSQPVKRKDVSTGIGDDCAILTVPEKQQVAISTDTLVSGIHFLPTISPEDLAYKALAVNISDLAAVGADPAWASLALTLPKVDNDWLEAFSRSLFALAEYYSIQLIGGDTTKGPLSLTITIQGLVPQGMALLRSGAKIGDWIYVTGFLGDSAAGLAVLQNRLQPSQPESRDYFITRHLRPQPRLLQGQALRSLASAAIDISDGLISDLNHILTASGCGARINLDALPYSAAMKSQVSKEQAEIWALSGGEDYELCFTVPEINRGALDIALAHTGADFHCIGQIMPIAEGIRYLREGKEVHPNLKGFDHFGDNK

SEQ ID NO: 5947 - protein, 324 aa, Proteus mirabilis
NLYHLGRWMRLMKYIKSIGTLSLLAAAVLLSGCDMALMNPKGAIGAEQKTLILIALGLMLIVVIPVILMVIVFAYRYRESNTKATYRPNWAHSNKIELVVWTVPIIIIVILATITWKTTHELDPYKPLVSDEKPVTIEVVSMDWKWLFIYPEQGIATVNELAFPTNVPVNFKITSDSVMNSFFIPRLGGQIYAMAGMQTKLHLIANEPGEYQGMSASYSGHGFSDMKFTAIATPDRAGFDAWVAKVKQSSDTLNTTAAFDELAKPSQKNPVTYYSSVKPMLFQETISKFGHTGHGAHTGSNQTEHSDATMNMNMSHAAHAGAEE

SEQ ID NO: 5948 - protein, 160 aa, Proteus mirabilis
QCHHIEDKTRYNINFVEIWRSNLNKVIKFIFIVLLLVGSILNIPILFVDNHFSYTKHDFIRYNLFTFDEIKNAPIISSNYIIFYDSPDGVVPMTNSILFSNVNPNRKIELINYIENLGYVKDINAYWNTDGNESWRKDNLFIQIKQINSEHTILFLVEKN

SEQ ID NO: 5949 - protein, 293 aa, Proteus mirabilis
TMNQPNRAAVTTSTLYIVPTPIGNLGDITQRALDVLSHVDLIAAEDTRHTGLLLQHFAINARLFALHDHNEQQKADQLISKLQQGLSIALVSDAGTPLINDPGYHLVNQCRKNGIKVVPLPGACAAITALSAAGLPSDRFCYEGFLPAKTKSRQDCLRDLAQEPRTLIFYESTHRLLDSLADMVTVWGEARYVVLARELTKTWETIQGMPVGELLNWVREDENRRKGEMVLIVEGYQKPQEDHFAPEVLRTLAILQKELPLKKAAAVTAEIYGVKKNALYKHVIAQNEAEQDQ

SEQ ID NO: 5950 - protein, 63 aa, Proteus mirabilis
VYDQFSLNHLSLSRTILPIRFNPIKIGRTDGQAFCSGPQRSPLGLSAYFYLLIGLVTYCLFTR

SEQ ID NO: 5951 - protein, 306 aa, Proteus mirabilis
GECQMLWFKNILVYRLNKEIALSMDELEQQLASLAFTPCSSQDMTKTGWVSPMGDRGEALIHVAGKQVMMCARKEDKILPATVIKQALQDKVEKLEGEQGRKLKKTEKATLKDEVVHTLLPRAFSKFSQTFIWLDLDKQLVIVDSGSAKRAEDNLALLRKTLGSLPVVPLNFNESVESKMTQWVRSGELPAGFTLMDEAELKAVLEEGGVIRCKKQELVSDEIATHIEAGKFVTKLSLDWEDRLQFMLCDDGSIKRIKFSDTLREQNDDIDKADFAQRFDADFVLMTGELSALIERVTEVLGGEAE

SEQ ID NO: 5952 - protein, 470 aa, Proteus mirabilis
CSRQLMWSIIMDASNLAPSAKSSPINKRGLIILAIDVVLLLLLLEFLPYDPKANAGLALMVFVGVLWLTEAIHVTITALFIPILAVVLGLMNTNESLKSFANPIIFLFFGGFALATALHIQGLDRLIANRLLMIAKGKLSIAVLLLFGVTALLSMWISNTATAAMMLPLVLGILSNLDIRSERNTFVFVLLGVAYSASIGGLGTLVGSPPNAIAAAQLNLDFITWMKYGVPIMLVLLPIMFIVMYLMLRPNLKHKFDLKLEVLEWNNKRVITMIIFLVTVFCWIFSSFISSAFGGVKDLDTVIAVSAAIVIGVTGVASWSQIQENTEWGVLMLFGGGLTLSAILQSSGASLVMADFMKDTFGNSHWFVIILAVTTFIIVLTEFTSNTASAALLVPIFATVAQALGMPVMALTMIIGIGASCAFMLPVATPPNAIVFGSGYIKQTEMVRVGGVLNLVCILVISLFAWFFWL

SEQ ID NO: 5953 - protein, 231 aa, Proteus mirabilis
SMIQILAVLIVVIIVARMILKGYKAEPVLLVAGLVLMALTMILGWGDILPKNVKTTGISWLDPFEVMRDLFSSRAADLGLMIMALMGFAHYMDHIGANEAVVRVATRPLKNMRSPYVLLFFSFLLASILQLAIPSATGLAVLLMGTMFPIMIGLGLSPASAAGVIATSLGVAYTPTAIDAIRGAKAVDLGVVEYVLYYQGPAAIATVLAVGITHIFWQRHCDRKAGYCTPN

SEQ ID NO: 5954 - protein, 156 aa, Proteus mirabilis
QHPHLIRGGVVLHWNKLECGMTKPTIIINELDAERLDSLLEQPAFADSPIAEALNEELDRADIVTPADIPANIVTMNSKVRFMDLKNNEERIRTLVYPASLKDSATELSVMAPMGAALLGLAINDEISWQLPNGLETKVKVLEILYQPEAAGELHR

SEQ ID NO: 5955 - protein, 111 aa, Proteus mirabilis
MSFFISDAVASAGQAAPEASFMSILPMLVIFILIFYFMILRPQQKRTKEHRKLMESIGKGDEVLTTGGLIGRVVKVSDNGYIVVALNETTEVTIKRDFVAAVLPKGTMKAI

SEQ ID NO: 5956 - protein, 635 aa, Proteus mirabilis
FFHQTEPSLVMMDNIRSTANNPFIKILLAVIILSFVLTGVGGYLFSSGVNDAAEVNGYKISRAQLEQAYQQRRAQLQKDMGDNFASLASSDEGQKMIRQQALNVLINQALLDQFAQELGISAGDQQIRDAIFALPYFQTDGKFDNKKYVELLTANNIDADAFAEGIRQNLINQQLRYSIQGTDFALESEVKDFAGLMLQSRNVRLASLDIQPFLEKETVSDEELKAFYDQNTSMFIAPAQVKVSYIQLEAQKDLSNITISDDEVKAYYDSNISEFTVPGQKKYSLLVLADETAAKEAEDALKNGADFVTLVKEKSIDTFSAKQNGSLGWITIGQELPELANASLTEKGQISQPVKISNGYAIFRLDDIKPSVVKPFDDIKADLLVKMRENKAIDDFFALQQKVSQAASNDNDTLATAAKAGNVTVINTDWFDENNVPAALNNEKLTQLIFGGSLVDDNGPTGMNSDMVTLGNDSAYIVRVEGYKPASTQPLDKVRDKVITLVKQQKASQAMNAQAQKLLAALKEGKGEAALKEANISFGEVESVVHSSATDPIQSAIFAMPKPAEGKKEYGMSNVPGSKVVLIQLDSVTDGKPTAEQLEFMTNLYRAQMGEEALQLMLSDLREKAKIEIFDKDYQ

SEQ ID NO: 5957 - protein, 292 aa, Proteus mirabilis
TMSQALKKLINLMELEKIEEGLFRGQSEDLGLPQVFGGQVVGQALYAAKQTIADNRYVNSFHSYFLRPGDSHKPIIYDVESIRDGGSFSTRRVSAIQQGKPIFYMTVSFQEFEEGFEHQDMMPEVPFPNDLISQDEILKKLAPKLPEPLRTLALRETPFEARPVQYFSPFGYEKAPAERYVWYRSRGEMPSDPFLHQYLLGYISDFDFLPTSLQPYGLGFMDPSLQVATIDHSMWFHRPFRVDDWLLYAIESPSASGGRGFVRGKMFNMSGQLVASSVQEGVIRQKRIKSNK

SEQ ID NO: 5958 - protein, 568 aa, Proteus mirabilis
IMSQRITIDPITRIEGHLRVDCEIDNGKVVKAWSSGTMWRGMEEILKGSDPRDAWIIVQRICGVCTTVHAIASVRAVEDALGMDIPVNAQYIRNLILASHIIHDHIVHFYQLSAMDWVDITAALQADPEKASAMLKGVSQWQLNSAEEFRKVQKKIQDLVDSGQLGIFANGYWGHSAMKLPPEVNLIAVAHYLQALECQRDANRIVAVLGGKTPHIQNLAVGGVANPINLDAPNVLNLERLMYVKHFIDNLGDFIEQVYKVDTAIFAAYYPEWLKIGKGANYYLSVPELPINGNNTEFLLSGGYMKGVDFSTYRPIKDWKDQNLKDGIEESGKHAWYEDDEPLKPWEGLTRPKYTGWDENNKYSWVKSPTFYGKPVEVGTLAWLVCGLAGKHEGTVKHYNEVNQIYTKLTGQTLVTEQLESTWGRIIGRTVHACVLQDSLNFLWQSLVDNIGRGDTASFIKPEFEPGKEYRGVGFEEASRGMLSHWIVFKDGKITNYQAVVPSTWNAGPRNFNDEPGPYELSLVGTPVADPNKPLEVVRTIHSFDPCMACAVHMVDLTGKELSKVKVL

SEQ ID NO: 5959 - protein, 424 aa, Proteus mirabilis
NSSLIVIIIYTSIIIKGKGRLMKQYAGFIYIATTLDTKSAEIFYVSELIKKAGLPVKTVDLTTKPTALEREADVTAAQVASYHPDGKNAVFCGDRGKAIAAMSVAFERYLTHCDDVLAILGLGGSGGTALITPAMQSLPIGVPKLMVSTMASGDISGYIGASDISMMYSVTDVSGLNRISRKVLRNAANQIAGAVYFYQEENSVDKPAVALTMFGVTTPCIQQLTKKLENNYDCLVFHATGSGGKAMEKLIDSHLLHSVLDLTTTEVCDYLFEGVLACDEDRFGAIARTKTPCIVSCGALDMVNFGRPATVPEKYKDRHFYHHNSQVTLMRTTPRENRQMGIWIAEKLNQCEGPLTFIFPQGGFSALDIEGGPFWDPQANQAFFDAFITTFKETETRQLVISPYHINSAEFNQQVYDLHQELIC

SEQ ID NO: 5960 - protein, 106 aa, Proteus mirabilis
IVIQGVINKSFLLYKVHRYNLSNRLFCMILSITIDYLCCIHHLKTGHHPKFKNRVSPKFTLNSSSERSQQRDNLKYDEYKLFQFTGVHYGSGYSQSPRFHSSCCFR

SEQ ID NO: 5961 - protein, 347 aa, Proteus mirabilis
IMTQSHFVELKNIVKRFGTNTVIDTLSLSIPQGKMVSLLGPSGCGKTTVLRLVAGLEKPTEGKIFIDGEDVTDRSIQQRDICMVFQSYALFPHMSLGDNIGYGLKMLGLPKAEIKQRVAEALALVDLAGFEDRFVDQISGGQQQRVALARALILKPKVLLFDEPLSNLDANLRRSMREKIRELQQQFNITSLYVTHDQSEAFAVSDMVLVMNKGKIMQLGSPQTLYRQPASEFMASFMGDANLFPATLGADYVDIFNYRLPRPENFNSNKTEIRVGVRPEAITLSQQGEACQQCTIIHVAYMGPQYEVTVAWQNQTLLLQVNATQLQPNEGDSYYLQIHPYGMFILE

SEQ ID NO: 5962 - protein, 410 aa, Proteus mirabilis
IAAHHICGCGGSTMSLQDTSFESCIKCTVCTTYCPVAKVNPLYPGPKQAGPDGERLRLKDPMLYDEALKYCTNCKRCEVACPSDVKIGDIISRAKLNYNPKTPKIRDAILSHTDLMGTLSTPMAPIVNTITGLKPVRKILDKALKIDHRRELPKYSFGTFRTWMKKQVEEQARFKDQVAFFHGCYANYNHPQLGKDLVKVFNKMDIGVQLLKREKCCGVALIANGFVKQAKKQATVNLESLTEKIVENNIPVVATSSTCTFTIRDEYEHILDIDTSKVRENIELATRYIYRLLEEGRELPLKHTPLKVVYHTPCHMEKMGWAAYSIDLIKRIPGVEVIVLDSQCCGIAGTYGFKSENYDVAQGIGAGLFRQIEESGCDLVITDCETCKWQIEMSTTKKCEHPISLLARAL

SEQ ID NO: 5963 - protein, 160 aa, Proteus mirabilis
PLGLNWNLKACRRFILPIILWSMKNETNIRRGRHCVFLMHVHLVFVTKYRRKIFDQDAIEKLRSYFASVCADFDVELVEMDGERDHVHLLINYPPKLAISNLVNSLKGVSSRLLRRDRPDIAQRDYYKGVLWSPSYFAGSCGGAPISIIRQYIEQQETPS

SEQ ID NO: 5964 - protein, 212 aa, Proteus mirabilis
SVQQRSTFLFKKRYDSTMNYLAHLHLAFRAKSSLLGNMMADYVKGTPSNDYSQAVIDGIRMHRRIDVLTDTHPLVKQARQLFPNEYRRVAPITLDIFWDHFLSLHWDKFEPDIPLLEFVTYVRNTIEPDLWRTPEKFQELNEYLWPQAWLTRYADKTYIAQTLKGMAKRRPRLSALAGSYIALETHYKELSEIFWQFYPQLLERAQHHQLDD

SEQ ID NO: 5965 - protein, 71 aa, Proteus mirabilis
HGKQPPLNIIKHLAEIAGFESWQQAQTYIHHTVDIISQFSSLAKEYDVSNSVRADIDKTLTNRLKENQHLL

SEQ ID NO: 5966 - protein, 445 aa, Proteus mirabilis
LIKQLQWRPMMKFDVIIIGSGLAGLTAGIRLAEAGKSCAIISNGQSALHFSSGSLDLLTYLPDGTPVSHPKQALSTLAQQAPEHPYSRIGEANVTQLIEQAQTLLSTTRNLDYKGNGDENHYRITPVGRSRMSWMSPQRVPTYSVNQPFPWKKIAVVGIEGFLDFQPQFASSTLNEQGIEAIPYHIHLPLLDRLRDNPSEFRAINIARYLDKPENTQALAEELIKHIDNSVEAIVLPACIGLDEEAPVNLLQECVGKPICLLPTLPPSLLGIRLHQALKLRFQQAGGLIMPGDRAEEADLVGNKVVGIHTRNHTDIPIRSEHVVLATGSFFNNGLIAEFDRIYEPLMELDLLESLPRNEWTQVNVFAKQPYMRFGVNTDSQLRPLKYGEALDNVYAVGALLGGFDPLNEGCGAGVSMISALYAAQQILQSDKSQHTTSAAVEAVL

SEQ ID NO: 5967 - protein, 340 aa, Proteus mirabilis
YMKQPDEITLAQGNGGQGMQQLIEGLFLKVFDNPLLNEKEDQARIALADLTAQGDRLAFSTDSYVIDPIIFPGGNIGKLSVCGTANDLSVGGAVPRYLSCGFILEEGLAFETLETLVMAMAKAAQQAGIQIVTGDTKVVPRGAADKIFINTAGIGVIPSKIDWAASHIKAGDKIIVSGTIGDHGATILNLRENLGLEADLQSDCAVLEPMIAPLRQIDGIRALRDATRGGVTAILHEFSQACGCGMNVYENKLPMKQSVRGVCELLGLEALNFANEGKIVLVVSPQAEKQVLEALHQHTLGQDACTIGEVTEERYIRLTGIFGTSRILDLPYNEPLPRIC

SEQ ID NO: 5968 - protein, 181 aa, Proteus mirabilis
IMKHIVDVMISEEEIKQRIAELGREITEHYRSRQEKHDLVLIGLLKGSFIFMADLCREIEVPHEVDFMTVSSYGNGMTSTRDVKIIKDLDEDIRGKDVLIVEDIIDSGNTLNRVKEILSLREPASIAICTLLDKPSRREVDVPVEWIGYSIEDKFVIGYGIDYAQRYRHLPYIGHVTLLDE

SEQ ID NO: 5969 - protein, 521 aa, Proteus mirabilis
SPEHSNMQRGARFFLQSLFLLLTYSLLWLSLWVISFYLSHNGQQAALFLPQGLRLALFILLWRRFWLPMLLAEWGLYYWLTQQQLITHVTLYLSPLISLLVALEVQRIWWRYPLYWQRLTLLIAAVGFNSLLQAFLLSFFLTTSTSAIFLTSITGGILLAPFVFLLYEYLRELQSRVLIAEITPEPPLRTSLLMWVFLFCLIGLSAQFFLTPEIERLLVILVFIPNVFMAYRYGWQGGVLSALLGSLMITFARQVNGAFADLHELEMFLTTQALIGIGLGIAISRQQQLANNLRHYQLRLEQELQARRALMEQLVHTEEDVKKAIARELHDEIGQNITAIQIQSMLVKRSADNDKTRQSGEQIERLAQQIHQSTRQLLRQLRPPILEEMSLEKALHHLIDEFSFHENGIHCHFHYALETEPESDTIIFTLYRLVQELLNNISKHANASEIHISLTQHQAQLRLVVHDNGIGILPTQPNNGFGLRGIEERICALGGEWEVISQLGTKIIVNLPTNSIEKREN

SEQ ID NO: 5970 - protein, 565 aa, Proteus mirabilis
LNMQKLKFLRFSKEKVSLFLAVYIGLFLNLSVYIGRYGTQNSHNSLIESLYILGEVAVNIAFTFFLLRLISFCGTLFFKIVASFILLISVCASYYISFFDVVIGYGIIISTLTTDIDLSKELISPNVIIWIIGLSILPLALTWLCKKPEKNITQQQKKKIWIKNTVKMLVIALAVFAYLKTLDSKQKAYEIKNNLDLPSYSGGLSYAYLPTNWIIPLFQYAITQYDDHFNSQNIFDPADNFTYIPSKANEDVYVVFIIGETARWDHMGLFGYERQTNPLLSQEKNLIALKGISCDTATKLSLKCMFVRENGTENNDQRTLKENNIFSVLHQLGMTSELFSMQSELWFYNKLDLDNYAMKEMMTAKNSNFGKELDDTLLINEVADSVAHYSKGNHLVILHTKGSHFMYSQRYPNAFKKYQPECLNVDDECTKEQLINAYDNSILYTDYFIDGVLNTLRDKKAIVFYTSDHGESISEKGGLHGTPKEIAPPEQFKVPFLVWMSDSYLAEPENKQLFDNLKRNQDNNRTFYHHNIFDSILGCLGYSSPDGGINNQNNLCFGDIASKAQ

SEQ ID NO: 5971 - protein, 198 aa, Proteus mirabilis
QKVHLRQQQRYLLNINRSIGMILQRLSLSTAIFAAVIAMANADPNMRFHGELIDEPCVIKPGDEIIVITLDKVTDSAFYNGVERTKSQQFEIHLSECDLSMNNKVSITFKGDENKAMAGKGFLALSPISRASGIAIGLEDSDGVLLPINQPSKNMALLSTNNTLRLSAFIQAEPTAIANQSIKRGPFSAIATFHLNYD

SEQ ID NO: 5972 - protein, 390 aa, Proteus mirabilis
RHSQGIYLCQNFKDKRASMTVSTPLSLYETALQQGDYQPDEVQRQTVLHLQQLYHALLNRTSPEKSSITQRLLGKFRAKKSTIVPERGVYMWGGVGRGKTWLMDMFYQSLPTERKLRLHFHRFMLRVQDELKGLQGQENPLDIIADGFKAQTDVLCFDEFFVSDITDAMILGTLLEALFARGITLVATSNIPPDDLYRNGLQRARFLPAIEQIKNHCEILNVDAGIDYRLRTLTQAHLFLSPLTEYNRQQMDKIFTQLASSSEVVFAPTLTINHRPMVMRKVANGVLAVNFDTLCVQARSQLDYIELSKHYHTVLLYEMVQMGSRNEDVARRFLALVDEFYERKVKLIINADVEMSEIYQGQFLRFEYQRCLSRLQEMQSEEYLSQPHLA

SEQ ID NO: 5973 - protein, 398 aa, Proteus mirabilis
RMTQKKPETSLLLSGRSKKYSQGAVNPIIQRTSSVIFDTVAQKREATQKRAEGALFYGRRGTTTHFALQEALTELEQGIGCALFPSGAAAITQSILAFIEQGCHILVTGSAYDPTQNFCDQILSKFSVTTTYFDPLIGTEISQLLRPETKIVFLESPGSITMEVQDLQGIITAVRHYNPNIIIMIDNTWAAGLLLKPLTLGADISIQSATKYIIGHSDGMLGFAVANQRCWPQLRENTYLLGQCADPDTAYMAARGLRTLAVRMKQHEQSGLEIARWLKQHPLVDNVYHPALSSCPGHTYFQRDFTGSNGLFSFSLKKILTTEEFSRFLDNLSLFKMAFSWGGFESLILGYHPNDIKAMRQYDTQPTLAGTLFRVHIGLENIDDLIEDLEQAFLRISN

SEQ ID NO: 5974 - protein, 446 aa, Proteus mirabilis
AFQQDSFPYTGKSKHTIAFLNIILSNGITMDKQQSRVLNLLFQGSLVKQILAGLIAGILLAWLAPEVAKMMSLLGNLFISALKAVAPVLVWVLVMASIANHRQGQKTSIRPILVLYLLATFFAALTAVVASFVFPSVLTLVVNNSQLSPPENIAEVLKGVLINVVANPVDALINGNYMGILAWAIGLGLALRHASDTTKALTQDFADAVTNLVRVVIRLAPIGIFGLVSSTIATTGFKALAGYFHVLLVLIGCMLFVALVVNPLIVFWKIRRNPYPLVWACLRESGVTAFFTRSSAANIPVNMAMCRRMNLNEDTYSVSIPLGATINMGGAAITITILTLAAVNTLGMPVDIPTALLLSLVAAICACGASGVAGGSLLLIPLACSMFGISNDLAMQVVAVGVMIGVLQDSAETALNSSTDVLFTATVCIAEDERLVANPLTEKNNG

SEQ ID NO: 5975 - protein, 341 aa, Proteus mirabilis
QSEHNILATMKDVARLAGVSTSTVSHVINNNRYVSEGIRAKVNHAIATLNYAPSALARSLKMNCTRTIGMLVTASNNPFYAEVVRGVERSCYEQGYSLILCNTEGDYERMDTSLETLLQKRVDGLLLMCTEARAPSSEVLNRYPRLPMVMMDWSPFEYSSDIIQDNSLLGGELATNYLIEKGFTDIACIAGPQDKLPAKHRLQGYYNAMQQAGLPIRKELVLTSDFEFAGGFSAMQTLLSLPIQPQAVFTCNDAMAVGAYQAIYQKGLRVPDDISIVGYDDIDLASYMIPPLTTIHQPKDELGKLAVSQLLRRMEDIEAQANLLVLTPKLIERGSVIAHRK

SEQ ID NO: 5976 - protein, 672 aa, Proteus mirabilis
ATRHMQEQRNKGMFGKLTLDAIPLQEPIVVVTLIGIILGGLAVVGALTYFRKWKWLWSEWLTSVDHKKIGIMYIIVAMVMMFRGFADAIMMRSQQALASAGEAGFLPPHHYDQIFTAHGVIMIFFMATPFVVGLMNLVVPLQIGARDVAFPFLNSLSFWFFVVGVLLINISLGIGEFAQTGWLAYPPLSGLEYNPGVGVDYWIWSLQISGIGTLLTGVNFFATILRMRAPGMTMMKMPVFSWAALCTNVLIIAAFPILTVTITLLTLDRYLGTHFFTNDMGGNMMMYINLVWAWGHPEVYILILPVFGVFSEVTATFSKKRLFGYTSLVGATVVITVLSFIVWLHHFFTMGSGANVNAFFGIATMIIAIPTGVKIFNWLFTMYQGRIEYKSPMLWTIGFLVTFSVGGMTGVLLAVPGANFVLHNSLFLIAHFHNVIIGGVVFGCFAGMTYWFPKAFGFTLNEKWGIRAFWFWFIGFFMAFMPLYILGFMGMTRRLSQNINPEFHPMLMVAAGGAALIALGIVCQVIQIYVSIRDRHLNRDLTGDPWGGRTLEWSISSPAPFYNFAVEPQVKARDEWWDQKEKGTAYQRPAKYEPIHMPKNTAAGVIISAFSLVFGFAMIWHIWWLAIVGFAGMIVTWIAKSFDTDVDYYVQVPEIETIENKHYEELKKAGVK

SEQ ID NO: 5977 - protein, 72 aa, Proteus mirabilis
RERQRTTHSIFIILINLKAIVLRGTMAFCFITQQMCVSSCREPAYTIGCFLSIYLCKFCYTNKLLTLLARRF

SEQ ID NO: 5978 - protein, 248 aa, Proteus mirabilis
PFIKGRIFTGVIMKFEQPLQSATLLKRYKRFLADVVTANGEEFTLHCANTGAMTGCATPGDTVWYSTSSNVKRKYPHSWELTQTQSGDWICINTLRANTIIADAIEAGDIPELSDYDEIRREVKYGSENSRIDILLKSNHKVDCYIEVKSVTLLDAGMGYFPDAKTERGQKHLRELTAIAKSGLRAILFYAVPHTGITQVSVAKEIDPKYDLLLKQACDAGVEILCYRINISEYDLTIGKQLPFISKG

SEQ ID NO: 5979 - protein, 670 aa, Proteus mirabilis
RLINANNLLLNKKGIYMTIVKNVKETTNFYLPKGIITTGTMIGWPKKSPNEITTITYTFPDHNTYREIIKNKNPLTENMRKKTLKDIYEYYRLVNIREQKKQELNTIEDKDSEASKKRIKELEEGIKKIANDIYTILDNIPIYIYSTQETIFPHQQKVIEEILQHTSDIVPIFFKKISPYTNADLKFGYYNQFVNISGTKFISGYRKGSASHPNEEGTPIKEIKPDEEHDDPGTIFIDFSSREYYKTIKQDNIDEYIENEADIYDIYYINNDKTITIARGNNELRKEYQQNKHKIGSFVYHTFIHELGHSLGLFHIWEYILNEKHKVLDSIKYSVMSYKCPDIKDADFGGLYPMTFMLVDILLLQYLYGENMTTRLENNTYGFNSNTGRAAYSLNSIEDKLVSCIWDSGGIDTLDFSLYTVNQVINLNEGCFSDIGGLRSNISIAYKTIIENAIGGKGDDTLIGNPFDNNLIGGDGNDLFYGGDGNDLFYGGSGNDVIYGELGNDVLYGDDGDDMLIDYYGANMLDGGKGNDRICVASTDRGLPGRNIILGGEGDDEIYLGTGTHRITGGQGNDAFNFFCYEGVESNSSIWDFEKNKDKITLITRDYRKIDISKMKKVDKLSGSKNEFSLNHNKPANKTIIDVSTSSNDNKSIVHIEIVGIFNHDELFAV

SEQ ID NO: 5980 - protein, 260 aa, Proteus mirabilis
YVVNLLARLGARSLSIFATFGRAGIMLFRALIGKPEFRKQWPLLMKQLYSVGVQSLLIIMVSGLFIGMVLGLQGYLVLTTFSAEASLGMMVALSLLRELGPVVTALLFAGRAGSALTAEIGLMKATEQISSLEMMAVDPLRRVVAPRFWAGFISMPLLSLIFVAVGIWGGAIVGVDWKGIDEGFFWASMQGAVEWQKDLVNCFIKSVVFAITVTWIALFNGYDAIPTSEGISRATTRTVVHSSLAVLGLDFVLTALMFGN

SEQ ID NO: 5981 - protein, 1053 aa, Proteus mirabilis
SMPKFFIDRPIFAWVIAIITMLAGLLALIKLPVAQYPTIAPPAISISAVYPGADATTVQNTVTQVIEQNMNGIDNMVYMSSTSDSAGMMNITLTFEAGTDPDIAQVQVQNKLQLAMPLLPQEVQQQGISVDKSSSSFLMVAGFISGDGSMSQDDIADYVGATIKDPLSRVTGVGETQLFGTQYAMRIWLDPDKLVKYNMTTLDVINAIKSQNNQVAAGQLGGTPPVPGQRLNVSIIAQTRLNTPEQFADILMKVNQDGSQVKLKDLGIVEMGAENYSTIARFNGLPAAGIGIKLATGANALDTATAVRAALADMEPFFPSGLEVVYPYDTTPFVKISIFEVVKTLVEAIMLVFVVMYLFLQNFRATLIPTIAVPVVLLGTFAILSAFGYSINTLTMFAMVLAIGLLVDDAIVVVENVERVMQEEGLSPKEATRKSMGQIQGALVGIALVLSAVFIPMAFFGGSTGAIYRQFSVTIVSAMVLSVFVALILTPALCATLLKPIPKGSHGVQTGFFGWFNRVFEKSSHHYTDSVSRTLRGTGRYLLIYVLLVAAMAIMFVRLPASFLPEEDQGVLLTMVQLPAGSTQEQTQDVLAQVNDYFNTKEKDVVKSVFTVSGFGFGGQGQNMGLAFVVLNDWDERKSDQDKVPAIVGRANQALSQIKEAFVYSFNIPAIVELGSAGGFEFELIDNANLGHEKLMEARNQLLGMAAQEPQMLTGVRPNGQEDTSQYRLYIDLEKAQAQGVAVSDIYSTLGTMFGGSYVNDFIDRGRVKKVYVQAESQFRMLPQDIANLYVRNNAGQMVPFSSFIDTSKDPWLYGSPRLERYNGLPAVQIQGSATPGQSSGDAMLMMEQLASKLPSGIGYEWTGMSYQERLSGNQAPALYTISLIVVFLCLAALYESWSVPFSVMLVVPLGVIGALAFTTLRGLENDVYFKVGLLTTIGLSAKNAILIVEFAKDLMEKEGKGLVEATLDSVRMRLRPILMTSLAFMLGVIPLVLSNGAGSGAQNSVGTGVFGGMIAATSLAIYFVPIFFVVIRRRFAKKNEDLEHPNYPHQTK

SEQ ID NO: 5982 - protein, 299 aa, Proteus mirabilis
MNTKIKVAIVGYGNIGRFALDAVLAAPDFELVGVVRRDSQNIPDELRNITVTNDIKRLGKVDVALLCSPTRAIKDLAKSILSLGINTVDSFDVHSDIVALKTELDEVAKKHNRVAVISAGWDPGSDSIIRTLMLAMAPKGITYTNFGPGMSMGHSVAAKAIDGVRDALSMTIPLGTGVHRRMVYVELETGANFAQVEQAIKADSYFSSDETHIKQVDSVDSLKDVGHGVQMTHKGVSGKTHNQLFEYAMHINNPALTSQFMVSAARASMKQQAGAYTVIEIPPVDFLAGDLTTLIAKLV

SEQ ID NO: 5983 - protein, 320 aa, Proteus mirabilis
FRYKLGFQRIKAMTTPRLAVLGSINVDHIMNIAQFPKPGETVIGHDYKIAFGGKGANQAVACGRSGADITFIACVGDDAIGREIIAQLKTDNIDTDAIRIIPKTPTGVAMILVNEQGENVISIVAGANSALTPSHLHQYRHIIEQADALLMQLESPLDTVFEAAKQAKAHQTKVILNPAPAQPLSDEFLSFIDIITPNETEAEILTGISVHDEVGAAKAANILHSKGIKHVLITLGSRGVWFSEQGTGMIIPGFRVEAVDTIAAGDTFNGAFVTAILEGKSAHDAIRFAHAAAAIAVTRHGAQSSVPWRDEIKSFLAERA

SEQ ID NO: 5984 - protein, 658 aa, Proteus mirabilis
PIYKGCVMVKNVLKISTLAMLVAFNVNAATVDLRIMETSDVHSNLIDFDYFKDKPTEQFGYVRTANLIKAAKAEATNAILVDNGDLIQGSPLADYQAAKGLEKGEAHPAHQLMNTMGYTVGNFGNHEFNYGLDYLKKAIAGAEFPYINANIMDAKTGKNYFTPYIIVDTPVKDRDGKEHTIKIGYIGFVPPQILIWDKANLDGKVVVNDITETAKKFVPQMKKEGADLIVAIPHSGFSSEPYKAMAENSVYYLSEVDGINAIMFGHAHGVFPSKEFEGIKGVDVAKGTVNGVPAVMPGQWGDHLGVVDMVINNDSGKWVMTQATGEARPIFDKANKKALVERDAELAQIIEKAHQGTRDFVGKHIGKASANMYSFLALVQSDPTVQIVNDAQVDYTKHFIQGDPNLDGLPVLGAAAPFKAGGRKNAPADFVEVEKGDLTFRNAADLYLYPNTLVVVKATGADVVEWLECSAGMWNQVDPNSTKPQYLINWDGFRTYNFDTISGVEYKVDLTQPAKYDVDCQVVNKDANRIKNVTYQGKPIDPKATFLIATNNYRGYGGKFAGTGESNIAFASPDENRAILASYIAKQTKENGEVATKAANNWSFLPIKTDKQLDVRFETSPSEKAANFIKDFAQYPMTFVENDDIGFAIYKIDLTEKK

SEQ ID NO: 5985 - protein, 61 aa, Proteus mirabilis
NRYNSYQHFLLLKIACGELLNICIYNMLHSVFTYFSLTIMILWLLKNLFCDCNHRNKINYR

SEQ ID NO: 5986 - protein, 1495 aa, Proteus mirabilis
GAHKLSRKQTMLYQKTAEKENCGFGLIAHIEGKASHKIVRNAIHGLARMQHRGAILSDGKTGDGCGLLLQKPTRFFQLIAEENGWHLANNYAVGMLFLSQDNAIAAQCRQIVEEELQRETLSIVGWRKVPTNTDILGSIALSSLPSIEQIFVNAPAGWRINDIERRLFVARRRIEKRITDNDFYICSLSNLVTVYKGLCMAIDLPRFFTDLADLRMESSICLFHQRFSTNTTPKWPLAQPFRYLAHNGEINTITGNRQWARARAYKFHTPLIPDLQTAAPFVNESGSDSSSLDNMLELFLNGGMDIVRAMRLLVPPAWQNNPQMDDDLRAFFDFNSMHMEPWDGPAGIVLSDGRYAACTLDRNGLRPARYVITTDNIITCASEIGIWDYQPDEVLEKGRVGPGELMVIDTYQGRILHSAETDEDLKRRHPYKLWLERNVKRLIPFEQLPEPQATGERAFDDSLLATYQKQFAYSQEELETILHVLAENGQEATGSMGDDTPFAVLSQRPRLIYDYFRQKFAQVTNPPIDPLREAHVMSLATCIGREMNVFSEAEGQAHRLSFKSPILLYSDFQQLLNQESPYYSSITLDITYQPTENNLETALHILCETAQQAVNRGAVLLVLSDRNITQARLPIPAPMAVGAVQKALVDNNLRCDANIIVETASARDPHHFAVLLGFGATAIYPYLAYESLAQRVDKKILSGTYAQVMLNYRNGINKGLYKIMSKMGISTVASYRCSQLFEAVGLHDNVVKRCFDGVDNRINGADFSDFEQDLFNLSKRAWLTRYPLDAGGLLKYTHQGEYHAYNPDVVQALQKAVNSGDYADYQHYSQLVQQRPITTLRDLLALNDTTPIAIEDVEAESELFKRFDTAAMSIGALSKEAHEALAQAMNTLGGFSNSGEGGEDPARYNTNKVSRIKQIASGRFGVTPSYLMSADVLQIKVAQGAKPGEGGQLPGDKVTPYIAQLRYAVPGVTLISPPPHHDIYSIEDLAQLIFDLKQINPRALISVKLVSEPGVGTIATGVAKAYADLITIAGYDGGTGASPLTSVKYAGSPWELGLVEAQQALVANNLRHKVRLQVDGGLKTGVDIIKAAILGAESFGFGTGPMVALGCKYLRICHLNNCAMGVATQDETLRRQHFHGLPERVINYFRFIAQETRELMAQLGVRKITDLIGRTDLLSCLEGITSKQQKLSLTGLLETASSPTGKALYCQEHNDTYDKGELNQRIVAQTITGVEQKISQTHYFSIRNTDRSVGATLSGLIAKTYGESGLSATPIKLHFTGTAGQSFGVWNAQGVELTLVGDANDYVGKGMAGGRIVISPPVGSAFKAHQTTIMGNTCLYGATGGKLYASGLAGERFAVRNSGAIAVIEGVGDNGCEYMTGGIVCILGKTGINFGAGMTGGFAYLLDEDTTLSQRINNASIELLPVANYAILAEHLRGMIAEHIRLTGSQQGERLLSQWEYWSQHFKLVKPKSSDVHALLGHPRRSVAELRVQAQ

SEQ ID NO: 5987 - protein, 540 aa, Proteus mirabilis
MNHKYKLVALAVSSVLLAGCAKNYDEANVVDVRVIALNDFHGALKAPGPNKPGGIEHMATLVKELKKDNPNNIVVAAGDMVGASPLLSSMFHDEPTIEALSLAGLEATSVGNHEFDKGMGELLRKQNGGCHPVTGCQGPTEFKGADFQYLAANVTVNETGKTLFPEYVIKEFNGIPVAFIGLTLEGTAAIVTPKGTEGLSFHNEAKTINALVPKLQAQGVQAIGVLIHEGAAQRRDGGPVNINACNGITGKVLGVVEQLDPAVDFVVTGHTHQAYNCTINGRSVTSAQSNGAMLTRIDLKLDKTTKDVVDVEARNIWVDNRKYEKDPAVTKLLEAYEKIATPLANRIIGKLEGNLTKQTNDAGESGLGQVIADAHLYTAKPKDMGGAQIALMNSGGIRADMTGGDVSYNAIYTVQPFSNVLLTQTLTGEQIKRLLEQQWDRSRPQVLAVSGNFQYTWDSKAPVGQRVIVESMRIDGKPVDMKANYRVVANEYLATGGSNFSVLKEGKDPVYSVPDVDAVVKYFAEQSPIAQPKANNITRK

SEQ ID NO: 5988 - protein, 161 aa, Proteus mirabilis
SYNNKYPLIRIKNAHHIVDFGDVMINKFNQLTNHPDLGKFVLRVSLGVLMLLHGLHKMEPGGLAGIQGMLANINLPAFIAYGTLLGEVLCPILLIIGLFTRFSAFVVAATMGVAVLMVHSGDLLALDPKTGGWAPESAGFYMFAAIAVMFLGSGRWALKKD

SEQ ID NO: 5989 - protein, 455 aa, Proteus mirabilis
PSNNDILTNLMAHRLTSRDILALGFMTFALFVGAGNIIFPPMVGLQSGEFVWTAAIGFLLTGVGLPVLTVVALAKVGGGIEALSTPIGKSMGLLLAIVAYLAVGPLFATPRTATVSFKVGIAPLVGDSDIALLIYSVIYFLIVIGISLYPGKLLDSVGRILAPIKILALAVLGLAALFWPAGTPIPATQAYQDMAFTQGFINGYLTMDTLGAMVFGIVIVNAARSRGIDNSSLLTRYTMWAGIIAGVLLTAIYLSLFKLGSASGSIIPEAKDGADILHAYVQHTFGNFGSFFLALLIFLACMVTAVGLTCACAEFFSRYLPISYRTLVLILAVFSAVVSNLGLSKLIAFSIPVLVMIYPPCIVIILMSFTLRFWHNPSRIIAPAMAISLFFGIFDAIKASDHLKHLLPDWAAKLPLSEQGLAWLIPVLVTIVVCAIYDKVAGSQHKKVIHSGINK

SEQ ID NO: 5990 - protein, 494 aa, Proteus mirabilis
STNKPYKKFFCYWFINLAIPLFIKHVKSLHFPLIIFTTLFHSFLRRFSMHQSDVADRSLFSLSWPIFIDIFLHLATLLINTYMISHVSTAYLAAMGVGNQVFDLFITIFNFISVGCSVVIAQYLGAGKRDKASQAIHISIAFNFLLGFSSAIIILFFGYNILNVMNTPEHLVQDGYNYLHILGICLIPEAISIILAACLRVYGKSKAAMYVTLIANIVTVIGNMIVLYGFFGLPQYGLVGVAWSTVVGRIIAVVLLCGLLFYGLRIKFDIRLLVIWSKNMLAKILHIGLPAAGENLVWILHYMTASAFIGLMGEVPLAAQTLYFQLSLFLMLFGIAISIGNEILVGHLVGAKRFDDAFTRGFKSLKAGVLFTIGVVIIYWFMRDPILYSITEDQRIIDQLLPLFILSVFLEPGRTFNIVMVNALRAAGDAKFPLITAVCFMWGVAIPIGYFLGIKMEMGLIGIWIGFLCDEWLRGLTNAWRWRSRKWQAKRLDI

SEQ ID NO: 5991 - protein, 674 aa, Proteus mirabilis
HRDKSCSYLAESMSYQVLARKWRPQTFNDVVGQRHVLTALANGLDHQRLHHAYLFSGTRGVGKTTIARLFAKGLNCETGITSKPCGKPCGKCANCLEIEQGRFVDLIEIDAASRTKVEDTRELLDNVQYAPARGRFKVYLIDEVHMLSRHSFNALLKTLEEPPEHVKFLLATTDPQKLPVTILSRCLQFHLRALDVDQIATQLEKVLSAEHIENDVRARQLIARAADGSMRDALSLTDQAIASGEGIVSTEVVSRMLGTIDDAQPLALIEALVKADGQQVMSLVNEVALRGTDWENFLVETLSLLHQIAMLQLLPSENNPQEQFTQERLRLLAKSVSPQDLQLYYQTLLVGRKELAYAPDRRMGVEMTLLRALAFHPKTVIDEIPTAPLAQTLPLASQPNQQRVETSAPQVRSNMATATPKVSPSPENSAALGNSPAAQLLRARQAIRGAEQETPPKKPQPATPKQAKPAASALERLAAVSEKRQQRVNEKRSSVAVEKKKKEAYQWKPQNPQAQVTEPVVSSPKEIKEVLEYEKTPELAAKIAQESQQRDEWAAEIAKMPLPKLVQQLALNAYKETVGEETIILHLRSKQKHLNSANALRTLTNALSELHGKAISLTIIEDDNLTVKTPLEWRQAIYEEKLALARQSITTDKTIQTLQHYFDAELDEESIRPV

SEQ ID NO: 5992 - protein, 61 aa, Proteus mirabilis
FNCNFLHLTEKYNLFPFFYKASRSSDVLFKFSYKLFFPSDTTNMLDCNTEKFFLRKITKIG

SEQ ID NO: 5993 - protein, 158 aa, Proteus mirabilis
FFINLSINKELLIMHESLTIALLQARESAMGFFRPVLKEHNLTEQQWRIIRVLADKRSIDFHELAQKTCILRPSLTGILIRMERDELICRLKPVSDQRKLFVSLSTNGQNLYDKIQPKIEEGYQLLEQKFSTEKLQHLSILLKELIALNPENSHSTEK

SEQ ID NO: 5994 - protein, 77 aa, Proteus mirabilis
RGVNEVIAKKNQTVISFHSIMCNAPVGHAEAHSPHKLHLPDFFVCGLTVAIIHGQAVVQAAQPIQRRVSTTIQPNSS

SEQ ID NO: 5995 - protein, 359 aa, Proteus mirabilis
PLTNKKGKNAMQVTRKQERVIRQALDHWQQSGELSAQQHQQLESTLQRLPFDWKRLSRYAFWIAIACLIIAAVNLFSDTALIHYLIELFSISEIMRVVFPALIAGMFYFWGFKRQRKEILWHYSTEFILFLGILFTAVFLWQLGELLDDGSGNIAPLLLMGCIIYAVIGFISRSSLVWLFFLLMLGNWFGAKTGYMSGWGAYWLGVNYPIRFVLFGSALLAGCYFLQHILMRRRLFFMTKIMGLFYLFIALWIMSIFGNYDPDTWYYISSVQLLPWALLFAVVAVICIYISLKTDDGMLRGFGLTFLGINLYTRFFEYFWNSLHSAIFFFILAISLIFIGRKAEKIWHAIENSRMVNKQ

SEQ ID NO: 5996 - protein, 190 aa, Proteus mirabilis
QNTNRSVLMKIKTLSIRFILGLSVSIGLTSAAFAIPDNLYFHGILVDEPCTIKPGDETVVLDFGNIPDKNLYAYKRTPSKLFQLRLSECDLSIGKSVKITFKGEENQAMAGEGFLAISPGSQASGIAVGLESENGNALPINKETDKMSLTAGDTILNFYAFIQGEPDAIANKSIKRGPFSAIATFYLNYD

SEQ ID NO: 5997 - protein, 950 aa, Proteus mirabilis
FHYKRRLRPPLNQLELLNMYRKLLIISVSLSLLGCATGNSSEHTNNALSLRPDIRHFTLDNGLNVYLLQRPQTGVEMRLLVKSGSVQEDEKQLGFAHFTEHMAFKGTTHFPGTTGFKQLESLGMKLGSHVNAATSLNSTTYKLSLPNANPTQIKTGLRILSDWAFGMTFDPVEFDKERPVIVEEWRLRQGIGFRINRQLEELRYYGSRYLDRDPIGDLDIVKHGDVKEAKRYYDTWYQPERMALVLVGNFNQGDAIADITQMFNAKNSENKGVDSPSWHRFIDNKDLLVKTIFDKEQGSRIVQFTLQRTLPAPLNSRQGQYDDLMDSLWLSILNQRFSTIVDNGLVPSVSANTQGAMLDARRSQQLMIAHPKGDDYQGTLDILFTEVQRLASQPVSQQELDNARNALLKRLSQQAAGEERYEHGYLANQITTALELEMPIQSKKQALNLSYQLINNVTPDTLKHYFAQYLTQASPRVAIIGPDSDSQVFSATKASQRWQEIRQSDPGAFTLKTHAVVLDIKPEQTGTVVTTQTLPIEKTQLWTLSNNVKVIIKNDQWLKDNIQVSLRIPGGVSLETGQSLGLVQWALNLPEVSGYGHYNARELALFSKQHQISLRPYSELLFHGLRGEAPIDELDTLLALLHLKVTAPQFNGQKLEQQKQATALGIAKTPVERIFLDHINKESYQNGERLVISPQGPWQQFTAQQLQQTNQSLLGQPADMVLVISGPINLNQAKPMIERWIATLPTRSSQRLFWADPAINPKLSSFNKTYPIASSDKSMISIQYAAKAQWSQQQLLALNLLDTVVSQRLRLNLRERAGGIYSLGFSESLTKLPSSFYTGRLNFTASPQRADELIALARKVVNDVKQAGITDKELQEAKNIWLTEYGQAKESASYWTDALAQVATDDQQYQRLLTETAIVNGISVSDVNQVARQWLGENEKIFKLTPPTKQ

SEQ ID NO: 5998 - protein, 70 aa, Proteus mirabilis
NSNNTILFINYPVLLKWGNLFLTIININPPPKNNYFNNYSHYCLIIISSNTFLQKIVVLFCIKITSMLYS

SEQ ID NO: 5999 - protein, 329 aa, Proteus mirabilis
SLNKDYMLNLINKLSFKLNNNEKYYSSTENREKLLLQQNRLLNEKSAELISEINGYKAAIDGITSRLTHLKRSIQNKKSQISNLQNQLNDLQILANEGYIPRHRYQEMIRELAENNNQLNETFGQISALEKQKLEYEQRILQRNANYYQLARTELNKIQLQISETEKQLIIETDKLAKMAIIAPISGTVMDLSVFTQGGFVKTGQTLMDIVPEDHQLVIEARLAPHLIDKVTPGLPVDLIFSAFNQNTTPKIPGEVTIISADRLIDERTTEPYYQVLINIKDYTLLADNKNKLKAGMPVDVFIKTGDRSLLNYLFKPVLDRLHTSLTEE

SEQ ID NO: 6000 - protein, 71 aa, Proteus mirabilis
RKDNMTKTDYLMRLRKCTSIETLERVIEKNKYELTDDELELFYSAADHRLAELTMNKLYDKIPASVWKFVR

SEQ ID NO: 6001 - protein, 85 aa, Proteus mirabilis
KLDNKNDTAGNTHTISPLLLANPLGSEGEANFLPYNHNTNHIFLLYRVLALEDVPQEQQEGLVHRQCLPEKPDVVCQKYNHGIVL

SEQ ID NO: 6002 - protein, 83 aa, Proteus mirabilis
TLCNEGSFCKKGLVVAKKKFCAQSLNNAGLSVSKACQLTLLSRSAFYRQPINCLKKGSVVSDAIQSVLAKSPQSRFWSAQSQI

SEQ ID NO: 6003 - protein, 364 aa, Proteus mirabilis
KWSNFMSTPFKLKPLVAGVLLTLSLSTIAQAASDKVVIAHRGASGYLPEHTLPAKALAYAQGADYLEQDLVMTKDNQLVVLHDHYLDRVTDVAERYPVRARKDGRYYAIDFTLDEIKGLKFTEGFDIVDGKKVQSYPNRFPMGKSDFRIHTFQEEIEFIQGLNKSTGQDIGIYPEIKAPWFHEQEGKDITKKVLEVLKQYGYTQKSDNVYLQSFDPNDLKRIKTELMPQMGMDLKLVQLIAYTDWNETYEKQPDGTWTNYSYDWMFKPGAMKEIATYADGIGPDYHMLVEEDSTPDKITLTGMAADARANKLTIHPFTVRVDKLPKYAKDGDQLYDIIYNQAGAEGVFTDFPDLGVKFLQKQAK

SEQ ID NO: 6004 - protein, 600 aa, Proteus mirabilis
CKGNKMNRVNDVGVFNKGIELSTKKDYLGSCYVTIAKNIKDISNTTAKPSFIKKVIHMMERFTMFFAISQTGRMGISNRDGNLNRYTETLTDLKIKVKDLKCKIDEFNNKLIKKDTVDKEKAEIATITAEYHNLNHFLSLIENENSSFKDRYSFFNYLNELQRAEAFCRNSSNTDYNRLADEFKNIIKERVERIKKEDVIKIFNEVLVRYDNETRFKNSNERILANFSSNKEKEKFLSKINFLVCVSKYNLPLMVEVEQLKEEFPVQLREIMNKILYEESIMGEILNEANIDCVYKYSLKKVQNIWIEEYINKFYGGEEIIMDKSTDDNVAYFVGDFEWDSFDGINNTNNDNMNSKRNLSEASEIIHGKLNKHVKGDEISDLTSILEQIELDKLGGKETYTLISILKEMGLGNLEWKEIYNLISILKEMELGKLEWDEIYTLISILKEMELDKLEWKEIYNLSSILKGMELGKLESKEIYNLSSILKKIELDKLEWDEIYTLISILKGLELGKLEWDEIYTLTPLLKEIERGKLIGKGIYNLTYIQEETELDEDNINKGNLKEGDIKYANIVELVEDQVFTQLNVDGFNIIDSDYAFSSE

SEQ ID NO: 6005 - protein, 71 aa, Proteus mirabilis
VALNIVVAFDLLKSVINLKKIKSMIISKRYVTKPATLYIVKKIKHLFSKSDILAERIKLKCLRNIFTGLVD

SEQ ID NO: 6006 - protein, 224 aa, Proteus mirabilis
NCINHLRFSYCRIVMSHKTADQEWLVEQLKYIAQGIGKTLSPFCEVVLHDLTDSENTIMVIENNLSGRKVGDRATELGMARIESSDFPQIVANYPNQFPDGRTAKSTSIGIKDKQGNYVAALCLNIDISMIKGLQMVLNQFSTLEEGNHIIETFSSVTEDSLKKRIDEFSATYSVTPRALKPHQRRELLLCLQDEGYLSLRKAMEITAQYLGVSRATVYNDLKE

SEQ ID NO: 6007 - protein, 61 aa, Proteus mirabilis
WLINVKFHGFLTLSGLVYKSDRYVELTKFRKKMPRHIVLGILSVKVTNVLMRKAFGFYDIR

SEQ ID NO: 6008 - protein, 595 aa, Proteus mirabilis
MTINNNKSIKTLLPALKRLLAYGKTYRKPMTLGVVMLWVAAIAEVGGPLLISYFIDAKVATHQVEWRGALGLAAAFILLQIIAALLHYYQTIVFNYAAVGVVQQLRADVMSAALKQPLSAFDNQPVGQLISRVTNDTETIKDLFVNVFPALFRAIALVVVMLIAMFLLEWQMALVAMTIFPAVIGVMMLYQRLSTPIVRNVRHYLANINDGFHEVINGMSVIQQFRQQARFGKKMSDDSWQHYQARMKALKLDGLLLRPLLSMLSALVLCGLLILFGYQGSAVIGVGVIYAFISYLGRLNEPLITLTSQQSLLQQAVVSGERVFELMDAPMQQYGNASYTINQGDIAINGLWFAYLKQQWVLKEINLDIPARHFVAFVGHTGSGKSTLASLLMGNYPWQKGHIYLDNHPLECYSHQALRSGIAMVQQDPVLLSGTLRDNITLGRHCSEAHLWQVLATVQLNSWVKTLPDGLETPLGEQGSRLSAGQKQLLALARVLLFPPRILILDEATANIDSGTEQAVQKALTEIREKTTLIVIAHRLSTIIDADEIVVLHRGEIVEQGKHAQLLAQKGRYYNMYQLQQVKESLQVQEPAVVE

SEQ ID NO: 6009 - protein, 533 aa, Proteus mirabilis
FYSKEYIMQRREFLKLGATLSAVTLLPSWSRLAFAQTNTPSLAIPPQISPDKQQKIVLNIQQGVSQFTATASTTTWGYNGSLLGPALKLKRGEPVTIEINNTLPETTTVHWHGLEISGEQDGGPQATIAPGKSRTVTFTPDQAESTCWFHPHTHGITGKQVAMGLGGLVIIEDDETAKRKLPHRWGVDDLPVILQDKRLDSNGQIDYQLDVMSAAVGWFGDMMLTNGAIQPQHIVPKGWIRLRFLNGCNARSLNLATSDGRPMYVIASDGGLLAEPVKVTELPILMGERFEVLVDTSDGRDFDIVTLPVRQMGMVLAPFDNVLPVLRLLPSAEKAVGILPDQLALIPALPSLSHIATRSLHLRMDMRLDMQGMMALTERYGDKALAGIHHGMSHMRQGNGNGMMGGGMNCGHGSADVDIYNANSINGIPFSMTEPAFDVKQGVYERWLVSGRGDMMLHPFHVHGTQFRILSENGRKPEKHRQGWKDIVRVEGQISEILVKFDHLATKEHPFMAHCHLLEHEDTGMMAGFTVSR

SEQ ID NO: 6010 - protein, 617 aa, Proteus mirabilis
TRSNWEYIMKMHNIQWHYRFSIINQIAILMLLFTLFGVVGMAISNHIILSVQGNAHAINKSGSLRMQSYRLLSALPLDDKHRDYLQELENDLDSKELRQVLSTSSLQSQYVQLTHYWKETLKPTLSAAKQPNDAKQEVIFFVSQLDTLVSSIDQLTEQKIRLVAYTQLIFTALTLLLLFGSVWHFRRRLLLPWQQLMSMANSIGHGDFSTRFRPRPHHDEIATLGIALNTMSEELSTLYSELEQRVIEKTHDLQQKNKVLSYLYHSSQQLHSQAPLCARLRQILAELQHIIPDSYLQIRLYEDNQHTLFNEISLAPSSRPEYCPTPDCERCNEDANITTPLNNRLLHWELTDQIHRYGLFVMQLPENSVLTDEQNNLMLLLTKQISAMLAMEQQNEQQQQLLLMDERSAIARELHDSIAQSLSCLKMQVSYLQMQSETLPDNCQKLLKEMREELNVAYRQLRELLTTFRLKLTEPGLLAALENTLNEFNQRLGFAIHFDYQLPAKCVNSHQSIHVVQIVREALNNILQHANANWAEVALTLNNGIVELQINDNGEGITPNPEKINHYGLIIMRERANSLNGSYSIRVRKEGGTQVFVTFPLITTHKDPIEKGANHNE

SEQ ID NO: 6011 - protein, 272 aa, Proteus mirabilis
RSPNLLLLNVSMVVKRLHKTSRIRRKRMADDMKHVKMEVMRYNPETDDAPHFVTYDVPYDEQTSLLDALGYIKDNLAPDLSYRWSCRMAICGSCGMMVNRVPKLACKTFMRDYPNGVRIEALGNFPVERDLVVDMTHFIESLEAIKPYILGNDRKPSEGPNKQTPAQMAKYHQFSGCINCGLCYAACPQFGLNPEFIGPAAITLAQRYNTDSRDHGAKERMPQLNGENGVWSCTFVGYCSEVCPKHVDPAAAIQQGKAASAQDFVIAMLKPR

SEQ ID NO: 6012 - protein, 613 aa, Proteus mirabilis
LMAKEKKGFFSWLGFGRNKEENTAQEKEQQRLEAERAEQARLAEEEAQRQAQLEAEQVRLAEEEAQRQAQLEAEQARQEAQRAEAERLAAERAEQARLAEEEAQRQAQLEAEQARQEAQRAEAERLAAERAEQARLAEEEAQRQAQLEAEQARQEAQRAEAEKLAAERAQQARLAEEEAQRQAQLEAEQARQEAQRAEAEKLAAERAEQARLAEEEAQRQAQLEAEQARQEAQRAEAERLAAERAEQARLAEEEAQRQAQLEAEQARQEAEAEEKARIAQAQAEAEDIVALREEVLVDKPVEQERPKKEGFFSRLKKGLLKTRQNLGSGFMGLFRGKKIDDELFEELEEQLLIADVGMDTTSKIINSLTQHASRKDLKDAESLYGKLREEMGDILNKVDKPLNIEGKKPFVILMVGVNGVGKTTTIGKLARQYQAEGKSVMLAAGDTFRAAAVEQLQVWGERNHIPVIAQHTGADPASVIFDAIQSAQAKGVDVLIADTAGRLQNKSHLMEELKKIVRVMKKLDEEAPHEVMLTLDASTGQNAVSQAKLFNETVGLTGLTLTKLDGTAKGGVIFSIADQFGIPIRYIGVGEGIEDLRPFKADDFIEALFAREE

SEQ ID NO: 6013 - protein, 659 aa, Proteus mirabilis
IAQKVMKLDPTRATPSVINNDGLNYVPTNRYVLFGHHFAAIAGAGPLVGPVLAAQMGYLPGTLRLLAGVVLAGAVQDFMVLFISTRRNGNSLGEMIKKEMGPVPGTIALFGCFLIMIIILAVLALIVVKALAESPWGVFTVCSTVPIALFMGIYMRYIRPGRVGEVSVIGIVLLIAAIWFGGVIASDPYWGPALTFKDTTITFGLIGYAFISALLPVWLILAPRDYLATFLKIGVIVGLAIGIVILNPELKMPAMTQYIDGTGPLWKGALFPFLFITIACGAVSGFHALIASGTTPKLIANEMDARFIGYGAMLMESFVAIMALVAASIIEPGLYFAMNTPPAGLGITMPNLHELGGENTAMIMDQLKDVTVHAAATVSSWGFVISPDEILQTAKDIGEPSVLNRAGGAPTLAVGIAMVFHKILPAADMGFWYHFGILFEALFILTALDAGTRSGRFMLQDLLGNFIPYLKKTDSFIAGVIGTAGCVGLWGYLLYQGVVDPLGGVKSLWPLFGISNQMLAAVALVLGTVILIKMKRTKYIWVTVIPAVWLLICTTWALGLKLLSNDPQMEGFFYLANEYKAKILAGGADLTAAEITNMNHIVINNYTNAGLSILFLVVVYSIIFYGIRTAMKARKNPKESAQETPYVPMPKDVKISSGH

SEQ ID NO: 6014 - protein, 214 aa, Proteus mirabilis
PNKNMINVALIDDHIVVRSGFAQLLMLEPDINIVGEYANGQEAWPYLLNDNIDVAVMDLSMPGESGLQLQSRLKQKRPDFRTIILSIYDTPAFVQSALDSGAHGYLTKRCGPQELVQAVRAVYQGGCYLCADAMKALRQTPEKEDALHSLTPREREIFNLLVQGINVKAIAVQLNLSHKTVHVHRANILGKLNCETTIDLVHFALNNQLITGTL

SEQ ID NO: 6015 - protein, 62 aa, Proteus mirabilis
NCKKNTKSISICKICLFFIYSKNHNLNFTFFIFSIRTLNFIKKNKQIKNMPHSFCLYKNRYI

SEQ ID NO: 6016 - protein, 103 aa, Proteus mirabilis
IIKNRNKKYFDIYPRIRNGDITGGREGRILSLMGRDNAIKEQYKRVVNGVDTVSQQHQPLTSNTLIMWYHHFSIPFLGTSANLSANRSPSSGKQSSGAKSANG

SEQ ID NO: 6017 - protein, 150 aa, Proteus mirabilis
KVKKQGLISANCSTVDSIGNRYQTVHKDQIQVLSLNYTISRMQNSVHHPVLFIKPIDKSSPLLGVAISNNELLDANFDFFRINQFGILEKYFEIKLSNATIVDFTQSSPESSNGYSIVSHEKILLRYESISWNHICAGTSGYSINEQNII

SEQ ID NO: 6018 - protein, 153 aa, Proteus mirabilis
STKKESIMQGIKRKIVYVTAYEVFGWVISSVGLALLADSSTAVTGPLALIITTIAVSWNFIYNCLFEFWESRQKSRIRTFRRRLAHAVGFQLTLVVYLIPLIAWWLGVSLWQALVMDFALIIIIPCYTFVYNWVFDKIFGLPKSALPEDVPVA

SEQ ID NO: 6019 - protein, 102 aa, Proteus mirabilis
MRKNSMSASLNWQKEGEILSFQGTLDRETLLPVWQQRKALLADINIIDISQLDHIDSTGLALFVHLKAEMEALERQCVIQGVSERFQTLITLYDLDEIMNIA

SEQ ID NO: 6020 - protein, 328 aa, Proteus mirabilis
IMKKMVLATVLASLFFSSVAMSEDKTAFSLPAIEKSAEEGNAASQYQLGVKYEGGEGVEQNTQKALEWYTKAAEQGHAEAQLNLALMYDMNDDIERDAEKAVYWYNKAAVQGLSLAQYNLAVSFDEGDGVEQDHEKAVYWYTKAGEQGDSDAQYNLAISYDEGIGIEQDHEKAVTWYTKAAEQGHADAQYNLAVSYDEGEGVERDGSKAVFWYTKAANQGNRDAQNNLGVMYDEGDGVAKDQRKANEWYKKAALQGNGLAQNNLAINYYYGKGVKRNLKEAYAWFAVAVENGEGDEAMLKRTARALNAAQLAEAKLLAASYIAKYLDD

SEQ ID NO: 6021 - protein, 212 aa, Proteus mirabilis
RTEKSRCEIMSTQTLNNANAHEHHGHHDAGATKVFGFWIYLMSDLILFASLFATYAVLVNGIADGPSGKEIFSLPFVLVETFLLLFSSITFGFAMLSMNKGSVSQVNLWLFVTFLFGLGFVVMEVYEFHELIAEGYGPDRSAFLSAFFALVSTHGLHVTAGLVWIIIMMIQVSRRGLTDVNRTRLSCLSLFWHFLDVVWICVFTVVYLMGAM

SEQ ID NO: 6022 - protein, 280 aa, Proteus mirabilis
RREKMRFLNTFALLLSLILTPCYVIAATPAQRVITLSPSATEMAYAAGMGENMVAASAYSDYPQAAKDLVQVADWQGINVERILLLKPDLIIAWPSGNPQRPLDQLKSLGIPIIYSDPHSIEEIIDDLTRLSSYSTHPEVALASAQKLRQQYQELQQKYASTTPHQAKKKVFIQFGMQPLFTTSKHSLQNEITELCGGENIFANSAVPWPQVSREQVISKKPDLILFSGKPNQIAAIQQFWQPQLDIPIIAIDEDSFSRPAPRIIYAAQQICEAIAIHSF

SEQ ID NO: 6023 - protein, 197 aa, Proteus mirabilis
GDRNRPRKLIGIFMKQQINKNSLVSILVLLSFFITTNVTAVTPVLSSTGLSQNSPITPIYPIPINIKGYVIAHPPCMINEGKTVEVNFGDVLSTRVDGLNYKRLVDYHPSCEQMPINTLKLSVEGNGTFFDANALMTNITGLGIRILYQNKPLKLGQAINFTYPDFPVLEAVPVRDFSTLLVGGDFSTTATLRMEYQ

SEQ ID NO: 6024 - protein, 347 aa, Proteus mirabilis
KVLNMKLKTLSTLVAAGLALSTVSLSTSAAGRLVVYCSATNAMCEAETKAFAEKYDVKTTFVRNGSGSTLAKIEAEKRNPQADVWYGGTMDPHSQAGEMDLLEPYVSANLDQIMPQFRDPAKRKGNYSSAVYVGILGFGVNKDRLKEKGLPIPTCWKDLVKPEYKGEIQIADPQSSGTAYTALATFDQLWGTEQAFDYLKKLNTNISQYTKSGIAPARNAARGEAAIGIGFLHDYSLEVENGAPLELISPCEGTGYEIGGVSIIKNARNMDNAKLFVDWTLSKEAQEISWKEGKSYQILTNTTAESSPMALKLSDLKLINYDMDKYGDSDVRKELINKWVTEVKMGK

SEQ ID NO: 6025 - protein, 299 aa, Proteus mirabilis
ILLNLISKFMIYTRNLFVNHGERSMTYSREVLLKKFNDMIARKEPIIGGGAGTGLSAKCEEAGGIDLIVIYNSGRYRMAGRGSLAGLLAYGNANEIVMDMAKEVLPVVKQTPVLAGVNGTDPFCNFDKFLDDVKAIGFAGVQNFPTVGLIDGNFRANLEETGMGYALEVEMIRKAHEKGLLTTPYVFSREDAIAMTQAGADIIVPHMGLTTGGNIGAETAVTLDDCVALINDWAKAAKSVRSDVIVLCHGGPIATPKDAQYILDNCPDCHGFYGASSMERLPTEVALTATTKEFKNIKR

SEQ ID NO: 6026 - protein, 550 aa, Proteus mirabilis
GIMNIAMTERYKWLLFFLFILLTYFIPLETRLLWQPDEIRYAEISREMLVSGNWSVPYLLDIRYFEKPVLGYWINCIAQWLFGESHFAVRIVVVTSTLLTGWLIYKAAMVVWRNSALAFNAMTVFLSSFLVLAIGTYNILDPIVTLFVTAAMYSFLVALSTPNKKGKIIAYMGIGFFCALGFLTKGFIAVVLPALVFLVMAISQARFKEVVCYSSIALLALAITAGPWVITVALQAPDYWNYFFWVEHVQRFIAKESARSQPTWFYIPIVILGVLPWLGFLFGALKSAFSLKKGTLYFLLWFALFFAFFSASKGKLLTYMLPCFVPLSILIAHYIEELKDRPDEKISKLNASINIAFGLMGISAVIYSLYSAKFALYDTNETLKIVLAISGFLFWSVIGAGALFRQTQFLTMFCSIGLSLVIGYAIPEKIESRSTPENIIQRYYEPLSNKSYLLTDEVGIGTSLAWGLKRTDIRLTETKGELAYGLNYPDVKNKYYSLEQLLALIEANQYKGVAIVLVRPDRKQILTKLTTLKEKPIVEKEGDLTLVFFN

SEQ ID NO: 6027 - protein, 193 aa, Proteus mirabilis
VNMNEEISYLFVPANKKVMISKALTYGANAIILDLEDAVHPDEKPLGRDNIQNWLTTINNTIINTSIYIRINHPKEKEFKNDVDLLNSLNETLMTGVMIPKLEDAEILSYIKSKLHLAISKRPFIGIIETARGVHHCEEIANSGVTRLAFGSLDYSLDIDCQQTAEALLYARSRIVIASRIANLISPIDCVTP

SEQ ID NO: 6028 - protein, 252 aa, Proteus mirabilis
LIMKIKLLATVMVSAALLSGCKNLDTSMLAQSGTQLFQAATLSDDDVKALTNDACKEMDAKNKIAPANSNYTKRLNNIAKALGNEVNGTPVNYKVYLTKDVNAWAMANGCVRVYSGLMDIMTDNEVEGVLGHEMGHVALGHTRKAIQVAHATVAARTAASSAGGVAAQLSSSQLAEMGEKLVNAQFSQHQETQADNFSYDLLKKRGVNTSGLVTGFEKLAKLGGSDSSMFDSHPPSKERADNIRNRIAEDKK

SEQ ID NO: 6029 - protein, 569 aa, Proteus mirabilis
EKMKTISRQAYADMFGPTTGDRLRLADTELFLEIEKDFTTYGEEVKFGGGKVIRDGMGQSQVVSAECVDVLITNAIILDYWGIVKADIGIKDGRIVGIGKAGNPDVQPNVDIVIGPGTEVVAGEGKIVTAGGIDTHIHFICPQQAQEGLVSGVTTFIGGGTGPVAGTNATTVTPGIWNMYRMLEAVDELPINVGLFGKGCVSQPEAIREQITAGAIGLKIHEDWGATPMAIHNCLNVADEMDVQVAIHSDTLNEGGFYEETVKAIAGRVIHVFHTEGAGGGHAPDVIKSVGEPNILPASTNPTMPYTINTVDEHLDMLMVCHHLDPSIPEDVAFAESRIRRETIAAEDILHDMGAISVMSSDSQAMGRVGEVILRTWQCAHKMKLQRGTLAGDSADNDNNRIKRYIAKYTINPALAHGIAHTVGSIEKGKLADIVLWDPAFFGVKPALIIKGGMVAYAPMGDINAAIPTPQPVHYRPMYACLGKAKYQTSMIFMSKAGIEAGVPEKLGLKSLIGRVEGCRHITKASMIHNNYVPHIELDPQTYIVKADGVPLVCEPATELPMAQRYFLF

SEQ ID NO: 6030 - protein, 148 aa, Proteus mirabilis
KLMNTGAMLMKKVITVCPYCASGCKIYLKVENGKIIGAEGANGLTNQGELCLKGYYGWDFIHDTKILTPRLKTPMIRRERGGKLEAVSWDEAIEFASSKLLAIKEKYGAKAIMTTGSSRGPGNEANFVMQKFARAVIGNNNIDCCARV

SEQ ID NO: 6031 - protein, 62 aa, Proteus mirabilis
LKPNLLGGHSAVVPPDPMPNSEVKRRSADGSVGSPHVRVGNCQALNKTRKPTRWVGFFAFEN

SEQ ID NO: 6032 - protein, 172 aa, Proteus mirabilis
LMKKTLCSTGLRWLWLAIAVVVLDLGTKQYFMQTFRLYESVVVMPFFNFTYAHNYGAAFSFLAAKGGWQRWFFALIALAICIVLVVMMYKNKASAKLSNIAYALIIGGALGNLSDRLIHGFVIDFLDFYVGDWHWPTFNIADVSICLGAGLIIIESFFPDKNASPQEANKQK

SEQ ID NO: 6033 - protein, 440 aa, Proteus mirabilis
IKRKFCMSIKSFSTLAIAIALFTSPTYAKTEIEWWHAMGGALGQKVNQIASDFNASQSEYVIKPVYKGTYPETMTSAVAAFRAKNQPAIVQVFEVGTASMMGAKKAVFPVYQLMEKTNEPFDPNSYLSTVTAYYTTSDGKMISLPFNSSTPVLYYNKALFKQAGIEQPPKTWKEMGAVSQKLLDAGVKCGFTTTWQSWTQIENFGARNNLPIATKNNGFDGTDTSFLFNQAPFVAHIQRMADWSKSGIFKYGGRQSDAMPLFYTQECAMVMESSAGFAGIKENMKGIDIGVSQLPYDDTLVDKPANSIIGGASLWVMAGRPDAEYNGVAKFFTYLSSPEVQADWHQATGYLPVTKAAYALTQQQGFYQQNPGADTAILQMTTSDSTANSKGLRFGNFLQTREIVDEELEKVWSGKQSAQAALDNAVKRGNEQLRRFERTQ

SEQ ID NO: 6034 - protein, 211 aa, Proteus mirabilis
NRRKAIMTISALICLANGSEETEVVTTADLLVRAGIKVILASAEDDVDDLVITCSRGIKLIADVPLVRVVDHHYDAIILPGGLIGAETLRDSPLVVEKVRRMHSENRLVAAICAAPAIILESHNLFPIGNMTGFPGLKDKIEPKKWVDYRVYFDERVNLITSQAPATTIDFALKIIERLKGKAVAADVAKQLVLPPGIYNYQDEFTGFGDR

SEQ ID NO: 6035 - protein, 413 aa, Proteus mirabilis
VLGKNMSWSEFKSQYLIRFWKPLPAVIAAGILSTYYFGLTGTFWAVTGEFTRWGGHVMQWFGAHPEEWGYFKIIGLEGTPLTRIDGVMIIGMFGGCIMAALWANNVKLRHPQHKVRILQAVLGGIIAGFGARLAMGCNLAAFFTGIPQFSLHAWFFAVATAIGSYFGAKLSLMPLFRIPVKLQKVSKASPITQDKQRAKRRFRLGMVIFFAMIAWSLIILFDSPKLGFAMLGGIGFGILIERAQICFTSAFRDLWITGRTHMAKAIIIGMAVSAVGIFSYVQLGAAPKIMWAGPNAVIGGLLFGFGIVLAGGCETGWMYRAVEGQIHFWWVGLGNVIGSTILAYYWDDFSAVLATDYDKINLLDTFGPVGGLAITYLLLGLSFILLLWWEKHFFRKRAQQAQALSTQINKEIA

SEQ ID NO: 6036 - protein, 142 aa, Proteus mirabilis
LKGNFVKPAARRRARECAVQAIYSWQLSGNDIADVELEFLSEQDTQGVDIAYFRELLVGVAINAARLDKAMEPYLSRQLEELGQVEKAILRLAMFELSFREDVPYKVAINEAIELAKVFGADDSHKFVNGVLDKAAPTVRKK

SEQ ID NO: 6037 - protein, 65 aa, Proteus mirabilis
TVYLFSEQKTPCQSLTGRVFAMFMSEKRSIKVRVLSDLHPLFPLFEQSGVRVSCPFSVLMQKPHK

SEQ ID NO: 6038 - protein, 64 aa, Proteus mirabilis
NAHLNKRNGVSYKSVLITIKRIDKNQIISFIKGILATLLQWYDRQNSHPYLLRKRQNYLIETLS

SEQ ID NO: 6039 - protein, 199 aa, Proteus mirabilis
FEVDMNELRIGLVSVSDRASSGVYEDKGLPALEAWLKKAITTPFHIESRLIPDEQLMIEQTLCELVDEAGCHLVLTTGGTGPARRDVTPDATLAIADREMPGFGEQMRQISLKFVPTAILSRQVGVIRNQALILNLPGQPKAIAETLEGLKDSEGQVIVSGIFASVPYCIQLLDGPYIETNEEIVVAFRPKSARRSTSA

SEQ ID NO: 6040 - protein, 173 aa, Proteus mirabilis
KMSDEKQANPLFRDAMASLGAAVNIVATNGDAGCCGLTATAVCSVTDTPPTVMICINSKSQMNSTFQENGKLSINILNHEQEEMACHFAGMTGLAMADRFTQPGWQYGALQQPILTNALASLEGDIYDVRQVGTHFVYMAEIKNIAVREDGDGLIYFKRRFHPVKHKLVPTTA

SEQ ID NO: 6041 - protein, 131 aa, Proteus mirabilis
AMADNQYYGTGRRKSSSARVFIKPGSGNIVINKRSLEVYFGRETARMVVRQPLELVDMLGKLDLYITVKGGGISGQAGAIRHGITRALMEYDETLRSDLRKAGFVTRDARSVERKKVGLRKARRRPQFSKR

SEQ ID NO: 6042 - protein, 425 aa, Proteus mirabilis
NNYDKRGPVMATQDPVNTTSPSFIKNRRSSLIAAIFLMATSAIGPGFITQTATFTATMGAAFAFGILASIVIDFVVQQSIWRVITVTNMRASDIANKAIPGSGYLLAVLVIFGGLVFNVGNIAGAGLGLNAMVGLDPKWGGVLSALLAIYIFSSRKASHFIDRMIIVLGIVMILLTLFVMFASNPPIGEALKQTVLPNTINFATITTIVGGTVGGYICYAGAHRLLDKGTTGIENIDAVSSAATKGILVVGLMRYILFLAILGVVASGVTLDISSHAANPASQAFQHAAGLTGLRIFGLILWAAALTSVIGAAYTSMSFITVFKKGITERQRNIATIIFIAISLAIYMVMGTAPAALLVFAGGFNGLILPIGMTLFIFVAWRRQDLMNGYKYPMWLQWSAILVCALTWYMGIMSVGAIFNYLNIA

SEQ ID NO: 6043 - protein, 824 aa, Proteus mirabilis
CYNEPQRKLISYGACVHLLPIFEVAGSVVTALKQCPQVLLHAPTGAGKSTALPLYLLQQNIFDGKIILLEPRRIAAKSIAYRLASQLNEEVGKTVGYRMRAESKVSQQTRLEVITEGVLTRMLQQDPELTGVSLVILDEFHERSLQADLALALLLDVQSGLRDDLRLLVMSATLDNQKLTSLLPDAPMISSEGRSYPVSRHYYPIQSHLPFEQEVATMARRLLTQETGSLLVFLPGSAEIIRVAQLLADKVDKHTLIFPLYGALSLAQQQQAIEPVEKGYRKVVLATNIAETSLTIEGIRLVLDSTIEKRAQFDLKSGVTSLLRQRISQASQTQRAGRAGRLEAGICWHLISQEQAERGATHQVPEILSSDLSSLWLSILQWGCRDINQLSWLDTPTPAAINAAKTLLQRLGAIDNQGGLTSRGVRMAQWGIDPRLAAILDYASEKSEHHLATAARLCAILEQPPRDREINLEWLIQQKNHQWSQREKQLLQQCKGQCRPELLASLLSVGFADRIAKNRDNQGRFRLANGQGAMMDNTQPMSQSPWILAPLLLQNAHYADVRILLALPIDINEVSSIFPELIQDNTTVEWDEKRGTLLAWQQRQLGQLTVSQMPLDKPNKAQMQTALLNWLRKQGLSALPLSEESKQLFIRLALAQKWCPEANLPVLNEAVLLDSLELWLQPELGDTQSLKALLQMDINGIIKNQLTWHEQQLLQELFPTHYIAPTGTKVMIKYDLDNPPIIAIRIQEVYGEKQSPIVAKGQLPVVMELLSPAMRPIQKTQDLATFWAGSYTQVQKEMKGRYPKHLWPDSPATTAPTRRVKKWS

SEQ ID NO: 6044 - protein, 457 aa, Proteus mirabilis
SMNDNKMTPLERKATWGLGAVFSLRMLGMFMVLPVLTTYGLQLQHATESLIGLAIGIYGLTQAIFQIPFGFFSDKFGRKSMIVFGLIIFIVGSLIAALSDSIYGIIIGRALQGAGAISAAVMALLSDLTREQNRTKAMAFIGISFGITFALALVLGPILTHIFGLQGLFWGIALLAFGGIMITLITVPNSEHHILNRESSFVRGSVKKVLFDAQLLKLNVGIFSLHTLLMAAFVALPLIMHNAGLVNEKHWVVYLVTMLIAFISVLPFIIYAEKKRKMKQVFLLCIFLLIIAQAIFMISGTSLWLIILGIQIFFIGFNIMEALLPSLISKEAPAGYKGTAMGIYSTSQFLGVALGGILGGWLYQHYDAQAVFAGCLLIGLVWFAISLTLRQPPYVSSLRIELPAHLSNAQQQQLEQKFKQQPGVNEVVIMAQEQSAYIKVDTKQTPRATLESLVLGV

SEQ ID NO: 6045 - protein, 144 aa, Proteus mirabilis
AQCEFITIIGMSVMNKAGMLGIAVLIIIIASATYRFFEQRKQRISDDNSPVKLYMVEVVDKQQIPKNDRRSRENDINGPETTYYYQVTFRLTTDSQQDIILRVDKTTFSNVALEMKGRLFMQGSRFVQFETDAPDNESSKTSAK

SEQ ID NO: 6046 - protein, 115 aa, Proteus mirabilis
TMSDDMALPLQFTDAAANKVKDLIADEENPNLRLRVYITGGGCSGFQYGFTFDDAMNEGDMTIEKQGVALVIDPMSLQYLVGGCVDYTEGLEGSRFIVTNPNAKSTCGCGSSFSI

SEQ ID NO: 6047 - protein, 1080 aa, Proteus mirabilis
IRSEKMAKRTDIKTILILGAGPIVIGQACEFDYSGAQACKALREEGYRVVLVNSNPATIMTDPEMADATYIEPIHWQVVRKIIEKERPDAILPTMGGQTALNCALELERQGVLAEFGVTMIGATADAIDKAEDRQRFDKAMKKIGLDTARSGIAHTMDEAFAVADQVGFPCIIRPSFTMGGTGGGIAYNREEFEEICTRGLDLSPTNELLIDESLIGWKEYEMEVVRDKNDNCIIVCSIENFDAMGIHTGDSITVAPAQTLTDKEYQIMRNASMAVLREIGVETGGSNVQFAVDPKTGRLIVIEMNPRVSRSSALASKATGFPIAKVAAKLAVGYTLDELMNDITGGRTPASFEPSIDYVVTKIPRFNFEKFAGTNDRLTTQMKSVGEVMAIGRTQQESMQKALRGLEVGATGFDPKVNLDDPEALTKIRRELKEAGSDRIWYIADAFRAGMSVDGVFNLTNIDRWFLVQIEEIVRLEEQVAQLGLAGLNADFLRQLKRKGFADARLANILNVKEQTIRQLREQYQLHPVYKRVDTCAAEFATDTAYMYSTYEEECESDPNQDKPKVMVLGGGPNRIGQGIEFDYCCVHAALALREDGYETIMVNCNPETVSTDYDTSDRLYFEPVTLEDVLEIVRIEKPQGVIVQYGGQTPLKLARALEAEGVPVIGTSPDAIDKAEDRERFQKAVDKLGLKQPENATVTTLEEAVDKAKSIGYPLVVRPSYVLGGRAMEIVYDEIDLRRYFQTAVSVSNDAPVLLDRFLDDAIEVDVDAICDGQQVVIGGIMEHIEQAGVHSGDSACSLPAYTLSQDIQDIMRKQVRELAFELGVKGLMNVQFAVKGNDVYLIEVNPRAARTVPFVSKATGVPLAKVAARVMIGQSLEQQGVTKEVIPPYYSVKEVVLPFNKFSGVDPILGPEMRSTGEVMGVGATFAQAFAKAMLGSNSTMKKKGRALLSVREGDKKRVVDLATKLLKNGFELDATHGTAIVLGEAGINPRLVNKVHEGRPHIQDRIKNGEYDYIVNTTAGRQAIEDSKLIRRSALQYKVHYDTTLNGGFATTLSLSADPTIDVISVQEMHAKIKKS

SEQ ID NO: 6048 - protein, 177 aa, Proteus mirabilis
PLTEVVMALSQHPEKMKKGVIENWHPEDKAFWEKTGQKIASRNLWISVPCLLLSFCVWMLFSAVAVNLNKVGFNFTTDQLFMLTALPSVSGALLRVPYSFVIPIFGGRRWTAISTVFLIIPCLWLGFAVQDLTTSYSTFIVISLLCGFAGANFASSMANISFFFPKAHQGGALGLNG

SEQ ID NO: 6049 - protein, 380 aa, Proteus mirabilis
VKYELDKTDGHARRGRLKFERGVVETPAFMPVGTYGTVKGMTPEEVEATGAQILLGNTFHLWLRPGQEIMKLHGDLHDFMQWKGPILTDSGGFQVFSLGAMRKIKEEGVHFRNPINGEKIFLSPEKSMEIQYDLGSDIVMIFDECTPYPSDWDYAKNSMEMSLRWAKRSRQRFDELNNKNALFGIIQGGVYEDLRDISVKGLVEIGFDGYAVGGLAVGEPKEDMHRILEHVCPQIPADKPRYLMGVGKPEDLVEGVRRGIDMFDCVMPTRNARNGHLFVTNGVIKIRNAKHRSDTSTLDEHCDCYTCKNYSRAYLHHLDRCNEILGARLNTIHNLRYYQRLMAEIRQAIDESRFEDFVHEFYERIGKPVPPLNSSASKCD

SEQ ID NO: 6050 - protein, 121 aa, Proteus mirabilis
AMDEYSPEKIDLAELSFLCEELLQQALSSLDKGTAVWNNDLSSTKSVDLNALIDHIMGFSWLFKIKYPDKHAINTLMEECIEETYRLFGSDSISYSELNNWKELNYSLLTLIDKNPKSYIK

SEQ ID NO: 6051 - protein, 547 aa, Proteus mirabilis
KQRLMLLQQPLDPLLAIKGRRILRFLPVNLSHILVELTSLKETLAFYEAIKQANIAEIEDIVPAAKTLLIQYVPWLITAKELVAILRNIEIKAIAMRQSHLLTIPVHYQGEDLHEVAELLGITATEVIRRHTEQTYQVAFTGFAPGFAYLIADKTELYVPRRKTPRTRIPAGSVGLAGEFSGVYPQQSPGGWQLIGTTEIKMWDLSREQPAFLLPGDAVQFVDVQKAPVTVSLPEKKQSINALSFNKDKGLCVISAGLQTLFQDEGRLGAASMGVSASGALDKCALHAANRLVGNPPSLAALEITQGGLILKAQQDCVIALSGADCTISLKQTTGDIAFFSTYQTIDIRSGDEITVGIPTAGVRSYLAVRGGFELSPVLGSYAFDTLAQIGPRALQNGDILHLNDDNALTGIISQEQPSFSLPKQEDIVTLDIVLGPRTDWFTEDAIKTLTSQLWQVTPQSNRIGLRLLGDKSLERQQQQELSSEGTCIGAIQVPINGQPVLFLHDHPLTGGYPVIGAVAEYHLSLAGQIPINAKIRFNPITLFQEY

SEQ ID NO: 6052 - protein, 231 aa, Proteus mirabilis
WHCDHQRRCMMLADLRLYQLVSPSLPVGAFTYSQGLEWAIEKGWVCSAETLSDWLSAQMTGTLATLELPILRQLQTSLAKGDSDTVKYWCDFMVASRETKELRQEERQRGIAFARLLPQLGIELDDTLQQRVKQTQLMAFALAAVHWHIDSEKLCCAYVWGWLENTVMSGVKLVPLGQSAGQKILFALAEQIPAIVELSAHWPQEDIGSFTPAQVIASSRHETQYTRLFRS

SEQ ID NO: 6053 - protein, 256 aa, Proteus mirabilis
AVLELIRNRFIKFNTMVQFYSPKKRPAKKQVKNLAVTANALDANGQGIAHAEGKTIFVKGLLPQETARIRLTEEKRQFAKGEVITRLTTNPERVTPPCQYYQHCGGCQQQHVPIDSQRTTKAEVLSHLIKRETNVVISAQPVIAGAEYGYRRRARLGLRYHPKKGLVMGFRQALSNDLVMVTQCPVLKPQLNVLLLPLWQCLKQLSVVRDLGHVELVLADNGPLVILRHLSPLSEGDKPIVRRFFSSRSSDNNLAG

SEQ ID NO: 6054 - protein, 353 aa, Proteus mirabilis
VILEFMKPIFSRGPSLQLRLIIAVIIAISLLIADNRIGAFSKVRQYLDTAVSPFYFLANGPRRFLDQLSETFATRERLQFENQALRKELLVRSGESQLLEQFKQENARLRELLGSPLRQNEQMTVTQVLSGNSTPYRDQVVIDKGTNDGVYEGQPVISDKGVVGQVIAVSELTSRVLLICDTSHALPVQVLRNDIRVIASGAGCADDLLLEALPANIDIRVGDVLVTSGLGGRFPEGYPVGVVSSVKVDNQRAYSVINVRPSAELQRLRYLLLLWNASEKKQAPPLPSEVYRAANERLMQLMPQVLPNYEQAGPPLPRSMSQEPTENSATPSDIAPVPPTENNKPQPNTNRGR

SEQ ID NO: 6055 - protein, 431 aa, Proteus mirabilis
LVLERLSWKALVWGLFLFCLPAFVLSLFIGHLPWLLVVSLLSALIWHAYNLMKLSKWLWLDRSVLPPEGKGGWEPIFYGIRQTQQRNRKRRRELGDLIKRFRSGAESLPDAVVMITNEGNIFWCNSLAQHLLGFRWPDDNGQNIFNLLRYPDFLHYFTVADFSRPLTIALNNGAIVEFRVMPYADDQRLMVARDVTEKNKLENSRRDFFANVSHELRTPLTVIQGYLEMMEENTAENPAEHKVIKTMQEQAKRMDLLVQQLLQLSRIESAPHIDLNTVVDMPALLSVLEHDAHSLSQEQQNIIFDIDHKWAVRGNEEQLRSAVSNLVYNAINHTPEGTTIRVSWKKVPQGMLFSVSDNGPGISAEHLTRLTERFYRVDKARSRHTGGTGLGLAIVKKSLQHHHSILNIESKVGVGSTFSFIMPQTLLTEKK

SEQ ID NO: 6056 - protein, 111 aa, Proteus mirabilis
VWLEEVPTMLDPALSPEENEHWVRFVELLRQAFEQGVEFPVLQLLMTPDERSALATRVRIVQELMRGELSQRELKELLGVGIATITRGSNSLKTAPHDVKLWLEKELMIKK

SEQ ID NO: 6057 - protein, 424 aa, Proteus mirabilis
LMTDKRKDSSGKLLYCSFCGKSQHEVKKLIAGPSVYICDECVDLCVDIIREEIKELAPHHERSELPTPHEIRKHLDDYVIGQELAKKVLAVAVYNHYKRLRNGDKADGVELGKSNILLIGPTGSGKTLLAETLARYLDVPFTMADATTLTEAGYVGEDVENIIQKLLQKCDYDVQKAQRGIVYIDEIDKITRKSENPSITRDVSGEGVQQALLKLVEGTVASVPPQGGRKHPQQEFLQVDTSKILFICGGAFAGLDKVVAQRLNTHSGIGFGAEVKSQNEKASEGELLAQVEPEDLIKFGLIPEFIGRLPVVATLGELNEDALIQILQEPKNALTKQYQALFKLEGVDLEFRKDALTAIAKKAMSRKTGARGLRSIVEAALLDTMYDLPSFENAEKVVIDENVINGKSEPLIIYSQPENQASGE

SEQ ID NO: 6058 - protein, 284 aa, Proteus mirabilis
MTKEMQSLALVPQGSIEAYIRAANSYPMLTAEEEKELAERLHYEGDLEAAKTLILSHLRFVIHVARSYSGYGLPQADLIQEGNIGLMKAVRRFNPEVGVRLVSFAVHWIKAEIHEYVLRNWRIVKVATTKSQRKLFFNLRKNKKRLGWFNQDEVELVAKELGVSESDVREMESRMSAQDMAFDMSADDSDDSHPVAPVLFLEDKSSDFADGIEEDNWDNHAADRLTLAIKTLDERSQDIIRARWLEDDNKSTLQELADKYGVSAERVRQLEKNAMKKLRLAIED

SEQ ID NO: 6059 - protein, 790 aa, Proteus mirabilis
KRRESSMNPERPERIEIPVLPLRDVVVYPHMVIPLFVGREKSIHCLEAAMNDNKQIMLVAQKDASTDEPGVNDLFSVGTVASVLQMLKLPDGTVKVLVEGIRRAKITTLSDNGEYFQAKAEYLDTPVVDEREQEVLNRTAINQFEGYIKLNKKIPPEVLASLHAIEESAKLADTIASHMPLKLKDKQAVLEMSDVTERLEYLMAMMESEIDLLQVEKRIRNRVKKQMEKSQREYYLNEQMKAIQKELGEMDDAPDEMESLKRKIEAAKMPKEAREKTEAELQKLKMMSPMSAEATVVRSYIDWMVQVPWNSRSKVKKDLVKAQEVLDTDHYGLERVKERILEYLAVQSRVSKIKGPILCLVGPPGVGKTSLGQSIAKATGRKYVRMALGGVRDEAEIRGHRRTYIGSMPGKLIQKMAKVGVKNPLFLLDEIDKMSSDMRGDPASALLEVLDPEQNIAFNDHYLEVDYDLSDVMFVATSNSMNIPAPLLDRMEVIRLSGYTEDEKLNIAKQHLLPKQIERNALKENELTIHDSAIMGIIRYYTREAGVRSLEREISKLCRKAVKQLLMDSTIKHIEIDENNLKDYLGVRKVDYGRADTENRIGMVTGLAWTEVGGDLLTIETASVPGKGKLTFTGSLGEVMQESIQAAMTVVRARADKLGINGDFYEKRDIHVHVPEGATPKDGPSAGIAMCTALVSSLTGNPVRSDVAMTGEITLRGQVLPIGGLKEKLLAAHRGGIKTVLIPDENKRDLEEIPENIVADLDIHPVKTIEEVLTLALEKSPFGIEVVTNK

SEQ ID NO: 6060 - protein, 87 aa, Proteus mirabilis
RLGEQMDKRFVQAHKEALLALVLTFIYLLGWLLTAYLPDNTVGLTGLPVWFELSCLFLPVLFFLLCYLMVRYFFKDMPLGDEHDNAN

SEQ ID NO: 6061 - protein, 127 aa, Proteus mirabilis
CCLDLCVHRSLSDGSDVMSHPNTSPSGASHGSMKSYLIGFILSVILTVIPFWMVMEGTATTSTILWTVVGMAVVQIVVHLVCFLHMNTSSEERWNVIAFLFTLLIIGIVVIGSLWIMYNLNINMMMD

SEQ ID NO: 6062 - protein, 86 aa, Proteus mirabilis
AIMDTNEIKQVLMDTLSLDEVIVNGDGSHFQVVVVGAMFEGMSRVKQQQTIYAPLMEYIADNRIHALSIKAYTPEEWKRDRKLSGL

SEQ ID NO: 6063 - protein, 456 aa, Proteus mirabilis
KPSEANMLSLFRPAPHKARLPKEQIDPVYRRLRWQIFMGIFFGYAAYYLVRKNFALAMPYLVEEGFSKGDLGFALSGISIAYGFSKFIMGSFSDRANPRYFLPAGLILASIVMLIMGFVPWATSSIMIMFVLLFLCGWFQGMGWPPCGRTMVHWWSQKERGGIVSIWNCAHNVGGGLPPLLFLLGMAWFNDWKAALYMPAFAAILVAMIAFALMRDTPQSCGLPPIEEYKNDYPPDYKETDEQELTAKEIFMKYVFPNKLLWMIAIANVFVYLLRYGVLDWSPTYLREVKDFAMDKSSWAYFLYEYAGIPGTLLCGWMSDKVFKGNRGATGVFFMTLVTIATIVFWMNPAGNPNIDMACMLIIGFLIYGPVMLIGLHALELAPKKAAGTAAGFTGLFGYLGGSVAASAIVGYTVDYFGWDGGFMVMIGGSVLSVVLLLIVMINETKHKREMSQKYE

SEQ ID NO: 6064 - protein, 391 aa, Proteus mirabilis
VMEETTMQNFTYYSPTRIHFGQGQIAKLRSEIGKNERILLTYGGGSIKRNGILDQVHAALPGYQIHEFGGIEPNPSYETLMKAVAYARYHGITHLLAVGGGSVVDGTKFIAAAIPYQGEPWEIVTSRGHAIEKALPLSCVLTLPATGSETNCFSVISKKQTMDKQSFASPHVYPHCAILDPTATFSLPPRQTANGVVDAFIHILEQYLTYPVNALVQDEYAEGLLRILIEEGPKALTSPQDYDIRANIMWTASQALNGILGVGVPQDWATHALGHEITALHGLDHAQTLAIVLPALLNEKRQEKYAKLIQYAQKVWGIHQGSDAFKIDSAINETRKFFERMGLKTRLSDFNISEADIPALVQKLQQHGQTALGEHQDITLEVSQRIYMAAL

SEQ ID NO: 6065 - protein, 163 aa, Proteus mirabilis
GVEDVKMLAEATHTNLSLVDEINQRLCEFRDEHNMSTGLVIAQGKKLYLVRYNRSFKHVDIDFLPNTPVPHKLSAAGATYAVFSHLEIDADLSIQQKNSIHQQGFAIRQQPAEGIPGAQSIACPVFNRKGEMVAAALTMGFIKPENQIELGNALKAKIRHVLS

SEQ ID NO: 6066 - protein, 242 aa, Proteus mirabilis
PTREYDTMRVGVIGAMEQEVKLLREQIENCEIVSRGGCEIYTGKINGVDVALLKSGIGKVAAAIGTTLLLEHFRPDVVINTGSAGGLDAKLNVGDIVVSTEVRYHDADVTAFGYEPGQMAQCPPAFIADPKLVNIAQECIGSLKLNAVRGLICSGDAFINGAEPLARIRRTFPEVVAVEMESTAIGHVCHQFDTPFVVVRAISDVADKESHLSFDEFLSVAAQQSSLMVTTMLDKLKTETQF

SEQ ID NO: 6067 - protein, 879 aa, Proteus mirabilis
LGLLMAKLFKTIDLNVKHKSKQCRGRSATTLIYFVIIGMASIASESFAVSKDIEFNSDILDLKDRGNIDLSSFSRAGYITPGKYELIININNNELSGTYRVDYIVPKDDPKASEPCISPILVKQFALRPEWLKKLTWKDKGNCLNEASLPGMSLRTDLGSGVFFITLPQAYLEYSSPNWESPSFWDEGIAGLLFDYNVNANVRAPSDGKQKQQITANGTAGANLGVWRFRADWQASYEHTTGVLHSTENHWNWDQFYLYRAITKWGARLVMGETYLRSNLLDNFRFTGISLLTDEQMLPPNLRGYAPEITGVAKTNAKVTVSQQGRIIYETQIAPGPFRIQDLQDAVSGRLDVRIEEQDGTIQEYQIDTANIPYLTRPGRLQYKVSAGKPSRLDHKTEGPIFAMGEFSWGVNNGWSLFGGTLVSKDYNSASLGFGRDLMMLGAISFDTTHSWATFANENKHYHGSSYRISYSKRFESIDGQITFAGYRFSDRHFMSMDQYLDRRYRYGAQENNKELYTLTLSKQFPQWGLSTYINYNHQRYWDRPNNDYYNFSLSKYLAIGKFKNINISLSAYRNRFNGNHDNGVYFNINLPWRDRATISYNSVINKEGNSHNVSYFDRIDDNNNYRLSAGVSSRGKPSADGFFTHYGDVALVTASASHINGDYTSASLSFQGGATLTTKGGDFHRSNMPGATRLLIDTQGVSDVPVKSLSAISHTNIFGKAVIPDINHYYRGSASIDLKQLPDNVEALRSIHQLTLTEGAIGYRQFDVIAGHKAMATVQLAEGGVPPFAATVTTLNGRELGVFNDGGKVYLSGINSGDVLYVHWDGKNQCQLSIPKLADTQLITSLLLTCFQRQPTISTSFLETDKTQALPQHSFLSK

SEQ ID NO: 6068 - protein, 194 aa, Proteus mirabilis
FFLLTEKNMNRKMAPLLLCLVASLVTASTIASDVKQDKNMHQRFGWLNLQGTILEPSCAISAGSSDQVIPLTTVSIPTLVTEGQGPIEYFSIRLTDCTLISQKGQEADNPRFIATFDGPSNGNGNFELSGEAKGASLAIADRYGRQAIPGQPLPPVGIDSQSMALLYQARIVKNNDTPKAGNYRTTLRFKLEYY

SEQ ID NO: 6069 - protein, 212 aa, Proteus mirabilis
CILLAIVMLQLTFVVYYLIEKVTKMKQRKFLTRFEVNAILKQAKEGRYPERDYCMFLMCFLHGFRVSELCNLTLSDIDLESRILYVRRLKGGLSTTQPIIDEEYEALCNWLKSRENWRESDSEWVFLSQKTGPISRQQVYGLLRRLGKKANVSISPHPHMLRHACGYALADLGRDTRLIQDYLGHRNISHTVIYTASNSKRFINMWETRNSQ

SEQ ID NO: 6070 - protein, 328 aa, Proteus mirabilis
VLLLLLCFGWWSHCYLNKGIVMPNSALLKGDHIVILLLISLCSFSVSAKKIIQGITQDSENIVVAKGDIPTPEKFTTNILNYRQKAVDQLTFVETALKNVIVNSEKNQLTDAQLAYQQAHYHYEVIRPIIALFGATERLLNNRADFFLERENSPRFSGFHLVEYQLFKLEDMQSSAESAKALLRGISDLKKRLAIEDIPIAKLVQSAGDSLELILTDKLAGIENQYAKSDLGDGYANLYGSRLIIESLSNHIPLQEYQSLRKQYDTISKLFLKYQRDEELFQPLDTLSDSEKAVLFAQITQLAEQVAQLRNVLNIDVYYYYKEAYGEK

SEQ ID NO: 6071 - protein, 141 aa, Proteus mirabilis
RQLLISLIIDSPVYRAISSVLLSEISMIKHLYQYTLLLLLMIASSTLAAEKYTVELEMKEGELIPRVLNVPAKTPIRIKIRNTGSSPVEFESTQLRKEKVLAPGASSVVVIAPLKPGRYTFFDDFHLSHPQGEIVATEKAE

SEQ ID NO: 6072 - protein, 406 aa, Proteus mirabilis
CAVLNRRLLNFRESMRGFIMSVIKMTDLDLAGKRVLIRADLNVPVKDGKVTSDARIRASLPTIEAALKQGAKVMVTSHLGRPTEGEYNEEFSLKPVVDYLKEKLSAPVSLAKDYLNGVDVNAGELVVLENVRFNKGEKKDDETLSKQYAALCDVFVMDAFGTAHRAQASTHGVAKFADIACAGPLLSAELEALGKALDKPERPMVAIVGGSKVSTKLTVLDSLSKIADQLIVGGGIANTFIAAEGHSVGRSLYEADLVDDAKKLMEKCDIPVPTDVRVATEFSETAPAVLKSANDIKDDEQVLDIGDVTAERLAEILKNAKTILWNGPVGVFEFPNFRKGTEVIAKAIADSDAFSIAGGGDTLAAIDLFDIADKISYISTGGGAFLEFVEGKKLPAVAMLEERAKQ

SEQ ID NO: 6073 - protein, 154 aa, Proteus mirabilis
NISLMAKILIMPRWDKIIVSIFFLILFIVIGILVYGYTISLFLMEDIIIFSGPIVMLTLGVPLVIYTCFAMTIEFFLGVKSIVFMSLMTFNKLIMRYLVYLGLAGVLLSFPISFVVNIFLLDEGYKTCDKISWLSPTTYVKELSFCNNKKALNK

SEQ ID NO: 6074 - protein, 107 aa, Proteus mirabilis
RVGLSIIEKEDTMELQITGHNIELTDALRDTVKAKSAKLPQFFDKINNVQVILKVEKVTKIAEATIQVNGGELHASAEAEDMYAAIDGLMDKLARQLTKHKDKLRQH

SEQ ID NO: 6075 - protein, 128 aa, Proteus mirabilis
IIQLSQKRQTLFLQHQQPQITLNFSELIMTIEKNVIPLSEKISDDPKKFLVIGWTVVLLGLAIFIFWAAFAPLDKGVPAIGNVVISGNKKSVQSSVEGIITHIFVKNGDPVFAGTNPDTTKALFNLKP

SEQ ID NO: 6076 - protein, 450 aa, Proteus mirabilis
IIKLFIGHNAMKEQLSSYWKILIEAVKQQVKPALGCTEPISLALAAATAARYLQHNITRISAEVSPNLMKNGMGVTVPGTGMVGLSIAASLGAVAGDSEAGLEVLKNATPEQVELSKNLLNSGIVCVSIKKACQEVLYSEVTVEDGENSATVIIAGDHTNIVKIIHNGQVVLDKLSSQSEQTASPCQIKQALTNTNTREIYQFITQAPVEEISFILQSAQLNDALSKEGLNNTYGLHIGQTLQRQQQRGLLAKDLLSEIMIRTSAASDARMGGAVLPAMSNSGSGNQGIAATMPVVVVAEYLQVSEEKMARALMLSHLLAIYIHHKFPALSALCAATTASMGAAGAIAWLMEERYEPMAMAISSMIGDISGVICDGASNSCAMKVSTGASAAYKAVLMALDDTCVTGNDGIVTHDVDMTIENLCALASRAMQHTDVQIIEIMEYKAVANG

SEQ ID NO: 6077 - protein, 510 aa, Proteus mirabilis
KEFCMLQAAFKQTTWYKSFILLLLGFTSGLPLALTAGTLQAWMTVENIDLKTIGFFSLVGQAYVFKFLWSPFMDRYTPSFLGRRRGWMLLTQIGLVLGIAGMGFLNPSHHLWWLASLAVIVAFCSASQDIVFDAYKTDILKADERGTGAAVSVLGYRIAMLVSGGMALWLADKYIGWQNMYWLMAALMGIGIIATLLAQEPETAVKPPRTLYEAVIEPLYEFFSRNNAWLILLLIVLYKMGDAFALSLSTTFLIRGAGFDAGEVGLVNKTLGLAATIVGALLGGLLMRRWTLFKALMIFGILQGGSNIGYWYLAISEQNIYSMGAVIAFENICGGMGTAAFVALLMTLCHQSFSATQFALLSALAAIGRVYVGPVAGWYVESHGWEAFYLFSIVASVPGIILLMIAKNTLTYTQKTGEFLQRTLFIKQYRLAIYGLLFAVLLFLCSLILLIINSLPNLEMFQSVDFIQSINSELLSELTSTLFLYGVIIGAVSLIIGTILDYLALKKTAN

SEQ ID NO: 6078 - protein, 231 aa, Proteus mirabilis
GSVCPRGVVVMIRFEHVSKAYLGGRQALQGVDFHLRPGEMAFLTGHSGAGKSTLLKLICGIERPSDGAIWFAGHDISRLKNSEIPFLRRQIGMIFQDHHLLMDRTVYDNVSLPLIIAGASEEDIRRRVSAALDKVGLLDKAKNYPIQLSGGEQQRVGIARAVVNKPTVLLADEPTGNLDGELSEGIMRLFEEFNRVGVTVLMATHDMTLVERRNYRILTLGQGRMVGGQNG

SEQ ID NO: 6079 - protein, 111 aa, Proteus mirabilis
TISCIRKAKSRVGTKTSNLPLRLISAKFFEGRLSWLVILSVIGRIVGSDGGTDITGSIDNLLLGVAHPASIVSANTAQSKFFIMIVSRLSNSAVFSADKGGYFAYHTTAKA

SEQ ID NO: 6080 - protein, 105 aa, Proteus mirabilis
FMSWIILFVAGLLEIVWAVGLKYTHGFTRLTPSIITISAMIVSMGMLSYAMKGLPAGTAYAIWTGIGAVGTAIFGIIVFGESANIYRLLSLAMIVFGIIGLKLAS

SEQ ID NO: 6081 - protein, 134 aa, Proteus mirabilis
NKYWHISCSISMALSKTVWSNYMKYIIAIIKPFKLEDVRESLSELGINGMTISEVKGYGRQKGHAELYRGAEYEVNFLPKVKIELAVCDGQLEPVLQAISQVTDTGKVGDGKIFVLELLQAIRIRTGESGEEAL

SEQ ID NO: 6082 - protein, 359 aa, Proteus mirabilis
LVNCSIILGGCIITSYQGSYMTIRVAINGFGRIGRNVLRALYESGKRAEISVVAINELADATGIAHLLKYDSSHGRFAWDIRVNNDLLQVGDDAIRLFHHADIADLPWGELGIDVVLDCSGVYGSRADGEAHIAQGAKKVLFSHPGTIDLDATVVFGVNQHELKKQHRIVSNASCTTNCIIPIIKMMDDAFGIESGTVTTIHAAMNDQPVIDAYHKDLRRTRAAGQSIIPVDTKLAAGITRIFPKFKDHFEAISVRVPTINVTAIDLSVTVKNAVNVLDVNKLIQKSATGAFRGIVDYTELPLVSTDFNHDPHSAIVDGTQTRVSGQHLIKTLVWCDNEWGFANRMLDTTLAMAATGFK

SEQ ID NO: 6083 - protein, 403 aa, Proteus mirabilis
LIRCTGNHSHREYGIFFISTIPLTMKKTKHLFKTKGCNIPFTSVMMVSFVLMGCNDQSTQPTKPAIPEVGVYTVKEEILPLTVDLPARTASYRVSQVRPQVDGILEKRLFTEGSDVKKDQPLYQIDKKPYETQVAKAQAAYDNVKKLAARYKSLRATNAISQQEYDDVVSRLDQAKADLNQAKINLGYTQVLSPISGKISRSFVSEGALVSSGQSQPLATITQLDPIYVDITQPITNQLKLKSLIQQGVVTDSEDKMDVTLFLEDGSQYPYTGTLSFSEVQVEPSTGSVTLRAKFPNPQHQLLPGMYTKARIMQGTQEKAIVVPQQAITFDARGKSITYIVDQQQVLQARDVEILKPQGNGWIIKQGLQAGDRIMTEGHHRAKPGVKVNAVPANNISLKTTLE

SEQ ID NO: 6084 - protein, 201 aa, Proteus mirabilis
SYLCFVIWKVKSNDMSMAFLLSEKQLLFRLFLFIEEERMPSFDIVSEVDLHEVRNAVENAQRELTTRWDFRNVEASFELNEKTESVKTTSVSEFQVQQLLDILREKMAKRGIDGAVLNIPEEMTHSGKTYSVEATLKQGIDTPLAKKIVKMIKDSKLKVQAQIQGEQVRVTGKSRDDLQAVMKLVREGELGQPFQFTNFRD

SEQ ID NO: 6085 - protein, 153 aa, Proteus mirabilis
RTYCFNRRASNGRGARDDKRCSSRVHFPRWHQIGFNSLTYCVGNNMIPGEIRVNAALGDIELNAGRETKTIQVANHGDRPVQVGSHYHFYEVNEALRFAREETLGFRLNIPAGMAVRFEPGQSRTVELVAFAGKREIYGFHGKVMGKLESEKK

SEQ ID NO: 6086 - protein, 78 aa, Proteus mirabilis
KTCCNVGSQDYREVRKKNRVIIEKQLDSFSIFQQKIPYGAIFVSLLAISVINYYHLKRSILPCQSDCNHLISTVLPFL

SEQ ID NO: 6087 - protein, 331 aa, Proteus mirabilis
CHCCWGICRCITYTIMEIRSLKVVKVYAPASIGNVSVGFDVLGAAVSPIDGQLLGDCVTVEAAQEFQLHSKGRFVSKLPSDAKQNIVYQCWELFCEKLGKQLPVSMTLEKNMPIGSGLGSSACSVVAALVALNEFAHKPFSESHLLLMMGELEGRISGSVHYDNVAPCYLGGLQLILEQNDIICQPVPAFDDWYWVMAYPGIKVSTAQARAILPKQYDKADIINHGRYLSGFIHACHTQQPKLAASLMKDVIAEPYRTQLLPGFDKAREAALQKGALACGISGSGPTLFSITDSLAIAQDVAQWLQQHYVQNDEGFVHICRLDTRGAREIG

SEQ ID NO: 6088 - protein, 285 aa, Proteus mirabilis
LGIWGSCLLALFSITSILLKRIITMIKAVDLNSDLGESFGQWRMGNDAAVLEIVSSANIACGFHAGSPEGILKTLKAAKQHQVAIGAHVAYPDLVGFGRRNMDIASDELTADVIYQIGALQGLAKAVGMKVTYVKPHGALYNTIAHDKRQALAVIEAILSIDPQLILVALAGSPLITLAKEKGLRVVAEAFADRAYHADGTLVSRKQEGAVLHDPQLVAQRMLKLVQKGGVESIEGTFTAIQADSICVHGDSPDAVNLAKSVKEILITHGIAIKPFTSAIGIKEA

SEQ ID NO: 6089 - protein, 81 aa, Proteus mirabilis
IEICLDANVQRYDYDEESNWIKNSGIAMQKLGGALPATSRHTRHLPWLLPSGPDRVNKLVLRENQQDPIDCLIAKTICIIF

SEQ ID NO: 6090 - protein, 456 aa, Proteus mirabilis
NRICEKRARISLLGNLTCTEENRMSKIVKVLGREIIDSRGNPTVEAEVHLEGGFVGMAAAPSGASTGSREALELRDGDKSRFLGKGVLKAVEAVNGPIAKALLGQDAKDQANIDKIMIDLDGTENKSNFGANAILAVSLANAKAAAAAKGMPLYEHISDLNGTHGQYSMPLPMMNIINGGEHADNNVDIQEFMIQPVGAPTLKEAVRMGSEIFHHLAKVLKAKGMNTAVGDEGGYAPNLESNAAALAAIKEAVEAAGYVLGKDVTLAMDCAASEFYNNETGNYELKGEGKTFTSQEFTHYLEELTKQYPIVSIEDGLNESDWDGFAYQTKVLGDKIQLVGDDLFVTNTKILKEGIDKGIANSILIKFNQIGSLTETLAAIKMAKDAGYTAIISHRSGETEDATIADLAVGTAAGQIKTGSMSRSDRVAKYNQLIRIEEALGSKAPFNGLKEVKGQA

SEQ ID NO: 6091 - protein, 296 aa, Proteus mirabilis
RIKCQAQCVLAFFYEILLTRHNDHFYIQGQIMSENREILRLLAIMAQLRDPQTGCEWDRVQTFDTIAPYTLEETYEVLDAIARKDFSALKEELGDLLYQVVFYARMAQEQQLFDFNDVCEAISNKLERRHPHIFATENENNLATEKHRWEKIKAQEREAKAQYSLLDDIPATLPALMKAEKIQKRCASVGFDWHELSPVLDKVYEEIDEVMAEVKKAPRDDQRIEDELGDLLFSVVNLSRHLKQKPEQALNRACRKFEQRFRFVEKMLTEQGINIENASLEEMEISWQKAKEKEIE

SEQ ID NO: 6092 - protein, 219 aa, Proteus mirabilis
RKKCMLQVYLVRHGETEWNVARRIQGQSDSPLTAMGVRQAQQVAERVKSAGITHIISSDLGRTCQTAEIIAQACRCDVITDPRLRELDMGVLEQREIATLNTQEEAWRKSLIDGTPDGRIPQGESMVELANRMQAALNSCLALPEHSRPLLVSHGIALGCLLSTVLGLPAYAERRLRLRNCSISRVDYQNSPWLANGWVIETAGDVSHLTDIALDEVQR

SEQ ID NO: 6093 - protein, 413 aa, Proteus mirabilis
WERCNESSKYFSFRRKPRQHEVLSDWLYSVRYPHRDPILDGDGRNSYNLNYLMDSRWYGRRTDCCSFSLFLTYEHVLRRALERYRIPIHLVDYRHCCDWLTVDYVQPEHQYDDGLRVVAMIKQYLQVTKPGIIFGNLISVIGGFLLASKGEIDYPLFFATLLGVSLVVASGCVFNNYIDRDIDRIMERTKNRPLVQGLIDPQISLIYASVLGIAGVVLLYVAANPLAMFIAVFGFIIYVGVYSLYMKRKSVYGTLIGSLSGSAPPVIGYCAVSGEFDAGAAILLLIFSLWQMPHSYAIAIFRFKDYQAANIPVLPVIKGISVAKRHIILYILAFMVATLMLTLVGYAGYKYLIVASAVSIWWLGMALSGYKATNDKVWARKLFIFSIIAITSLSVMMSVDPTSSTETVLAYLR

SEQ ID NO: 6094 - protein, 713 aa, Proteus mirabilis
GERCSRSFFYIIIMSFTVGGFMSHTLALSEKKRWDPIFLWILIAWMAFILMPSWSLDYGLFDSTADELLTSYGWSNLNISLLWFLLPSILLIRPLHPVGRENRIRHYFDASFAFFCAFITIVTATMEGRGLGYSVIVLFISLGMIAKHALTRLEWLGGDSFVIGSLITVVALIGVFIIFPSVAIFIPMFQDSAGNFAPFEFIAILSQAHIVQVMINSILLSIAVGIGCTFFGLILAIYTSRIAVRSAIIGRVFSILPIVTPPFVVGLGVTLMMGRSGYITEFLATYAGLENTNWLYGFTGIWLAQVLAFTPMSFMILDGAIKTIHPSLEEASYTLRANRYQTFFHVFMPLLKPALANAFLIVIVQSLADFSNPLVLGGNFDVIATQIYFYITGSQLDYQAASTLGASLLVFSLLVFCIQYMWIGKRSYVTVSGKSYRGDVQPLPTSLVTFVTSVLGIWVIFNILLYGSIFYGSFTVNWGVDYTLTFDNFIKLFGQGMSDGAWPSLLDTLLYAGIAAPITAILGLLIAYIVVRQDFKGKKSIEFTTMLCFAVPGTVAGVSYILAFNDSPFYLTGTAAIVIISMTMRNVPVGIRAGIAGLGQIDKSLDEASLSLRANSMRTILYVLLPLLRPAILSALIYSFVRAITTVSAIVFLVTPETRVATAYILNRVEDGEYGVAIAYGSILIIVMLAIIFLFDYLIGEARVSRSKAKNAQ

SEQ ID NO: 6095 - protein, 124 aa, Proteus mirabilis
INGCISEVFISSFSYHVAVGNTISENRQVLDIRKSKVTTKSTLPSPPLSCHSTSCGLTWPCSPKSLPCNPFSVPNRYFSKYSCPLPADPNKLERQINKLRGKFCGLSGCSDAKRISPDFRALMV

SEQ ID NO: 6096 - protein, 320 aa, Proteus mirabilis
RSLCDEITEVERKITMRVSHLNFNHLYYFWHVCKEGSVVGAAEALYLTPQTITGQIKALEERLGGKLFKRQGRGLVPSELGQLIFRYADKMFMLSQEMLDIVNYSRESNLLFDVGVADALSKQLVSRVLETAVIDHEQIHLRCFESTHELLLEQLSQHKLDMILSDCPVDSSQQEGLFSVKLGECSVSFFCSQPIPEKPFPECLEDRKLLIPGRRSMLGRHLLTWIRNKNLQVEILGEFDDAALMKAFGLNHNAIFVAPSIYTNETFVQSNIEEIGTLDSVKEEYYVIFAERMIQHPAVQRVCNTDFSALFSGEKKANNE

SEQ ID NO: 6097 - protein, 152 aa, Proteus mirabilis
SSQCARLCHCHAETTLRRKQDMTTKRKPYVRGMQPNWWTKLGFYRFYITREGTCLPQLWFSLVVLFGVFALKNGPESWAGFVGFLSNPIVMLINIVTLIATVFHTATWFKLAPKAVNIVVKDEKLPQEPIVRGLWGLTIVVTVVILAVALIV

SEQ ID NO: 6098 - protein, 172 aa, Proteus mirabilis
LTGCFLFTEQVHCLGVLSTVGITMHCPFCTAVDTKVIDSRLVGDGSQVRRRRQCLVCHERFTTFEVAELVMPRVVKSDEIREPFDEEKLRRGMLKALEKRPVSSDDVEAAINHIKSQLRATGEREIPSKQIGNFVMEQLKKLDKVAYIRFASVYRSFEDVRDFGEEIAKLQD

SEQ ID NO: 6099 - protein, 66 aa, Proteus mirabilis
IVLRVHGYVRDHGYVHVHGYEYVHENVHDDRHAHDDAHGTLGLHFAVHHDKNGDEHRHYYGNGDDE

SEQ ID NO: 6100 - protein, 62 aa, Proteus mirabilis
FDLLYSYLGKFLRINILNNNLFARKKVKNNKKKAHNTEPENNNAVLKTSTPQKFDNSSTCKN

SEQ ID NO: 6101 - protein, 107 aa, Proteus mirabilis
SFILGAEMELTPREKDKLLLFTAGLVAERRLAKGLKLNYPEAVALISCAIMEGAREGKTVAQLMSEGRTVLTAEQVMEGVPEMIKDVQVECTFPDGTKLVSIHSPIV

SEQ ID NO: 6102 - protein, 122 aa, Proteus mirabilis
RKNRRPSRLSSLYSQFICLICYGAAMLIFLGRFLMIGVWGFLCLNLISPFPKPLKYFMDIALIFMVIMHGLQIAMYKAGQPEDKKPSGLLQFKIFFFGIFELLRIQKELRKEYLEKQKNKNQ

SEQ ID NO: 6103 - protein, 304 aa, Proteus mirabilis
SEPRQEYIMKLKKIATLLSVVALSATISANALAKESIALVISTLNNPFFVTMKDSAQKEADKLGYDLVVLDSMDNPAKELANVQDLTVKGTRLMLINPTDSDAVGNAVLMANKAKIPVVTLDRVANKGEVVSHVASDNRLGGKMAGDYIAEKVGNDAKVIQLEGIAGTSASRERGEGFKQAVDAHKLNILASQPADFDRTKGLNVMQNLLTANPSVQAVFAQNDEMALGALRALQTAGRTDVLVVGFDGTNDGIKAVNRGVLGATIAQRPDQIGIIGIQTADKILKGEKVDPTIPVELELVTQK

SEQ ID NO: 6104 - protein, 195 aa, Proteus mirabilis
VQARYVKGHVLVNVLVTLMQKIMHQDKRTNMSKQQQRVYIILGSNLNSPEQQVKSAIKAISEIPNTTLIAQSPWYRTRPMGPQDQPDYLNMAVAVDTTLAPEALLDHTQAIELAHGRERKAGNRWGPRTLDLDIMLFGDQVIQTERLTVPHYGLKVREFMLYPLADLAPELCFPDDGERLADRLALVPKNGMEKW

SEQ ID NO: 6105 - protein, 433 aa, Proteus mirabilis
QMKRFISYFFTLALTYFLLPQLAIGATTIDIDKADNSFMLICSALVFFMTIPGIALFYGGLLRSKNVLSLMTQVMLIFSVVIILWIMFGYSLAFTAGNKIWGGWSLTFLNNISVDSVAGEINQYVHVVFQGSFAVITVALIVGALGERIRFSALLIFTVIWFTFSYIPIAHMVWGEGGWLIDDGALDFAGGTVVHINAAVAALVGAYLLGKRGDYQHTAIKPHNLPMVFTGTAVLYIGWFGFNAGSAGSANGIAALAFLNTVVATAGAVLAWTFAEWLVRRKPSMLGSCSGCIAGLVAITPAAGTVGPIGALVIGIIAGIIGLWGVVVLKRWLKADDVCDVFGIHGTCGIAGCLLTGIFTASFLGGIGYSEHMTLGKQVLTQLFSVVITLIWSSVVAYIAFKIADKLVGLRVSQEEEHDGLDITTHGERAYEQ

SEQ ID NO: 6106 - protein, 71 aa, Proteus mirabilis
LVPLHKVVMILLISLLCEFKAVTLPRISQEINLSLLQPVNFISKSRETTLSLVVIIPNKSRKAIGKSSDLA

SEQ ID NO: 6107 - protein, 419 aa, Proteus mirabilis
QRLRALLIWLTVIVKNKSRNTIRRITMSSHDPRPLGGKLFTLAVRVFLPLAVLGFILIGKRLVLGLGDVSDLNGGYPWGIWIAFDLLIGTGFACGGWALAWAVYVCNKGEFHPLVRPALLASLFGYSLGGLSIAIDIGRYWNMPHFFMPQYFNVNSVLFETATCMTIYIMVMALEFLPALLERLGWKVSLRRLNKAMFFIIGLGALLPTMHQSSMGSLMISAGWKVHPLWQSYEMLPLFSLLTAFILGFTIVIFEGSLLKASRTINDDETPLFTKLTKIIEVLLITFLVLRWGEVIWNGKLSYIAKGDMFSWLFLAESALLFIPLVLMHLKNNRRSPRMLFVCALFMLVGAAMWRMNYSLVAYNPGNGYHYFPTASELLISIGFVAFEVTAYILIIRLLPVLPAQTESNIQLKKAEVKS

SEQ ID NO: 6108 - protein, 62 aa, Proteus mirabilis
GLLRLVNIFLIDHLIAVRFLVFFASSFIPTCYVMMCLPQVNAFFTEVQKRIATVDKISRYMK

SEQ ID NO: 6109 - protein, 405 aa, Proteus mirabilis
NSMRVTGSVIFIVQFLFIVQLLSMGAMEMSGPFWPLHLESMASTELLSIVGTGVYIAPMLGVMLTSTFWGRIGDKTGNKVMMIRALMGLALTQLGLAFANDVWVILLLRFLQGTCAGYIAPAQAYGIAMIPIAQRTRLLAWLQVSTNAGSLAGAIAGGAILDLLSFFWINFGAFIICTLCALLVFFILPNDLPRHASSNCVTSSTNKAKAISSINHSAIVGLLTVLGLLLVSRMITQTPFSLYVSSVFNAPNWLTGVAYGLQATGVIVSASLWARWFEAHNISHALYRMVGIIAGCFIVTLLLAAVREISWFIGLYFLWGILLGATTPVLTALISRSTAESKQGYILGLVQSISQFASMVGIALGGGILVWPGLTTLFLCVAVMYCITLIITLKMSYSSKNTNQK

SEQ ID NO: 6110 - protein, 298 aa, Proteus mirabilis
WVVRYIFVYFLIYLINFAKLAGVGMPDFSEKGWLADIALRYELKRGKTCLTEKRHLGPLMVQRPFYPEQGVAHTYLLHPPGGVVGGDTLSININVQPYAHALLTTPGATKFYRSAGGTASQTQTLTVAQEGFLEWLPQENIFFPDAQVCLTTHIHLASSAKFIGWEMQCFGRPVLNEWFETGKVKGRLNFYVDERLILTESMRVEGLQKQAAAMREFPMFGSLYIYPATDALKEIIQHHLEKVNPLVEYGLTDVDGILVLRVLGTQTEPMMACFAQVWQIVRQHWLGYCPEPPRIWAT

SEQ ID NO: 6111 - protein, 129 aa, Proteus mirabilis
YYIFILYKNIYCYRESKMSKYQEIVTDISGNMGALSKNIPEVMKSFMSTTKASSKDGVLDAKTKELIAIAIAVANRCDGCIGFHTKTLVELGTTEQELAEALGVAIYMGGGPSVMYASNTMGAFKEFSQ

SEQ ID NO: 6112 - protein, 133 aa, Proteus mirabilis
EYRRYLNLFLNIRKKFMSKVLVIANGAAYGNESLFNALRLSITLKEQHPETQLNIFLMSDAVTGALAHQQPKEGYNLQQMLEILTAQNVPVKLCKTCTDTRGISELPLVDGAELGTLVDLAQWTLDADKILTF

SEQ ID NO: 6113 - protein, 442 aa, Proteus mirabilis
SNIFRLYFVTKTKWTCIRNTQCLPRRILVSFFIDQSIIGNMKRLQAFKFQLRPNGQQEREMRRFAGACRFVFNRALARQNENHEAGNKYIPYTKMASWLIEWKSDTETQWLKEAPSQPLQQSLKDLERAYKNFFQQRTAFPRFKKRGKNDAFRYPQGVKLDQSNSRISLPKLGWMRYRNSREVVGEVRNVTVSQSCGKWYVSIQTEYEATEPQHESTSIVGLDAGVTKLATLSDGTVYPPVSSFKVNQRKLARLQRKLSRKIKFSANWQKQKRKIQRLHSHIANIRKDSLHKVTSEISKNHAMIVIEDLKVSNMSKSAKGTTERPGRNVKAKSGLNRSILEQGWYEMRRQFEYKQLWRGGQVLAIPPAYTSQKCACCGHTAKENRQSQSQFECLECGYTANADINGARNILAAGHAVLACGGRVQSDRPSKQEPAEVIQTSV

SEQ ID NO: 6114 - protein, 709 aa, Proteus mirabilis
PLFRLGSNIMINGWTGNILRINLTTGAISRESSSQYKSLIGGMGFGYKIMYEEVAPGVKPFDEENKVVFAVGPLTGSGAPCSSRVNITSLSTFTRGNLVVDAHMGGFFAAWMKFAGYDALIIEGQADNPVWIHIDDDQVSIEDASFLWGKGTRQTTEELCAQTSPEACVAAIGPAGENLVPLSGLINSRNHSGGAGIGAVLGAKKLKAIVVEGSRGVNVADRKALKELNDYMMTQLIGANNNHVVPSTPQSWAEYSHPGSRWTARKGLYWGAAEGGPIETGEIPPGNANTVGFRTMKSTFDLGPEAEQYTVKMGGCHSCPIRCMSQLNVPQAKKFGVPQTGGNTCVANFVHTTIFPNGPKDIEKKGDANVVGNLVGLNIFDDMGLWCNYGQLHRDFTYCYTHGVFKRVLSEEEYNDIPWDKLEEGDPAFIKDFYYRLAHRKGEFSHLADGSYLIAQRWNLGEEYWGNKKNKLWSPMGFPIHHANEASAQVGSIVNCMFNRDAMTHTHINYIGSGLPLKLQKEIAGELFGSGDAFDETKNYTPINKAKIAYTKWTILRSCLHDAVTLCNWVWPMTVSPHKSRNYRGDLDMEAKFFTAITGEPTTSQDLDLASERIFTLHRAYTVKLMNTMDMRNEHDQICSWVFDKDPDIPVFTEGTDKMDREDMQLSLTLFYEEMGWDPQLGCPTKATLVRLGLQDVADDLASRGLLPN

SEQ ID NO: 6115 - protein, 500 aa, Proteus mirabilis
IIIRGIKDMDKPAKVGLLQQPKPFFMIFFVELWERFGYYGVQGILAVYFVSKLGFSQEQAFITFGAFSALVYGLISIGGYVGDHLLGTKRTIVLGAIVLAIGYFMTGMSIMYPNLIFYALATIAVGNGLFKANPASLLAKCYKPKDPRLDGAFTLFYMSINVGSLISLSIAPVLADRYGYALTYNICGIGLIMAILVYFFCRKMVVNIGSEPDHLPMNFNKLLLVIAGSVAMVFICAWLLHNVMIANIVLISLSIVVVIIYFREAFKQKDRVARNKMYVAFVLMLEAVIFYILYAQMPTSLNFFAIHNVHHTLLGFDINPVSFQALNPFWIIIASPILAMAYSHFGAKGKDLSMPAKFTTGMLLCSLGFLTAAASGMWFADAQGLTSPWFVVLIYLFQSLGELMISALGLAMIAAFVPQYMMGFILGMWFLTQATAYLLGGHVATFTAPPEGITDPLQTLPIYTDVFGKIGIVTLVVGLIMWATVPLLNRMMKEESKMIK

SEQ ID NO: 6116 - protein, 872 aa, Proteus mirabilis
FMVRSFKTVCLEKREKRKKHAIRPVAILIYLIVTGASSLSNSALANSDIEFNADILDLKDKQNIDLSDFSRAGYIMPGRYEFVVRINNNELPDIYNINYVVPADDPKGSEPCLPPELVRQLGLKPEWLDKIRFNDNQTCLDTSSIPGMTINASLGSGNLLLTIPQAYLEYSAPNWDPPSRWDDGISGILFDYNVNANVTDPAKGKQRQQVTGLGTLGANLGAWRFRADWQASYQHTTGIPQSTENSWKWNQYYLYRAIPQWEARFVMGETYSRSDIFDSFRFTGVHLATDDNMLPPNLRGYAPEVTGVAKTNAKVTISQQGRVIYETQVAPGPFRIQDINDAVSGKLDVRVEEQDGSVQEFQMDTASIPYLTRPGRVQYKFSAGKPSNIDHNTEGPVFGMGEFSWGVSNGWSLYGGSIVAGDYNALSAGIGRDLMAFGALSFDATHSWAKIPRDDKRYNGGSYRLSYSKRFEAINSQVTFAGYRFSERDFMTMDQYLERRYRDGNADNNKELYTIMFSKQFPDWGLSTYLNYSHQTYWNKPTNDNYNLSLAKSADIGRFKNINFSLSAFRNKFNGTNDNGVYMNVSMPWGDRATISYNTVINKSGNSHNVSYYDRIDDNSSYRVGAGVSSNGKPSADAYFMHYADAALVTASASHINGEYTSATLSLQGGATLTPKGGALHRVSRTGSTRLLIDTDGIANIPVKNFGAISHTNMFGKAVLPDINDYYRSSASIDLNRLPENVEALRSIQQLTLTEGAIGYRRFDVIEGQKAMAVIRLKDGTFPPFGASVTTEKGRELGIINDGGNVYLTGINTGDVLSVRWSGKEQCKVLIPTLVENVQISSLLLTCSDDGTATSTFNQREVSLPKTKFLSR

SEQ ID NO: 6117 - protein, 109 aa, Proteus mirabilis
SAPRVAGKRLASPIKLAINSEAGWRYKVCGEPNCIILPLFITNTISETAKASLWSWVTYREVILNCCCNSRIFSLMLRRKLASRLLNGSSNNSTLGFKIKARANATRCC

SEQ ID NO: 6118 - protein, 69 aa, Proteus mirabilis
VFYRKRGIIMSHYEEVIKQVDEAIASASIQTMNELLVELGKDNTIAFAQRYEQQERLRTAIFHHGEKQR

SEQ ID NO: 6119 - protein, 235 aa, Proteus mirabilis
LSYSFFVMRVRRMGTLKEIIHALLQHDYMVLADPNILWIIYIVLFVIIMLENGVLPAAFLPGDTLLILCGALIAKDVLHFLPTIIVLGTAASIGSWLGFLQGRWLSDTKVVKRWMAQLPEQYHHKANDLFHRRGLYALLIGRFIGFVRTLLPTLAGLSELQQRRFQLFNWISGFLWVGLIVSLGYILNLIPFIQKHETLVMNILMTLPVLLLTAGLIGSIVMYIRHRKSSNNSAK

SEQ ID NO: 6120 - protein, 227 aa, Proteus mirabilis
NQYSSHEKWSNSEGIFMSFSRNEIDTMSGTRKRTYQLLVTTALQLFEQGMLPTVSELAAHAGVSRATAYRYFPTQSDLISATVDASLAPIIAWQPTPEDNTQQRITALLNLAYPQMFKHEGALRGALQVSLQQWAKERQSSEYTEKRFIRGHRKEILLKVIEPLKAHYPQEMWDKVIKAFSLIYGSEVFLVMKDIWKMDDQQVIDMTQWMAKAILNQAKSDFPIDND

SEQ ID NO: 6121 - protein, 89 aa, Proteus mirabilis
NKNSIINLFSQYSVDTHVFYYRYLSLLLLSLFSTSIYNATIICLLNKSNSYQLVALFYLLHLVIENSNYYRYSFNSYLLAIISLIPSVG

SEQ ID NO: 6122 - protein, 605 aa, Proteus mirabilis
SENRRFFKTNKRYLVLKIDKLNQEYHMPQIKYNNEITSIIKERRKVFLSIGLFTALINILMLVPSIYMLQVYDRVLPSGNEMTLLMLTIIMLALFIFMGGLEYLRSIIVIRMSNKLDLSLNSRIYTAAYREKLNKIANINPTLALTDLITLRQFITSHAIFTFFDLPWFPIYLLVITLFNPWLGLFALCGALILFALAILNEYLSKNHLKKANNFANQAQLIQSHHLEHPQTIEAMGMLSQLRKQWQTSHFKYLQAQTQASDNAAGINAITKVTRMALQSLMLGLGGWLAIDNTISPGMMIAGSILLGRALAPIEQVINVWKSWDSSKAAYNRLTTLLKTYPQENKKMALPKPQGQLLVNIDEAVYPHSDRILLNNINFALLPGDILGIIGPSASGKSSLAKFIVGIWQVKKGIVRLDNADIFQWSKEEIGPHIGYLPQEIALFPGTIAENIARFTEVDPQKVIQAAKMAHVHEMILRFPQGYETQIGAHGEGLSGGQKQRIALARALYGDPTLVVLDEPNSNLDDLGIRALTQAIETLKQHKKTVILITHQKQLLSVTNKLLVIFDGNTKLFGPTASVIAELNNPTITKTANTISSTPATSNNA

SEQ ID NO: 6123 - protein, 338 aa, Proteus mirabilis
TVNRRHFFKLASGGVLLAGMAPTASHAAAQNRPPIPGALGMLYDSTLCVGCQACVTKCQEINHPEPMERGDTYANGDPIWSNNDKLSPYTNNIIQIWRDGTGENKDQLENGYAFIKKQCMHCVDANCVSVCPVSALTKDPKTGIVHYHADICTGCRYCMVGCPYNIPKYDYDDPFGKLYKCELCNQKGVERLDKGLLPGCVEVCPTGAVIFGTREELLEEAKRRLAKKTGEEYHYPRQTINGGDTYLHKIPEYQDHIYGEFEGGGTQVMVLSAVPFENLGMPEVAPLSTGARSEHIQHTLYKGMVLPIAALAGITYLVNRNSKKQEQEHHKEDNDVES

SEQ ID NO: 6124 - protein, 2777 aa, Proteus mirabilis
TMGRFKKININDDIERITLEIVKYIKEHSVELPFNIESVRRVLIENYIYILTYKNEYAANDFLIKIESNLSLYNRDKFTKAIDFIVKEINASIENLFVNNSYLTNKNYQKLNKTRINSVFQHYPSGFFHLKIENKNLFIQIDNTNQLFKIIDFEGTVEFFSKKDDLIHTINQMVKNSVADNSISYRFYAKNEYFNFFTLDKYWQVTPKDIYAEVINDIKAKKQVHIDSHLTIELIDSYSYKNIFIVRDSNENSEKILHIYLNNIDEAFLIAVAKHRQLKENGEHLLYKLNKDWFFTKMKDKSVKYFSQTSDLLIPLEKIMGRINLVASAENNYNFSHFDPLSGVCYGISLKYLLEVRNNGIEGGNKYLHWLKENINLYKDKKEKISDKLEKIIFDSVQEYEVLKLIKEIKEIKFAQIFQMERIYEKINYTIFDLTKATEYRKILAENGLKASNANRLESSLSQINYHLEYIMQYYNEYYAIIAFKTHAIALAYKRYSNNHYKFTLFDSNSELTEFSNIESIKDALIKTMGSYTLNKADGKEYFIIDEYKRNPTTKYRSLWDQNEIELHKGIAENIKKIGFSLPFKDGVVGRVIHYSEQRDLILELKINSKLVEVVAKNVFVDEGIFLVKNNLDKILENNKSSKVIIMSNSDGIDIQFTEFNAHQKMSKPKGYLEFNDVYYRDLIKINSYLLNGKKSFSLNKIVSLIDTLRGNIYFDKITASFSIIDEIILFNQNNENISLVDILNQVKQKIEDKLFYSDLLYGKEKLIALAQKNSLVAAIFYRMMVNEINEGYTGISNFIYEQIIDNPFLILDKNRNVGVVGYDYTINFKNNYKALKEIIDGIDISEIKNIFLLDDENRLHLKVTYQRLSEYRNNKYVNKLLHLIEDEIDSIKKIDNTGIYRDLYLEFFSNHQFNNRVIIHEIAQLESYFNNNYQERNHGYHPSNFYINENDPLTLLEKSFNQNKNEIDGSYLLFNESKENFYFLFVDNNFITRDFVDNIIIESISGVYQDDIVIYFYNGVKSEQLTQYLKDKPEIGRFLDYCLKHEIRVIAAGNEEYFPATNALVKQKSRVESLQNVILQHQFVGERTIVFANKETLFSYQSGHLFIEGIAQRLNMPIYTVTDNSVILENEYIMVKPTTESQFIGHPLLADTGASNTLLTETVPNEPNTVSNRQRVDIENKNYAAEIYQFVSHNYTNYRDNQEFKLGYQNEISTIFPDYSDNMTIADILNYIQLNRYQINYAQLGAIIRKVDQINLKYHKEKLAEFSDKIINHDLLIDNAIEKYLVELSAIFNTSDNSLIKRNLIQSLYDPSVNKEFNQFLMDGTNFEQWQEITNKDYGNYSLTERTYQVIEIIHAIYDTPHLIDNLSELSKNRLNAFFDEGNKGILSRVLLSKISSFELYKETINNLKKLAVISQSDEEISALSPVEALNKLNEFKGEVNLATSEDSSTISSKVEINNLVIDKRLLCYLGAKINGESIDAIDLNQIENWDKKITFDPQHLNDYFLSVTGNEKDKEVIALLRYLLNNKQDKIKYFLSHMSSRADYVAAHERLMKIIALGSKQYNQQDWENLRIPSLKIPRHMRVISKIGYANISFGIWQSINSTFMLAEQLNNPLLTPQEHRETINYLAITWSEMAYNGLSELIEIALAKGLLKYRNNPLEYISKTSTRIGIGLNILSIGFDIYNIYDNFSRISVEKNEKRRIDYIVNGSLAIVSGLVTLGVSIAMLAGSTVAGPIGIVAGAVIALAISIYNAARLIEEAKEKIGFTPLEELNNGFYAFLMGDILPSKKNEIVYLETISQLETMIAQNAQEHLKEIKKQEPHSYYFYSNEKQLYEEHHYYKVIPRILGKTLDNILNPFGEIVVQRVAKNLSKEEAEKIAALSHYLSVERTEYKYYVPKEAIATDEILIFDMDFYVNQLNRYTINFAFEDDNPVFEDEVDISFFDKIRTTKEKTWQNLSSGELTDDLIKSTAEKQYFEPSWRENELFYFNTYNGDDIIAAPLITQNIFDVHNGTKRLSGGEKDDTFNVFTSESPRYASRFYGREGNDTLRIIQTEKKYIGYEVNLSKNYIKFIGGENKSNSQSFHARLFIFQEQGQIYTHKLADTMPNITLQKQPVIAYLESIENVVGSEIGNDIIYGDQKNNYLNGMGGVDSLYGLAGDDTLVLREGYAQGGAGNDSYTILRASNTDNNVKQLETIIDEETHTEASLIQLNYTFDEITAISRRETDIVFTLKVSNDKDPDQFIEHLIALSHVYQDKNSQLLAHRYTIVTMDGFILTINENNNQPREVSYNFSYLEKYNQQEKLQQLSINDDKHTLSIQSENKTKLIQLLPELQYSGFSSGEHLKLNLQGNSENNHYAGIAAHSSIKLSRGYDNYQISSLLAKNRNEKIIISLSDNDKQLTSDCTSHFFLSDVSGFDLMFSDGVLSHRYNPDAHIKLVFDTESVSAIFNSGMTLQFIDKDNRVFHLPKPDSGQRLLIPTITLDVRLSHQSDVLMIPPSLRLNKEALSLYPQYFHREEPSSRSTQLQRIISTQTLEPYPLKVTELLRDDIAVNDNQPVNSILSLNKLFSNRSQDIFSQAIDLLPMIELMDGDDIVVNHNQSSSVIDGGKGDDHIVVNEGHHILIAGEGNDNLNGGSGHDLFISTSGNDYLGGGSGNNVYVVQKRHGEVTVYDEGEMSHIFVSGLSEHEKLISSQAGKDKQYRTADNQFVLTVKTNRVEKIETDPVKVIEKEQTLSMGSLATIIQQMAQFNQQQLSTMQGSDVIPSSNWSPLAVVVKHL

SEQ ID NO: 6125 - protein, 399 aa, Proteus mirabilis
MGILIMKSLKPLAALVGLLVLSGSANAVNVYNDKGTRFDVNGQFRLKTQVTSQNHEMKMNDDGSRIGFFGSHELTNDIKVFGKLEWGSDTQKTNSDNPKSNFEMYNRVGYVGFSHRDYGQIQFGRTYIPIDWVKKSSYGYGNTGVFYFSDVLGRAVGYSNGYADGKGVGKNNFMTRLPQTIFIETNRYEGFKLAGTITGKTGDDNTRTTGDITRAYSIVGFYKSTFGLEFDAGYSAAKGEATHSSKSTVRGKTPENSILAFGAEYFFPGREFSIGIDYGQSRGKNSGLTLASNASEKDYRWNSVKGDWKANLYGVGVKWHWDRIESGMYAGYYLRDGDANTFNYKKETYTVGVDKRFAVSKYNNLRLFAEMAYDDARSENPAYEDKKQYIFETGMRLYF

SEQ ID NO: 6126 - protein, 223 aa, Proteus mirabilis
INFSQNRGIMARKTKRQAQETRQQIIDAALRLFTVQGVSATSLSDIATEAGVTRGAIYWHFKNKVDLFTEACELTDLKIESLELEYQSKYPDDPLFVLRELLIYILTSIVEDPKHNALLEIYFHKCEFVGEMTPIVEIRRELCAADYSRIEQSLFRCIEKKQLPVNLDLRRAAIMLRAMMTGLAENWLFSPESFSIKEESQYLVDSFIDMIKHSVNMRISALS

SEQ ID NO: 6127 - protein, 267 aa, Proteus mirabilis
RSYRNRKRREGMIQLYWVALKTIWIKEVTRFGRIWVQTLIPPVITMSLYFVIFGNLIGKRIGDMGGVDYMQFIVPGLIMMAVITNSYANVSSSFFGAKFQRSIEELLVSPVPTHVVIAGFVGGGVARGICVGILVTLVSLFFVPLEIHSWTMVVVTLLMTSIVFSLAGLLNAIFAKTFDDISIIPTFVLTPLTYLGGVFYSLSLLPAFWQGVSKLNPIVYMISGFRYGFLGITDVSLTVTITVLCLFIAVFYIVAWYLIEKGRGLRS

SEQ ID NO: 6128 - protein, 312 aa, Proteus mirabilis
GRYRMTNLRTVSKHPEQLETTPLVAESHHYDDPLAPQKLVFLKAVNQQRCVINSPQRNSQLTNTIPFFIVLLVMACYTLFNFMEGHIGAKAELESMSQYLFENNKDINALNEIERKSILKYQPFWETEKISWWEYIKAYNSGEFFIDSQYDKYLVIGWLIFFPGFLWLFGYLSFFTPPVYLIADRQRGMLYSYGMGKVRLTRYKEAQFGYAGNMLAIKLYSINEKTGQLKTILYRPNVSHYSSFLTSTDSENHRFITFLNAYMQQGRDAVSPVDYQARKPFLSFGKNPLPADFEQQVEQILAKLDQEKKHHA

SEQ ID NO: 6129 - protein, 168 aa, Proteus mirabilis
RGNSMSELNWDITGYDEPPIELLESSFREIAKKEMQALPFYRENIPVKAGGFTLFEKQWIGTILTPWMLELIVLPGPSQEWPRRKIGERIALALPCGQVKFVVGELANGAQYLACSLMSPLDRHLQGEQAVELAENSAKMALSLPVQTQSVTEVDLSRRSLFRGQLRS

SEQ ID NO: 6130 - protein, 1267 aa, Proteus mirabilis
MKRLSKSLLLITLFCLIIFAVVLSGFRYFLPRLDNYRPEIETYLSKQFNSPVTMTQVKGEWQNFGPDIQITGLYIDNNSVEVSAEQITFSFDVWRSLLHFQLYFRELTFEQLAVNYKKPIFTGQNGDITFTEPDDISSIFLKQFDRFKLVDSRFVFLSPSGDTSTLHIPELMWLNQKNRHRAQGEVTLDTPINHYGGLKVRLDLYTKKQGALDKGQVFVTADEVDISPWLSQWVKSNSGLGEAKASLSNWIEISNGRITGSQLQIHQGEMDWRNEGRTHVLKVEDLILRMRRQENGWLADIPYTRKITMDGDEWPDGYLAVLYQPKEKQQDEAWRIRAKNIELERLSALLPLFSFLTPDVVRQWQYRQFSGMVDSFALDLAPDDFKRSAIDISWQNVAWKRWQEIPSVAHFNGHLKGTLQQGALNFALNNSEIDTAGLFKAPLNIEKGTGTVYWQHQGDSLSLWSQGIDIKATSAWVAGDFRYQKQGEHQQLSILSGVNVTDAGETWRYLPEKYVGKDLTQYLSDAIIAGNVKNGTFIFHGDPRDFPFEQHNGWFQVYAPVKQATFKYDSEWPALFDLNVNLNFKNNGLWMSSDNVQVGKATAKNLTAIIEDYNKEKIVIDADIEATGDDLKEYFLASQMATIGHTLEILKVAGKINGSLHLDIPFDGEQVVASGQVNLNNNDVTLAFMDTTLEGVTGQFRYHNDKLESDTLTANWFGQPLTFSFAGGDQRDAYQVGVDLKGQWDIGKIKGLPNDIQHKLSGFLPWHGAVSVNIPETADVNYQVDLTGQVNALQSQLAAPSTDDFKNASPIVISAKGNSEKLNVSADAQDQWSLNSEWALGEPLRLLQGNLVSSSLTLPQLNDQSRLTIALQGLQGDKWLPTLMAFSSLAPSENAIRFPTNIHISLPELNFAGQQWIAPQTEIMRADDGVKLSFSGSELRGDLFVPNTAQPWQVNITYLYFNGASPTEENKSLKMANVPDAKKAVQFSLKDIPAINFACQECWVNGLLLGNIEGAIQPRDGALLLTAGKLKNSSGELSVSGVWSEDSLGNSITKLAGKLTAPEVDEMAAYFGYIIPIVQSPLTADFSLQWHNTPWNFDLKTLNGEVNASLGKGRIEKVDVGQAGKLLRLVSFDALLRKLQFDFRDTFSDNFEYDSIKGDLTIKQGVLNAKSVAVDGVIADIAIKGQVDLLARKMDLQVVVTPEISATVGVATAFAINPIAGAAVFAASKVLGPLWSKISVIRYHVTGTVEQPKIDEVLRQLKEDQAL

SEQ ID NO: 6131 - protein, 80 aa, Proteus mirabilis
HIGRLCFINKKATNFNYLVCKVVKISGFYFLYNNNVGECRCHSPDDYFALIARPSSRCLREPTSFTKCFIFIELRVYVSS

SEQ ID NO: 6132 - protein, 712 aa, Proteus mirabilis
ITLRSERIIMITNKHFLALTIAASLIPDFVSAEERIIVNAERVNPQTKGRLSQQANIGLLGNKDIQDIPFSIKGYTSKYIEQRQAKTLGDVIKDDPSVQVTSPSGGILDSFMIRGFPIGEGNIGEVALNGVYGVAPNYQLLPQYLERIELLKGPGAGLYGISPNGGVGGVVNAVTKRPTRQGTKQITTTWGSDNQLGAYIDVGKLWVTPDGEMWGVRFNGGGSGGDLALDNTHKKTALGALALDYGKDGFTVSVDLFDQYQYVKSPNRPFIVLAGIDVPKAPNGRRNIAQKGMWWNTRDQGVLLHSSYEINDNLTLFMNAGGGRSIVSRISEQTPKIINDNGDVESAITNYRFNVHRYIFETGVRSYFSTGAIDHQMTLQASYYHDRLAVAGNVGKQKVISNIYSPSEVDVTLPSSPASVPKVSSSQLTSFAVSDTMTILNGSVDIIPGIRLQRVQADNFMANGQRLATYDESAVTPMLGLVYHPLESVSLYANYIEGLSKGDIAPSFAKNAGQVMRPYRSRQYEVGVKYDNAGIQSSLAFFQITKPSGAIDSTDNIFNANSEQRNRGVEVNLSAQVLENLQISGNLSLIDAELIKSPKSDIRGNKPVGVSPLQANVGVEYDLPILHGLSLNSYVNYSAKQYVNQANTQSINPWTTVDMGASYKTRVYGAPTTFRFDVQNLFNHHYWSGVASYTTIAQGAPRTFLASVSVDF

SEQ ID NO: 6133 - protein, 955 aa, Proteus mirabilis
LSISKNKHEKYSFLQVRIILISPSYLVTKIIKSMNGIGEMRINNKKRPLKRSLLTLLITATVAAPYSYAATLSVSLPEQSLADSLNTIAKQGQVQILFDANAIKNLRAPALSGQYETHTALQKVLIGSGMEIISQGNGFVIRPLATSSTIVIPEVKVTGVGSSYHPATDVVSAPQYITSEEIKQRNTGDGNVTDLLKSNPAVQFANNDSNSMNQGEIKPSRISIHGSSSYQNAYKLDGVSFNNDFDPANSGNGETNTRITSDEQGMYLDSRLIDSVTVYDNNIPVEFGGFTGGTVEVQSRRWSGETHANAYYRTTRSSWNNIFTDPKLKFDTANNDFSNPARFQKKYDKQNYGGWFETGLTENTGLIFSASRRESTIPMMISAEGGIVHTPEGALEHVLQSPHYRDQTRTSDNYFIKYSWNISDKQSFDLSSNIARYKSYLFSSSVYNSGYDNEHNGLSFTALYKHQLALGTLELTAGYQNLEDKRTNDQDYFIKVEDYTDWQHPDQVSSGGQGDLRSKQETYSAKSIMRFDPIVWGTVTHRPTTGFEISRTKGAYIRDKTYYNYTYRGMTVNDEWMGSLSQTTRFLAGTHNASYTNYSFFIDDNIQYKRLTLRPGVRLDRDDFVQKNNLSPRLSATYDIWGTGNTLIIGGVNRYYGRSMLTYALYGAQNAGLQHCYFDCQTSEEKWTNRTDFDGVDSLKTPYNDEFTLGLQQEIASTTWRLQYVHRNGRDEVRSDTKYPDSTIDEKRAIRHFNNNGRSTHDTLTLSVRNSQPWELAKADHVFNASISWQKSKTNTPKDSGYANFDPSVQGMNYDKVWYGGKIINAKDLPSDNFNSPLKVTAELTSVWDEVGVTWFNRLQWNGARSQAEKANNGAPKPSEYGPLFEYKKRHYSSRFTWDTKLSWQPEFAYGVGISVEVNNVLNTKNVNDYITYQDKEYKSYEPGRQFWLQVSYDY

SEQ ID NO: 6134 - protein, 62 aa, Proteus mirabilis
PKPRTPSIGFLYWFFLSTHEQFLSLKPLHHTLRVKKPNIVAIFPSYPTGKLSNCYSARIYTR

SEQ ID NO: 6135 - protein, 230 aa, Proteus mirabilis
SMARRILVVEDETAIREMICFVLEQNGFQPIEAEDYDTALSFLIDPYPDLVLLDWMIPGGSGIQVIKQMKRENNTRDIPIIMLTAKGEEEDKVKGLETGADDYVIKPFSPKELVARVKAILRRLSPMSAEDVIEFNGLSLDPVSHRVTSQDKPIDMGPTEFKLLHFFMTHPERVYSREQLLNYVWGTNVYVEDRTVDVHIRRLRKAIEQDGHDRMIQTVRGTGYRFSARF

SEQ ID NO: 6136 - protein, 624 aa, Proteus mirabilis
FPQREKGTAVLNRYPLWKYLMLIFAILIGLLYALPNLYGEDPAVQITGARGTAANEQTLDQVRSLLDKEKIEAKSIALENGAILARFSNPDIQLRAREALLPALGDKFVVALNLAPATPKWLEAIGGEPMKLGLDLRGGVHFLMEVDMETALGKLQEQNVDSLRTLLRDEGIPYSSIRKTDNYGVEIRFRNADDRSKASDYLARRNQDLIFRNGDNNSLKAIFTDERLRDARTYAVQQNITILRNRVNQLGVAEPLVQRQGADRIVVELPGIQDTARAKEILGATATLEFRLVNTNVDPSALETGRIPGDSEVKYTRDGRPTILYKRVVLTGDHITDSTSQADEYGQPQVSISLDSAGGSIMSNFTKDNVGKPMATLFVEYKDSGKRDENDRAILVKNEEVINVANIQTRLGNNFRITGISNANEARQLSLLLRAGALIAPIQIVEERTIGPTLGLQNITQGLEACLWGLIASVAFMIIYYRKFGVIASTALLANLVLIVGVMSLLPGATLTMPGIAGIVLTLAVAVDANVLINERIKEELRNGRSVQQAIHEGYKGAFSSIIDANLTTLITAVILYAVGTGSIKGFAITTAIGVATSMFTAIVGTRAIVNLLYGGKRIKKLSI

SEQ ID NO: 6137 - protein, 116 aa, Proteus mirabilis
LLQRETIMFGKGGLGNLMKQAQQMQEKMQQMQEEIANLEVTGESGAGLVKITINGAHNCRRVEIDPSLLEDDKEMLEDLIAAAFNDAARRIEETQKEKMASVSNGMQLPPGFKMPF

SEQ ID NO: 6138 - protein, 179 aa, Proteus mirabilis
VMQSKKIEVWVGLFVVIALIAVVFLSLKVADIKEVGNQPTYRVYASFGNIGGLKERSPVKIGGVVIGRVASITLKEEMEGNYRPEVALDILNIYDHIPDSSSLSIRTSGLLGEQFLALNLGFYDEDLGSDFLKDGGRITNTHSAMVLEDLIGQFLYKTGDGDGKTTSDSKTQTEQPALP

SEQ ID NO: 6139 - protein, 106 aa, Proteus mirabilis
  UNSURE (87),(101): Identity of amino acid at the above locations are unknown.
INKRADRTMFEQRVNSDVLTVATVNSQDQVTQKPLRDSVKQALKNYFAQLNGQDVNDLYELVLAEVEQPLLDMVMQYTRGNQTRAAXMMGINRGTLRKKLXKYGMN

SEQ ID NO: 6140 - protein, 645 aa, Proteus mirabilis
KIKRAAYLLFPYYKSLINRHHMSIDIEKYPTLALVETPEDLRLLPKESLPKLCDELRLYLLNSVSRSSGHFASGLGAIELTVALHYVYKTPFDNLIWDVGHQAYPHKILTGRRDRIDTIRQKNGLHPFPWREESEYDKLCVGHSSTSISAGLGMAVAAEQENLGRKTVCVIGDGAITAGMAFEAMNHAGDINPDMLVVLNDNEMSISENVGALNNHLAQLLSGKLYTTLREGGKKVFSGIPPIKELLKKTEEHIKGMVVPGTMFEELGFNYIGPVDGHDVIALVQTLTNMRDLKGPQLLHIMTKKGRGYAPAEQDPISWHAVPKFDPKTGTLPKSPNARPTFSKIFGDWLCEEAATDEKLMAITPAMREGSGMVRFSKEYPAQYFDVAIAEQHAVTFAAGLAIGGYKPIVAIYSTFLQRAYDQVIHDVAIQKLPVLFAIDRGGIVGADGQTHQGAFDLSFLRCIPNMIIMAPSDENECRQMLHTGYHYQEGPVAVRYPRGSGVGAPLQPLSELPIGKGIIRRQGKSIAILNFGTLLPEALDVAEKLDATVADMRFIKPLDKELILSLAKQHDILVTLEENAIMGGAGSGVNELLMQERCLVPVLNLGLPDLFVSQGGQEEIRADLGLDATGIEKSIKAYQAHSLS

SEQ ID NO: 6141 - protein, 156 aa, Proteus mirabilis
FGKRGEVNMEYDVVLYPIALLRPSEEVNMAHVEALTKEIVRCQRWTTPIPIEKETGIIMDGNHRYQVAHHLALTYIPCVLLDYTDTRITVYDWQNGRAFSPLRIREQILKQGNIFPYKTTRHLFSPSLPAVNFPLEQLVEKIASNHLNVFKLGVGR

SEQ ID NO: 6142 - protein, 68 aa, Proteus mirabilis
TYERIILQAGTEKSVYSTNHNKQRQGAIRYLVKSGHVNNHKGTIFYVTFPNWSRKKLHKNGLIKTINA

SEQ ID NO: 6143 - protein, 137 aa, Proteus mirabilis
SHMSTLIKVYGFHLDVFEHVNNARYLEFLEQARWDWIEQHLDLAWFKRHGLALVVANININYRLPANLGDELIISCDIAEVGIKSGVLSQKIVRKQDGALISDALVTFVLVDINTKKALTLTDQLREKLEYVRQSAD

SEQ ID NO: 6144 - protein, 138 aa, Proteus mirabilis
SIMSDTQRPQGPASGVLNSLSRIGAVIVGMVETRLKLIAIELEEEKITLIQLILMAGITLLLTAFGLMSLLILLFWVIPPEYRIHALAITTAILLVGALIGAIMTLRKARNSTLLGDTRQQLELDKRLLEQYRDEQTK

SEQ ID NO: 6145 - protein, 362 aa, Proteus mirabilis
HSMSENRASKQHSSKTTKAKVVKEYQRQILRRFFYLMILGGVLCSVLILDFTLGPSGLSLTELWNTLISPEIADAGTRVIVWDIRLPYSLMAVIVGMSLGLAGAEMQTILNNPLASPFTLGVSSAAAFGAALAIVLGIGIPGVPAQWFISVNAFIFALLATLLLDFISRWMRVSTSGIILFGIALVFTFNAAVSIMQFIANEDTLQGLVFWTMGSLNRASWDKLYILLVVLVIIFPLSLMNAWKLTALRLGEDRAMSFGINVRRLRLTTLLRISIISALAVAFVGPIGFIGLVAPHIARMTFGEDHRFYLPASALIGALVLSIASLVSKNLLSGVIIPVGIVTSLVGIPFFVSIILRHRGRI

SEQ ID NO: 6146 - protein, 320 aa, Proteus mirabilis
IISSACLPFSRRKMMKITVLGCGSIGKLWIAGLTQQAHEVQGWLRIPQPDFDVNVDSINGIPFQQRIIANQKTWLQHSELLLVCLKSWQVSDAVNALIPHLSADCPILLIHNGMGTLDELTLPETPTKRAILQGIITHGAYQQDQKVLHTAEGITHIGPLNTTARQYGYLAEILHQALPDVAWHNDIHTISWLKLAVNCVINPLTVFYQCRNGDLLKYPEHIQKVCDEVYQVMEREGVIPTSRSHLHGYIIDTIEQTANNYSSMYQDVKYQRHTEIDYITGYLLRRASEQGLVLPENKRLFQFIKQKEGNYDHIRTHLSS

SEQ ID NO: 6147 - protein, 214 aa, Proteus mirabilis
NMTSINSFNLQEYIMVLVTRKAPDFTAAAVLGNGEIVNDFNLHSFIKGKPAVIFFWPMDFTFVCPSELIAFDHRFEEFQKRGVEIIGVSMDSEFVHNAWRKTAIDDGGIGEVRYPMVADIKHDIIKAYGIEHPEAGVALRGSFLIDKEGVVRHQVVNDLPLGRNIDEMIRMVDALQFHEEHGDVCPAQWEKGQEGMGASPDGVAKYLKANSGKL

SEQ ID NO: 6148 - protein, 639 aa, Proteus mirabilis
VLQSHYLIIVKVEIMNVKEIIRHEPFGTLLGYAPGGVAIYSSDYSSIDKEDYAANDSFRSYIGNEYMGHKWQCVEFARRFLYLHYGVVFTDVGMAYEIFSLRFLRRTIDDDILPLQAFANGSKQPPTVGALLIWQEGGEFKVTGHVAVITEVLEDKIRIAEQNVIHTRLPRGQQWTRELPLKVSDNGYFIEDTFDNTTLLGWMIQTEPNAYSLPQPKVAPELLAIHEAKLANKGQFAGKWLDESDPLEKAYVLAQHGHTINQDSYEYFTISESAEHELIRASNEMHLMYLHATEKVLKDDNLLRLFAIPEVLWPRIRLSWQNRRHQMITGRLDFCMDERGIKVYEYNADSASCHTEAGLIIEKWAKQGGIKAGYNPGERLLDALSDAWKHSDAKPFVHILQDDDNEEDYHARFMQQALTKAGYSSKILRGLKELHWNSRGQLIDGDKRIVECVWKTWAWETALDQLREESEQQSLIPIRIGDPAGEVRLVDVLLRPEITVFEPLWTLIPSNKAILPILWQLFPDNPYLLDTEFTLTPRLSQSGYAVKPIAGRCGSNIGLVDHQENVLGETSGQFEHQENIYQELWCLPKVSNRYIQVCTFTVDGHYGGCCLRSDPTLVIKKDSDIEPLIVLEDKHFLAD

SEQ ID NO: 6149 - protein, 500 aa, Proteus mirabilis
QHKRIHRITMKQSLQLRLSQQLAMTPQLQQAIRLLQLSTLELQQEIQQALESNPLLEQEDDQADVTHSDSSSTQESDDSTPDNERDNEVLDTLDALEQKEMPDDLPLDTQWEEIYTAGTPSGTSNDYAADELPLYQGETTASLQDYLTWQADLTPFTDTDRAIATSIIDAVDETGYLTVSTDDILAGMGDDELELDEIEAVLKRIQRFDPVGVAARDLKECLLIQLSTFPTNTPYLKETELVIEHYLALLGNRDFRQLMRHTKLREETLKVVIETIQSLDPKPGLSIDTEESQYVIPDVLVKKSGEHWQVELNTDSIPRLRINETYAALGQSAQNESDGKFIRDNLQEAKWLIKSLESRNETLLKVAHCIVDTQQAFFEFGEEHMKPLVLADIAEQVEMHESTISRVTTQKYLHCPRGIFELKYFFSSHVNTDNGGEASSTAIRALVKKLIAAENPAKPLSDSKLANMLAELGIQVARRTVAKYRESLSIPPSNQRKELV

SEQ ID NO: 6150 - protein, 345 aa, Proteus mirabilis
IRKRVKGQLMRNLTASIILAIGLTGSAFADTTPAKQTEQPATTATSSTASTQGTATTTIAPTAENTATPTGEAAKTATSETPVAEENTSTSTGDAAQTALEPENATQGATPEIVTGGGFAEDLSVMGMYRNADLVVKSVMIGLLLASIVTWALFFAKGSYLLALRRRLRNESAQLVEAKSLKEALAISQKFGNKSATADFFNDAELERTYSQESHVASGIKERVEMRMERRVAAIIRELGRGNGYLATIGAISPFIGLFGTVWGIMNSFIGIAHSQTTNLAVVAPGIAEALLATAIGLIAAIPAVIIYNIFARMISGYRGEIGDIATGVVTLVSRDLDIENSKSR

SEQ ID NO: 6151 - protein, 400 aa, Proteus mirabilis
IVRSQNMCSTCGCGEGNVSIEGVAPHSHDHHHHSHDHDHHDHGHHHHGHHHHHGHDHHHEHNATPANTVHKYIDKSEQKHKHNYETHGQPIIIHHHHYHNSGDVHLHFYHDAQQNEAQVFHEHHHGHDDHHAHSHEHTHSHEHEHSHDHEHSHEHEEQFSPVIDNDNMHYGQGEAGTHAPGISQKRMLKIEMDVLDKNNRIAVHNREHFAQQNVLALNLVSSPGSGKTTLLTQTLKQLTQRVPCAVIEGDQQTTNDADRIRETGVAAIQVNTGKGCHLDAQMVHDATHQLGLKDNSILFIENVGNLVCPASFDLGEKHKVAILSVTEGEDKPLKYPHMFAAADLMIINKIDLVPHLNIDVQACIESARRVNPNIEIIALSATTGEGMEEWLAWLESRLCA

SEQ ID NO: 6152 - protein, 93 aa, Proteus mirabilis
NIFGSWNLANIKSAKKRAVQSEKRRQHNASRRSMMRTYIKKVYAAVASGDKEAAQKAFNDMQPIVDRQATKGLIHKNKAARHKANLQAQIKAM

SEQ ID NO: 6153 - protein, 315 aa, Proteus mirabilis
KMFGSSNVILRNKRLSSYQLARLHTFEATGRHLSFALAAEELSLTPSAISHRINTLEKELGIKLFNRFHRRIELTEEGERIYWALKKTLEDINQEILDIYNQEISGVLTVYSRPSIAQCWLVPRISDFTQRYPSIELNLLTGNDDINFRGYGIDLAIYFDDKHLKNLYCEDLISESIIPVCSPEYAARHELVGNIHHLANCTLLHDRQAWSNNSDFDEWRAWSEYMGLGLFPNKSNICFDRSDLAVIAAVNHSGVAMGRKRLIQKQLANNELIVPFDNCEFFCAQRYYLVTRDEKSNAKVQLFIQWLKKQILQGM

SEQ ID NO: 6154 - protein, 944 aa, Proteus mirabilis
RKLGTENRMSDYKNTLNLPETGFPMRGDLAKREPEMLSRWYKEGLYQAIRQAKSGKKTFILHDGPPYANGNIHIGHSVNKILKDIIIKSKGLSGFDSPYIPGWDCHGLPIELKVEQIVGKPGEKVSAAQFREECRKYAYEQIEAQKKDFIRLGVLGDWDKPYLTMDYKTEANTIRALARIIANGHLLKGAKPVHWCTACGSSLAEAEVEYYDKTSPSIDVRFRAVDSNAVAAKFGVVTDKPISLVIWTTTPWTLPANRAIALNGEFNYALVSFNDECVILAADLVEHVMKRIGVTDWAVLGECKGSDLELLRFNHPFMGFDVPAILGDHVTLDAGTGAVHTAPGHGPDDFVIGQKYGLEVANPVGPNGCYLPNTYPTLDGVFVFKANDVIVELLKEKGALLHHEAMQHSYPCCWRHKTPVIFRATPQWFIGMDKNGLRQQSLKEIKGVKWIPDWGQARIESMVENRPDWCISRQRTWGTPMSLFVHKETQEPHPRTLELMEEVAKRVEVSGIQAWWDLDIRELLGDEADDYMKTPDTLDVWFDSGSTHSTVVDARPEFHGNSADLYLEGSDQHRGWFMSSLMISTAIKGKAPYREVLTHGFTVDGQGRKMSKSIGNTVSPQDVMNKLGADILRLWVASTDYTGEIAVSDEILKRSADTYRRIRNTARFFLANLNGFDPAKHQVKPEEMVILDRWAVGRAKAAQEDILKHYENYDFHNVIQRLMQFCSVEMGSFYLDIIKDRQYTAKSDSVARRSCQTALYHIIEALVRWMAPIMSFTADEIWAQLPGERAKFVFTQEWYTDLFGLEASETLNDEYWAELLAVRSEVNKVLEQARTDKQLRGSLEAAVTLYADKALAEKLNALGNELRFVLLTSQATVADIHDAPENALASDMAGLKIVLSKAQGEKCPRCWHYATDIGQVAEHADLCGRCVTNVAGNGEERKFA

SEQ ID NO: 6155 - protein, 589 aa, Proteus mirabilis
NITGYSMLSSIFVRFKTGLSYTAILSALIMSGCTLTGQQQQPLTPAEKAQVEMKQFQKVIDDANGQASLDVIRAYIGLEPLITDPVLHQQNIDDTWLTLTKLTPEQRRSVVIKADENTLQGWLDLLNTYEYNQDDAGKLSQAIREWQTRYPRNPGALTLPTLLLRQSQSAVSNSGKIALLLPLTGQAKVFGNAIMQGFTDAKEGLPQANAAPEAPQQDSLASILAELGISSPNADTATTENDNTAEGAENSDATSAKETEAFAGNSRVQLDPIVQNNRQVIMYDTNSQPIDLLLKQVQQEGADLIVGPLLKPEVIKTIELKSGLPVLALNEVDNIPLATTVCFFSLSPEDETRNAAQHLRQQQKSNPLIIVPDNKFGQRMAQTFADEWQRSGGGTVLQQTFGSLDSLKSSINRGVGIRMTGTPVLPTDNAPLPLDTASMPTTNGAIDSVYIIATSDELTLIKPMIDMAISTKKRPPIYVSSRSNQGGMGPDFRMEMDGIQFSDIPLMTGANLPLMQKASSKFANDYSLMRLYAMGIDAWSLANNYNELTKGTLQFNGVSGSLRVEDNCTIYRQLPWMQFKQGKIEPVGQ

SEQ ID NO: 6156 - protein, 88 aa, Proteus mirabilis
ADYGNNVSKDYCFKHSKNLFKLKKTPAGGGEISAIKSLKSTQEKNTFSVDYEQFGNGALDTQLARSKYELNGRMGTIKKSSYLGICAI

SEQ ID NO: 6157 - protein, 483 aa, Proteus mirabilis
HGYGSSIIRRIRSYNVTISRGSHCLCWSCQYQPYGNRKTYCTGYDYRRHRCCVIHVISGEMIMSVSLEQLIKWRREFHQYPEIGWSEFLTTAKIVKVLRGLGLEVKVGPEVINQDFAFGRRRQVVEKGLAVARKHHVDEALLDEMQELTGCVAIFDSGKPGPTVALRFDIDCVGVTETTETQHRPQVENFASCHPGEMHACGHDGHITIGLGVAHWLVDNKDKVSGKVKILFQPAEEGVRGARAMAESGIADDANYFLGSHLGFIANSGEIVLNPTHFLCTTKYDFRFKGTPSHAGAEPELGRNALAGACHAATQMLGISRHGKGMSRINIGVLKAGEGRNVTPANAEMQIEVRGENEEINSFMAANAVRMAEGAAHSFQLEMESEVMGEAVDLTNDQELIDVMAKVVGKHPELTAIPTRPFGGSEDATVLAKRVQRCGGKSLYFIVGADRTAGHHQAGFDFDEQQLMTAVNLYTGCLEELLK

SEQ ID NO: 6158 - protein, 349 aa, Proteus mirabilis
KKCGQANRAHKPPWIMRLNGEMNNYADLNALSKVFGIRRTSISVRLLFCQISGYSMASQSVYFKQKWLPIALIFPQLAITLIFFIWPAGQALLQSFQLEDAFGLSREFVGLENFQRLFNDNYYFDSLITTLIFSTSVVLLSMLSAVILAGIAEQILRGKLFYRTILIAPYAIAPVIAGFLWLFMLDPTIGVLSRVLNKIGINWEPVLNTSHAMWMVILTATWKQISYNFLFFLAALQSVPKSLLEAAAIDGSGPIKRFITISLPLISPTTFFLLVVNFAYAFFDTFPIIHAMTQGGPGNSTSTLVYKVYNDGFVGLDLGSSAAQSVILMLIVAILTIIQFRYVEKKVAY

SEQ ID NO: 6159 - protein, 288 aa, Proteus mirabilis
EKGGLLMVERRPLFHAFCHLILIVGILSVAFPVWIAVVATTHQNTEFATGSPLWFGQEGIEVFKTLFSSAGTTQNSAITINGMLLNSLVMALVITIGKLVISIASAYAVVFFRFPGRMLAFWTIFFTLMLPVEVRIMPTFEVVTNLNMLNSYAGLTIPLIASATATFLFRQFFLTITPELIEAAKIDGAGPIKFFFTILLPLSRTNIAALFVITFIYGWNQYLWPMLITTDTQYYTIVMGIKQMVAVSDGVIEWNKIMATTLIAMLPPVFIVILMQRAFVKGFVDTEK

SEQ ID NO: 6160 - protein, 315 aa, Proteus mirabilis
GRYGMTRLRTVSKHPEQLETTPLVAESHHYDDPLAPQKLVFLEAVNQQRCVINSPQRNSQLTNTIPFFIVLLVMAFYTLFGFIENHKSNYFTLQYRSNYYNEKYGIDNLPKELSRYLPYMKVKEISIGTYLIDYYTDKIYKNDKFKILMIIGWLIFFPGFLWLFGYLSFFTPPVYLIADRQRGILYSYGMGKVRLTRYKEAQFGYAGNMLAIKLYGINEKTGQLKTILYRPNVSHYSSFLTSTDSENHRFITFLNAYMQQGRDAVSPVDYQARKPFLSFGKNPLPADFEQQVKQILAKLDQEKKNMRKIDKEGTE

SEQ ID NO: 6161 - protein, 315 aa, Proteus mirabilis
GRHGMTNLRTVSKHPEQLETTPLIAESHHYDDPLEPQKLVFLEAVNQQSCVINSPQRNSQLTNTIPFFIILLVMAVYTLYGFIENHKSNYFTLQDNSNYFNEKYGVDNLPIGLSNYLPYMKVKEISIGTYLIDYYTDKIYRNDKFKILMIIGWLIFFPGFLWLFGYLSFFTPPVYLIADRQRGILYSYGMGKVRLIRYKEAQFGYAGNMLAIKLYSINEKTGQLKTILYRPNVSHYSSFLTSTDSENHRFITFLNAYMQQGRDAVSPVDYHARKPFLSFGKNPPPADFEQQVEQILAKLDQEKKTMRKIDKEGTE

SEQ ID NO: 6162 - protein, 155 aa, Proteus mirabilis
RIDGDRSIMSENFHILLLNGPNLNLLGTREPETYGHLTLNDIVQSLSADAQALNVKLTHFQSNAEHELINKIHAARGNVDYILINPAAFTHTSVALRDALLGVNIPFIEIHLSNVYSREPFRHHSYLSDIATGVICGLGAEGYRFALQAAVNRLS

SEQ ID NO: 6163 - protein, 235 aa, Proteus mirabilis
SQSGLLYPQLGKIAEEAKSDKNIPGFYALLPMLPIIMAVSSSSLFVEGIHLDVVTIVLISMAICMLIETLRLRDFKSVCAGFQHFLKGMGSAFSNVVGLLVAAGVFAHGIKVSGAIDSLIVMAESVGLPPFAMALVFAIVTLAAAIIMGSGNAPFLAFVELIPQIAHSMGVNPIAMILPMQQASHMGRGMSPVAGVIIAVSSGAKLQPFDVVKRTAVPLMVGFVFHCAIIAIFYY

SEQ ID NO: 6164 - protein, 133 aa, Proteus mirabilis
LKIGNTTMLRTMLQGKLHRVKVTQADLHYEGSCAIDQDFMDAAGILENEAIDIYNVDNGERFSTYAICAERGSGIISVNGAAARRAAVGDRLIICSYVQIPDSDARSHKPNIAYFEGDNEMKRIAKAVPVQVA

SEQ ID NO: 6165 - protein, 291 aa, Proteus mirabilis
GGSGVMKKVNVALLQLCSGKNIKNNLAQIEQQIKQLPDSVKLVLTPENALLFSSAKDYHKHAEIQGKGPLQDAIANMAQRYKVWILVGSMPLISRDSPEQITSSSLVFDDEGVIRARYDKIHMFDVNIDDEQGEYNESAIYQRGERLTVVDTPVGKLGLTICYDLRFPGLFQALREKGAEIISVPAAFTRLTGKAHWEPLLRARAIENQCIILAPAQVGTHDARRTWGHTMAVDGWGKVLKKNPDAVSALTLNIRVDSLEGMREQIRVVKHNRFRPKLTHLIKKVKDKKEL

SEQ ID NO: 6166 - protein, 334 aa, Proteus mirabilis
ISAGDCKQIYLVDEINKMTNKLTSLRKLTTVVADTGDIAAMKLYQPQDATTNPSLILNAAQIPEYRKLIDEAIEWARSQSDSREQQIVDACDKLAVNIGLEILKLIPGRISTEVDARLSYDTQACIVKARRLIKLYNEAGISNDRILIKLASTWQGIRAAEQLEKEGINCNLTLLFSFAQARACAEAGVYLISPFVGRIMDWYKANTDKKEFAPAEDPGVISVTEIYNYYKEHGYNTVVMGASFRNIGEILELAGCDRLTISPALLKELSEAQGEVEHKLSFNGEVKSRPAPITEAEFYWQHNADPMAVDKLSDGIRKFAVDQEKLEKMIADLL

SEQ ID NO: 6167 - protein, 324 aa, Proteus mirabilis
MVQGAYMSVPSQENITLTKEDLRQLHVSSSLYRWFLRYFPHGGTYRAIHNELIKQRQTQWIESLIQYIYLRHFSQSSFAKQEQEVIENILSLLGNEKQTGVILQRLPYHQPQSSDENIQFSTEWHQLIVKSQQFNTALALCGRDNIVAFSGDENSIANTGYSNQLINSGFAGKISNTADQCRIGSLGGRSRICNSGNDVKIYASGQGAHIANSGIRNFINATQSRTKVTNTGDLAHITVTGDNAIAINTGDNCTLSVSGDNSVCISTGHLQQFCLGKGGSAVIAYHDGKRTRFNVFYEGENNIEAGIHYYLDEKQRPVAMDNIT

SEQ ID NO: 6168 - protein, 285 aa, Proteus mirabilis
VLKGNWRYIMSNPKLIQLSDGNTIPQLGLGVWQADNDQVIKAVHHALDTGYRLIDTAAIYHNEEGVGKALKQSTIPRDELFITTKLWNNDQSHARGALLESLERLQLDYVDLYLMHWPVPSRELYLDAWKQMIVLQKEGLVKSIGVCNFKEEHLERIITETGVSPVINQIEIHPLMQQASLRAWNTTHNIVTESWSPLAQGGEGVFDQPIIQKLAEKYQKTPAQIVLRWHLDSGLVVIPKSVTPSRIEENFHIFDFKLEKEEVAEIKQLDKGKRLGPDPDTFVDI

SEQ ID NO: 6169 - protein, 117 aa, Proteus mirabilis
REKGVCVIMRLTNNKPSTVSKPTMALWLIDDIAFALFVEEVTQLDEAWRGKSFGSMKKTSSAHNVQMINAPKFIQKKLSKSRMAPPAMAPANDPALVDTCNHAKSRVRCAMGIMAIP

SEQ ID NO: 6170 - protein, 473 aa, Proteus mirabilis
LLRGFHMSSLLNTYYRANESWQIAITQVLPPYIDPVIIRWLETSPDTLVHLTQIYGSPLNIVWPHTVEQNVNAMVEVAKTFGIQTNLYYGVKVNKSQSLLQAAVAAGTGADVSSLYELNDAIRAGCRGTELCATGPAKTTAFLQALIVQGARIVIDSLEEMDELIHLATRWISPSGRISILLRFRPESNHISRFGMSSAEIMTALEKLNYSDQVKVDGFHFHLSGYSSVSRIKAFFDTLPLISYARALGYSPYIIDIGGGLPVQYVDSHCYKKWLSTQTHKDYRTRRIPDSFYPYGGEINAQGWLTEFLTGVDPTGKRVCDALIEEGLTLCLEPGRSLVNQSAISVFRVCRVRPYDHVGHVIFVEGTSFSACETWFNSEFLSDPLHIYQNNHQPLSSAGNAWIAGHSCLDDDVITNRLIAFAHLPKPGDLLIFANTAGYQMDLLENQFHRHPLPTRLTAVINSHQKPIFTIDN

SEQ ID NO: 6171 - protein, 644 aa, Proteus mirabilis
GGRGNVVKQKWSFVLAISTLCFSAWAQADSLSEQRTRYQEIKAAWDAKDTAQVEKLLPTLQDYPLYPYLEYRQITDNLDVVAPAVVTEFVEKYPTLPPAKALPSLFVNELAKRQEWQNLLTFSPNPPKPKAARCNYYYAKWATGDKQTAWVGAKEAWLNGTSMPSSCDPLFDEWQKAGNLSIELVLERINLAIKSGNTGLATYLAKRLPMDYQTINDAIVELQDHPNLVARYATQLSPTDFTRNIVQAAFSRWARKDADSARAQLDSIARAQKMTTAERQLMRDTVAWQYMPYATPEQAKWRDSVIQDTASDTLRERRVRLALSQNQPAELALWLERLSPESKNKEEWRYWRAMVLQSQGKNSEAQALLQELTQHRGFYPMVAAEKLGKPYVMVIDKAPSVSPTIPQQPEVQRVRELMYWQMDNLARTEWANYVATQPATTQSQLARYAFEQQWADLAVQATITGKMWNHLEERFPLAWQNEFERYTKDKAIDRNYAMAIARQESAWNPQARSSAGATGLMQVMPKTAEFTVKQAGITGYASSAQLTDPVKNIEIGTAYLDSVYQRFNQNRILSSAAYNAGPARVDRWLSDANNQLDAIAFIESIPFAETRGYVKNVLSFAVFYSYFAGEQQPVLTQTEWNSRY

SEQ ID NO: 6172 - protein, 106 aa, Proteus mirabilis
LIGGKRSPMSKVYPISQIIGHKIRQQRQHLRLSAKAVAERVGVSQQQFSRYENGLCKIDVDMLFLIAKELNVTPTAFLPSPLNEDPIASSSAVTQSKLFWSAQSQI

SEQ ID NO: 6173 - protein, 347 aa, Proteus mirabilis
HTGGEDMLFQVGEIAKKTGLTVRTLHHYEEIGLLQPTARTDAGYRLYDMKSIERLTQIQMLRQIGVKLKDIGHILNGHSAEIACLIEERISQLTTQMQQIAKLRYQLEHVQQQIQTGTPFTQHDWFSLLEMMSMYDKYFTYSELAQLPLYTAHTLKSQAWQQRISTVNNLIKQGKSADSNEAMQVSREWMIALEQDTGGNPDFFVRLNKMHISDDKFATATGITKQMIDFVAKGFSEYQLSVFKPHLTPEQFAVVHQHYFDAGSVWPELISGLYNALTCGEKADSEQVQNLAKMWLNMFNQFTQGDSDIQAKIRTIYQTDHEIAKGTWMTPEIGQYLFTAISLLVQK

SEQ ID NO: 6174 - protein, 1260 aa, Proteus mirabilis
RALGEYLMSKFLDRFRYFKQLGDTFSQDHGQELNVNRDWENSYRSRWQHDKIVRSTHGVNCTGSCSWKIYVKNGLVTWETQQTDYPRTRPDLPDHEPRGCPRGASYSWYLYSANRVKYPMVRKRLIKLWREAKAQHADPVDAWASIVNAPEKTKSYKQARGRGGFVRSSWSEVNEIIAASNVYTAKTFGPDRIIGFSPIPAMSMVSYAAGARYLSLIGGACLSFYDWYCDLPPASPMTWGEQTDVPESADWYNSSYLIAWGSNVPQTRTPDAHFFTEVRYKGTKTVAVTPDYAEIAKLCDQWLNPKQGTDSAMAMAMGHVILNEFHVKRQTEYFSNYVRTYTDMPMLVMLDKHDSGKLVAGRMLRAADLVNNLDQEKNPEWKTVAIDEKTQQLVAPQGSMGFRWEGAAKWNLEPKDGKSGEEVTLQLGLLENHDDVVDVAFPYFGGIKSEYFEGVALDDVLVHKLPAKRITLANGEEKYVTTVYDLLLANYGVDRGLNDENCATNYDEIKAYSPAWAEQVTGVSRQDIIRIAREFADNAEKTHGRSMVIVGAGINHWYHMDMTYRGIINMLIFCGCIGQSGGGWAHYVGQEKLRPQTGWLPLAFGLDWQRPPRHMNSTSFFYNHSSQWRYETVSPTELLSPLADKSRFSGSLIDMNVRSERMGWLPSAPQLNVNPLSITKKAQQAGVSATDYTINALKSGEIRFASEQPDNPQNFPRNLFIWRSNLLGSAGKGHEYLLKYLLGTENGLQGKDLGEQGQVKPQEVEWQDKGGEGKVDLVVTLDFRMSSTCLFSDIVLPTATWYEKDDMNTSDMHPFIHPLTAAVDPAWESKTDWEIYKGIAKTFSKLCVGHLGVETDLVTQPIQHDSAAEMAQPFDVKDWKKGECDLIPGKTAPHLIPVERDYPNTYARFTSLGPLMDKLGNGGKGIGWNTQTEVDFLKKLNRVRHDGVAKGRPAIETAIDAAEVILSLAPETNGQVAVKAWDALSKVTGRDHTHLAKVKEDEKIRFRDIVAQPRKIISSPTWSGLEDEHVSYNACYTNVHEMIPWRTLSGRQQLYQDHEWMRAYGESLVVYRPPIDTKAIEAVKGKKPNGFPEKALNFLTPHQKWGIHSTYSDNLLMLTLGRGGPVVWLSEDDAKEMGISDNDWVEAYNSNGALTARAIVSQRIPDGMIYMYHAQERQINLPGSEITGMRGGIHNSVTRVCPKPTHMIGGYAQLAYSFNYYGTVGSNRDEFVVVRKMKQIDWLDGEGDAYQQTLNGQEKA

SEQ ID NO: 6175 - protein, 280 aa, Proteus mirabilis
INMGQVLFVVWRESFEALLVVGIIYAWIKRSPTPKQGMKYLWGGVIVGILLSILLALSIYGVFSSLEDIWQSLFMVMMEIIACLLIVQMVYWMNKQGKSLKANIENELTQKTQQQSVWGILLIIAIAIAREGSEVVVFLSSHIMALTAQTALSFLIEVFIGLLIAGLTLWLFLLTSKMISWRKFFVITGFLLLFLAVSLLLKAVEEIANLLIEMDIELPDFLIYPLWDLSHILDDSSIFGNFLVSFFAYRSQPIGLSVVTFIVFWLVVALLFKQGDRHAK

SEQ ID NO: 6176 - protein, 81 aa, Proteus mirabilis
RLIFTIYQDIPNSLRILFIKEKCIACMGLFFLIECCCFYTLFNFYILGKQNEIKKTAFSFRVRLIYHCGLCISGRSRAWYC

SEQ ID NO: 6177 - protein, 139 aa, Proteus mirabilis
YKILSGINIMKNFENIALLIARILMPILFISAGYGKIEAYEGTQQYMQSMGVPGALLPLTILLELGGGLAILFGFLTRTTAIFTSVFTLLTALLFHTNFAEGANQLMFMKNITIAGGYLLLVITGPGKWSLDRLFKKNW

SEQ ID NO: 6178 - protein, 261 aa, Proteus mirabilis
GDFMRFIKLLPAILAVILAGCVTQAPEVKQPLKPQAKLVEGVSCTLPDAPTANYDYIATNDRYGQNSKASTDYFKLAINYSPAFCDYKKNNIKRLNNDNEKERAKREFDKFEIQCFSDNKFGWIVHGLWAETCDGKSWDECRDWKDIRKHPRLCKGDLPPLEYSAIKPYLCSSPGIDLLQGEWEKHGVCAFDTPEAFFGQQQALFDALVLPEGRPSNSELIKFLKENNPSLKDKEIQINRDEFYICYSKDFEVIDCPKREY

SEQ ID NO: 6179 - protein, 162 aa, Proteus mirabilis
VAFMHKQVEIFTDGSCLGNPGPGGYGAILRYQQHEKTLSEGFFMTTNNRMELLAAIVALEALKFPCKITLTTDSQYVRQGITKWIHSWKKRQWRKADKSPVLNVDLWKRLDKAIERHEIEWHWVKGHAGHDENERCDELAKAAAQSPTKEDTGYLESQQDKT

SEQ ID NO: 6180 - protein, 397 aa, Proteus mirabilis
LVFFANLFGGSQMIPNEKLRVTLCGAGRTGHLAAILFSLNPAIDVTLYSSRSETVTAYKENDHQLQAVMPDGQVIKTGSVRMTEAIDEACSKADIIIITTPSHVRESLLQRMAPILPKHKNIFVGAIPGFAGFDWLAEKTLGDAPNIVIWGMKDVPHIAFDLQPGKSVRMGGGKSQLYVAVHGREKPQYANLLLNYLKQLYDSPITLLTDYLEITLTPGNPIMHSSVIYGLIGPWGQWHNRPFESIPCWWNDCPELGAYFLARCDRENQALCNKAEIVLGINLSSVQPLQQEIVAAYADSIADPRTLLSVLRTNKAYQGIPLPLISTAQSHGYIFDKQHRVFQEDIAYGLALLVALGERLRVPTPYIREIYDWCCGYMGGSLPHPQIPMDWPIIRVK

SEQ ID NO: 6181 - protein, 254 aa, Proteus mirabilis
GNFMELIRIPALSDNYIWLLSNENSECVIVDPSQAKPVIDTISQRSLTPVAILLTHHHEDHVGGVAGLVSKYPNIEVFGPQETQTKGANKIIHDQEHIIIDSFSFLVIGTPGHTLGHVAYYSEPYLFCGDTLFSGGCGRLFEGSAQQMFSSLQKLMALPDNTLICCAHEYTLANLTFAHHIMPKNPDITDYLNQVTEMRHHLQPTVPITLKNEKNINLFLKSDDIDLQRILGITSNTYAPIKTFTKLRELKDNF

SEQ ID NO: 6182 - protein, 77 aa, Proteus mirabilis
SIFMCYTENFNTLLWTISRTIEYYKTLNLTHNIGELIGYTKNDIYAERIKKANIIFLCLVAQYLDSLNCFQDEFRPK

SEQ ID NO: 6183 - protein, 312 aa, Proteus mirabilis
ALFILTHVHFELACGISKTMEYKHILSSNQISLKTFYIENPMIAMVYGAKGEICINGQTITVTTNLTLIIPKYSQVSCDVTNFFPTKPIELHTLVLSETELQSVFSLLKPLIKSGAPITRHLPDYHLSTPEVVKTNFTLLQQCLPLEHGTPSQETLFMQQSLFFILLAVYHEGVDILNIFRFNYDEPKNQAITHLITQDPQRKWHLEDVAKTLYTTPSTLRRHLSKEGVSFCQLLLDVRMGIALNYLTFSNYSVFQISHRCGFGSNAYFCDAFKRKYGMTPSQFRTQSRQANDPNAIATMASQNDESIKKVF

SEQ ID NO: 6184 - protein, 316 aa, Proteus mirabilis
FPLMTYALELTELTKTYHNGVKALKGINLTVEAGDFYALLGPNGAGKSTTIGIISSLVNKSSGKVKVFGYDTDTDMVNAKRQLGLVPQEFNFNPFETVLQIVLNQAGYYGVPRKVALERAKTYLTQLDLWEKKDDRARFLSGGMKRRLMIARALMHEPKLLILDEPTAGVDIELRRSMWTFLQHLNAQGTTIILTTHYLEEAEMLCRNIGIIQRGELVENTSMKGLLSKLESETFILDLAAKSPLPELQNYQYRLVDTSTLEVDVKREQGLNGVFAQLNAQGIQVLSMRNKANRLEELFVHLVNEDHTETEKGERE

SEQ ID NO: 6185 - protein, 71 aa, Proteus mirabilis
EKLMFGNLGQAGKYLGQAARMLIGIPDYDNYVQHMKDNHPDKPVMTYNEFFRERQEARYGGGDGKGGFRCC

SEQ ID NO: 6186 - protein, 1047 aa, Proteus mirabilis
YIIMSRFFINRPILSWVMAIVIMIAGGLSLIKLPVSQYPEIAAPAIMITAVYPGASAETVQDTVVQVIEQELSGLDGFRYLSSNSNTDGSFEVIATFEQGTDSDIALMQVQNKLQLATPKLPLEVQRQGMRVVKFQINFMQVVALVDESGKLDAFDLGNYLASHMKDPISRIDGMGDILLLGSPRAMRIWLDPDKLTNYHLMPQDIAAAIQDENVQVSAGQLAGLPALKGVELNATITSASRMVSVDEFNHILLKVNLDGSQVLLQDVAKVEVGADNFSISSLYNGKPSAGMAMRLAPGANLLDVSKKVKEVVEAQSQFFPQGVKALFPYDTTPSVKSSISSVVRTIVEASILVFLVMFLFLQNIRATLVPTLAIPVVLLGTFGVLAALGLTLNVLTMYAMVLAIGLLVDDAIVVVENVERIMHEQAISVKEATILSMTQIQGALVGIGLVLSAVFVPMAFFGGSAGIIYRQFAATIVVAMALSVLIALTFTPALCASILKKPQPKVKKRRGFFWLFNRFFDRGTNYYEKGVRNILYRRGRYMFIFLIITVGTGWLFTQLPKAFLPNEDQGVVMIEVRMPANSTAERMEQTMAEFRDYLLTEEKHLVKTVFTVNGFNFAGRGQNAGMAFVNLADWSERKGKGEDVFSLVARAQQHFNSIRDGMVIAFPPPAIMEMGNAMGFDFYLQDNAGLGHTELVKARDKFLELAAQSPVLTNVRPNGKNDEPQLRVVIDKERARALQLRLSDINDTLSAAWGSMYVNDFIDEGRVKRVYLQGEASARMLPTDLDKWHVRNQRGEMIPFNAFATTQWYMGPPKLERFNGLSAIEILGEPAPGYSTGDAMLAIADIMKQLPSEISLSYSGLSYEEIQTQDQAPALYVMTILFVFLSLAALYESWSVPFSVALVVPFGILGAVIATLLRGLSSDVYFQIGLMTTIGLSAKNAILIVEFAKHLYEKDGKPLIDAAAEAARMRLRPIIMTSLAFTFGVLPMALASGAGQGSQHSVATGVIGGMLASTFLAIFFVPLFYVFVVKLFSRKKAHMSIEEIDK

SEQ ID NO: 6187 - protein, 370 aa, Proteus mirabilis
ESIMLKVIQSPAKYIQGPDALYHIGKYTKPLGERALIIADKFVMDLAGSIVKDSMTQYEVNGHFEQFHGECTHKEIDRLVEIAKQQAALVIIGVGGGKTLDTAKAVAYKCQLPVVISPTIASTDAPTSALSVIYTELGAFDSYLFYPKNPDIVVMDTNVIASAPPRLLVAGMGDALATYFEARACSRAQKQTMAGGKTTLAALALAELCYHTLLEDGYKAKLAVSRSVCTTAVENIIEANTFLSGIGFESAGLAAAHAIHNGFTALEECHAMYHGEKVAFGTLVQLVLENSPLEEIEEVLDFCVQVGLPVTLEELGVHATGDELNEKIMAVAELSCAEGETIYNMPFDVDSDKVFAAIMAADQLGREWLY

SEQ ID NO: 6188 - protein, 184 aa, Proteus mirabilis
TPIMRSLMNRKIRNTLIISTLFSISVPVMALKDDTQQPIVVNSEKQSLNLEKNITTFTQNVVVKQGSIDIRADKVVVTRPGGDSKKIVIEAFGNPVTFYQLQDDGKPIKGRGDKMTYEMDKELVTLTGKAYLEQLDSNITGDKITYLVPTQQMEAFSGKGKQVTTVLLPSQLQEKGPGVNNKGK

SEQ ID NO: 6189 - protein, 256 aa, Proteus mirabilis
LYIMIRKSILLFITTTCTLPAQANYLGGFANISINYLDWTTHTTHKTGQTSHKDDFAYLELEGGAHFSWGEFYGFFDLENPFNNRQTQPGDNQRYTVKGTSRIYLADSGLNLYGHVYGTWSLPGKEYGGNFHEVNTLYGIGYNTQLADIWFKPFIALHYVDQTYYSGNNGYVVGWVAGYDFNLVNQKFSITNWHEMEFDRNKRYGNGGKNGFNGAVAIWWHPTASITTGIQYRYAYKKLGENFLQDGVIYSLKYNF

SEQ ID NO: 6190 - protein, 110 aa, Proteus mirabilis
LDIIVSILCLELIMKLSLLTDIDVSRAFATHLRKRREKEKWSREHLAERSTVPASTIKKFELQGKISLRQLLLLWQCLDDLNNLYAVVDPKKANKPRIPRTIEEVLQDEF

SEQ ID NO: 6191 - protein, 139 aa, Proteus mirabilis
ELIMSLKITTAPTTNEINEIYEGLLTHNLQYIQMEQYTPLAVFKEENGKKIGGITGDILGNWLRIRYLWVDKAYRGNNIGTELLQAMENTAKKKGAKYAEVDTFSFQALPFYQKQGFEVFGTLENYPISDKKYYLNKVL

SEQ ID NO: 6192 - protein, 135 aa, Proteus mirabilis
IQIIVIFTIKRKPEFLLPKFNQHAEQLAISTITLAELIFGAEKSVNPAKNLATVNDFVSRLTVLSYDDLAAFHYGDIRATLEKQGKHVGDNHLHIAAHTRSKGLIVVTNNTREFERVDGLRIEDWTVINSDPQTD

SEQ ID NO: 6193 - protein, 484 aa, Proteus mirabilis
KRIMSLAVVSESLLEANNLSLDDLASTLEQLAQRQIDYGDLYFQSSYHEAWILDDQIIKDGSYNIDQGVGVRAIYGEKTGFAYADQLTLNALNQSAHAARSIVQAQGNGQIHTLGAIQHTPLYNLNDPLQSLSREEKIALLHDVDRVARAEDKRVKQVNASLTGVYEHVLVAATDGTLAADVRPLVRLSVSVLVEDDGKRERGSSGGGGRFGYDYFLTKENGETHAATYAREAVRMALVNLSAIAAPAGTMPVVLGAGWPGVLLHEAVGHGLEGDFNRRQTSVFSGRIGDKVTSELCTIVDDGSIEGRRGSVAIDDEGVPGQYNVLIENGILKGYMQDKMNARLMGVKPTGNGRRESYAHLPMPRMTNTYMLAGKSSPEEIIASVDRGIYAPNFGGGQVDITSGKFVFSTSEAYLIEKGKITKPIKGATLIGSGIEAMQQVSMVGNDLALDKGVGVCGKEGQSLPVGVGQPTLKLDKLTVGGTA

SEQ ID NO: 6194 - protein, 255 aa, Proteus mirabilis
KRIMSTPITRQIVLDTETTGMNKLGVHYEGHNIIEIGAVEVINRRLTGRNFHVYIKPERLVDPEAFEVHGISDEFLEDCPSFAEIADEFLAYIRGAELIIHNASFDIGFMDYEFQKLNRDIPLTETFCQITDSLAMARELFPGKRNNLDALCDRYLIDNSKRTLHGALLDAEILADVYLAMTGGQTALAFSMEGEPNEEQKGDDIQRIVRPVRGLRVIKASAEELVAHEARLDLVVKKGGHCLWRPAPASNDETA

SEQ ID NO: 6195 - protein, 257 aa, Proteus mirabilis
NLVILVIERYNILGIDISENKTISFNAHHERRVITSINKNPKISIIGKKNKITIYSIYQRTKFGDYERDGNPLIYSLKGIFNYTITINELYKFKPSFLAILNKIRDKIVNQNIIFIAMPSSSTVPYLLARRISRHFKSTLYNEIFIKCTVEEVINRYANSTVNKKENHIKLLNRTLSELQSLPPNTIFKMKHIPNKIRHYFSPWKIDPNFNIRKLNNYNIILIDDLLSTGTTLNMATIELNNLGFTCSTAICLLSNL

SEQ ID NO: 6196 - protein, 182 aa, Proteus mirabilis
FMVMEQWFSPSKAVLVFILATFTGGLSSTAVANLPAGAVIRATPGIVYINITGNVIAPPPCLINDGKMIEVNFGEVMSTRINDSNYKQPIEYTATCQKRPTNAMKVYITGNATGFDSNALQTNITGLGVRILYQGKLLGLGSAVKFTYPNLPKLEAIPVRDNRETLVGGDFVANATLHVDYQ

SEQ ID NO: 6197 - protein, 548 aa, Proteus mirabilis
VQVMITVLDYLLVRLKELEIKTIFGVPSDYNLPFIGVVDNDKDIQWVGACNELNASYACEGYARIKGFSALCTTYGVGELSAINGVAGAFAEQIPIIHIVGAPSQSKQEKGKTLHHCLATGRFDAFEKMYRHISKTTAVLTYHNATEEIDRVLETLWRYRYPVYLLIPEDVGVMKVNKPKLPLQLTLPQSNPDDLNKVITLLENKIKQSKSPCIIIGEQVSRYQLRKQVENLLEKTNLPFFTVWGSKGVVDEGRQQYGGILFGELSNPQGLDYIINSDLIISLGVSWDEVNTAGFTFDVPTQNCYQFYDTYSLIEEEKIYGVSLLDMPNALLALDYIYPHNIALLPQKIVPPDWQGLIKIDSIPLLLDKVLDDNSVILAEAGNAFLCAVNHIFSGNSQLVVSNIWASIGYTLPAALGVTLALENQGRAFVVIGDGAFQMTAQELSTLLRLKLNPVIFIVNNQGYAFEKIFYGPKDTFNDIQNWNYSQLPELFNCDAYSVKVDSLEALETVLPLLKVHQDKLCLVELDMDKHDYSEPISEFIALLNQYK

SEQ ID NO: 6198 - protein, 76 aa, Proteus mirabilis
TGSICSFGRRALCGAGLNRLNILASDGFYFNMLILNNDKTNNKVIKKFSLTNVIVNLLKQIYCEVILSCRIIFQDV

SEQ ID NO: 6199 - protein, 195 aa, Proteus mirabilis
GVTMKLLPITAVLCSALLLQGCIGAAVVGTAAVAGKTATDPRSLGQQVDDGTLEARVSGALNKNQQIKNSNARIVATAYQGNVLLTGQSPDMSVAETAKQVASKVEGVNNVYNEVRQGEPVTLGTASSDTWLTTKVRSQILASDAVKSSSVKVITENGEVFLLGILTRQEGAAAAKIASETKGVVKVTTAFTYLN

SEQ ID NO: 6200 - protein, 486 aa, Proteus mirabilis
PLTMKFIIKLFPEITIKSQSVRIRFIKILTSNIRNVLSTLGDDITVVRHWDNIVVVSKDESKSEAVCDALTRIPGIHHFLQVEEHSYTDLHNIFEQTFAAFGHLVENKTFCVRAKRRGKHSFTSNEVERYVGGGFNQHVESAKVKLTRPDVTINLEIEDDKLILVNARYEGIGGFPIGTQEDVLSLISGGYDSGVSSYMLMRRGSRVHYCFFNLGGSAHEIGVKQVAHYLWNRFGRSHKVHFVAVDFEPVVAEILEKIDDGQMGVVLKRMMVRAASRVAERYGVQAIVTGEALGQVSSQTLTNLRLIDNATDTLILRPLITHDKENIINIARQIGTEDFARTMPEFCGVISKNPTVKAVKAKIEAEEEKFDFSILDSVVENAKNMDIRRIAEETVQQVTEVEMVSEFATNDVVLDIRSPEEQENSPLKLEGVDVKELPFYKLSTQFGDLDNSKTYLLYCERGMMSRLQALYLREQGFNNVKVYRKK

SEQ ID NO: 6201 - protein, 445 aa, Proteus mirabilis
HTYITKHGVKKVNEIYEIAYSAAANRLCLFTGTGFSKALTNNKALGWQSLLEKACDKLDGLNKVKKSLFPEDGKNPLSLEEAAQVIYIEYQKKGENLHEKIAEIIKEIHLSKDNKHVKNFLDNNSIRIITTNYDKLIEEMIPIKKCQSLAPGLPIPKASSSTKIYHVHGSIDSPSNMVVTSDDYFKFINYNSYFSKKISSMIYENTIVILGYSLGDTNLKAIINEYKNFSRENVIGSSMFLVSRKKVESYLKEYYFHCYGIRVIDNLDIHDFFDKLNSKIQDVQKRVEDSLENIEKVLSGKHSFSKSFLKVENNFYEIIMSLAAFGVLVTDAKAMNMIEKIIQEKIKLTSENSAWEQYVHLANWLIYLATIIEIKDTSLEKIYLKAVFHSMNHMSKDYSIGYSWHAYKAWESKWFSLIVSNRVMLKNYVSKNINNQDAVNLVKNL

SEQ ID NO: 6202 - protein, 106 aa, Proteus mirabilis
VVYIFHTTYLVSYKNCYMAVFIGAITMIQYGKVFMSNRTQNVRLPAETRFPDDVKEVFVRVKGKERIITPIQNAWDSFFLSEKSVTDDFLSERPDQATSERGSFDD

SEQ ID NO: 6203 - protein, 395 aa, Proteus mirabilis
VNNMTAIIRQFLRLEASGGILLIVAAIIALIMANTPLSALYNEFLSIPIMIKFGALELDKPLILWVNDALMAIFFLVVGLEVKRELKEGSLAQRDRAIFPAIAAVGGMLAPALIYLFFNHGDAIGQQGWAIPAATDIAFALGVMALLGRRVPVELKVFLLALAIIDDLGVIVIIALFYSKSVALVPLLLAALITIMLFILNWRKVSNTAVYLVLGFILWVCILKSGIHATIAGVIVGFLIPLRDKEGASPSEELEHVLHPWVAYLILPLFAFSNAGVSLNGVTLDGMLSTLPVGIALGLFLGKPIGIFLFSWVSVKLGIAKLPDAINLKQIFAVSVLCGIGFTMSIFIAGLAFEGAIEAYNTYSKLGILVGSTMAAVVGYLLLNSVLPKLKQKQK

SEQ ID NO: 6204 - protein, 477 aa, Proteus mirabilis
AINIFDNNIKRLIFMLTKKRKLLLSALAMSVGLSLSTLPATSMAALPSVMPSGEQLPSLAPMLEKVLPAVVSVHVSGTRVQSQQVPEEFKFFFGPNFPSQQQSIRPFEGLGSGVIIDAEKGYVLTNNHVVDGADKIQLQINDGREFDAKLIGSDPQTDIALLQIEKPNNLTAIKMTDSDKLRVGDFAVAVGNPFGLGQTATSGIISALGRSGLNLEGLENFIQTDASINRGNSGGALVNLNGELIGINTAILAPGGGNIGIGFAIPSNMARDLSQQLITHGEVKRGILGIRGTEMNADLAKSFKIDAQRGAFVSEVLADSSAAKAGIKPGDVLISIDGKRINSFAELRAKVGTTPPGKEILIGLIRQGKPMDVKVTLEKQSADATRADNFSPALQGATLSNYVNKQVKAVAVDSVEKGSAAAASGLQKGDLIIGINNMPIGSLGDLRKTIDAKPPVLALNIKRGNEEIYLLLRNSSR

SEQ ID NO: 6205 - protein, 241 aa, Proteus mirabilis
VANMQTPHILIVEDEVVTRNTLKSIFEAEGYIVHEATDGNEMHNILSDHDINLVIMDINLPGKNGLLLARELREQVSVALMFLTGRDNEVDKILGLEIGADDYITKPFNPRELTIRARNLLSRTMNLANGTEERRLVESYKFNGWELDINSRSLISPTGEQYKLPRSEFRAMLHFCENPGKIQTRAELLKKMTGRELKPHDRTVDVTIRRIRKHFESTPDTPEIIATIHGEGYRFCGDLDE

SEQ ID NO: 6206 - protein, 245 aa, Proteus mirabilis
GENMMISLKVISLLLDYPSEDLWEHRNEIIDALQEADELPVTQVAKLMAFIRELTQQDLLDAQANYSEIFDRGRARSLLLFEHVHGESRDRGQAMVDLLNQYQQAGITLSSRELPDYLPTYLEYLTLLPTDESIEGLNNIAPILALLSERLKQRGSDYHALFDVLLCLSQSELDASQLAAQVEKEPVDDTPAALDAVWEEEQVTFLGESAQCGSNNISQHQRRFAQETPVQYLNVGNSLDMGAQK

SEQ ID NO: 6207 - protein, 111 aa, Proteus mirabilis
WVNIMMMNFDFANIDVNASVGKKIQKKRKELGYTGMQLAKKIGVSQQQFSRYERGMNKIDLRHLVLLALYLNTPIYWFFEDCYVKKPSLNNKGIDKRNYVIAQATPDAFHY

SEQ ID NO: 6208 - protein, 749 aa, Proteus mirabilis
GENMVAVRSAHLTPAGEFAVDKWVNSLNLTHANAGSEIMQTWEYCHRTVLGREDAQLLLWRGVEMVELLSTLSMDKDSMRAALLFPLAEEDLINQEVITEHFGEAIWNLVRGVMEMDAIRQLKATHTNETSSVQVDNVRRMLLSMVEDFRCVVIKLAERIAHLREVKDATEDERVLAAKECFNIYAPLANRLGIGQLKWELEDFCFRYLHPDEYKQIANLLHERRIDREQYIDNFVSTVRGYMQQENIEVDIYGRPKHIYSIWRKMKKKNLAFDELFDVRAVRIVVERLQDCYAALGIVHTHFRHLPDEFDDYVANPKPNGYQSIHTVVLGPEGKTVEIQIRTRQMHEDAELGVAAHWKYKEGATGATTKGGTGSYENRIAWLRKLIAWQEEMADSGEMLDEVRSQVFDDRVYVFTPKGDVIDLPAGSTPLDFAYHIHSDVGHRCIGAKIGGRIVPFSYQLQMGDQIEIITQKHPNPSRDWLNPNLGYVTTSRGRAKIHNWFRKQDRDKNIIAGRQILDNELAPLDINMKEAEKLLIARYNVHSLDEVLAGIGVGDIRINQLVNFLQSKLNKATAEDEDKEALRSLENKTATPKTTTSGGGSIVVEGVGNLMHHIARCCQPIPGDNIVGFITKGRGISIHRADCDQLAELLSHAPERIVDAVWGENYSSGYSLVVRVVANDRSGLLRDITTILANEKVNVLGVSSRSDVKQQIATIDMNIEIYNLQVLGRILAKLNQLPDVIEAKRFSH

SEQ ID NO: 6209 - protein, 210 aa, Proteus mirabilis
ETDMSFNDTQEQFAPNMALVPMVIEQTSRGERSYDIYSRLLKERIIFLTGQVEDHMANLIVAQMLFLEAENPEKDINLYINSPGGVITAGMSIYDTMQYIKADVSTICMGQACSMGAFLLSAGAKGKRICLPNSRVMIHQPLGGYQGQATDIQIHAQEILKVKSRMNELMAQHTGKSIEEIERDTERDRFLSANEALEYGLVDKVYTQRS

SEQ ID NO: 6210 - protein, 216 aa, Proteus mirabilis
GADMQIKSYFKNTPLSLKSINNESYKFNTKLKSAILSCYNTISSFIKPFFHKTSNNSEFKVHISNIENMKKNENIQSDNKVINTPHSMKDDNDKFGDLSKVHKKFKVDEIINLIINDIISVLEEKPTLEKGKIIQFEDELHSHSKSILSSTNGLSLTEIKNKFLASIIDSILTSDEKIKSEFGNINNYKYFLSNSINETVSRSLAKDKNLVKNGDK

SEQ ID NO: 6211 - protein, 340 aa, Proteus mirabilis
TCCMAVNASRNCLFKEHVVAQDYTVEQLNHGRKVIDFMRWDNVAFTISFLLLVASIAIISVKGFNWGLDFTGGTVIEINLSQPADLDKMRDSLAAAGYKDPLLQNFGSSRDIMVRMPPVEGQAGQELGKKVIDIINVEIDNDATVKRIEFVGPSVGSELAQTGAMALLSALICILIYVGFRFEWRLALGAVISLAHDVVITLGILSLFQIEVDLTIVASLMSVIGYSLNDSIVVSDRIRENFRKIRRGTSYEIMNVSLTQTLSRTIMTSATTLLVVLMLYIFGGSMLKGFSLVMLIGVSFGTVSSIYVASALALKMGMKREHLIVQKVEKEGADQTTLLP

SEQ ID NO: 6212 - protein, 303 aa, Proteus mirabilis
GRCMDQTNIIRDLLAWLDNNLDQPLSLDNVATKAGYSKWHLQRMFKEVTGQAIGSYIRSRRLSRAAVALRLTSRPILDIALQYRFDSQQTFTRAFKKQFDRTPALYRRSDEWCAVGICPPIKLDPQPFPKWEYVQLPEIKLIGIEQTCSHTLEQWANACSDMRQTFWQNYITKVNTIPHEVYGLHHTQHSDEHEDEQRVIYTTAVEPAYASFVEDDTADEVILEAGDYIRFDFEGEAKRGAMQEFLFLIYGVCLPTMGLTRRKGHDIEKYYLKEVHYDNVMTAEPQDHIKRFEYYIPIKRELA

SEQ ID NO: 6213 - protein, 167 aa, Proteus mirabilis
GEGIVMRTLVLGIGNLLLSDEGIGVRIVEALEERFSLPENVDVIDGGTSGMEILQDIAARDLLIVADAVRSQHEPGSIFVLHDDDVPALFTQKISPHQLGLSDVLMALRMTDEFPRKLILVGIEPASLAPSMSLSDIGQQSMEIALEQVVNILREHGITVTPKEVTA

SEQ ID NO: 6214 - protein, 109 aa, Proteus mirabilis
YYILFYLQCDGIVKGAKFCLIFSFAYKGLEWAFKDQYHLADFLGNVTVDMAKTALAAAGAWAVGTVLLSSAVVGGSVVAVGLIVFLVGVGITMTLDYIDKQYGLSEKVI

SEQ ID NO: 6215 - protein, 61 aa, Proteus mirabilis
DAFMLSISVIEQRAILSNDYFSFTSYHQRILGLIPFSVVKKKSASFKDALYFLIDSFSVYP

SEQ ID NO: 6216 - protein, 492 aa, Proteus mirabilis
GDFMTAELLVNVTPSETRVAYISGGILQEIHVEREAKRGLVGNIYKGRVSRVLPGMQAAFIDIGLEKAAFLHASDIMPHTECIAGEEQKKFNVRDIAQLVHQGQDLIVQVVKDPLGTKGARLTTDITLPSRYLVFMPGASHVGVSQRIESEEERERLKRLVEEYCDENGGFIIRTAAEGVGEHEIKQDAAFLKRLWNKIIERKKRNKTRIQIYGELALAQRILRDFAGAELDSIRVDSKLTYHQLQEFIGEYIPELTAKLELHQGNQPIFDLYGVESEIQRALERKVELKSGGYLIIDQTEAMTTIDINTGAFVGHRNLEETIFNTNVEASQAIARQLRLRNLGGIIIIDFIDMSNEDHRRRVLASLEQALSKDRVKTTINGFSQLGLVEMTRKRTRESLEHVLCDDCPTCQGRGTVKSVETVCYEILREIVRVHKTIDADRFLVYAAPAVVEALKGDESHALAEVEIFVGKQVKVQTELLYSQEQFDVVMM

SEQ ID NO: 6217 - protein, 379 aa, Proteus mirabilis
VTLIQVECKTLPVPNIGSYYMSKVFDFVKPGVITGDDVQKVFAVAKENNFALPAVNCVGTDSINAVLEAAAKVRSPVIVQFSNGGAAFIAGKGLKAEAPQQAAILGAISGAHHVHQMAEYYGVPVILHTDHCAKKLLPWIDGLLDAGEKHYAKTGKPLFSSHMIDLSEESLEENIEICSKYLARMAKIDMTLEIELGCTGGEEDGVDNTGMDSSALYTQPEDVAYAYEKLNAISPRFTIAASFGNVHGVYKPGNVQLTPKILRNSQDYVSEKYNLPHNSLNFVFHGGSGSSAEEIKEAVSYGVVKMNIDTDTQWATWDGILQFYKKNEGYLQSQLGNPEGADKPNKKYYDPRNWLRHGQTSMVVRLEQAFKELNAIDVL

SEQ ID NO: 6218 - protein, 63 aa, Proteus mirabilis
NIIIVILLLRFLKVFSLKQRILNWKTKVNVFFQIFLLNEALVGYLSEKIFCLVFIDFVRVLLF

SEQ ID NO: 6219 - protein, 327 aa, Proteus mirabilis
EVIMKALLVEQHSDKLSAGVQHIDESQLPIHEVIVDVHYSTLNYKDGLAITGKGKILRQFPMVPGIDFSGVVHHTEDPRFHIGQHVLLTGWGVGENHWGGLAQKAGVKGDWLTAVPEGLSLKNAMIIGTAGFTAMLCVMALEQGGITPDSGEILVTGASGGVGSTAISLLTALGYQVTALSGRASNHDYLRKLGAEHIITREAFEAAGKALDKQRWAGAIDTVGGQILANILSQTHYNGTVAACGLAGGYTLPTTVMPFILRNVRLQGIDSVYYPAEKRAQVWQRLLQLLPDTFYQQTVTEITLNEVPRYAQMIMDNQVTGRTLVKL

SEQ ID NO: 6220 - protein, 252 aa, Proteus mirabilis
MVVMMAISTNKERKMKIAAHRGFSGKAPENTLAAFKMAIDFGCEWIETDVQLTADHVPVLIHDKTVNRCTNGQGAVRFHSLDDLHRLDAGSWFSSLYQGEKIPTLRQGLQLIKRSGTKLNIELKTWPDDDVERLCLAVSEMIKSADIPNEQILFSSFDTHALMVMKRYLPAIRRGQLWDDIPDNALETLQAIEGFSVHCNYQYLTQQQAAMLKQAGYEIYCYTPNDPKEVKDFEAWGVDMLITDVPDIYQQN

SEQ ID NO: 6221 - protein, 231 aa, Proteus mirabilis
FCVIYHRYLRVISQLLEDFSHHAQVIIIWRGDNGKIAQLPTIRRDPFYQIEGLKLHFAPPDFIQVNDEINHKMVVQAIAWLDLSPTDRVLDLFCGMGNFTLLMAKRVDKVVGVEGVPALVAMAKKNAELNQLDNVQFWHADLSADFSAMPWAQEGFNKVLLDPARAGAAQVMSHIVTLSAEKIVYVSCNPTTLARDSKILLDSGYQLTQLRMLDMFPQTGHLESMALFIRK

SEQ ID NO: 6222 - protein, 192 aa, Proteus mirabilis
RISISENASGTVLKGKRSPNTFKKRGPPTNEANNPTARPATITVPISAPNSLVTKSAAGCGGTIQCTAINAVHKGMASFNNEVFVFLAIENANGISSTTPTSTNRVIPQISPTNTIITSGDNQRHFCKVIPMRSAAPDISIILPRIVPKPIMAAKNPSVPPIPFSIALTISNGFIFIAIPTKKLASSSAKNG

SEQ ID NO: 6223 - protein, 123 aa, Proteus mirabilis
SLPILKKFESIIMSLPSCPKCNSEYTYEDGAMYVCPECAHEWNDAEPTTDSDELIVKDAHGNLLADGDSVTVIKDLKVKGSSTPLKIGTKVKGIRLVEGDHNIDCKIDGFGQMKLKSEFVKKS

SEQ ID NO: 6224 - protein, 234 aa, Proteus mirabilis
SLPIKILSKREQIIMNNMGAVADKATILLIDDHPMLRNGVKQLLSLDTTLTVVGEAGDGIQGVKLAEELDPDLILLDLNMPGMNGFETLDQLRLRSLSGRIVVFSVSNYSDDLITALKRGADGYLLKDMEPEELLAALKQAAAGKMVVSPTLTPILAQSLREDRSEGERDIDQLTPRERDILKLIAQGLSNKMIARKLDITESTVKVHVKHLLKKMKLKSRVEVAVWVHQQRVD

SEQ ID NO: 6225 - protein, 427 aa, Proteus mirabilis
GITMVMQLIAVAVIIVTVYLLIKKYETRMVLIGAGLLLCILSLTPLDAFTAFSDRMVSSSLIQAICSSMGFAYVMKYTKCDMHLVHVLSKVLTRLGFFLIPATVIVTYFINIAIPSAAGCAAAVGATLIPLLIAARIHPAIAGGAVLCGTIGSMLSPGMSHNAFVANMANMEVVDLIARHSPYSLMAGAIAAVSLAVVALVKKEFKVSSVATDVANSSSQATPEAVRPNYLYATAPFIPLILLILPFFETFSTFKLSVPAAMLIGAIYALIITLTNPAQITKEFFKGMGNAYGDVLGIIIAAAVFAAGLKASGLIDAFINFLTHSPEFARWGGTLGPFLMGIITGSGDAAAFAFNETVTPHAAQFGYEIPDMGMAAALSGALGRTMSPLAGAAIVCAGLANINPMEIAKRTAPGMIIGVIAVALFML

SEQ ID NO: 6226 - protein, 110 aa, Proteus mirabilis
ISVFWSNIAMSKQNRRTLALARRKKLLLDEIQQQRTQLAQEGQTWLEVTAPYDKAWNILTSLKPILLIGASVVSLYSIKHPKKLVRWGRRAIGAVGLIRTLQKSVKKTAD

SEQ ID NO: 6227 - protein, 195 aa, Proteus mirabilis
NIVFFNESCIQIILPVNKSLLYPRQNHSFFFLWNKFNMFNFKKILALSILLPMSIMVKAEEIGYVDTVFKFFGANHKIVIEAFDDPEVKNVTCYLSRAKTGGISGSLGLAEDTADAAISCQQVGPIELSEKVLKGKNRGDVVFQKRTSLVFKKLQVVRFYDKNRHALIYLTYSDKVIDGSPKNAISAVPIMPWKE

SEQ ID NO: 6228 - protein, 429 aa, Proteus mirabilis
FTYIHVCLYYTSQSFINLIIFYPGKQLLNRGFLMRKNRGVLPLALLVLSGSLVIAGCGDKNQSAGGPPPAPAVGVVTLDAKPLTITTDLPGRTSAYRIAEVRPQVGGIILKRNYTEGSYVEAGTSLYQIDPAIFQATLNSAQADLAKAKANAEIARLTVERYKPLLGTNYVSKQDFDTATSQYAQAVAAVKAAEATVTNAKINLEYTKVTAPISGRSGKSTVTEGALVAPGQQVALTTVQQIDPIYVDVTQSSEDYLKLKNEIESGIIRQEQGKPVVHLTLTNGQSYAQKGHLEFSDVTVDESTGSITMRAIVPNPKGELLPGMFVRTKLENGIRQNAILIPQQAVIRTPRGEATTMVVNKDNVVEVRTIEVSQAVGNKWLVNSGVQVGDRVIVSGLQKAKPEMKVTPQEENLDATASTEKSEPAKDPQ

SEQ ID NO: 6229 - protein, 63 aa, Proteus mirabilis
LIHILCLKIYFAVYIKNITLNLCETMRSYRVSSPCLPNSFYENFLLIIELSNIIHCNRALFFI

SEQ ID NO: 6230 - protein, 188 aa, Proteus mirabilis
GLNMNSRYVRALTLLSLIPTSVFALEYPVGQPIIKNGMEIQGVYLQPITMDTEEGHHAMKHLPADKADIHLEADIHAVEDNPNGFAEGDWIPYLTVEYTVTKLDAPEKKQQGTFMAMVASDGPHYGENLKLDGNGQYNVTYKIYPPSYNKDVVFGRHIDKETGVAAWFEPFEVSWDFNYSGTGRKGSY

SEQ ID NO: 6231 - protein, 447 aa, Proteus mirabilis
FSNMKTKVILFSILLLAGCQQSKSIKPDLSAITPTSLGTSTSYQPQYDIKTNLWGYVVSELKMDIPDNERISQQETYFLNNPKHIQTVALRAEPYMYWIIEEIEKRNLPMELALVPVVESAFNPHVTSSAKAAGLWQFVPVTANYYGLAQNQWYDGRRDVVASTNAALDLLERLYIMFDSDWPLALAAYNAGEGRVMQAIKANESKNLPTDYWSLSLPKETMNYVPKILALSKVIRDNEADITFPKSNYRDKSLAAIDIGEQITLSKVAELSQLPITTVKDYNPGYKRGITAPNGPHVILLPRNKLAQFQNAFADEAILKTIRLAVAKANQSIKQEGIYKVRSGDSFYAIARRYNMSVKELQRLNGLSAKSTLLVGQTLKIHNAGSVNNRPTSKPTGASPSYYKVRQGDSYYSIARRHNINLKQLMSWNADIKMLKPGTQLTLYLKK

SEQ ID NO: 6232 - protein, 431 aa, Proteus mirabilis
ESDMSKSETLYNLAQQVIPGGVNSPVRAFNGVGGTPLFIERANGAYIYDADGRAYLDYVGSWGPMVLGHNHPAIRHAVTDAVQKGLSFGAPTAAEVEMANLVTELVPSMDMVRMVNSGTEATMSAIRLARGYTGRDKIIKFEGCYHGHADCLLVKAGSGALTMGQPNSPGVPADFVKHTLTCTYNDLNSVRQAFENYPEEIACIIVEPVAGNMNCVPPKADFLPGLRALCDEFGALLIIDEVMTGFRVALGGAQAYYDVDPDLTCLGKIIGGGMPVGAFGGHKEVMSQLAPIGPVYQAGTLSGNPIAMAAGLACLQEVSQPGVHQTLDELTTMLADGLLEKAQQAGIPMVVNHVGGMFGLFFTDAKEVTCYQDVMNCDVERFKQFFHLMLEKRIYLAPSAFEAGFMSIAHSKEDIQRTIDAAEYAFSKMKA

SEQ ID NO: 6233 - protein, 281 aa, Proteus mirabilis
LTDINNSIYTQHAMEFIIMKPVTLSTLNRYKQEKKKFATITAYDASFARLFANEGIPAMLIGDSLGMTLQGHDSTLPVTVEQIAYHTRCVRAGAPNAFLIADMPFMSYSTPEQACLNAAILMQAGANMVKIEGGSWLIPTVKMLTERAVPVCIHLGLTPQSVNVFGGYKVQGREEAAAEQLKQDAMALEAAGAQLAVLECVPVSVAKTITGSLNIPVIGIGAGNVTDGQILVMHDLLGLTPNAPKFSKNFLQEAGSLPEAVRLYVQQVEQKLFPQEQHSFN

SEQ ID NO: 6234 - protein, 116 aa, Proteus mirabilis
GIDMHEITLCQSAFEIIDSQAKLNNAQKVKSVWMEISALSCVEVSALEFCFDIVCRDTIAQGCQLHIEVIPAKAWCWDCHQVVTVSTFNAGCPACGSQNLRVENDDAMRIKQIEIE

SEQ ID NO: 6235 - protein, 111 aa, Proteus mirabilis
DHCIICDNWRRYGRVVSLVGEPFMCLGVPAKIVEVGDDVHQLAYAEVSGVKRAVNISMVCEGDPSELLDKWVLIHVGFAMSILDEQEAQDTLDALQHVYGVTLEEADDAIR

SEQ ID NO: 6236 - protein, 83 aa, Proteus mirabilis
YCCMMIKTLSMIILVATGIISNAITTQNRATELRGLVCNSKRESVSSGNTWRTCVRVLWSIFIIRKREAKPMKKSKQPSLNPR

SEQ ID NO: 6237 - protein, 83 aa, Proteus mirabilis
GNRMNEKKTIVPDYRLDMVGEPCPYPAVATLEAMPSLKKGEILEVVSDCPQSINNIPLDAKNYGYTVLDIQQDGPTIRYLIQK

SEQ ID NO: 6238 - protein, 486 aa, Proteus mirabilis
EMSMTMQTEVIVPLVGYLLLVFLLSAYAYRKREKGQFLNEYFLGNRSMGGFVLAMTITATYVSASSFIGGPGAAYKYGIGWVLLSMIQLPAIWLSLGVLGKKFAILARRYNAVTLNDMLYARYQSRFLVWFASLSLLVAFVGAMTVQFIGGARLLETAAGIPYEFGLLIFGISIALYTAIGGFRASVLNDALQGLVMLLGTFILLFAIIYKAGGLDIAIQKLNAIDPALTSPHGADGILTGPFMASFWVLVCFGVIGLPHTAVRCISYKDSKAMHRGIIIGTIVMALLMFGMHFAGALGRAIIPDLTVPDQVIPTLMVDVLPPFAAGIFLAAPMAAIMSTINAQLLQSSATLVKDLYLNLAPHAINNEKRIARLSSLSTLILGILLLFAAWNPPSMIIWLNLLAFGGLQAVFLWPLVLGLYWNKANRYGAIAGMITGATLYATLATFNIQIAGFHPIIPALLLSLVAFLVANRFGEQTLPQSAPLQ

SEQ ID NO: 6239 - protein, 79 aa, Proteus mirabilis
THLITITLKSGKNMNNNNDELNNALYRVALVLDKGLESTRELAAGYVETMGLGFDRSVRNLSYFFDGYEDVYENIKYKI

SEQ ID NO: 6240 - protein, 297 aa, Proteus mirabilis
KRLIMPWIQLRLNATSENAEAIGDELVESGAVSVTFQDSHDTPIFEPLPGETRLWGDTDVIGLYDAETDMSIIVAMLENTAVLGKGFVHKIEQLEDKDWEREWMDNFHPMRFGERLWICPSWREVPDPNAVNVMLDPGLAFGTGTHPTTSLCLQWLDGLDLAGKTVIDFGCGSGILAIAALKLGAAKAIGIDIDPQAIQASRDNAQRNGVADALTLYLAKDQPDNLSADVVVANILAGPLRELAPIISTLPRQGGHLGLSGILATQADSVAQAYQEQFTLDPVAEKEEWCRITGVKK

SEQ ID NO: 6241 - protein, 324 aa, Proteus mirabilis
GKLMLSMEKIKQPYWPALKLILSSLIVFSFYLKQSHTPDFSLLINIFDLTLIPMFVFIIGFITKNGTWKSWRDNLLAALVIYATFQTIDMIPLYYSGQFDLNTYLLFPQNGVWFFLATPIWQAFFLLLPSYIRHHKPILFSLLLVSILLSLLTKGYETKLSTFLAIIQYFPFFIIAYLVDQQTIAKLRSQSSVVIALISLLSIFILYYQSNINYIILTKLEGSLFFAKLIIYIISLLISFILSAGIIYLAPTTQKYASLANNALGVYLIHPIICFILLQGIIFFQLSLTLPMVFALIIITISLALLLASIKLIHWFISPTFNIR

SEQ ID NO: 6242 - protein, 76 aa, Proteus mirabilis
LYIISGSDFPLITFSSMTTFSAFSNEGRSYIVSSNAASTMERKPRAPVLRDIAFLAIAVNASLRNSKSTPSNLNNA

SEQ ID NO: 6243 - protein, 145 aa, Proteus mirabilis
FSIMKTFTAKPETVKRDWYVVDADGKTLGRLATEIARRLRGKHKAEYTPHVDTGDYIIVLNAEKVAVTGHKRTDKVYYRHTGHVGGIKQATFEEMIARSPERVIEIAVKGMLPKGPLGRAMYRKLKVYAGAEHNHAAQQPQVLDI

SEQ ID NO: 6244 - protein, 222 aa, Proteus mirabilis
QKIMQKKTSPQILCQKIADIIRQKITIGELPPGERLSEATLSEQLEISRNTLREVFRILTQEGLLTYKPNRGVFVSVPDMASIMDIYRVRRLIECDALRHAYPMHPAISRMQDNVNQAKMFQQQKDWNSVGTCNMHFHTAIVELSDSPRLFKQYQLILAELRLAFGLLNDPQLLHAPYIEKNEHILTLLMNGKAQEAAIEMESYLEISERTVLAAFSRHNIC

SEQ ID NO: 6245 - protein, 400 aa, Proteus mirabilis
GEIMKHTLLKTTAIAMALSVGVVQATEYKASTAEHPIKIVNLDALENQVKENMDKGAFGYIRGGAEDENNLRSNTNAFNKKYIMPRALQGIEFSDLNLKTEFLGIKLDTPIIQAPMAAQGLAHQQGEVATAKGMAKAGSIFSLSTYGNKTIKEVAQAQPGYPFFFQLYMSKNDAFNQYILSQAKQYGAKGIILTVDSPVGGYREDDIKNSFQFPLGFANLEAFAKISDDKSKTGKGSGISEIYAQAKQAFTPADIQYVKKMSGLPVIVKGIESPEDADTAIKAGADAIWVSNHGGRQLDSAPATIDVLPAIAKVVNKRVPIVFDSGVRRGSHVFKALASGADVVAVGRPILYGLNLGGAEGVNSVIEQLNKELRINMMLGGARNVKEIQATHLYTDADFK

SEQ ID NO: 6246 - protein, 66 aa, Proteus mirabilis
IGVIGEFCDSPVLDKTGVTAVTFVVIKKLNSTNIDTRLFLLICCFINIPINFLGLFLSPYIHDYRS

SEQ ID NO: 6247 - protein, 65 aa, Proteus mirabilis
GFVILMPKRQEQLSYDFHIKGFLKLSHSGVNTKTFSLVIYLPVIHIIGFIFHCLKQQHSNKINKN

SEQ ID NO: 6248 - protein, 179 aa, Proteus mirabilis
SLSICLLFLCDLNKFGIVFCHQNATFHIKTATTNHRLTGHLMKLTIEKLPQLSAQDKIDLGKIWQDSEYQMALTAPITTEHALFVARFNGRLLAACRIKYQAKTALISDFMVREVTRRRGVGHYLLTQCLEKNPTITHWQALLKTGQINDPVAQAFLAHHHFTTSLQADTYDYLCNDKA

SEQ ID NO: 6249 - protein, 241 aa, Proteus mirabilis
KISIFRSILMKKTVVVFSGGQDSTTCLIQALEQYDEVHCITFNYGQRHKEEIEVAQRVSQLLGATAHKVLDVSLLNELAISSLTRDNIPVPDFKQSEQSDIPSTFVPGRNILFLTLASIYAYQIGAESVITGVCETDFSGYPDCRDEFVKALNHAVNLGIARDIQFITPLMWLDKAQTWALADYYGKLDFVRHNTLTCYNGIQGDGCGQCAACHLRERGLHGYLQDKNAVMDAMKNKVGLK

SEQ ID NO: 6250 - protein, 126 aa, Proteus mirabilis
IMSILDEWAERHIEKALKNGELSSLPGEGKPLVLDDNSHVPESLRASYHLLKNAGFLPPEMQDRKDALSLAEILSSLSETGIKDEQLQKKLTLLELKLQQAGMDTQFLHTDYATQLTEKLATHKHK

SEQ ID NO: 6251 - protein, 165 aa, Proteus mirabilis
IVTINPYRSRGRWIIWLSFLIALVLQIMPWPEQLEVYRPIWPVLFLIYWITSLPHRISVGTAFVLGMSMDLVQGTTLGVNALAYTLVSYVIAFKYQLFCNLALWQQALVVMLAIGVVDLTVFWAEFLLSPVTFHPQVFWNSPVSGILWPWLYFLLRKVRHQFSVH

SEQ ID NO: 6252 - protein, 413 aa, Proteus mirabilis
GIAMRIIHTSDWHLGQYFFTKTRAQEHQQFLDWLLAQIREQQVDAVIVAGDIFDTGSPPSYARELYNRFVVAIRDTQCQLIILGGNHDSVATLNESKSLLACLNTTVIANVHTETPQAPIILYQKNHTPGALLCAIPYLRPRDMINSKSGQSGADKQGALKEAIADYYQRQYQAALDLRKQLNVNIPIIATGHLTTIGASVSDSVREIYIGTLEAFNATLFPPFDYIALGHIHRPQRVNKSGHIRYSGSPIPLSFDESAQQKSVCLIDFEQDKLAEMTLLPIPEFQLLRTLSGSLQEIATQLEKLATQYNEMDTTIWLDIEVSTQDYLSDIQNRIQELTQSPLFEVIVLRRARKQHQALMQNEKETLTELTVYDVFERRLAQHQFETEEDKTRLTTLFKQAVEMAEQEDNNAR

SEQ ID NO: 6253 - protein, 143 aa, Proteus mirabilis
IMAMNLGNDSGEDNELHDINVTPFIDVMLVLLIIFMVAAPLATVDIKVNLPASSAKPQPRPEKPVYLTIKSDKQIFIGEEMVTHETMASVLDSMTQSNKETTIFFQADKTVDYETLMGAMDSLRKAGYLKVGLVGMETVSSGN

SEQ ID NO: 6254 - protein, 116 aa, Proteus mirabilis
NLQIIFCSFMEYPLVPAQIWFHEIDSYRSNIFSWETIEYPLDDSGEDCVKSTIVALLNLISKYFSKIPNWFILKKSKLASNNSLLDMATPNNGDDLSIGLMNKTGWWTEFCILLIV

SEQ ID NO: 6255 - protein, 134 aa, Proteus mirabilis
LSQITNLVKSSHIGMSPLMKKMFALFCTIILSFATLFSSSAKALTYTQAEDLADLTAVYLFLNNDCGYEQISKQKIERALIIFSQSQQWDVSNYSMLPMSKLNEDSYQDLKNIQIAHNKKCQLLAQKSLSLLNY

SEQ ID NO: 6256 - protein, 329 aa, Proteus mirabilis
RRQIMEPIAVTILTGFLGSGKTTLLRHMLNEEHGYKIAVIENEFGEVPIDDEIIGDRATQIKTLTNGCICCSKSNELEDTLLDLCDSLDRGDIVFDRLVIECTGMADPGPITQTFFSHEVICQRYLLDGIITLVDTIHAQQQLDQFAIAQSQIGYADRILLTKTDIQPASQQLLARLRRINARAPTYTVINGNIDLALLFNVKGFMLNDTLEIKQPLFRFQPEKQDDIQSIVLNFDYPVELQAVSDVMESLLLSFADNLLRYKGILNIKDSPNRLLFQGVQRLYSADWDRPWQENETRQSTLVFIGIHLPEEEIKASFDALMHNTKEYE

SEQ ID NO: 6257 - protein, 93 aa, Proteus mirabilis
KAQMTQYRRVAIKNRLGMHARPAMKLFDLVNTFQSTVTLRNHEGVEAQADSVIAMLMLDSEQGSHIDIEASGCDEKEAIDAIIALFESGFDED

SEQ ID NO: 6258 - protein, 641 aa, Proteus mirabilis
MGKIIGIDLGTTNSCVAVMDGKNARVIENGEGDRTTPSIVAYAQDGEILVGQPAKRQAVTNPQNTLFAIKRLIGRRFEDAEVQRDVSIMPYKIIKADNGDAWVEARNEKMAPPQVSAEVLKKMKKTAEDYLGEPVTEAVITVPAYFNDAQRQATKDAGRIAGLDVKRIINEPTAAALAYGLDREVGNRTIAVYDLGGGTFDISIIEIDEVDGEKTYEVLSTNGDTHLGGEDFDSRLINYLVDEFKKEQGIDLRNDPLAMQRLKEAAEKAKIELSSAQQTDVNLPYVTADATGPKHLNIKVTRAKLESLVEDLVKRSMDPVKVALEDAGLKVSEVNDVILVGGQTRMPMVQKTVAEFFGKEPRKDVNPDEAVAMGAAVQGGVLAGDVKDVLLLDVTPLSLGIETMGGVMTSLIAKNTTIPTKHSQVFSTAEDNQSAVTIHVLQGERKRASDNKSLGQFNLDGIQPAPRGMPQIEVTFDIDADGILHVSAKDKNSGREQNITIKASSGLNEEEIQKMVRDAEANAEADRKFEELVQTRNQADQLVHGTRKQIEEAGDKLAANDKEAIEKALSELEIASKGEDKAAIEAKLQALVEASKPLLEIAQQQAQAGAGNTADATDAGAKKDDDVVDAEFEEVDGKDKK

SEQ ID NO: 6259 - protein, 77 aa, Proteus mirabilis
TAKIIPLIVSISKRSLRVSLTTDAPENAVLNHDTTAVFRIPCNTYGLSASSTWLFYVHNESEIGLYRASLALLALSQ

SEQ ID NO: 6260 - protein, 178 aa, Proteus mirabilis
ENKMKLKKLHLVLGLGLSIIAGSALAADQGHGTVEFYGSIIDAPCSIDPDSGAQRIPLGQVSSSALKDGGRSASKMFKIKLLQCSTETYKTVKTTFTGAEAPDVLEGALGIEGIAKNAAVVITNAGGEQIKLGQASAAQTLNDGNNDLNFAAYLQGSSSKAAIPGDFTAIATFALSYQ

SEQ ID NO: 6261 - protein, 317 aa, Proteus mirabilis
MLKIHHGDQDFIMELTFLGTNAGVPSKDRNVTSMVLDLQNKQKSLWMFDCGEATQHQILHSHVKLSRINKIFITHLHGDHIFGLPGLLCSRSMGGTENPLTIYGPTGIKAFIETALTLSQSYLTYPLDIIEIEQDGFLFEEEGIRVSCGALSHPVPCFGYRLEEDNKPGKLNADKLEAENIPRGPWYKLLKQGKTVTLPDGRIIDGKDYLSTEIKGRCIVIFGDTQPTPNAVKLAENADVIVHEATFKHDMADKANSRGHSSTIQAAELAKKANAKRLIITHISSRYSPKETPELLAECHTIFDNTQIASDFETFKL

SEQ ID NO: 6262 - protein, 227 aa, Proteus mirabilis
GAKIMRVSRRKFVAGIGSVIFFSAPLGSALAAATDKKPIRYAMIHDETRCNGCNICATACRRLNKVPTGMARMDIAHIPLSLKEDNDKYHFFRHSCQQCEDAPCISVCPTGASWRDESNGIVRVNKEKCIGCSYCISACPYQVRYLNPVTHVADKCDFCLESRLQKGFPPICVSACPQNALLFGREDSPQIQQWLKTHDYYLYQLDGVGKPHLYRRVGPHVQGGDNV

SEQ ID NO: 6263 - protein, 91 aa, Proteus mirabilis
CEKMVNTMNAQFDDATKTLDTLGLRCPEPVMLVRKTIRNMAQGETLLVIADDPATVRDIPGFCRFMEHDLLQQETQATPYRYLIRKKEGQL

SEQ ID NO: 6264 - protein, 492 aa, Proteus mirabilis
LTEMTKVRRNISRHHKKGIVSWQITVFFLLIRNFIVTSFADLHALPAEQLTNLNELGYLTMTPVQEASLPAILAGKDVRAQAKTGSGKTAAFGLGLLQRIDAKQFNTQSLVLCPTRELADQVANELRRLARFLPNIKILTLCGGVPFSIQRDSLIHAAHIIVATPGRLLDHLNKQTVTLADVKTLVLDEADRMLDMGFFDDISDIISQMSTQRQTLLFSATWPDEIAKISRKIQQDPVTIEINSPDELPAVEQQFYEISRYGKLGLLQKLLSHHQPNSCVVFCNTKRDCQDVYEALTESNQSVLALHGDMEQKERDQTLIRFANGSCRVLVATDVAARGLDIKALEMVINYELSHDPEVHIHRIGRTARAGESGLAISFCAPEEIPRANALEEMLNIKLDWQSAPSGLSITPLVATMATLCIDGGKKAKMRPGDILGALTGDLGFSGEDIGKINIHPTHAYVAVKQSIAKQVWKSLQQGKIKGKSVKVRLFR

SEQ ID NO: 6265 - protein, 195 aa, Proteus mirabilis
RHRMNKLKSWFTLILAIIALGLIGWNYTNNTELDDGKIVEDGQPTYQSKSSISFVYEPTGILGYKLVADDVKNYAQQKFTWFTNPVLTTYSPTGDATWTVRANKAKLTNSKMLYLYGDVQIDSLTDDSQLQRISTENAIADLDTQDVSSDDEVTIIGVGLKSVGLKMRGNLREKRAELIEQVNTYYEIPNESKNP

SEQ ID NO: 6266 - protein, 434 aa, Proteus mirabilis
DNRILLNKIQKTQRSLIMNIVDRFISYTKVNTTTNRENGAAGIMPSSEGQRVLALQLVEELKALGVEDIKIRDTAIVTATLPSNLDYEVPTVAFFGHLDTSAEQTNDTKAQILPYKGGDLCLNKELEIFLRQSEFPELENYIGDDIIVTDGTSLLGADDKAAIASIMDMLQYFKQHPEVKHGTVKIGFVPDEEQGLRGAKAFDVTEFGADFAYTLDCCGIGELVYENWNAGDVEITFIGTSAHPMSAKGKLKNSLLMAHKFIAMLPGGEAPEYTEGREGYYWVKQLAGNSARTVLKMDVRDFTEAGYAHRMAFLKQLSEQCEALWGEGTVVCKQADRYANVFNSLQGENRYPIDIAIDAYKANGITPRPIPMRGGYDGAALSQKGLPCPNIFTGAHNFHSIYEYLPVKSLYAASDVLKSVVKITAERFAPGAKA

SEQ ID NO: 6267 - protein, 312 aa, Proteus mirabilis
GYGIMSNPFTISNFPEQLETSPLIDESHHYDDPLPPKDLVFLQSINNQECKIKSSQVNGRFTNTVPMFLVLIVMMFYTLFNFIEGHIITKYTLEDNIKEIENYSTYYTGNDRVVLRDINKYKPFFGKEKISWWEYIKAYNSGKFFVGSEDDKYFVLAWLVLFPSGLYILSSLAFFVPMTYLVADRKRQILYSYVDGIVMATRYEDAQFGYAGKMLAFKLFYIHSETGELGIHIYRPNVSHYTGFLLSSDTEDHRFITFLNAYMQQGRDAVCTSDYYARAPLFCFAKNPLPADFEQQVEQILAKLDQEKKRHA

SEQ ID NO: 6268 - protein, 405 aa, Proteus mirabilis
VFLMNKKLKILWMHYNMYMVLPLKRLMMQYVDEFRDPELAKALLAQIRETISQWPHPITRPLQIMEVCGGHTHAIFKFGLDRLLPQEIEFVHGPGCPVCVLPMGRIDACLEIAARPEVIFCTFGDAMRVPGRHGSMLDARRRGSDIRIVYSPLDSLKIAQDNPDKQVVFFGLGFETTMPSTAMTLQQAKLRGLKNFSLFCQHITIVPTLRCLLEQEDVRIDGFIAPGHVSMVIGCTPYQPLCDEFEKPFVVTGFEPLDLLQAILMVVKQLKAKAENADYVLSIENQYSRIVPNEGNKLAQKALKDVFMLKESSEWRGLGEIPMSGIQLTPAYAEFDAERRFTPAPQQVADNPQSRCGDVLTGRCKPSDCPLFGKSCTPETALGALMVSSEGACAAYYQYRREGNI

SEQ ID NO: 6269 - protein, 70 aa, Proteus mirabilis
RQLIRVLTLSPSSPLKVLYNPKAFFIHAAWLHQACAHCAIFPTAASRKSLGRVSVPVWLIILSDQLEIRA

SEQ ID NO: 6270 - protein, 254 aa, Proteus mirabilis
LKMMASKHLFMVTTTLLTGMVFTSQVGATIALDRTRIIFNGADKSVSLSISNQNKELPYLAQGWLENEQGEKIETPLIVLPPIQRIEPGNKSQVKVQSLPDIAQLPQDRESVFYFNLREIPPRSDKPNVLQIALQTRIKLFYRPKSIYATQTDLSNPWQEKITLTKQGESYVVHNPTPYYITIVDGLTDLKGKSLEGFTPIMVAPRGQEKLNLTVSTLGASPVLSYINDYGGRPRLKFSCDSRECKVIETDQGN

SEQ ID NO: 6271 - protein, 254 aa, Proteus mirabilis
LKMMLLKRSCIVATTLLMGMAFTHQAVAAIALDRTRVIFNGAEKSISLNVSNQNKDLPYLAQGWMENENGERIESPLIVLPPIQRIEPGDKSQIKVQSLPDIAKLPQDRESVFYFNLREIPPRSNKPNVLQIALQTRIKLFYRPASIYASQTDLTNPWQEQITLTKKGDRFEVNNPTPYYVTLVDGLTSLKGKSLDGFEPLMIAPKSSGTINLSASMFGASPVLSYINDYGGRPQMKFTCSGNQCKVTETAAGN

SEQ ID NO: 6272 - protein, 182 aa, Proteus mirabilis
RVSICFTGSGQPLVLIKNIKRVRNQLMDIRKIKKLIELVEESGISELEISEGEESVRISRNSGVQGQMAPQQYFAAPAAPQPALAAAVAPVAPETPAATATQEISGHVVRSPMVGTFYRSPSPEAKVFVEVGQQVNVGDTLCIVEAMKMMNQIESDKAGVVKSILCQDGDTIEFDDPLFVIE

SEQ ID NO: 6273 - protein, 89 aa, Proteus mirabilis
RSAFGNAETGAAWLSSARVVKCWVKSRNERNPYPLLPARNGGNSKETAGDKPEEGGDDVKSSWPLRVGLHTCYNGRYKEKRPRESKRNS

SEQ ID NO: 6274 - protein, 1244 aa, Proteus mirabilis
QRTMKILSLRFKNINSLKGEWKINFDQEPFVSNGLFAITGPTGAGKTTLLDAISLALYHRTPRLDKVTQSQNELMTRHTAECLAEVEFEVKGVAYRAFWEQRRANYKEEGNLQAPQAELAKINRLGGEDKVLANKISQVKEKIISITGLDFDRFTKSMLLSQGQFAAFLNADDKSRAELLEELTGTDIYRHISQTIFKHWREEEQALNTLKQQAQMMALLDATTRQELLTQQANIQAQVTRLQKEQQEYQVAKQWQEKALEIQQQQQSAQAGLNEAQQALIIAQPDIQRLEKNEPAEKIRPLYDEKNRRLTEQNYLATQLTSLKTEKQAIEQQSLPINKKLADFHEQLKTHHEKKQHTLQLIREKVLPLDNQLGLLQQEISTNNQHKHKLEKICAEYLQHSQLAEKKLITTQQQVNQLNNDLTQHAYHAQLAENLPLWQHYFQQYNEISSQYLANQKRETVEQEKVISLEKALQQATQTLATQQEQLNLQQQQLQSYQTQLDARQKADKPDEIKPRLQQINLQKNALAKIINLHTQLQRNGKEQQHYQTTLSENQQKIATLTQTIAENDLALKEKAQHLKDLNDNYLLLQKVAEYEQERARLLKDKPCPLCGSTQHPYVETYHDIKPDETKLRLEALQQQVHSLTITLAEQRTQRVNYGSQNSTLSDNIAQLTQENSVLTQQWQTLAQAHHLPLVDDANNLLTLEQSLNQQELILTEKLDNYQQLEAQTHQKNTYFLNAKEQFNQQQQSVKQQQNDLDYLQKTIKTYQQQSEHLHQQQQQLAQHIQSAIEKQGYTLPEFEQFTPWLAARQQEHQQYQSQLKELQLLQQSLREQQVTQNEKKRYLAEKQAELEALLAKLSQQQHQQTQWQDQRQALFGSQSVEQVRSELDKHSQFLQTQIEQYTQEKNQLENRLNQLIGQYQENEKALQRAITQAQQATEHYQHALKESLFADENDFLASLLSVEERTRLQEQQKQRLDKLLQEKTRLETQEKAYQQHLLQQPLLSTQCTAEQCNIHLDDLAKQHKALQETLFSLQIQLRQDDEKRIEQQTLLVQIAKQQAHYDDWSYLNELVGSASGDKFSRFAQGLTLDHLIYLANRRLEKLHGRYFLQRKTTGSLELQIADTWQADALRDTRTLSGGESFLVSLSLALALSDLVSNKTQIESLFLDEGFGTLDPDTLDIALDALDSLNASGKIIGVISHVEAMKERIPVQIKVKKAGGLGISQLAPEFRYGNKSNENQSVKD

SEQ ID NO: 6275 - protein, 236 aa, Proteus mirabilis
IQQMVLVRKLKKLLIILIALWLGIVVLFSFLPVPFSAVMLQRQISSWSKFDFSYVSHSTWVNENEISPQIYLAVIASEDQNFPKHWGFDFDAIEKVFQNSLQSSKTIRGASTISQQTVKNLFLWDGRSWIRKGLEAGMTPVVELIWSKKRILTVYLNIVEFGDGIFGVEQASQHYFRKPAKQLTAHEAALLAAVLPNPHILHVNKPSAYLLKRQQWILNQMRLMGGTSFLSKNALL

SEQ ID NO: 6276 - protein, 338 aa, Proteus mirabilis
RYKMSHLILKSSVLIHRRKQQMQILLANPRGFCAGVDRAISIVERALEIYGAPIYVRHEVVHNRYVVNDLRERGAIFIEEISEVPDNAILIFSAHGVSQAIRQEARSRNLTMLFDATCPLVTKVHMEVARASRKGKEAILIGHAGHPEVEGTMGQYSNPEGGMYLVESPDDVWKLKVKDEDNLCFMTQTTLSVDDTSEVIDALNKRFPKIIGPRKDDICYATTNRQEAARELAERADVVFVVGSKNSSNSNRLAELAQRAGKPSYLIDSAEDIDEIWVSHANIVGVTAGASAPDILVQQVLARLKAFGAEEVIELSGREENIVFEVPKELRLDYKVVE

SEQ ID NO: 6277 - protein, 437 aa, Proteus mirabilis
GNKMQVSVETTQGLGRRVTITVPAADIQKAVDSELKKAAKTVRIDGFRKGHVPMSMVKQRYGMSVLNDVLGDLMQRNFINAIIENKVNPVGAPDYKPEQYKEGEDFVYSVEFEVFPEIELKDLESIEVVKPIVTVKDEDVDNMLETLRKQQAEWKDKEGEVAAEDRVTVDFNGSIDGEEFEGGKAEDFVLAMGQGRMIPGFEEGLIGHKAGEEFTIDVTFPEDYHAENLKGKKAQFAINLKKVEERELPELTEEFIKRFGIADGSVDGLRAEVRKNMERELKNAIRTRVKSQVIDGLVKANEVDVPAAAVDSEIEVLQRQAAQRFGGDEKQALQLPRELFEEQAKRRVISGLLLGEVINSNELKAKDERVKALIDEMASAYEDPSEVVEFYNKNEQLMNNIRNLALEEQAVEKILATAKVTEKETNFTELMNEVQMG

SEQ ID NO: 6278 - protein, 324 aa, Proteus mirabilis
EFEMSTKSIPASKRWFSKAWLLEQKSLIALLLLIVVVSTLSPNFFTLNNIFNILQQTSVNAIMAVGMTLVILTSGIDLSVGSLLALTGAVAASMVGADVNALVAVVGALALGAAIGGVTGVIIAKGKVQAFIATLVMMLLLRGVTRVYTDGSPINTGFSDNADLFSWFGIGRPFGIPTPIWLMMIVFLSAWYVLHHTRLGRYIYALGGNEAATRLSGISVDKIKIIVYALCGLLAALASVIEVARLSSAQPMAGNGYELDAIAAVVLGGTSLAGGKGRIMGTLIGALILGFLNNALNLLGISSNYQMIVKAVVILLAVLVDNKK

SEQ ID NO: 6279 - protein, 76 aa, Proteus mirabilis
TAEMEIAGGAIVGYCATGSLMSAKRPASMVIMAITHANIGLSIKNLGIDHRLLIEDPSLVQIFQLMLLHLNFLLVA

SEQ ID NO: 6280 - protein, 208 aa, Proteus mirabilis
DKEMQEYNQPLRIGVGGPVGSGKTALLEVLCKAMRDSYQIAVVTNDIYTQEDAKILTRAQALDADRIIGVETGGCPHTAIREDASMNLAAVEELAMRHKNLDIVFVESGGDNLSATFSPELADLTIYVIDVAEGEKIPRKGGPGITHSDLLVINKIDLAPYVGASLEVMEADTAKMRPVKPYVFTNLKEKVGLETIIDFIIDKGMLRR

SEQ ID NO: 6281 - protein, 170 aa, Proteus mirabilis
SMEIKDMSPRRPHLLRAHYDWILENELTPHLVVDVNVVGVQVPMEYAHDGQIVLNISPFAVSHLELMPHQVLFSASFGGVPRKVRVPMAAVIAIYARENGAGMMFEPEPAYEEGYTPSLVDDEQQDGSSASATEGLSLVKDETQVENPSSPDDDPEPPRPTGRPSLRVVK

SEQ ID NO: 6282 - protein, 242 aa, Proteus mirabilis
VKEIMMNKQNASASIPPDIAHDADITLEQPDISLRRWLLPLSERGIGHGTHTLTDTTEEQIEDIAQLSAEQHLANAIRQCSKEGELLAISTLYDAPYSLSEEEVMQLRVALNEDAFVDITYLTHNGEDYFYSDTVMSDNYAQLQLLNRYTDICTAIAGLVRFECETYPRPLKQSMLMSEPFYYTAAEIDDALTLMKTHPDFQDIQQIFASNNAPYLFSSTLMSYGKARGLTEWLEVEQYENP

SEQ ID NO: 6283 - protein, 212 aa, Proteus mirabilis
PLWIMTVFLCHRHEDIIVITLYLASSSPRRRELLSLLDVQFSTITPAIDEIWQQGEAPEDYVIRLAREKSQEGVRQATNDYPVLGSDTIVVQAGRILEKPRDKAHAAQMLSNLSGATHQVMTAIAISDKTRTISQLVVTDVTFRKMTESEISAYIETGEPMDKAGAYGIQGKGGRFVQRIEGSYHAVVGLPLVETEALIAQFLSLANDKEIS

SEQ ID NO: 6284 - protein, 362 aa, Proteus mirabilis
SRRIFPSRLAGLSFRMFKKFRGMFSNDLSIDLGTANTLIYVKGQGIVLDEPSVVAIRQDRAGTSKSVAAVGHEAKQMLGRTPGNIAAIRPMKDGVIADFYVTEKMLQHFIKQVHNNSFMRPSPRVLVCVPVGATQVERRAIRESALSAGAREVFLIEEPMSAAIGAGLPVSEATGSMVVDIGGGTTEVAVISLNGVVYSSSVRIGGDRFDEAIINYVRRNYGSLIGEATAERIKHDIGSAYPSDELNEIEVRGRNLAEGVPRSFTLNSNEILEALQEPLTGIVSAVMVALEQCPPELASDISERGMVLTGGGALLRNLDRLLMEETGIPVIVAEDPLTCVARGGGKALEMIDMHGGDLFSED

SEQ ID NO: 6285 - protein, 97 aa, Proteus mirabilis
IMGMKSVNKTQLIDKIAANADITKAAAGRVVDAMVASITESLQKGDDVALVGFGTFTVRDRAARTGRNPQTGKEIQIAAAKVPAFRAGKGLKDAVNQ

SEQ ID NO: 6286 - protein, 1155 aa, Proteus mirabilis
EAVFQYSLNKLLNMRGSNVFIRLNHFISTIFIVSILFVLLGNILFTSAKAETVSNNLPTKESIQNQLNLLNKRSDLSAEDKLTIGDLEQALLLLDNIQQLEKKADDYNKTVEQLPEKLRSIQNQLSQLKQKIANKEVDDYRQSLESLPLATLESQLEEVLQSLAKAQEDLANYSNELIVLQTQPERAQSVLFNNSERLQQIRIALNKSSADKAQMRSSSVQLLQLEQYYLQQQNSFQKRTLQSNVQLQSLLQLQRDYSSAYIDLSQEHAQLLQEILSDKRLDSSEEVAKEAQTAELSNQAIKNNAFYLAQADINKKLSDKLIITTQNNNELNRHSLMVKNRLDRAIQSERNLKEQIDVLKGSLLLSRILFEEQIELPDDIFINKLPDKIADLRLEQFEINKQRDQIFQPNLYIDQLMQEYQATHPEITDKNELKELHNALLQLIDARRDLLDKLNNQLGSQISESINLQMDQQQLRSVVSSLENTLAQQIFWVSSNKPINLSWFSTFPDQAVAEFQSFKLNWSNENLLTGAKKSYPVLIALILFSSILVWQRKKFDKQFDKLSADINKLNKDTQLHTPLALGIVFLKTLPLSCIVLAIGYWLINSFNVQQEFIWSFTWQFAVFWLMFEWSYRLMSDNGVAVNHFKIPLERVQQNRKRLLRLSLPMLPIILLSAYGINNPLLLVGDVIGQLVTIISLFFISLCALPFCREMWQEKGNHVVRTVVITLLTFSPLLLMGLVIFGYYYTALRLANRWIDSLYLLMLWFIAYHASLRGLTVAARRLAYRRALERRQAMLKEKKEGDDNTLEPIQEPPMDMEQINQQSLRLTTMILFIIFASSFYGIWSDFITIFTYLDGITLWHYNLPTELGNVVKAVTVADLLLSFAIMAISWFMIRNLPGLLEVLILSRIKLQQGASYAITTILTYIIIAIGTIVSLGILGVAWEKLQWLAAALTVGLGFGLQEIFANFVSGIIILFERPVRIGDTVTIGSYSGTVSRIRIRATTVTDFDRKEVIIPNKAFVTERLINWTLSDTVTRIIIQVGVAYGSDLDKVKTILMKAAKDNPKVMTEPEPVVLFTEFGASTLNHELRFYVRTLGDRNTAIDEVNRAIDKLCNENDINIAFNQLEVYLHNKQGEEVQEIKKGPLDGSTPEANTPFN

SEQ ID NO: 6287 - protein, 459 aa, Proteus mirabilis
APYFINGRIMMLIKKLFTLFSVGLLSLPASAVTLSDLYFLAIKHDPTFNAAVKEQVAGKEYENIGLSQLLPNISVNYKNNPRNWQRKAYPINIFQDKITTVEYQNYQSYSVNAIISQPLFDYTAFSEYKASIIKTLLADSHYQNKFSELIIRLIDNYIQVAYTQDKLLLNQAQQEIYQKQLASSQRLFELGEGTKTDIAEIETRLYLTQSQYTDLQLEIEKAKNKLSAMIGSQLPTHEHIAKLTDTKFVLQSLAPDDYSTWEKNAIQNNLKIQSARHEMAIAKQEIEKNRGEFFPTVQFYAAYSSSNSDSNNTINQKYQSANVGFYVSMPLFNGGKTTASMRQSTAKYQMSAFERDAIIQNIMQELRYQYQICSTSHIKLMAFEQAVSSAKLQLNATRKSYIGGQRTMVDVLNAEELLYRAQQDLIKAKYDYIQAWALLHQYTNTLDIEKIKIIENYFQ

SEQ ID NO: 6288 - protein, 220 aa, Proteus mirabilis
LINLEVFMAVAANKRSVMTLFSGPTDIFSHQVRIVLAEKGVSVEIEQVEAGNLPQDLIDLNPYQSVPTLVDRELTLYDSRIIMEYLDERFPHPPLMPVYPVARGSSRLMMHRIEQDWYSLMNVIEKGNDQQANAARKQLAEELLAVSPVFKEYPYFMSEEFSLVDCYLAPLLWRLPVLGVDLSGAGAKDVQIYMQRVFERDSFLASLTEAEREMRLPSRG

SEQ ID NO: 6289 - protein, 420 aa, Proteus mirabilis
TNNFGMVKDRSMAVASETAKEPTVLSRRKLLCIAGMGWTFDAMDVGLLAFLLTALKEDWGLTAAQLGWIGSINSIGMAVGAFVFGIMADRKGRKPVFILTLLLFSLGCGLTALASSLMVVLILRFFIGMGLGGELPVASTLVSESVKAHERGRIVVLLESFWAVGWLIAALIAYFIIPDYGWRMAMLLSALPAVYALYLRSKLPEPSSTQSLLQNRLSLRQSMALIWSPQYRRSTLMLWVLWFCVVFSYYGIFLWLPSVAMLKGFSLIKSFQYVLIMTLAQLPGYFTAAWFIERYGRKFVLITYLAGTAISAYYFSVADSTTTLLVFGMLLSFFNLGAWGALYAYTPEQYPDGIRATGAGTATAIGRIGGILGPLMVGYLVQYQFDISTIFLIFSLSIVIAILAVMLLGKETKNRPLNSI

SEQ ID NO: 6290 - protein, 291 aa, Proteus mirabilis
LGNLGVSVMQLIAPLVVSVGVFAMFSGPGVVQPDGSRLWLENAAWIWVPFLLIFTFAAWFGMNDLAANKASLSQQLPVLKRGHLWLLSILYLCSFGSFIGFSAGFAMLSKTQFPDIVILHYAFFGPLLGALARPVGGALSDKFGGIKVTLINFIIMAIFSVLLFLTLPENGAGGSFIAFYGVFMVLFLTAGLGSGSTFQMIAVVFRKITIDRMKAQGASDEAAQKEAVTESAAALGFISAIGAIGGFFIPKAFGTSLAMTGSPAGAMKIFVLFYIACVLITWLVYGRKHNK

SEQ ID NO: 6291 - protein, 71 aa, Proteus mirabilis
ISFVGLKEASIFTLFIIMNIKIASFKAKESRRNNFLLPNYDLNNKISFVINKTYDINFKIRIIIIAISING

SEQ ID NO: 6292 - protein, 415 aa, Proteus mirabilis
TNFVYTIDKFDVYQGITMTALPRKNMWQIVLTIILVGINLRPFLTGPGPVIDNIIASTGMSYSQVSLLTLLPMILMGVGALVVPFLQPYIQARRGLQVAMLILLLASFSRAYVSDGDQLLITALFCGLSVAYIQAVFPGIIKAWFGQKTPIMMGLYSAMLMGGGALGAQLSPVLTASDGNWQQALAWFALPASVALVAITLSIKKNISETNKLPLNTLIWRPRTALLIVGFGFVNAGYASMVAWLAPFYQSLGMPSAQSGSLVAILSLFQASAALIIPFLAAKNHDRRFWLLLTLTSQLIGFLALMTMPMSAPYLWSIFLGCGLGGCFSMMMIAALDHVPHPLHAGALSALMQGGGFIIASFGPLIAVWLQQDDGSFTYAWAFHAVLVILTMGLFARLNPHNYNKAYPTSHILTD

SEQ ID NO: 6293 - protein, 444 aa, Proteus mirabilis
AIPVWLLAVLSFCFLGKNILKNNTKTIYINQNIAIIYFVSMETKLRGNIMKLSIRSLFYLVCFSALLGSLAQNIYTPVLPLIQQQFNTTLSLVNLTVSAFTFAMAVMQLCYGSLIDKWGRKPILLSGLTISIIGALICIWANSINLLIFGRVIQAIGIAAIPVVAATILGDLYQGNERAKAMGSYQMLLALAPASGPLLGGYLAQHYHYQSIFVFLSMVGLVLLIAHLFYLPETRPEQKQSVKSLSAMRQVLAAPEGKSVFVISFMVFYNYFCLLVFLPLIAFHLYHLNSSEIGGLYVPMSIALVLGSYLYRKVCHLFSAEYGVIITSCINLAMLSLFALFWQISLPIMLILTVLYGLSLGLTMPTHTTLITSHFSSVRATAMGIYNFIRYCGMAAGPMVASYFVTDNHYQYVFYSCVILTSLALCFAIKTLLSTLKQQRQTID

SEQ ID NO: 6294 - protein, 621 aa, Proteus mirabilis
INNVSELNSRQLFQFSLEQWRSAVQTFNADIAIIGAGGAGLRAAIAAAEANPQLKIALISKVYPMRSHTVAAEGGSAAVTQAHDSYDFHFNDTVSGGDWLCEQDVVDYFVEHCPTEMTQLELWGCPWSRKEDGSVNVRRFGGMKIERTWFAADKTGFHMLHTLFQTSLKYPQIQRFDEHFVLDILVDEGHARGVVAINMMEGTKVQIRANAVIMATGGAGRVYRFNTNGGIVTGDGMGIALRHGVPLRDMEFVQYHPTGLPGSGILMTEGCRGEGGILVNKDGYRYLQDYGLGPETPLGKPENKYMELGPRDKVSQAFWHEWRAGRTIKTHRGDVVHLDLRHLGAKKLHERLPFICELAKAYVGVDPVNEPIPVRPTAHYTMGGIETNQRTETRIKGLFAVGECSSVGLHGANRLGSNSLAELVVFGRLAGEEAVRRAQEATPANASALDAQTRDIEDNLKKLMNQKGSENWAQIRDEMGEAMEEGCGIYRTPELMQKTIDKLTELKERFKHVEIKDTSSVFNTDLLYKIELGFGLDVAECMAHSAFNRKESRGAHQRLDEGCTERDDVNFLKHTLAFYNPEGAPRLEYSDVKITKSAPAKRVYGGEATAQDKQNKEKANG

SEQ ID NO: 6295 - protein, 67 aa, Proteus mirabilis
CQNVCTTFAHNSFLCAILGHIYFLFPHSNVNKMLKMRSCWHFYHRIFKSICLFIHLLLLIVQQSNIY

SEQ ID NO: 6296 - protein, 151 aa, Proteus mirabilis
PHDVRPCLANLRAPPLLFRRRPPQSNYPPDTVPDPVYGPRLEHQTLKGGISRLAPCRLASTLQSLPPILHIKAQCSVSSYSKGSRGLSVLPRVHCIFTASSISLSLGWRQPGHHYAIRAGRNLPDKEFRYLRTVIVTAAVYWGFDQELRLR

SEQ ID NO: 6297 - protein, 239 aa, Proteus mirabilis
SYFVLAYCQRKWWETEFTGSHIMMRKIEELLANNKQWSSSVTEENPQFFKELSKGQKPHFLWIGCSDSRVPAEKLINAAPGDLFVHRNVANLVIHTDLNCLSVIQYAVDVLQVEHIIVCGHYGCGGIEAAIEGTELGLINNWLLHIRDIWYKHSSMLGELAPQDRLNLLCELNVIEQVYNLGHSTIMQAAWKRGQKVMIHGWVYGLNNGELHDLDITSDSREKLELSYRQAIAKLSHPR

SEQ ID NO: 6298 - protein, 532 aa, Proteus mirabilis
RRCLSTNPEWTGEGIMKIRSQVGMVLNLDKCIGCHTCSVTCKNVWTSREGVEYAWFNNVETKPGTGYPQNWEDQEKWKGGWIKNIKGKLVPRMGNRVGLLSKIFANPDVPALDDYYEPFDYDYEHLKNAPEGSLPTARPRSLITGQRMTKIEKGPNWEDDLGGEFSKRAADKNFANMQKEMYGQFENTFMMYLPRLCEHCLNPACVATCPSGAIYKRAEDGIVLIDQDKCRGWRMCLTGCPYKKIYFNWKSGKSEKCIFCYPRIESGQPTLCSETCVGRIRYLGVMLYDADKISQAASADNEKDLYQSQLDIFLDPFDPEVIKAAEEQGIPLSVIDAAQRSPVYKMAVDWKLALPLHPEYRTLPMVWYVPPLSPIQSAADAGVLPHTGVLPDVESLRIPVQYLANLLTAGDTAPVLLALKRMLAMRHYKRAETVEGKTDLTALEQVGLTEAQAQEMYRYLAIANYEDRFVIPSSHRELAREAFPERNGCGFSFGDGCHGSESKFNLFNSHRIDAIDITSKTPQDERRSEEKI

SEQ ID NO: 6299 - protein, 157 aa, Proteus mirabilis
PMNVIKGVVAAPNARVAIAIARFNNFINDSLLEGAVDALERIGQVSSENITVVWVPGAYELPLTVKALAESDKYDAVIALGTVIRGGTAHFEYVAGECSSGLSHVAMQSEIPVTFGVLTTESIEQAIERAGTKAGNKGAEAAMTALEMINVLKAIKG

SEQ ID NO: 6300 - protein, 337 aa, Proteus mirabilis
TARFVFCWSFSFMSEIADWQPSASIANLLKKAKIVSNIRRFFADRGVLEVETPMMSQATVTDIHLCPFETQFVGPGASQGLKLYLMTSPEYHMKRLLAANSGPIYQMGRCFRNEEAGRYHNPEFTMLEWYRPCFDMYRLMNEVDDLLQEVLDCEASESLSYQQAFLRYLDIDPLSADKEKLREVAAKLDLSNIADTEENRDTLLQLLFVSGVEPHIGLEKPTFIYHFPASQASLAEISSEDHRVAERFEVYFKGVELANGFRELTDAKEQRLRFERDNRQRVAMGLPEQPIDERFLAALEAGLPECSGVALGVDRLIMLALGVERISDVIAFPVYRA

SEQ ID NO: 6301 - protein, 334 aa, Proteus mirabilis
VKGVWWEDKMAKGKHSRKAMPTPKAKTKALRGGRREQWRYAWRNTMADFLRQPLSSFLTVMVVAISLTLPSICYIVWKNVSTAAEQWYPTPQLTVYLDKSLDDSLAQATIKNIEALDKVEEVNYLSRQDSLVEFRSWSGFSSALDMLEENPLPAVAIVTPVMDPNDEQLMVNLRDAVANIAGVDEVRMDDSWFTRLSTLTSLVGQIAMVIGSLMIVALLLVIGNSVRLNIFSRRDTINVMKLIGATDGFIMRPFLNWGLVLGFIGAIFAIIFSALLVWKLSDVVTQAATVFGTTFSISGLGFDESVILILVSMTIGWFAAWLTTMQHLRQFTPE

SEQ ID NO: 6302 - protein, 72 aa, Proteus mirabilis
SILVFYCFYTFYLKKDKLHFLISLFGKEYNYYLCNTSINCFYKYPREKGGSLIQNNAKARYKVKNRVLATIF

SEQ ID NO: 6303 - protein, 121 aa, Proteus mirabilis
VLGLLGLTLSKKLGQGDVSEILLPTNGKNSSVDLVLLMMQLGKRNINSVWVESGAHFAGALLELGLVDELIIYIAPKILGNDARGLLSISPLSSLSEAPEFTIDSLQQIGPDIRVCLKPRY

SEQ ID NO: 6304 - protein, 2385 aa, Proteus mirabilis
LLKVQFLISKKTINTKISSLFVTMSLKMTTLNNVPSPRPSSITRKVAWLNIFIQLAFPIVTTMPTQTFANENNFKKHNISDINQQNTYQVKAGDTPESIAKKFNIKLFKLIEANPQHVSLTGELKINDGTILNIPNEYLLKKKWLNNQDEAIPSTEGEELAKIIVDNSFLLNKDIDVTQYAISQISSKSNQKIEQWLNQFGHARVSLSADKNLTLKNSSAELLIPLYEQKEKLIFAQTNYHRKDLRSQFNYGIGYRYFTEKFMVGINGFYDHDLTHHHNRLGIGAEIWRDYFKLSSNHYHRLSSWRASNNILDYSERPANGWDIRTEGYFPAYPQLGTKLIFEQYYGKEVGLFGKDKRDKNPHTYTLGINYTPIPLVTLNAERRIGLHDRADNNLNINLSYRIGESLASQLNPDNVKAIRTLAGSRYDFVNRNNDMILEYKKETLVFLSMVDSINGYAKEERDLQVQVKTKYPLANIEWSASKLNAQGGQIKHHGGTHYTVILPQYQIGAIEKNSYIISAVAIDTHGNRSAPVQTTVIVDKSLINTRNSLFSPKQSQLFANGEATQKLILSIVDNDNLPVDIDSKEITLQQQSDTEKGNSRISTFSRLAAGKYQLTVTAGSIPEKLTLTPVFRDNTFNSATVTLIADNQTAHIAKGNLTVTKDNAPADGKSQNKIKVRVTDSNHNPLAHYPVNFTASNGANVISSRKTDEQGEIIASVTNTQVGSSQIGVQVKGITYSTEVHFSVDNDSAYIPQQNFTITPPLSLADGKTEKNISLQVVDKQNNPIPATHVTLSADNQAQLKQTILTTDEQGKATTTMISKVAGTVTVRAKINDKMTHATTQFIANQAKGVIVSITPSSTTHVADGQTPVILTALVQDQFGEPLPHAQISWETEHDKSIVKIEHTTMTNEQGITTNKLTSTQALSVRVTARINNNAFTAEPITFIANGQQALISELLVNKNQIVADKQDPAELTAIVTDKLGNQLPDTIVNWQGSAGTQFAQQQTKTDAQGIAKNTLTTSQSGITTITARLNNGQHAQTNLVAVADLKSATLTLTTLNNKQSAIADNQDSITVVANLTDAYHNPLKNIPVYWQSSINHIDETTTQTDEKGRTQVVISGTKAQPTTITAYLSNKEKKSIQVTFVAGAPVQQNSYLTIEPQSIIADGNAFAVGKIDLRDKFDNPVIGRSNDIALIGDNSTIQFSKITETANGNYQAHIRGTKAGLSQITATIDSITVTQSLGFLTDNKTVKIHSVKVMAPYTVTANGKDKVIIQAQITDKHNNPVSKGVTVGWISDLGKLAAPLSMTNKQGIAEITLSSTQAGKAKVTAVLNNQQSVNADHIVTFTEGDISASLSTVAIFPDTIVAGANKATVTITLKDKEGNLLPNLANKITLTPQTNLQTTITPFKEKQKGIYQAQVSALKTGKTSLSAHVAPLAIKQSVSLTVLPNNTTAKVKNFTISNMQPHAGESITYKAYLVDNHDNPVGMGVPVAWSTNEGSQLETPLTFTDDNGVAIVGLSRRSVGVAKVSAILETGTYIADDVHFLTGHIDETMSELSLNPSQIIANGKDKALLTFVIKDKNGNIIPNQQVSGFSKNPTIKFSQAQQISLGRYEIEITGTQSGTAQIGVMVNGTHFKKQKILQLNADVTTWKIRAVEVDRTTITAGDKGVNYQATVVDANNNVLPNVIVSWKLLGSADDYHYSTYTNDKGIATNRVTSHVAGRLKMSAYLDSNNYKSTQDITVIPAEIDIHKSTFNSHRRSINADNKDSTLLSVKLMDKYDNTIDGKNVEIKTISGKPNFSDNPLKSVGNGEYQTNVTANTMSDIILTAQAETITIAEPLTIKVAIPKSEITFEKPIQQEIYKSTVIDALSYKGVPQNMQVIWSSSDPTVASIDTTSGQISMKKAGTTIITLQTLGNEQYPSAKNSYPLVIEKAPPKLKVTSPHTIQSIWNDGITHQITAEFDNPEVKNTPIHFSSSDTLVATIDSKGNLTAIKPGKTKIVIQSDATDKFLADSQTVDYQQEKAALSYYFKKNYIVLTTDSAADKLLMAQSPTPDVPVEANATWYSSQPNIVEITPDGIIKNLNIGQTTLTLEVKNNNYFQDHEQSYNVIIQASPRITINSFEFLSAGESKSNTHLDDLTWQPLYTSDDQFIVKWSSSDTPKAINFELFDENGTSIALEERQNYAPKHNIHDPVKIQVPKQYLTSPKQLTLEVTTFDSNNQPYVDPKKYKINIDYFPANNAYKIISLDYNSKFIYTNSGKSASACQNGWSTATTHLILTPRLVFKGEPKKLLYPISITTELYDVTLNSSDKLIGHINKKLTYPDKIIFSERSKKIAEISPTSSHYALDEECRINDSGHGTLKANITIGNRSSYLKKEFHWNGQIGVYF

SEQ ID NO: 6305 - protein, 265 aa, Proteus mirabilis
MLLVTQLLIGSAIGLVITTTGVGGGVILLPVLIYLFGMNALAAVATANLLSMLMKISSSYIHFRLGNIPLKPALLILGIMFPATFLASYGVTWLGSQPQYYEQVELGINILMIVAIIFSMFLFLQRIFKKSTSSHPLSSLAPSSSIPLNSLFVPGMSAGFVLGATGVGGGLVVLPVLMRFAQMNIKEAIGSSIFITTILSGGSAIAYSAGGYTDVHTAIILCLGSLISIPLARYLLVYLSERFFQYLTLLFILISIIMMSWKLIN

SEQ ID NO: 6306 - protein, 108 aa, Proteus mirabilis
NIMVKYRRANIDVNALVGKRIQKRRKELGYTGSQLAAKLGVSQQQFSRYERGLNKIDLTYLVLLAKFLNTPIYWFFEDCITSTSVKSGKPLSRRSNLLAKKALDAFLY

SEQ ID NO: 6307 - protein, 75 aa, Proteus mirabilis
SGMVSMLSLINCSCCALAVIISAIIKNETIESMQYAVKMQQKASEQLFFVALSQFMFLAKQVQSPNEKNRSIEFV

SEQ ID NO: 6308 - protein, 62 aa, Proteus mirabilis
KVVVFPAPLGPSKPTISPELTLRLTSPTTVRPLYAFAKFSAFNSAIKCYLPLLLTPGPFSCN

SEQ ID NO: 6309 - protein, 94 aa, Proteus mirabilis
LGQVRKEAAMAGVVCAGMSLARPHPISALQSRYFLSSYFLHRNRIVERLHLNIFLFTYCLINSFFNYIYSQYGFGELIRNRMPFTYYRLRVIDE

SEQ ID NO: 6310 - protein, 66 aa, Proteus mirabilis
RLKVHIASMFTYLCTLPSKPQIHLLKIVLNSSRLSVEHYYAKDRGLIKWQGCHNNATRHNKKGKRD

SEQ ID NO: 6311 - protein, 310 aa, Proteus mirabilis
WVWVYQDANSIQWNDIHHWEIKGSYLMVLMIVSGRSGSGKSVALRALEDMGFYCVDNLPVDLLPELAKTLAERDAAAAAVSIDVRNMPESPEIFEKALESLPAEYSPQLLFLDADRNTLIRRYSDTRRLHPLSTKNLSLEMAIDTESDLLEPLRSRADLIIDTSEMSVHELAEMLRTRLLGKRERELTMVFESFGFKHGIPIDADYVFDVRFLPNPHWDPKLRPMTGLDRPVAAFLDRHTEVHNFIYQTRSYLELWLPMLETNNRSYLTVAIGCTGGKHRSVYVAEQLADYFRSRGKNVQSRHRTLEKRK

SEQ ID NO: 6312 - protein, 81 aa, Proteus mirabilis
KIRVYMNIKVGDEFLVYMALGEESYMKEYYRVLELDSALSQVTGKLLRRTTADDKNIGLGRCELEGGIEQFALEDIYLIEK

SEQ ID NO: 6313 - protein, 91 aa, Proteus mirabilis
TQRVHPYLCIHYALCSFFMFFYSWGANKLELYLLHIGSHENFYCSLYYLSWAKKSPQRLWARNENKKRVFGSDVYIKVYYLKILKRASSSI

SEQ ID NO: 6314 - protein, 138 aa, Proteus mirabilis
GGLFIRDNIRKSWMIIPKSTYLVGQYYERKALNYLRQQGLKLIERNVRYPCGEIDLIMQGNRTWIFVEVRFRRSAQFGDAISSVTYSKRRRLWYAANCWLAQRQQSIETVNCRFDICAFDQRQLIWLKNILDHTEFIR

SEQ ID NO: 6315 - protein, 862 aa, Proteus mirabilis
IQLLPPPPEFYIAGRAVAYKKQKTKKPALRNAGFFLAKNQESCMRVLKFGGTSVANAERVLNVADIAEKKREQGQVALVLSAPAKITNYLVAMIEKTAEGEEPLTQVREAEQIFANLLQGLRENQPGFDYQGLKDKVEREFAEIKHILHGISLLGQCPDSINAAMICRGEKLSIAIMESVLQARGYNVTVIDPVKNLLAQGHYLESTVDIPESTRRISALNIPKDHMILMAGFTAGNEKNELVVLGRNGSDYSAAVLAACLRAQCCEIWTDVDGVYTCDPRLVPDAHLLKGMSYQEAMELSYFGAKVLHPRTIAPIAQFQIPCLIKNTGNPEAPGTLIGDGQKDDSTPVKGITNLNNMAMINVSGPGMKGMVGMAARVFSVMSRAGISVVLITQSSSEYSISFCVPQKELIRAQKALSEEFYLELKDGVLDPLDIMNNVAIISVVGDGMRTLKGISARFFSALTRGNINIVAIAQGSSERSISAVIANDAATNAVRLCHQMLFNTNQIVEVFIVGVGGVGSALIEQIHRQQAWLKNKHIDLRVCGIANSRAMLTNMQGIDLDNWQQALQAAKEPFSFSQLIRLEKEYHFLNPVIVDCTSNEMIAQQYANFLQNGFNVVTPNKKANTMSMDYYHQIRQSAEASRRKFLYDTNVGAGLPVIENLQNLLNAGDELVQFNGILSGSLSYIFGQLDEGKSLSEATLSAKEKGFTEPDPRDDLSGMDVARKLLILAREAGYQLELSDIDVEPVLPSSFDSTGDVESFLNRLPQVDVEFDAKVEEAQKSAKVLRYVGLINEGKCQVKIMAVDANDPLFKVKNGENALAFYTRYYQPIPLVLRGYGAGNDVTAAGVFADVLRTLSWKLGV

SEQ ID NO: 6316 - protein, 172 aa, Proteus mirabilis
MELFMGKRLFPVLIVVAVLFFVLYKGLVPETQIPATAPPTSTTSTSSKSSISQPESQRPLAIDEKTQANKVADYLQQHARLPDFYISKKEARAKGWNAKAGNLCDVLPGRAIGGDRFMNREKQLPEEAGRQWFEADVNYQCGHRGSDRLLYSNDGLIYLTTDHYRTMQRVAP

SEQ ID NO: 6317 - protein, 208 aa, Proteus mirabilis
TLIFIKEISMSNAFTELMKKRRTIYHLGNQLPISEDRVATIIKEAVKESPSAFNSQTSRVVVLFGEQHQKLWNIVKDTLKKLVPADAFSATEAKINSFAAGAGSILYFEDTDIVKGLQEQFPLYAENFPVWSEQASGMAQLSVWTALAAENVGASLQHYNPIIDDEVHATWDIPRHWKLRAQMVFGSIEQEASEKNYIEDDARFKIFK

SEQ ID NO: 6318 - protein, 360 aa, Proteus mirabilis
RNILPQHYYIVKDMSMQDRRNALMTSKSGNQPHTDEAPATLLADTHDQLSQQSIDEQAALWFTRQHSQQMSSQQRQAFKQWVADKDNQQAYQAIAEIWHSCEALPRPTIVPIEKRKSSLWRPFIHTTAALCLVAVLYLPYSHLPALLMDNMTLATSNFPKEMTLADGSKVFLNRNTQVRVSYVQTQRRLWLDKGEAYFKVKPNPYRPFYVHADERLIKVVGTEFEVSRYQNNQISVAVHEGIVEVKATEKSPATYLYAGSQAISQSTDNQFVISSVNADSVGSWRFGQLHFFEQPLGDVITKLKPYLDINVHISSADVAKIKVSGVANINDAKSFITALPLLLPVNVIFTDKNNVLIINK

SEQ ID NO: 6319 - protein, 74 aa, Proteus mirabilis
EQILMNDKNKLAAALLAIFLGGLGIHKFYLRKVGMGILYLIFCWTGIPAIIGFIEGIYYLCISDQTFNDKYNRN

SEQ ID NO: 6320 - protein, 574 aa, Proteus mirabilis
KIVLIKIRIVYILIFYNTQTTIYPHQQEVISDILNEIAYITQAKFVASNPEFDADIKFGFYDDFHISHGSIEFSYTTRGFATYPSRYSTPIKKINIDEQYQYSGTIFLNLSSHQYYKIIHQNDLDNYIKTEGNIGDAFNFKDNGTVLIIKKTNTLIETLKNNKYQPGTYHYKVVLHEVGHALGLSHSWQYLEYKDKNHVLASLKYSVMGYDIPTSEHADFGGLYPMTFMLLDILLLQQLYGENMTTRLENNIYGFHSNTGRVAYSLKSIEDKLVSCIWDSGGIDTLDFSLYTVNQVINLNEGSFSDIGGLRSNISIAYKTIIENAIGGSGHDTIIGNSANNELIGGDGNDTIKGGLGNDHLYGGMGNDILYGDIGNDYLYGGIGDDILHGGMGNDILHGSMGNDYLYGNKGNDKLFGGDGDDTLVDYYGNNTFIGGKGNDLLFSISKAGRNELQGGEGNDIFYCGLGTNLLYGEQGNDTFNFLCYKGAKSYNLIFDFNTNEDKIIFVDQNYKKIDISKMKRVEQLSGNENEIVLHNDIHTNKTTITISTANNDHHSTIFIKLEGILSYNDLLDI

SEQ ID NO: 6321 - protein, 182 aa, Proteus mirabilis
IFPFFFPLTKRFDHLHNINKSNLFSYFHFLLCRTAKRFAEEAKMKKGVLLNSSISSVIARLGHTDKITIADAGLPIPSSVERIDLALTQGIPDFMSVLQTITHEMQVEAVMLAIEIKNINPLLFSEITRYLHLLEQQQKKPIEIIYVTHEEFKTQLPDNKAVIRTGECSPYANIVLFSGVTF

SEQ ID NO: 6322 - protein, 219 aa, Proteus mirabilis
GRQLILLIPIFLYWKRCLCVIFLLFLWEETFLPQRHCAWNISEEITGMFNKQRIFFFITLLSSFSLMADETANKATITNSENNLRLFGTLFIPPPCVIQNNDMIDVNFGHQLGTSRIDGINYTKTVNYTLQCEENAKGWALGLSIIGSASQFDAAALQTNITDLAVHLTIDSEPFILNKRFVITSDKPPIILAVPVKKSGSTLTKGAFEATATLLAEYQ

SEQ ID NO: 6323 - protein, 161 aa, Proteus mirabilis
MKKFTQIIDQQKALELTSTEKPKLTLCLTMDERTKSRLKVALSDGQEAGLFLPRGTVLKEGDILLSEEGDVVTIEAAKEQVSTVYSDDPLLLARVCYHLGNRHVPLQIEAGWCRYFHDHVLDDMARGLGATVVVGLEKYQPEPGAYGGSSGGHHHHHDHHH

SEQ ID NO: 6324 - protein, 458 aa, Proteus mirabilis
LHFSYIGNIREDVMLGKNLASINKTYDFWRKNLMLSMIIGYATFYLTRKSVNFVMPVMQTELHLDKGDIGWIASLFYLTYGLSKFLSGIFHDQYGYRWFMGAGLVMTGVMNIIFAYCLSFPALLLVWALNGFFQGWGWPPCARLLTHWYSRNERGFWWGLWNISINLGGMSIPLLTAWLATHFSWQIALVIPGLIGIVMGLWLCMQLKGTPAEEGLPTVGVWRRDIFELRQEQVSPPTPMLTILKESILFNRMIWLLGFSYILIYLIRMAINDWGNIWLSETHGANLLSANAILSLFEMGGLLGALCSGWGSDLLFRGQRAPMILLFSLGLFIAVTALWLMPIHHYALLAACFFSIGFFVFGPQMLIGLAATEYCHKNAAGTVTGYLGLYAYLGAAIAGWPLSQVMAHYGWTGMFVLLTSAAALMGLLLMPLLIADVSKREHLVGPLSFSDDDTFKRF

SEQ ID NO: 6325 - protein, 307 aa, Proteus mirabilis
KRFSMKIELAKSLELNRNITAEEADNLFSKKIITSKYLFECTEPDCHAQVTCANLDKPNRLRKRVPHFKFVSEHSDTCKIGINEENEFRRIKKMKEDPEALPFILDDIVELDLSTPYKTKFHDIPSSKEEDGINKRLKTKNIDGENSNKTRHSKKRLSGLVNDFIDKKNFFLNIAEGKIHLRDFFIYINDKKDLSEYVDEPRIYFGKAWVKRIDNYYLVRFDKKMKKGDLICKPTFFISERLVNKSEYKRTSRQELDKIALSTPPKPLYLFIFSELPPVKMNNGDFINFKLDDLTYLYYKTWGKKSE

SEQ ID NO: 6326 - protein, 431 aa, Proteus mirabilis
VMKLYNLKDNQEQVSFAQAVKQGLGKQQGLFFPKDLPSFSQAEIDALLKLDFATRSSRILSAFIGDEIPADVLAKRVNTAFAFPAPVTQVEEDISCLELFHGPTLAFKDFGGRFMAQMLSEVAGDQPVTILTATSGDTGAAVAHAFYKLDNVQVVILYPQGKISPLQEKLFCTLGENIHTVAIQDDFDACQALVKQAFDDEYLKNTMHLNSANSINISRLLAQICYYFEAVAQIPAEKRQQLVISVPSGNFGDLTAGLLAKSMGLPVKRFIAATNVNDTVPRYLDSGKWEPHRTIATLSNAMDVSQPNNWPRIEELYRRKGWLLSDLSHGAVSDETTEETVRELAQKGYISEPHAAVAYRLLRDELQEGEYGVFLGTAHPAKFKENVERILGDTLPLPKELAERADKKLLSHLLPADFSQLRAFLLERAPK

SEQ ID NO: 6327 - protein, 384 aa, Proteus mirabilis
HILSKAKLCYSHDTYDAILLFKHKYRIFMLSKLLRSTLIGVLTAAILLVAVPSIRPIFIEHLINGDFLNAPFSYNKAVRRAAPAVVNVYSSTMGSFSQEGRELTSLGAGVIMDPRGYILTNQHVINNADQIIVALQNGDLYEGLLIGSDPLTDLAVLKVDAEKLPTIPINSKRISHVGDVVLAIGNPFNIGQTITQGIISATGRVGLSPTRYQNFLQTDASINEGNSGGALINTEGELVGINTMTFDSGTYNGYRPSAEGLGFAIPTQLAVKIMNKLIRDGRVIRGFIGITAKELPKIRSSNTDIKQIQGLRIFRITPNSPADKAGMKIGDIILSIDHAPAKSAMEMMDYIAETRPGTVLPVTLLRDGNEINVDVTISEYQPES

SEQ ID NO: 6328 - protein, 66 aa, Proteus mirabilis
QNISMKLIHDFYLYILSIANYGLARVHDQLHAKQLYNDMYLADIYYFLVFQLEYWFFLLSEQYHYL

SEQ ID NO: 6329 - protein, 173 aa, Proteus mirabilis
DSVSLRLPYAVNLATEYKSLTHYTKGTQSPHPQMSRLPLRSILPDFLTSVARVLLGTLRDGLKKSTNLVSKFGAIFGDVLASLSARHLSDGAPTACTYTVSGSFSLPSPGFFSPFPHGTGSLSVNQEYLALEDGPPIFRQDNTCPALLVEFTITASSDTGLSPFTAGLSRPFS

SEQ ID NO: 6330 - protein, 574 aa, Proteus mirabilis
HGPSVAGLQRSVGNGAMSNSIVEIEDTKCLFVFGYNAADSHPIVARRIVKAKEKGAKIIVCDPRYIETARLADLHLALKNGSNIALLNAIANVIIEEKLYDKSFIENHTEQFDEYCQLVASYTPESVEKTTGLSAQIIREAARMYAKAETATILWGMGVTQFYQGVETVRSLTSLALLTGNLGKKYVGVGPVRGQNNVQGACDMGALPNTLPGYQYVTDAKAREKFAKAWGIESMPEEVGYALSEVPHNIDHGLIKAHYVMGEDPLQTEPDLATIRRTFEKLDLLIVQDIFMTKTASIADVVFPATSWGEHEGVYTSADRGFQRFYKAVEPVGDVKTDWQIISLMATAMGYPMHYNNTKEIWDELRELCPIYYGATYEKMADLAYIQWPCPTEDSPGTQYLYEGGKFDTPNGKGQFYTCEWAPPIDQLSDEFPMVLATVREVGHYSCRSMTGNCKALAALADEPGYVQLNTEDAKQLGIKDQELVWIRSRQGKVITRAAVSDRPNKGAVYMTYQWWIGACNELVAENLSPITKTPEYKYCAVCVESIKDQAQAEHYVKTEYNNIKRRLREAAEG

SEQ ID NO: 6331 - protein, 118 aa, Proteus mirabilis
QITSFFDCYVIRTEMIRDDIENKLISRFSPHFLQVINESHRHNVPAGSESHFKVVIVSDLFNDKRSVSRHRDVYQTLSHELDNGVHALALHTFTLSEWDEQQDKALHSPGCRGGSQQD

SEQ ID NO: 6332 - protein, 264 aa, Proteus mirabilis
SFASHDYLKITINNKSMMTINNSNNLTGNEPANDETYMRRAIELAALGRFTTSPNPNVGCVIVKEGKIIGEGYHHHAGGPHAEVNALNMAGENAKGATVYVTLEPCSHFGKTPPCADALINAGVKRVVAAMQDPNPQVAGRGLHKLVAAGIDVSHGVLMQEAEKLNIGFFKRMRTGFPYIQLKLAASLDGKTALASGESQWITSKASRQDVQNFRAQASAILTTSATVLADDPAMNVRWEALSDEIKAIYPLESLRPAYSHYYR

SEQ ID NO: 6333 - protein, 204 aa, Proteus mirabilis
MSHSIRNNPILNELIILDVFILYISGNKKMKLNKLALVLGLGLSVVAGSALAADQGHGTVKFVGSIIDAPCSITPDTENQTVPLGQISTAALKDGGRSNSRDFKISLENCTTETYKTVQTTFTGSEATEVLEGSLGIEGIAKNAAVVITDAGGKQIKLGTPSAAQNLRDGNNDLNFAAYLQGSASEAAVPGDFTAIATFALTYQ

SEQ ID NO: 6334 - protein, 73 aa, Proteus mirabilis
YKNSESKIMAFKYKITIIIFLLSFIFFVVYEFFIPVKVMEVHKDTYTTSILVEDFPITDYGKIIWWKKQSRCF

SEQ ID NO: 6335 - protein, 168 aa, Proteus mirabilis
YKNSESKIMAFKYKITIIIFLLSFIFFVVYEFFIPVKVMGVHKDTYTTSILVEDFPITDYGKIIWWKNNQDVLDKKYNLFKAKDSSFYIYIWNYGDGYLEEGKYDRLCFTEIKSNKKCIEKDKVMSIMYSLNEEEIRIGNSAYIKDKNGSFIKKDKDANTTITVVPNA

SEQ ID NO: 6336 - protein, 349 aa, Proteus mirabilis
MRSTFMNEPISLQSFNTFGLKANARHIETAKNTDELCRYWQNAQDQKLPILILGGGSNVLFIEDFNGTVIRNCISGIEITEDEQQWHIHVGAGENWHNLIKSLIEKHIYGLENLALIPGNVGSAPIQNIGAYGKELKDVCAYVDIVELSTGKVTRLTNEECQFGYRDSIFKHHYQQGYAIIAVGLVLNKHWEPILTYGDLAKLSPETVTPQIVFESVCGMRTSKLPDPALTGNAGSFFKNPIVDIKLAQRLKSKYPFCPQYVQHNGVKLAAGWLIDQCGLKGYQSGGAAVHTKQALVLINKEGKASGHDIVNLASYIRQKVFERFGVQLEPEVRFIGRHGEINAVDAIS

SEQ ID NO: 6337 - protein, 390 aa, Proteus mirabilis
KNYFYAFILRLFLFFMTIFCTFFTNLFSSRQKKQKKSKKSLRLCHITRYDAVYFLSDTGVLNSLSNLRILGRCWLMNNKERFTTPYLEFDRKQWATLRNSVPLTLTETEIADLKGINEEISIDDVIEIYLPLSRLLNFYISSNLRRQAVLEQFLGTNNAKIPYIIGIAGSVAVGKSTTARLLQALLTRWPEHRKVDLITTDGFLLPNAELKKRGIMKKKGFPESYDMHSLVSFVSDIKSGKKQVTAPVYSHLVYDIIPDKKQVIEQPDILILEGLNVLQSNQDYPHDPHNVFVSDYVDFSIYVDADEALLKHWYISRFLKFREGAFTDPESYFNNYSKLSREESIEIASSIWQEINGLNLKQNILPTRERASLIMTKGDNHSVKSVRLRK

SEQ ID NO: 6338 - protein, 71 aa, Proteus mirabilis
KDTYIILGMMIIKNKEKQMQKSQPIGLAFSSYLMLSSSLLSHGETPHYHRRYGVSLLSSAWDQVGPPRYGR

SEQ ID NO: 6339 - protein, 73 aa, Proteus mirabilis
FFRKKTTKMTAKKSKKIQRNILSAILDLSLNSKIHLKELFLRFYSTLIFIFYDYFLYFFYKFIQFASKKAEKK

SEQ ID NO: 6340 - protein, 326 aa, Proteus mirabilis
CGGCYFMKETSTPLLLINILADGEIHSGEQLGESLGMTRAGINKHIKTLRSWGIDIHTVAGQGYQLDAPMNLLNSERVNRGIQGAPARVIPVIDSTNQYMIQRISELTSGDVCIAEYQSAGRGRRGRQWISPFGRNLYLSMYWKLDQGPAAAIGLSLVVGVILAEVLQQFGANGVKVKWPNDLYLNDKKLSGILVELTGKTGDVAHIVTGIGINIAMSNNQKDAINQQWINLEQVGIKIDRNQLACEITNALRKAFVQFEKQGLSAFIERWKSLDNFIDRRVKLIIGDKEIFGIAKGINEQGALLLEQNNKIVPYIGGEISLRSAP

SEQ ID NO: 6341 - protein, 90 aa, Proteus mirabilis
KHLSKELMVVGEGFEPSKSVTADLQSAPFGRLGIPPNLNFKWCRHQESNSGPTDYKSVALPTELCRLSGAHSRRTFAMMQQKNCDICSFA

SEQ ID NO: 6342 - protein, 156 aa, Proteus mirabilis; identical to SEQ ID NO: 5578

SEQ ID NO: 6343 - protein, 173 aa, Proteus mirabilis
DSVSLRLPYTVNLATEYKSLTHYTKGTQSPHPQMSRLPLRSILPDFLTSVARVLLGTLRDGLKKSTNLVSKFGAIFGDVLASLSARHLSDGAPTACTYTVSGSFSLPSPGFFSPFPHGTGSLSVNQEYLALEDGPPIFRQDNTCPALLVEFTITASSDTGLSPFTAGLSRPFS
